United States Patent 12,569,549 (FLAVIVIRUS VACCINE) - sequence listing, part 67

SEQ ID NO: 23163 - RNA, 9873 nt, synthetic construct
  misc_feature 1..9873: note = derived and/or modified CDS sequence (opt6) from DENV-3__GQ199886__SS-prME
  source 1..9873: mol_type = other RNA
acctctctttgtctaatgatgatcctaccagcagcgctagcatttcacttgacatctcgagacggcgaaccgagaatgatagtaggtaaaaacgaaagggggaaatcactcctttttaaaacggctagtggaatcaatatgtgcaccttgatagctatggatctaggtgaaatgtgcgatgacaccgtaacatataaatgcccacatataacagaagtcgaaccagaagatatagattgctggtgtaatttaacaagcacgtgggtcacatatggcacgtgtaaccaagcaggggaacataggagagataaacggagcgtagcactagcacctcacgttggaatgggtttggacacacgcacccaaacgtggatgagtgcagaaggggcatggcggcaagtagaaaaagtagaaacatgggcattgagacatcctggatttactattttggctttatttttagcgcactatattggaacatcactaacgcaaaaagtagtcatttttatacttttaatgctcgtgacgccaagtatgactatgagatgtgtgggagtagggaacagagactttgtagaaggcctatcaggtgcaacctgggtggacgttgtgttagaacatggaggctgcgttacaacaatggctaaaaataaaccaacactcgacatagaactacagaaaaccgaagctacgcaattagcaacgctcagaaaattatgcatagaaggaaaaattacgaacattacaaccgattcgcgatgtcctacgcagggagaagccgtgctcccagaagaacaagaccaaaattatgtctgtaaacatacatacgtcgatagaggttggggaaatgggtgcggattatttggtaaagggtccctagttacctgtgcaaaatttcaatgtttagaacctattgaaggtaaagtggtacaatacgaaaatctaaaatacacggttataattacggttcataccggtgatcaacatcaagtaggaaatgaaactcaaggagtaacggcagaaatcacaccacaagcaagcactacggaagcaatactaccggaatatggcacacttggactcgaatgcagcccccgtacaggtctggattttaatgaaatgatattacttacaatgaaaaacaaagcatggatggttcataggcaatggtttttcgacttacctttgccttggacctctggagccaccacagagacccccacatggaatcgaaaagaattgttggttacattcaaaaacgcacatgccaagaaacaggaagtagttgtcctgggtagccaagaaggagcaatgcatacggcactgaccggagcaacagaaattcaaaacagtggtgggacttcaatatttgctggacacttaaaatgcagattaaaaatggataaattagaacttaaaggaatgtcttatgctatgtgtacaaatacatttgtcttaaagaaagaagtgtcagaaacacaacacggaacaatattaataaaagtcgaatataaaggtgaagatgtaccctgcaaaataccgttttctacggaagacggtcaaggaaaagctcacaatggacgattaattacggcaaatccggttgtgaccaagaaagaagaacccgtgaatatagaggccgagccacctttcggcgagagtaacattgtcattggcataggcgataatgctttgaaaattaactggtacaagaaaggatcttccattggcaaaatgtttgaggctacagcccgtggcgctcgaagaatggctatattgggtgacaccgcatgggattttggatcagtaggaggcgtactcaactccttgggaaaaatggtacatcaaatattcggttcagcgtacaccgcattattttccggagtaagttgggtaatgaaaataggcataggagtcttacttacctggatgggtctaaacagcaaaaacacatcgatgagcttttcgtgtatagccattggaataataaccttatatctcggcgcagtagtccaagcagatatgggttgtgttataaactggaaaggaaaagaacttaaatgtggctcgggaatttttgtaacaaatgaagtacacacatggacagaacaatacaaatttcaagcagactcaccaaaacgtttagctacggccattgctggtgcttgggaaaatggagtatgcggtatacgtagtacaacaagaatggaaaatctcttatggaaacaaatagcaaacgaattaaactacatactgtgggaaaataacattaaattaacagtagttgtcggcgatacaatcggcgtgttagaacagggaaaaagaacattgactccccaaccaatggaactaaagtactcgtggaaaacatgggggaaggcgaagatagtcacagctgaaacacaaaactccagcttcataatagacggacccaacacaccagaatgtcctagcgcaagcagggcatggaatgtgtgggaggtagaagactatggttttggcgtatttactactaacatctggctgaaattgagggaggtatacacgcaactgtgtgatcatagattaatgtcggccgcagtcaaggacgaaagagcagtgcatgcagacatggggtattggattgaaagtcagaaaaatgggagttggaagttagaaaaggcttctctaattgaggttaaaacgtgtacttggccaaaaagtcacacgctctggagcaatggagtattggagtcggacatgattattccaaagagccttgcgggaccaataagtcaacataactacagacccggttatcatacccaaaccgcgggaccctggcatttgggcaaactggaattagatttcaattactgtgaaggaaccacagtcgtaatcaccgaaaactgtggtacacgtgggccctctttacgaactactaccgtatcaggaaagctgatccacgaatggtgttgccgaagctgtacgcttcctcctttaagatatatgggcgaagacggatgttggtatggtatggaaataaggcctatatctgaaaaagaagaaaacatggtaaagagcttagtttcagctggatcagggaaagtcgataatttcacaatgggcgtattatgtttagcgatattgttcgaagaagtaatgaggggaaaattcggtaagaaacacatgatagcaggagtattctttacctttgtattactattgtctggtcaaataacatggagagatatggctcacacattgattatgatcggatccaacgcttcagatcgaatggggatgggagttacttatttggcgttaatcgcaactttcaaaatacaacctttccttgcgctaggtttcttcttacgcaagttaacatcaagagaaaatctcttattaggggtcggcctggcaatggcaaccactctacaattacccgaggacattgaacaaatggctaacggaattgccttaggtttaatggcactcaaactaataacacaatttgaaacttaccaactctggactgctctaatatcgcttacatgtagcaacacaatattcacgctaaccgtagcttggagaaccgcgacattaatattggcgggcgtatctttattaccagtttgccaaagttcttcaatgaggaaaacggattggctgccaatgacagtagccgcaatgggagttccgccattaccactgttcatattttcacttaaagatacacttaagagaaggtcatggccattgaatgagggagttatggctgtaggacttgtgtcaattcttgcaagttctttgcttaggaatgatgtacccatggctggacctcttgttgccggtggtttgttaatagcatgttatgttatcacaggaactagcgccgatttaacagtagaaaaagcggcggatgtaacgtgggaagaagaagcggaacagacgggtgtatcccataacttaatgattactgtagatgatgatggtactatgcgtatcaaagatgacgaaacggaaaatatacttacagtacttttgaaaactgctttattaattgtatctgggatattcccttacagtattccagcgactctcctagtatggcatacttggcaaaaacagactcaacgaagtggtgttctatgggacgtaccttccccacccgaaactcagaaagctgaactagaggaaggcgtttataggattaaacaacagggaatcttcggaaaaacccaggtgggtgtgggagtccagaaggagggggtatttcacactatgtggcacgttacaagaggggcggttctgacctacaatggaaagcggctagagcccaactgggcatcggttaaaaaggatttaatttcatatggtggcggctggcgtctctcagcgcaatggcaaaaaggggaagaggtccaagtaatcgccgtcgaacctggtaaaaacccgaaaaatttccagacaatgcccggaactttccaaactaccacaggtgaaattggggcgatcgctttggattttaaaccaggtacgtcaggttcgcctataattaaccgcgaggggaaagtagttggactgtacggaaacggtgttgtgacaaagaacggaggctacgttagcggcatagcccaaacgaatgcagagccagacgggcccactcctgagcttgaagaagaaatgtttaaaaagcggaacctcacaataatggacctacatccaggatcaggaaaaaccaggaaatatctcccagccatagttcgtgaagctataaaaaggagactacgtacgctaatcctcgcccccacaagggtagttgctgcagaaatggaagaagcactcaagggactgccaatacgctatcaaactacagcaactaaaagtgaacatacaggaagggaaatagttgatctcatgtgtcacgctaccttcacaatgagacttttgtcaccagtcagagttcctaattacaatttaatcataatggatgaagcacactttacagaccccgcaagtattgctgcacgaggatacatttcaacaagagttggaatgggagaagcagctgccattttcatgacagcaacaccacccggaacagctgatgccttcccacaatcgaatgcacccatacaagacgaagaaaaagatatccccgaaaggagttggaactcaggcaacgaatggattacagatttcgcaggaaaaaccgtttggtttgtgcccagtattaaagcagggaacgatatcgctaactgcttaagaaagaatggaaagaaagttatacaactttcaagaaaaactttcgacacagaatatcagaaaaccaaattaaatgattgggactttgtagttacaaccgacattagcgaaatgggagctaacttcaaagcggacagagttattgatccacgaaggtgtttgaaaccagtaattttaactgacggtccggagcgcgttatactagccggacctatgccagttacagcggcttctgctgcacaacgtagagggcgtgtaggacggaacccacaaaaagaaaatgatcagtatattttcactggacaaccattaaacaatgatgaggaccatgctcattggacggaggcaaaaatgttgttggacaacattaatacacctgaaggcataattcctgccttattcgagcccgaacgtgaaaaatcagccgccatcgatggagagtaccggcttaaaggggagagcagaaaaaccttcgtagaacttatgcgcagaggcgatttacctgtttggctggcgcataaagtagcttcggagggaataaaatataccgatcgtaaatggtgtttcgacggacaacgaaataaccaaatactcgaagaaaacatggatgtagaaatctggacaaaagaaggtgagaagaagaaactaagacccagatggctagatgcgagaacatattctgaccctctggcactaaaagagttcaaagattttgcggctggtcgtaaaagtattgctctcgatcttgtaacagaaattggtagagtaccaagccatcttgcacatagaactcgaaacgccttagataatttagtgatgttgcacacatctgagcacggtggtagagcatatagacacgctgttgaagaacttcccgaaaccatggaaaccctacttttgctcgggttgatgatattactaacgggaggagccatgcttttcttaataagtggaaaagggataggaaaaactagcataggattgatctgtgtcatcgcaagtagcggaatgttatggatggcagaaatcccacttcaatggatagcgtccgcaattgtgttagagttcttcatgatggtattattaatccccgagccagaaaaacagagaacaccgcaggataaccaactagcatatgtagtaataggaatactaaccttggctgccataattgcagcaaatgagatgggactgttagaaactacaaaacgcgatctaggaatgtctaaagaacctggagttgtctcaccaactagctatttagacgtagatttacatccagccagtgcatggactttatacgctgtagcaactacagtaataacccccatgttacgtcatacgatagagaatagtaccgcgaatgtctcactcgcagcgattgctaatcaagcggtcgtattgatgggactcgataaaggttggccaattagtaaaatggatttgggagtgcctttgttagcacttggctgctacagtcaagtaaatcctttaactctaacagctgctgtactattattgataacacattacgcgattattggccccggtttgcaagccaaggcaacaagagaagcgcagaaacgaacagcagcaggaatcatgaagaatcctacggttgacggaattatgacaatagacctagatccagtgatatacgatagtaaattcgaaaaacaactaggtcaagtaatgctgcttgtcctttgtgcggttcaactattattaatgcgtacctcctgggcactttgtgaggcattaacattggcaacagggcctattacaactctatgggaaggctcacccggaaaattttggaatactactatagcggtatcaatggcgaacatatttagggggtcttatttggccggtgcaggattggcatttagtataatgaaaagtgtcggaactggcaaacgtggaaccggtagccagggggaaacattaggtgagaaatggaagaagaaactaaaccaactatctagaaaagagtttgatttatataagaaatcaggcataacggaagtagacagaactgaagctaaagaaggcttaaagagaggagaaattacgcatcacgccgtatccagaggtagcgcaaaattacaatggttcgtagaacgcaatatggtgatcccagagggccgtgttatagatttaggttgtggtaggggaggttggtcttattactgtgccggacttaagaaagttactgaagtaagaggctacacgaaaggcggcccgggtcacgaagaacctgtcccgatgtcgacgtatggatggaatattgtaaaactaatgtcaggtaaggatgtattttatttacctccagaaaaatgtgatacgctattatgtgatatcggagaaagttctccgagcccaactgtagaggagagcaggaccattagagttttaaaaatggtagaaccatggttaaagaataatcaattttgcatcaaagtcttaaacccatacatgccgacagtaattgaacatctggaaagactacagagaaagcatggaggaatgctcgtaagaaacccactatcaagaaatagtactcacgaaatgtactggatttcgaacggaactggaaatatagtcgcctcagtaaacatggtttctagattattactgaatcggttcacgatgacacaccgaaggcctacaatagaaaaagacgtagacctaggagcaggaacgcgtcatgtcaatgcagagcccgaaacacctaatatggatgtcattggagaaaggataaagcgtataaaagaagaacataattccacttggcattacgatgatgaaaatccatacaaaacgtgggcatatcatggaagttacgaggttaaagcaaccggttcggccagctcgatgattaacggcgtagtgaaactattgactaaaccgtgggatgtagtgccaatggtaactcaaatggctatgacggacactacgccattcggtcaacagagagtattcaaagaaaaagtcgatactagaaccccaagatcaatgccaggtacaagacgggtgatgggcataactgctgaatggctgtggagaaccttgggcagaaacaagaaaccaagactgtgtacacgagaggagttcaccaagaaagtacgcacaaatgctgcgatgggtgcggtctttacggaggagaatcaatgggactcggcaaaagcagctgttgaagacgaggatttctggaagttagtagatcgtgaacgtgaattacacaagttgggcaaatgtgggagttgcgtgtataatatgatggggaagcgggagaagaaacttggggagtttggtaaagccaagggtagtagggcaatatggtatatgtggcttggggcacggtacctagagttcgaggccctcggatttctgaacgaagaccattggtttagtcgtgagaatagttactcaggtgtcgaaggagagggattgcataaattaggatatatacttcgagacatatccaaaataccgggaggtgcgatgtacgccgatgatacagctggatgggatacacgaattaccgaagatgacttgcacaatgaagaaaagatcactcaacaaatggatcccgaacatcgtcaacttgcaaatgctatattcaaactgacgtaccaaaacaaagtagtaaaggtacaaagacctactccaacaggtacagtaatggatataatttcgagaaaagatcaaaggggctcgggtcaagtaggcacgtacggcctaaatacgtttacaaatatggaagcacaactcatccgtcaaatggagggagaaggagtgttatcaaaagcagacctggagaatccccacttaccggagaagaaaattacccaatggctagaaacaaaaggagtcgaaagacttaagagaatggcaatttccggtgatgactgtgtagtcaagcccatagacgataggttcgcaaatgcgctattagctctcaatgatatgggaaaagtccgaaaagatattccacaatggcagccgtctaaaggttggcatgattggcaacaagtacccttctgcagccaccattttcatgaacttataatgaaagatgggcgaaagctagttgtcccctgtagaccgcaggacgaactgattggacgggcaaggattagccaaggtgcaggttggagccttagggaaacggcttgtctcggtaaagcgtatgcacagatgtggtcactcatgtattttcatcgtagagatctacggctcgcatcaaacgcaatttgcagcgcagtaccagtacattgggtgcctacatctcgaactacttggagcattcatgcacaccatcaatggatgaccactgaagatatgctgacagtgtggaatcgcgtatggattgaggacaatccttggatggaggacaaaactcctgtaacaacatgggagaacgtaccttatctaggtaaacgagaagatcaatggtgtggatccttaattggattaacttcaagggcgacgtgggcccaaaatatacccaccgcgattcagcaagtacgcagtctaataggaaatgaagaatttcttgactatatgccaagcatgaaacgtttccgaaaagaggaagagagtgaaggcgcgatatggtga

SEQ ID NO: 23164 - RNA, 9873 nt, synthetic construct
  misc_feature 1..9873: note = derived and/or modified CDS sequence (opt6) from DENV-3__FJ882576__SS-prME
  source 1..9873: mol_type = other RNA
acctcactatgtttaatgatgatcctgccagcagcattagcgtttcatttaacttctcgcgacggagaaccacggatgatcgttggtaaaaacgaacgaggaaaatcattgttatttaaaactgcatctggtataaatatgtgtacgctgatcgcaatggacttgggagaaatgtgtgacgacacagtaacatacaaatgtccacacatcacagaagtagaaccggaggatattgattgctggtgtaacttaacaagtacctgggtaacttatggaacctgtaaccaagcaggagaacataggcgcgataaaaggtctgttgcattagcgccccatgtaggtatgggactggataccaggacacaaacttggatgtctgcagaaggagcctggcgacaagtagaaaaagtagaaacgtgggcccttcggcatcccggttttacgatccttgctttatttttagctcactatattggcacatccttaactcagaaagtggtaatcttcatattattgatgttagttacaccaagtatggcaatgcggtgcgttggtgtaggaaaccgtgattttgtggagggtctgtcgggtgcgacatgggttgacgtagtacttgaacacggaggctgcgtaacgacaatggccaaaaataaacctacactagatatagagctacagaaaactgaagctacgcaattggcaacccttcgtaaactgtgtatagagggaaaaatcacaaacataactacagactccagatgcccaactcaaggcgaggctgtactacccgaagaacaagatcaaaattacgtgtgtaaacacacctatgttgatcgcgggtggggtaatggatgtggacttttcggtaaaggatcactcgttacatgtgctaaatttcaatgcctagaaccaatcgaaggaaaagtcgtacaatacgaaaacctcaaatataccgtaataataacagtgcataccggcgaccaacatcaagtaggaaatgagacacaaggtgttactgcggaaattacaccacaagcatccacaacagaagcaattttaccagaatacggaactctcggccttgaatgttcacccagaaccggtttagatttcaatgaaatgatcttactaaccatgaaaaataaggcttggatggttcatcggcagtggttctttgatctaccactaccctggacaagtggagcaacaacagaaacaccaacctggaatagaaaagaactcttagtgactttcaaaaatgcacatgccaagaaacaagaagtagtagtactaggatctcaggagggagccatgcatacagctctgacaggtgcaacagagatccaaaatagcggaggtacctctattttcgcgggacacttaaaatgtagactgaaaatggataaactggagctaaaaggtatgagttatgctatgtgtaccaatacattcgttctaaagaaagaggtctctgaaacccaacatggtaccatccttataaaagtagaatataaaggtgaggatgttccctgtaaaataccatttagcacagaggacggtcaggggaaagctcacaacggtcgattaataacagctaatccggttgtgactaagaaagaagaacctgttaatatagaagcagaaccaccgttcggagaaagtaatatagttataggaattggtgataacgcattaaaaatcaattggtacaagaaaggatctagcatagggaaaatgtttgaagcgacagcaaggggagcaagacgcatggcgatactgggcgacacagcttgggatttcggatctgtaggaggagtactaaattcactaggaaaaatggtccatcagatttttggatctgcgtacacggcactatttagcggcgtcagttgggttatgaaaattgggattggagtgctccttacatggatagggctaaatagcaaaaacacaagtatgtcattttcctgtatagctatcggaataataactctttaccttggagcggtcgtccaggcagacatgggctgtgtaattaactggaaaggtaaagaacttaaatgcggaagtgggatcttcgtaacgaatgaagtgcacacttggacggaacaatataaattccaagcagactccccgaaaagactggcaaccgccatagctggagcatgggaaaatggcgtatgtggaatcaggtccacgacgagaatggaaaatttattatggaaacaaatcgctaatgagctcaactacatactatgggaaaataatattaaactaacagtggtcgttggggacatcataggggtactcgaacagggaaaaagaacattaacaccccaaccaatggagctaaaatattcatggaaaacttgggggaaagccaaaattgtaaccgcagaaactcaaaatagttctttcatcatagatggccccaatacgccagagtgtccctcagcttcacgagcatggaacgtttgggaagtagaagactatggctttggagtttttacgacaaatatatggttaaaacttcgagaagtctacacacaactgtgtgatcatcgtctaatgtccgccgccgtcaaagacgaacgcgcagtgcacgcagatatgggatattggattgaaagccagaaaaatggctcttggaaactcgaaaaagccagtctaatagaggttaagacttgtacgtggcccaagtcgcatacattgtggtctaacggcgtgctagaaagcgatatgataatcccaaaaagtctcgcaggacctattagtcaacacaattacagacctggatatcatacccagacggcagggccctggcacctaggcaaattagaattagatttcaactattgtgaaggaaccactgtcgttataactgagaactgtgggactcgtggaccatctctacgaacaactacagtatcaggcaaacttattcatgaatggtgctgcaggtcttgtacactacctccgctacgttacatgggcgaagatgggtgttggtacggaatggagataaggccgatctctgaaaaagaagaaaatatggttaaatccttggtcagcgccggtagtgggaaggtcgataacttcactatgggcgtattgtgcttagcaatattatttgaagaggtgatgagaggaaaatttggtaaaaagcatatgatcgcaggagtattctttacctttgtcttactcctatcaggtcaaattacttggcgcgatatggcccacacactaattatgataggttctaatgcctcagatcgaatgggtatgggtgtgacatacttagccttaattgcaacatttaaaatacaaccgtttctcgcactaggcttctttttgcggaaattaacaagtagagaaaatctacttttaggcgtaggtttagctatggcaacaactctacaactacctgaagacatagagcaaatggccaacggtattgcgttaggattaatggctctgaagttaataacgcaatttgaaacgtaccaactgtggacagcgcttataagtcttacttgctcaaatacaatatttactttaacagtagcatggcggacagccacgttgatactggccggagtttccctactgcccgtatgtcaaagtagctctatgaggaaaactgactggttgccaatgactgttgctgcaatgggggtacccccactacctttatttatatttagtctcaaagataccttgaaacgaaggagctggcctttaaacgaaggtgtgatggcagttggactggtatcaatcttagcttcatcactattaagaaatgatgtaccaatggctgggcccctagtcgctggtggtttacttattgcctgctacgttataacgggaactagcgcagatctcactgttgaaaaagcagcagacgtcacatgggaggaagaggccgaacaaactggtgtatctcacaacctaatgatcactgtcgacgacgacggtacaatgagaataaaagatgacgagacagaaaacatactgaccgtattattaaaaaccgcgcttctaattgtcagcggaatttttccatatagcatcccggcgactttgttagtatggcatacctggcagaaacagacccagagatcgggcgtcttatgggatgtcccctcacctcctgagacgcaaaaagctgagttggaagaaggcgtgtatcggataaagcaacaaggtatttttggcaaaacccaagtaggcgttggggtacaaaaagaaggagtcttccatacgatgtggcatgttacaagaggggcagtactagcgtataacggtaaacgcttagaaccaaactgggcatctgtcaagaaagatctaataagctatggcggaggatggagattaagcgcacaatggcagaaaggtgaagaggtgcaggttatcgctgtagaaccaggtaagaaccctaagaattttcaaacaatgcctggcacgttccaaacaactacaggggaaattggtgcaattgccttagattttaaacccggtacatctgggtcgccaataattaatcgcgaaggaaaagtggttggtttgtatgggaacggagtagtaacaaagaatggtggatacgtatctggtatagcgcagacaaatgctgagcctgatggaccaactccagaacttgaggaagaaatgttcaaaaagaggaatttaactattatggacctccaccctggtagtggaaaaacaagaaaatatttgcctgccatagtgcgagaagccataaagcgtaggcttagaacactcattctagcaccaacacgagtggttgcagcagaaatggaagaagccttaaagggtcttccgattcgttaccaaacgactgcgacaaaatcagaacatacgggccgtgagattgtagaccttatgtgccacgccacattcacaatgcgtcttctcagtcccgtacgagtaccaaattacaatcttattataatggatgaagcacacttcactgatccagcgagtatagcagcaagaggttatattagcactagagtaggaatgggtgaagcagcagcaatattcatgactgcgactccacctggcaccgccgacgcattccctcagtccaacgccccaatacaagacgaagaaagggacatccctgaacgtagttggaatagtggtaacgaatggattactgacttcgctggtaaaacagtttggttcgtacccagtataaaagccggcaatgacatagctaattgccttaggaaaaacgggaagaaagtaatccaattgagtcgtaagacctttgacactgaataccagaaaacgaaactgaacgactgggacttcgtagtaacaacggacatctctgaaatgggggctaattttaaggctgacagggtgatagacccaagacgatgcttgaaacccgtgatcctaacggacgggcctgaaagagtaatccttgcaggtcctatgccggtgactgctgctagtgctgcccaaagacgaggaagagtaggaagaaatccccaaaaagaaaatgaccaatatatttttactgggcaaccccttaacaatgacgaagatcatgcacactggactgaggccaaaatgttactagataacatcaatactccagaaggaattataccagcattatttgagcctgaaagagagaaatcagctgccatagacggtgaataccggttaaaaggtgaatcccgaaaaacatttgtagaactaatgagaaggggagacttacctgtatggttagcacataaagtggcctccgaaggtattaaatacactgatcgaaaatggtgttttgatggcgaaagaaataatcaaatattggaagaaaatatggacgttgaaatttggacaaaagaaggtgagaagaagaaactaaggccacgatggttagacgcgagaacatactcggatcccctagctttgaaagaatttaaagacttcgcagcaggaagaaaatctatagctttggatttagtcactgaaatcggaagagttccatcccacctagctcaccggactagaaacgctctagacaatctagttatgctccacacatctgaacacggtggtagggcatacagacatgccgtagaagaattacccgaaactatggaaacgcttctgttgctaggacttatgattctcctaaccggtggtgctatgctgtttctaattagtggaaaaggtattggaaaaacatcaattggattaatatgtgtaattgcaagttcggggatgttgtggatggcggaaattccattacaatggatagcatcagccatagttttggagttctttatgatggttcttctgataccagagcctgagaaacaacggacccctcaggacaatcaactagcgtatgttgttattggtatattaacattagcagcgataattgcagcaaacgaaatgggactattagagactacaaaacgtgacttagggatgtcaaaagagcctggagtagtgagcccaaccagctacttagatgtagacctccaccccgcgagtgcatggactctctatgcagtggctacgacggtcattacacctatgctgagacatacgatcgaaaattctacggcgaacgtttcactagctgcaatcgctaatcaagctgtggtgctaatgggcctagacaagggctggcccatatcaaaaatggatttaggggtacccctccttgcattaggatgctatagccaagtaaacccacttactctgaccgcagcagtactactcttgattacacattacgcgataataggaccaggattacaagccaaggccactagagaagctcagaaaagaacagccgctggtataatgaaaaatccaactgtggacggcataatgacaatagacctcgatccagtcatatacgactccaaatttgaaaagcaactaggacaagtaatgctattagtactgtgcgctgtgcaattgctactaatgagaacttcttgggcactatgcgaagccctaaccctggccacaggccctattaccacactttgggaaggaagtccgggaaagttctggaatacaacaatagccgttagtatggcaaatatattcagaggatcctacttagccggagcagggctagccttttctattatgaaatcagtcggtaccggtaaacgaggtacagggtcgcaaggtgaaactttgggggaaaaatggaagaagaaattgaatcaattgtcacgtaaggaatttgacttatacaagaaatcaggaataacggaagtcgacagaacggaagctaaagagggcttaaagagaggagagattacacatcacgcagtttctagaggctctgcgaagctacagtggtttgtcgaacgcaacatggtaatcccagagggacgagtcatcgatttgggttgcggacgaggaggatggtcatattactgcgcaggcctaaagaaagtaacagaagtcaggggctataccaagggtggaccaggacatgaagaaccagttccaatgagtacgtatggctggaatatagtaaagttgatgagtggaaaggacgtattttatctaccaccagagaaatgtgatactctcctttgcgatataggtgaaagttcaccaagtcctactgtagaagagagtagaacaataagagtactaaaaatggttgaaccatggcttaaaaataaccagttttgcataaaagtgttgaatccatacatgcctacagtcatagaacacttagaacgacttcaaaggaaacacggaggaatgttggtcagaaatccgttatcgcgaaactcaacccacgaaatgtattggataagtaatggtacgggcaacatcgtaagcagtgttaacatggtctcacggctactactgaatcgattcacaatgactcatagacgaccgacgatagagaaggatgtagatcttggagcagggacacgtcatgtaaatgcagaacctgaaacgccgaatatggatgtgatcggagaaagaataaaacggataaaagaggaacataactcgacatggcattatgatgatgagaacccatataaaacttgggcatatcacggatcttacgaagtaaaagcgactggttcagcttcgagtatgataaatggggtagtaaagttattaacaaaaccatgggacgttgtacccatggttactcaaatggcgatgactgatacgacacctttcggtcagcaacgtgtatttaaagaaaaagtggatacacgaactccaagaagtatgcccgggacacgtagggtaatgggtatcactgccgaatggctatggaggaccctggggagaaacaagaaaccaagattatgtactagagaggaatttactaagaaagtaaggacaaacgctgcgatgggagccgtttttaccgaagaaaatcaatgggactcagcaaaagctgcagtagaagatgaagatttttggaaattagtagacagggaacgggaactccacaaactgggtaaatgtggatcttgtgtttataatatgatgggaaaacgcgaaaagaaacttggtgagtttggtaaagctaaaggaagcagagctatctggtatatgtggttaggggcaagatatttagaatttgaggcgttaggtttcctaaatgaagatcattggttttcacgagaaaattcatattctggagtcgaaggagagggtttacacaagctgggttatatccttagggacatctctaaaataccaggaggtgccatgtatgcagatgacacagcaggctgggacacccgtattacagaagatgatttgcacaatgaggagaaaataacacaacagatggatccagaacacagacaattggcaaatgctatatttaaactaacctatcaaaataaagtagtcaaggtacaaaggccaactcctacggggacagtaatggatataatatcgcggaaggaccaacgtggctcgggacaagtcggaacgtatggattaaacacctttacgaacatggaagcccagctcattcgtcagatggagggggaaggtgtactctcgaaagccgacctagagaatccgcacttaccagagaagaaaattactcagtggcttgaaacaaaaggtgttgaaagattaaaacgtatggctatatcaggggacgattgtgtagtaaagcctatagacgatcgatttgccaatgctctattggcactaaatgatatgggcaaagtacgaaaagacatcccacaatggcaaccatctaagggatggcacgactggcagcaagtgccattttgttctcaccatttccacgaactaataatgaaggacgggagaaagttagtagtgccgtgcaggcctcaagacgagttgatagggcgagctaggatctctcaaggtgccgggtggtctttgagagagacggcctgccttggtaaagcgtatgcacagatgtggtcactaatgtacttccatcgaagagacttaaggttagcatcgaatgcaatttgctccgctgtcccggtccattgggttccaacgtcacgcacaacatggtcaatccatgcacatcatcaatggatgacgactgaagacatgctaacggtgtggaaccgagtatggatagaggataacccatggatggaagataaaacgccagtcactacgtgggaaaatgtaccatacctcgggaaacgagaagaccaatggtgcggcagccttattggtcttacatcacgagcaacctgggcacaaaacataccgactgctattcaacaggtccgctcattaattggaaacgaagagttccttgattatatgccaagtatgaaacggtttaggaaagaagaagaaagtgaaggagcgatatggtaa

SEQ ID NO: 23165 - RNA, 9873 nt, synthetic construct
  misc_feature 1..9873: note = derived and/or modified CDS sequence (opt6) from DENV-3__FJ850052__SS-prME
  source 1..9873: mol_type = other RNA
acctccctatgcctgatgatgatactaccggctgcacttgcatttcatctcacaagtagagatggtgaaccaagaatgattgttggcaaaaatgaacgaggaaaatcgttactttttaaaactgcttccggaataaatatgtgcacattaatagcgatggatttaggtgaaatgtgtgatgatacagtaacctataaatgtccacatattacagaagtggaaccagaagacattgactgctggtgtaatttaacaagcacatgggttacatatggaacatgtaaccaagctggtgaacatcggcgtgacaaacgttcagttgccttagctccacacgtcgggatggggctagacacacgaacacaaacatggatgtccgctgagggggcttggaggcaagttgagaaagtagaaacttgggcgctaaggcacccaggttttactattcttgcgctatttctggcacattatataggtacatcgcttactcaaaaagtagtaatctttatccttctaatgttagtcactccaagtatgaccatgaggtgcgttggtgtaggcaacagagattttgtcgagggattatcaggagcaacttgggtagacgtggtattagagcatggcggttgcgtcacaacgatggcgaaaaataaacctactctggatatagaactgcagaaaactgaggcaacgcaattagccactctaagaaaattgtgtatagaaggcaaaatcacaaacattaccacagattcacgctgccctacccaaggcgaagcaaccttaccggaagaacaagaccagaactacgtttgcaaacatacatatgtagacaggggttgggggaatggatgtgggttattcggtaaaggatctctggtgacctgtgccaaattccagtgcttggaaccgatagaaggaaaagtggtacaatatgagaacttaaaatatactgttataataaccgtacatacaggtgaccagcaccaagttgggaatgaaacacaaggtgtaaccgcagaaatcacacctcaagcctcaactactgaagccatactccctgaatatgggactttaggtttagaatgctccccgcggaccggattagattttaacgaaatgattctgttgaccatgaaaaataaagcgtggatggtccacagacagtggttctttgatctaccattaccctggacgtcgggtgcaacgacggagacaccaacttggaaccgaaaagaattattagtcacatttaaaaacgcacatgccaagaaacaagaagtagtagttctcggttctcaggaaggcgcgatgcatacagccttgacgggggcgacagaaatacaaaattcagggggcacgtcaatttttgctggccatttaaaatgccgtttaaaaatggacaaattagaacttaaaggtatgtcttatgctatgtgtacaaacacctttgtactcaagaaagaagtttcggaaacgcaacacggtaccattttgataaaagtagagtataaaggtgaggatgtcccttgtaaaataccgttcagtacggaggatggccagggaaaagcgcataatggacgtctaataacagccaacccagtcgtcacgaagaaagaagaacctgttaatattgaagccgaaccccctttcggcgagtcgaatattgtgattggtattggagacaacgcacttaaaataaattggtataagaaaggatcctctattggcaaaatgtttgaagcgactgcaagaggagcccgcagaatggccatactaggtgatacagcttgggatttcggtagtgtgggaggtgtattgaacagcctaggtaaaatggttcatcaaatattcggaagcgcatatacagcacttttcagtggcgtaagttgggtcatgaaaatcggtataggggtactactcacatggatcggacttaactctaaaaacacaagcatgagctttagttgtatcgcaataggaataattacactatatttaggcgcagtggtccaagcggatatgggatgcgtaataaactggaaaggaaaagaactaaaatgcggaagtggaatctttgttacaaacgaggtacatacctggacagaacaatacaaatttcaggcagacagtccaaaaagactagcaacggctatcgctggggcatgggaaaatggggtatgcggcatcagaagtacaacacgtatggagaatcttctttggaaacagatagcaaatgaattaaattatatattatgggaaaataatataaaacttacagtagtcgtgggggatataataggcgtacttgaacaaggcaaaagaacactcactccccaaccaatggagctcaaatattcctggaagacttgggggaaggccaaaattgtaacagcagaaacccaaaattcctcatttataatcgacggtccaaacactcctgagtgtccgtcagtcagcagagcttggaatgtatgggaagtagaagactatggctttggtgtattcacaaccaacatttggctaaaactacgagaggtatatacacaactatgtgaccataggcttatgtcagcggcagtgaaagacgagcgagcagtccacgccgatatggggtattggatagaatcgcagaaaaatggatcatggaaattagaaaaagcatctttaattgaagtcaaaacatgtacctggccaaaaagtcacactctctggtctaatggcgtactagaatctgatatgattatccccaagagcttagcaggaccaatttcacaacataatcataggccaggataccatacccaaacagcaggtccctggcatttagggaaactcgaattggattttaattactgtgaggggacaacggtggtaatcactgaaaactgtgggacacgtggcccaagcctgcgaacaactactgtatcgggcaaactaatacacgaatggtgctgtagatcgtgcacactaccaccgcttagatatatgggggaggacggttgctggtacggaatggaaattagaccaatcagtgagaaagaggaaaatatggtaaagagcttagtttctgcaggcagcggcaaagttgataactttacaatgggagtcttgtgtctcgccattttgttcgaagaggtaatgagaggcaaattcggcaagaaacacatgattgctggtgtattctttacattcgtcttattattaagtggacaaattacttggagggatatggctcatactttaataatgataggatccaatgcgtcggatagaatggggatgggtgtcacttatctagcgcttattgcaacatttaaaattcaaccatttttagcactgggattctttttaagaaaattaacttctcgtgagaatttattgctcggtgtcggtttggcaatggccacaacattgcagttacctgaagatatagagcaaatggcaaacggaatagcattgggattgatggcccttaaattgataacccagtttgaaacctaccaactatggaccgcgctgatttcacttacttgttccaataccatatttacattaaccgtagcttggcgaaccgcaactcttatcctagccggagtatcattgctacccgtatgtcaatcatcatccatgcgaaaaacggactggcttccaatggcagtagccgcaatgggagtcccaccgttgccgttattcatattcggcctcaaggacactctgaaaaggagatcatggcctttaaacgaaggtgtaatggcggtcggtcttgtttcaatactagcaagcagtcttttacggaacgatgtaccgatggctggaccgctggttgcgggtggactacttattgcttgttatgtaataactggaacatcagccgatttaactgtggagaaagcagccgatataacgtgggaggaagaagcggaacaaacgggcgtaagccataatctaatgataactgtggatgacgatgggacaatgcggataaaggacgatgagacagagaacatactaaccgtattgttaaaaactgctttactaattgtttcgggaatattcccctatagcataccggcaactctactggtgtggcatacgtggcaaaaacaaacacaaaggagcggtgtattatgggatgtcccatcaccgccggagacgcaaaaggcggaattagaggaaggtgtttataggataaagcagcaaggcatcttcggtaagacacaagttggtgtcggtgttcaaaaagagggagtgttccatacgatgtggcacgtgacacgaggcgccgtactaacatataatggaaaaaggctggagcctaactgggcgagtgtgaaaaaggatttaataagttatggtggtggttggagattaagcgctcaatggcaaaaaggtgaggaagtacaagttatcgcggtagaaccgggtaagaaccccaaaaatttccaaacaatgccaggcacttttcaaacaacaactggcgaaattggtgcgatcgcactagatttcaaacctgggacctcagggtcgccgataataaacagagaagggaaagtagtgggattatatgggaatggagtcgtaaccaaaaacgggggatatgtttcaggaattgcacaaacgaatgctgaacccgatggacccacccccgaacttgaagaagagatgtttaagaaaagaaacttgacaataatggatctacaccccgggtctggtaaaaccaggaaatatttacctgcaatagtaagagaggccatcaaacggagactacgaacgctcattctagcacctacaagagttgtggcagcagagatggaagaagcgttaaagggcctaccaattcgctatcagactactgcgaccaaatcagaacacacgggtcgagaaattgtcgacttgatgtgtcatgcgacatttaccatgcgattactatcgccggtaagagtaccgaattacaatcttataattatggatgaagctcacttcaccgatccggcctcaattgcggcaagggggtacatatctacacgagtaggaatgggtgaagctgcagctatatttatgactgcaacccctccaggtacagcagatgcttttccacaatccaatgcgcctatccaagacaaagaacgagacatacctgaacggtcgtggaactccggaaacgaatggataacagacttcgcgggaaaaacggtttggttcgtgccaagtattaaagctggaaacgatatcgctaattgtctaaggaaaaacgggaagaaagtcatacagttatcacgaaagacctttgacactgagtatcagaaaaccaagttaaatgactgggattttgtagtcacgacggacatatcagaaatgggggccaactttaaagcagacagagtgatcgacccgcgaaggtgtttgaaaccagtgatcttaactgacggaccagaacgagtgatattggcaggaccaatgccggttaccgcagcatccgccgctcaaaggagaggccgagtgggccgcaacccgcaaaaagaaaatgaccaatacatcttcacggggcagcccttaaataatgacgaagaccacgcacactggaccgaggcaaaaatgttgctagataacattaacactccagaagggatcataccagctttgtttgaaccagagcgtgagaaaagcgcagctatagatggagaatatagattaaaaggtgaatcaagaaaaacattcgtagaattaatgcgtcggggagatttgccggtgtggttagcccacaaggttgcttcagaaggtattaaatacacagatcgtaagtggtgcttcgacggtcagcgcaataaccaaattttagaagaaaatatggatgtcgaaatttggacaaaagaaggcgagaagaagaaattaagaccaagatggctagatgctaggacatacagtgatcctctagctctgaaagaatttaaggaatttgctgcgggtaggaaatccatagcgcttgaccttgtcaccgaaataggtagagtaccctctcatttagcgcacagaacgcgaaacgcattagacaatctggtaatgttgcatacctctgaacatggaggtagggcgtatcgtcacgcagtagaagaattgccggagacgatggagacactactcttgttgggccttatgatattattaacgggtggggctatgctatttttgatcagtggtaagggcattggcaaaacaagcatcggactcatatgcgttattgcgtcaagcggaatgctatggatggcagaaattcctctccaatggatagcatcggcaatcgttttggaatttttcatgatggtactcttgataccagaacctgaaaaacagagaacaccacaagataatcaactcgcatacgttgtaatcggtatcttgaccctagcagcaattatcgctgcgaatgagatgggattattagaaacgacgaagcgtgatcttgggatgagcaaagaaccgggtgtggtttcaccaacgtcatatttagacgttgacctacatcccgcaagtgcatggacattatatgcagttgcaaccacagttataacgccaatgttgaggcatacaatagaaaatagcactgcaaacgtgagcttagccgcgatagctaatcaagccgtagtactaatgggcctggataaaggttggcccatctcaaaaatggatttaggagtgcccctgttagcgttaggatgttatagtcaagtcaacccgctaactctaacggccgcagtactcctattaattacacattacgctatcataggaccggggttacaggcaaaagcgacaagggaggctcagaaaagaacagcagcaggaattatgaagaatcccacagtagatgggataatgacaatagatcttgatcctgtaatttatgactccaaattcgagaaacaactcggtcaagtcatgttattggtattatgtgcagtacaacttttgttaatgaggacatcttgggcgttatgcgaggcattgacgctagcaacaggaccaattaccacattatgggaaggtagccctggtaaattctggaacacgactatagcagtgagtatggcaaatatattccgcgggagctatcttgccggtgcgggtttggctttcagtatcatgaagagtgtaggcactgggaagcgtggtactgggtcacaaggtgaaactctaggagaaaaatggaaaaagaaacttaatcaactcagtcgaaaagactttgacctttacaagaaaagtggtataactgaggtagatcggacagaggctaaagaaggattgaaacgaggcgaaattacccatcatgcagtctcaagaggctcagccaaacttcaatggttcgtagaaagaaatatggttatccccgaagggagagttatagacctaggttgcggccgaggaggttggtcttactattgtgcaggactcaagaaggtgaccgaagttagaggttatacaaaaggtgggccagggcacgaagaacccgtacctatgtcaacgtatggctggaacatagtgaaattaatgagtggaaaagatgtcttctacttacccccagaaaaatgcgatactctactttgcgatatcggagaaagctctcctagcccaacagtagaagaatcgagaacaataagagttctcaagatggtggaaccgtggctcaaaaacaaccaattttgcataaaagttctgaatccatatatgcccaccgtcatagagcacttggaaagactacagagaaagcatggcggaatgttagtccgaaatcctttaagtcgaaattcaacacacgaaatgtactggatttcaaatggaactggaaacatcgtggcctccgtgaacatggtatcaaggttactgctcaatcgtttcacaatgacgcaccgccgtccaacaatagaaaaggatgtagatctgggagctggaacgcgtcatgttaatgccgaaccagaaactccaaatatggatgtaataggagagagaataaagcgaatcaaagaagaacataatagtacatggcactacgacgacgagaacccatataaaacatgggcctaccatggatcatatgaagtaaaagcaacagggtcagcaagttcaatgattaacggtgtagtaaaactactaactaaaccatgggatgtagttcctatggtaacgcagatggctatgaccgataccacaccatttggacaacaacgagtatttaaggagaaagtagacaccaggacgccgagatctatgccaggcacgagaagagttatgggaatcactgccgaatggctatggaggactctgggacggaataagaaaccaagattatgtacacgtgaagaatttactaagaaagtcagaacaaatgctgccatgggagctgtattcactgaggaaaatcaatgggatagcgcaaaggcagctgttgaagatgaggatttctggaaacttgtagacagagaacgagagttacacaaactcgggaaatgtggaagctgcgtctataatatgatgggaaaaagggaaaagaaacttggtgagtttggaaaggccaaaggttcacgagctatatggtatatgtggctgggagcgagatacctcgaatttgaagctctcggattcctaaacgaagatcactggtttagtagagaaaatagctactccggcgtagagggtgaaggtttgcataaactgggatacattttaagagatatatctaaaatacccgggggcgctatgtatgcggatgatacagccggatgggatacaaggattacagaggacgatctccataacgaggagaaaattactcagcaaatggatcctgagcatcgacaacttgctaatgcaatatttaaacttacttatcaaaacaaggtagtcaaggtgcaaagaccaacaccgactgggacagtcatggacataatttctagaaaggatcaacgaggttcggggcaggttggtacatatggactgaatacatttacaaatatggaagctcaactaattcgacaaatggaaggcgaaggtgtgcttagtaaagcagatctcgaaaatcctcacttgccagagaagaaaatcactcaatggctcgaaacaaaaggagtagagagactaaagcgaatggcgatatccggagacgactgtgtagttaaacccattgatgacagatttgctaatgcattattagcgttaaacgacatgggtaaagtaaggaaagatatccctcaatggcaaccaagtaagggttggcacgactggcaacaagtaccattttgcagtcatcattttcatgaattaattatgaaagatggaaggaagctcgtcgtaccatgtagaccccaagatgaactaattgggagagcaagaatttcccaaggagctggctggtcactaaaagagacagcatgtttgggaaaagcatatgcgcaaatgtggtctctgatgtactttcatcgacgagacctaagacttgcgtctaacgcaatctgttccgccgtacctgtccattgggttccaacatcccgcacaacttggtcaatccatgcacatcaccaatggatgacaacagaagacatgttaacggtatggaaccgagtctggattgaagacaatccctggatggaagacaaaacgccagtaacaacatgggaaaatgttccgtacttggggaaacgcgaagatcaatggtgcggaagtttaattgggctgactagccgtgcgacgtgggcacagaatattcctacggcaatacaacaagtacgcagtctaataggtaatgaagaatttctagattatatgccttcaatgaagcgctttcgcaaagaagaagaaagtgaaggggcaatttggtaa

SEQ ID NO: 23166 - RNA, 9873 nt, synthetic construct
  misc_feature 1..9873: note = derived and/or modified CDS sequence (opt6) from DENV-3__FJ873812__SS-prME
  source 1..9873: mol_type = other RNA
acatctttatgtcttatgatgatattaccagcagcgcttgcgttccatttaacttcaagggatggagaacctcggatgattgtcgggaaaaacgaacgcggaaaatcacttttattcaaaacagcgagtggaataaatatgtgtactttaatagcaatggatttaggagaaatgtgcgacgacacagttacttataaatgcccccatataactgaagtagaacccgaagacattgattgttggtgtaatttaacatcaacatgggtaacttatgggacgtgcaaccaagcaggggaacatagaagagataaaagaagtgttgcactagcacctcatgtaggaatggggcttgatacccgaacgcaaacgtggatgtcagcagaaggagcatggcgacaagtggagaaagtagaaacttgggcacttagacacccgggattcactatactagcattatttttggcgcactacataggtacttctttgacacaaaaagttgtaatatttattttactaatgctagtaaccccatcaatgactatgagatgcgtgggagtaggtaatcgcgactttgtagaagggttatctggagctacatgggtggatgtggtattagaacacggaggatgtgtaacaaccatggccaaaaacaaaccaacattagacattgaattgcagaaaacagaagcaacgcaattagcaaccttaagaaaattatgcattgaaggtaaaataacaaacataacgacagattctcgttgtccaactcagggtgaggcgactctaccagaggagcaggaccaaaactacgtttgcaaacacacttatgtcgatagaggctggggaaatggctgcggactgtttggtaagggttcattagttacttgtgctaaattccaatgccttgaacccattgagggtaaagtcgtacaatacgagaacctgaaatatactgtcataattaccgtacacactggcgatcaacatcaagtcgggaatgaaacacagggagttacagcagaaataactccacaagcctccacaacggaagcaatacttcccgaatacgggactttaggcctggaatgtagccccaggactggtcttgattttaatgagatgatattattgacaatgaagaataaagcatggatggtccaccgacaatggtttttcgacctaccactaccttggacaagtggagccacaactgaaacgccaacatggaacagaaaagagctattagtaacctttaaaaatgcacatgctaagaaacaagaagttgttgtattaggatctcaagagggtgccatgcacacagcattaactggtgctactgaaatacaaaacagtggcggaacatcaatcttcgcaggacacttaaaatgtcgactcaaaatggataaattagaattgaaaggaatgtcctacgctatgtgtacaaacacatttgtactaaagaaagaagtatcagaaacgcaacacggaacaatattgataaaagtagaatataaaggagaagatgttccgtgcaaaattccttttagtacagaagacggccaaggaaaggctcacaatggacgacttattacagcaaatccagtagtaaccaagaaagaagaacctgtaaatatagaggctgaaccgccgtttggggagagtaatatcgtgattggaattggtgataacgcattaaaaatcaattggtataagaaaggtagctccatcggaaaaatgtttgaagcaactgcaagaggggcgaggagaatggctatactgggagatactgcctgggattttggaagcgtaggcggagtactaaactctctcgggaaaatggtacaccaaatatttggttcagcatatacagcattgttcagtggagtaagttgggtaatgaagattggcatcggagtactcttaacctggattggattaaatagcaaaaatacctctatgagtttttcttgtattgcgataggaataatcactttgtatctaggagcggtcgttcaagccgacatgggatgtgttataaattggaaaggtaaggaattaaaatgtggaagtggaatatttgtaacaaatgaagttcatacatggacggaacaatataaatttcaagctgattcacctaagcggcttgcaactgcaatagctggtgcatgggaaaacggagtttgcggcatacgttcaactacccgaatggaaaatcttttatggaaacaaatatcaaatgagttgaattacatattatgggagaacaacatcaaacttacagtagtcgtgggagatataataggggtgcttgagcagggaaaaaggactcttacacctcaacctatggaacttaaatactcctggaaaacatggggtaaagcaaaaattgtgactgcagaaacccaaaattcatccttcataattgatggtcctaatactccagaatgccctagcgtgagtcgtgcgtggaacgtttgggaagttgaagactacggattcggagtatttacaacgaacatctggttgaaattaagagaagtatatacccaattgtgtgatcatcgtctaatgagcgcggccgtcaaggatgaaagggctgtacatgcggacatgggttactggattgaatcacagaaaaacggatcatggaaacttgaaaaagcgagccttatagaggtaaagacttgtacgtggccaaaatcacacacgctgtggtccaacggggttctagaaagtgacatgataatacctaaaagtctcgcaggcccaataagccaacataaccatagacctggttatcatacacaaacagcaggaccctggcacctaggaaaacttgagttggactttaattattgcgaaggaactacagtagttataaccgagaactgtggcacacgcggcccttcactacgtacaacaactgtgtccggaaagctcattcatgaatggtgttgtagatcgtgtaccttgccaccactcagatacatgggagaggatgggtgctggtacggaatggaaattcgcccgatcagcgaaaaagaagaaaacatggtaaaaagtttagtgtccgcaggatcaggcaaggtagataatttcacaatgggggtactatgcctagcaatactatttgaggaagtgatgagaggcaagtttggcaagaaacatatgattgcaggggtgttcttaacattcgtcttactcctaagtggtcaaataacatggagagatatggcccacactttaattatgatcggatcaaatgctagtgacagaatgggaatgggggttacctatttagctcttattgcaacctttaaaattcaaccttttctagcgctaggattctttttaagaaaattaacaagcagagaaaatttactacttggcgtgggattagccatggctactactctgcagttaccagaagacatcgaacaaatggcaaacggcatcgctctagggttaatggcgctaaaattgataacacaatttgaaacctatcagctctggacagctcttataagtcttacctgttccaacaccattttcacactcacagtagcgtggcgaacggccacattaatactggctggtgttagcttgttgccagtatgccaaagctcatccatgagaaaaacggactggcttccaatggcggtagctgccatgggagtaccaccattaccattattcatattctcgctgaaagacactcttaaacgtagatcttggccgcttaatgaaggggtcatggcagttggattagttagtattttggctagctcattactccggaatgatgttccgatggctggccccttggttgctggtggtttactaattgcgtgctatgtaatcactggaacatccgccgacttaactgtcgagaaagcagcagacataacgtgggaagaggaagcagaacagaccggggtaagtcacaaccttatgataacagttgatgacgacggtacaatgagaatcaaagatgacgaaactgagaacatcctaaccgttctacttaaaactgccttgttaatagtctcagggatcttcccgtactcaattccagcaacattgttagtttggcatacctggcaaaaacaaacgcaacgaagtggtgtactgtgggacgtaccctctccacctgaaacacaaaaagcagaattagaagaaggagtatacaggataaaacaacaaggtatcttcggtaagacccaagttggggtaggggtacaaaaagaaggcgtcttccacacaatgtggcatgtaacacgaggagctgtgttgacgtacaacggaaaacgtctagagccaaattgggcgtctgttaagaaagatttaatttcttatggtggtggctggcgcttgtcagcccagtggcaaaaaggtgaagaggtacaagtaatcgctgtcgaacccggcaaaaaccctaaaaatttccaaaccatgcctggaacattccaaaccacaactggagaaataggagctatagcattagattttaaaccgggcacttcaggatcacccatcataaatcgggaaggaaaggttgttggactatatggaaacggagtagtaactaaaaatgggggttacgtatcaggaattgcccagaccaatgcagaaccagacgggccgactcctgaattagaagaggaaatgttcaagaaaaggaacctaacgattatggacttacacccaggttctggaaagacccgaaaatatctgccagcgatagtcagagaggctataaaaagaagattacggacacttatcttagcgccgacgagagttgttgcggcggaaatggaagaagcattaaaagggttgccaatccgttatcagacgacggcaactaaatctgagcataccggaagagagatagtagacctaatgtgtcatgcaacattcactatgcgattactttcgccggtacgggtccctaattataatttgatcattatggatgaggctcatttcacggacccagcaagcattgccgcaaggggctatatatcgacaagagtaggaatgggagaagcggcggcgatttttatgactgcaactcctcccgggactgcagatgcatttccccaaagcaacgcaccaattcaagatgaagaaagggatatcccagaacgttcatggaatagtggaaatgaatggataacggatttcgccgggaagaccgtctggtttgttcccagtataaaagccggaaatgatatcgccaactgcctacgcaaaaacggtaagaaagtgattcaattaagtcgcaaaacatttgataccgaataccagaaaacgaaattaaatgattgggattttgtagtcaccacagatatatcagaaatgggtgcaaatttcaaagctgatcgtgtaatagatccgaggcgatgtttgaagccagtgattttaacggatggaccagaaagggtgatcttagcaggaccgatgcctgtgaccgcagcatcagctgcccaaagaaggggcagagtaggacgcaacccacagaaagagaatgatcaatacatatttacaggtcagccactaaacaatgatgaagaccatgcgcattggacagaggcaaaaatgttgttagataatatcaatacaccagaagggataattcctgcattatttgaacccgaaagagaaaaatcggcagcgatagacggtgagtacagactcaaaggagagtcaagaaaaacatttgtagaactgatgagaagaggcgatctgccagtgtggctcgcccataaagttgcgtcagaaggaataaaatacacagatcgtaaatggtgttttgacggccaaaggaataaccaaatactggaggagaacatggatgtggaaatatggacaaaggagggtgagaagaagaaacttagaccacgctggttagatgcacgaacctatagcgatccactggcactaaaagagttcaaagagttcgcagcaggaaggaaatcaattgctctggatctcgtgactgaaattggtcgcgtgccgtcacacctagcacatcggacgaggaacgcattagataacctagtcatgttacacacttctgaacatggaggtagggcataccgacacgcggtagaggaattaccagagacaatggaaactttactacttctgggtttaatgatattattaacaggaggagcgatgctgtttctaatcagcggcaaaggaataggcaagacttccattgggttgatatgtgtgattgcatctagtggtatgctatggatggcagaaattcctctccaatggatagcaagtgcaatcgttctagagtttttcatgatggtgttattaatacctgaaccggaaaaacagcgaaccccgcaagataaccaactagcttacgtagttattgggatacttacattggccgctatcattgcagcaaacgaaatgggattactggagaccacaaagcgtgatctaggcatgtctaaagaacccggtgtagttagtccaacaagctaccttgatgtcgacctccatccggcgtccgcatggactctgtatgcagtagcaactacggttataacaccgatgctgcgacatacaatcgaaaattctactgctaatgtctcccttgcggcgatcgcaaaccaagcagtcgttttaatggggcttgataaagggtggcctatatctaaaatggatctaggggtaccattgctagctttaggatgttattcccaggtcaacccattgacactcaccgctgcagtattgttactcataacgcactatgctataatagggccaggtctacaagcaaaagctacaagagaggcacaaaagcggacagctgcaggtattatgaagaacccgaccgtagatggtataatgacaattgatttagatcctgtaatatacgattcaaaatttgaaaaacagttagggcaagtgatgttgctagtcttatgtgctgtgcaattattattaatgagaaccagttgggcattatgcgaggcattaacattagctacaggaccaataacaacgttatgggagggatcaccaggtaaattttggaatacaactattgccgtaagtatggcaaatatatttcgcgggtcatatctagccggtgcaggcctggccttctcaatcatgaaatcagtcggtacaggtaaaagaggaactggatctcaaggagagacactaggagaaaaatggaagaagaaactgaatcaactatcaagaaaagactttgacttatataaaaagtcgggaataacggaagtagacagaactgaagctaaagaaggactaaaacgaggcgaaataacgcaccatgctgtgtccaggggatccgcgaaactacaatggtttgtcgaacgcaatatggttattcccgaaggaagagttatcgacttaggatgtggacgcggagggtggtcctactattgtgcaggattgaagaaggtcactgaggttagaggatacacaaaaggaggccctgggcacgaagaaccagtaccaatgagtacctacgggtggaacatagtaaaacttatgagtggtaaagacgtattttatttgccaccagagaaatgtgatacattactctgtgatataggagaatcatcaccatcgcccaccgtggaagaaagtaggacaatacgggttctaaaaatggtagaaccatggttgaaaaataatcaattctgcattaaggtcctaaacccgtatatgccaacagtgattgaacacttagaacgattgcagcgaaaacacggtggcatgctggtacgaaaccctctaagcagaaattcaacacacgaaatgtattggattagcaatggaacgggaaacattgttgcttccgtaaacatggtatcgagattgttacttaaccgctttactatgacacaccgaagacctaccatagaaaaggacgtagatttgggtgcaggaacgagacacgttaacgcagaaccagagacgcccaacatggacgtaataggcgaaagaataaaacgcataaaagaggaacacaatagtacatggcattacgacgatgaaaatccttacaagacatgggcttatcatggatcgtatgaagtcaaggctactggtagcgcatcatcaatgatcaatggcgttgttaagttacttactaaaccatgggacgtagtaccgatggtaacacaaatggcaatgaccgacactacgccatttggtcaacaacgcgtgtttaaagaaaaagtggacacgagaacaccacgatccatgccaggtacaaggagggtaatgggaatcacggccgagtggctttggagaacgttaggaaggaataagaaaccgaggctgtgcacaagagaagagttcaccaagaaagttcgtaccaatgctgccatgggtgcagtttttacagaagaaaatcaatgggactcagccaaagcagccgtagaagacgaagatttttggaaattggtagatagagagagagagctgcacaaactcggaaaatgcggaagttgcgtctataatatgatgggaaaacgcgagaagaaattgggcgaatttggaaaagccaaaggaagtagagcaatatggtacatgtggttaggagcacggtatttggagtttgaagctctagggttcctaaacgaagaccattggttctcgagagaaaattcttacagcggagttgaaggagaaggattacataagttagggtacatattacgagatatctcgaaaattcctggtggtgcgatgtacgctgacgacaccgcagggtgggatactagaatcactgaagacgacttacacaacgaagaaaagattactcaacaaatggacccggaacataggcagcttgccaatgcaatatttaaattaacgtaccaaaacaaagtggtaaaagttcaacggcctacaccaaccggaactgtgatggacataataagccgtaaagatcaaagaggatccggccaagtcgggacatacggcttaaacacttttacgaatatggaagcccagctcatacgtcaaatggagggtgaaggtgtactcagtaaagccgacctggagaatccacacttacccgagaagaaaataacgcaatggctggaaacaaaaggagtcgaaagattgaaaagaatggcaatcagtggagacgattgtgttgttaaacctatagacgaccgctttgctaatgcattattagctcttaatgatatgggcaaggttagaaaagacatacctcaatggcaaccctcaaaaggttggcatgactggcaacaagttcctttctgcagtcatcatttccatgaacttataatgaaagatggaagaaaattagtagttccttgtaggccccaggacgaattaataggtcgcgcacgaataagtcaaggtgctgggtggagtttgaaagaaacagcgtgcttaggtaaagcatatgcccagatgtggtccttaatgtacttccatagaagggatttgcgactagccagtaatgctatatgctcagcagtacctgttcattgggtcccaacaagtcgtacaacttggtctatacatgcacaccatcaatggatgaccacagaagacatgctaacggtttggaatagagtttggatagaggataatccttggatggaagacaaaactccagttacaacttgggagaacgtaccttaccttggaaaacgagaagatcagtggtgcggtagtttgataggactcacctcccgagctacgtgggcgcaaaacatccccactgctattcaacaagtgcgaagcctaattggaaacgaagagtttttagactacatgccttcaatgaaacggtttcgcaaagaagaggagtctgaaggagccatatggtaa

SEQ ID NO: 23167 - RNA, 9873 nt, synthetic construct
  misc_feature 1..9873: note = derived and/or modified CDS sequence (opt6) from DENV-3__FJ873813__SS-prME
  source 1..9873: mol_type = other RNA
acatctttatgtttaatgatgattctgcctgcagctttggcttttcatttgacatcccgggatggggaaccgcggatgatagtggggaaaaatgaaagggggaaaagtttattatttaaaacggcatcagggatcaacatgtgtacgcttatcgccatggatctaggtgaaatgtgtgatgatacagttacttacaaatgtccgcacatcacggaagttgaaccggaagacatagactgttggtgtaacctcacaagtacttgggtaacttatggaacgtgtaatcaagctggagaacataggcgagataaaagatccgtcgctctcgcaccgcatgtaggtatgggacttgataccaggacccaaacatggatgagtgcagaaggggcgtggcgacaagttgagaaagtagaaacatgggcgctgcgtcacccaggatttacaatattagcactgttcctagctcattatataggaacttctctcacccaaaaagttgtgatttttatcctactcatgttagtgacccctagcatgacaatgagatgcgtaggcgtaggtaacagagatttcgtagaaggcctatcaggagccacatgggtggacgttgttctggaacatggaggatgcgttactacgatggccaaaaacaaaccaaccctagatatcgaattgcagaaaactgaagcaacacaattagccacattaagaaaattgtgtatagaaggcaaaattacaaatattaccacagactcaagatgtccaacacaaggcgaagccacattaccggaagaacaagatcaaaattatgtatgtaaacacacttatgtggacagaggttgggggaatgggtgtggtctatttgggaaagggagcttggtgacatgcgcgaaatttcaatgtcttgaaccaatcgaaggtaaagtagtgcaacatgagaacctaaaatatacagtaataattacagtccataccggagatcaacatcaggttggtaatgaaacccaaggtgtaactgccgaaattacgccacaggcttcaacgaccgaagcaatcttacctgaatacggaacattaggattagaatgtagtccaagaactggtttagatttcaatgagatgatccttctaacgatgaaaaataaggcttggatggtacaccgacaatggttcttcgatctccccttaccttggacaagtggagcaaccaccgaaaccccaacctggaatcgcaaagaactattggtaacattcaaaaacgcacatgcaaagaagcaggaagttgtggtattaggatcacaagaaggtgcaatgcacacagcattaacgggagctacggagatacaaaattctggagggaccagtatattcgccggacatttaaagtgtcgcttaaaaatggataaactcgaactcaaaggcatgtcctatgcaatgtgcactaatacatttgtgctgaaaaaggaggttagtgagacacaacatggtacgatattaataaaagtggaatacaagggagaagacgtaccatgcaaaataccctttagtacagaagatgggcaaggcaaagcacataacggcaggctcattacggctaatcctgtagtgaccaagaaagaagaaccagtaaatatcgaagcggaaccgccatttggagaaagtaatatagtaatagggattggagataatgccttaaaaattaattggtacaagaaaggatccagcatagggaaaatgtttgaagctacagcaagaggtgctaggagaatggccatcctaggggacaccgcttgggattttggctcggtcggaggcgtactaaattctctgggcaaaatggtacaccaaatattcggatccgcatatacagcgttatttagtggagtaagttgggtgatgaaaatcggcatcggggtgctattgacgtggataggactaaattccaaaaacacttccatgtctttctcctgcatagccattgggataatcacattatatcttggcgcagttgtacaagccgacatgggatgtgtaataaactggaagggtaaagaactaaaatgcggaagcgggatatttgtgacgaatgaggtgcacacctggaccgaacaatataaatttcaagcagactctccgaaaagactagccaccgcaatagccggcgcatgggaaaacggggtttgcggtattcgttccacaacacgaatggagaacctactatggaaacagatagcgaacgaattaaattacatattgtgggaaaacaatattaagctaacagttgttgtgggtgatattataggagttttggagcagggcaaacggacgctcacaccccaaccgatggaactaaaatatagctggaaaacatggggtaaagccaagatagtaacagcggaaactcaaaattcaagtttcataatcgacggaccaaatacacctgaatgcccgtcagtatcaagagcctggaatgtgtgggaggtcgaggattacggcttcggtgtctttacaactaatatatggctaaagttgagggaagtgtacacccaattgtgtgatcaccgactcatgtctgcagcggtaaaagacgaaagggctgtacatgcggatatgggatattggatcgagtcacagaaaaatggttcttggaagctcgaaaaagcatccttaatagaagttaagacctgcacatggcccaaaagtcacacgctttggtccaacggagtactagaaagtgatatgatcatccctaagtccttggcaggacctatatcgcaacacaaccatcgaccaggttatcatacacaaaccgccggaccgtggcacttaggcaaattggagcttgatttcaattattgtgagggcacaacagttgttataacagagaattgtggtacacgcggaccgtcattacgcacaacaacagttagtggaaaacttatacatgaatggtgctgcaggagttgcacattacctccattaagatacatgggtgaagacggttgttggtacgggatggaaatcagaccaatatcggaaaaagaggaaaacatggttaaatcattggtatcagctggcagcggaaaagtagataactttacaatgggcgtactatgtctagcaatcctgtttgaggaagtgatgaggggaaaattcggcaagaaacatatgatcgctggtgtattctttacattcgtgttacttttgtcgggacagataacgtggagggatatggcgcacacactaataatgataggaagtaatgcgagcgatagaatgggaatgggagtaacatatttggctttaatagctacctttaaaatacaaccatttttggcattgggattctttctccgaaaactaacatctagagagaatttattgttaggagtgggcctagcgatggctacgacattacaactacccgaagacatcgaacagatggcaaatggaatagcattaggattaatggcacttaagctaatcacacaattcgaaacataccaactctggaccgcattgatttccttaacttgtagcaatacaatatttacgcttacagtggcatggagaacagcgactttgatactagcaggcgtatcactcttgccagtttgtcagagttcgtcaatgagaaaaacagattggctgcctatggcagtcgctgccatgggagtaccaccattgccgctgttcatcttttctttaaaggataccttaaagcgaaggtcctggccccttaatgagggcgtaatggctgttggattagtctctatcttagcatcatcattattaagaaatgatgtaccgatggcggggcccttagtagcaggcggactcctaatagcctgttatgtaataacaggaacttcagccgatctaacggtagaaaaggcagccgatataacgtgggaggaggaggctgaacagaccggagtctcacataatttaatgattactgtagatgacgatggaactatgagaataaaagatgatgaaactgaaaatattttgacagtcttactgaaaacagctctgctaatagtcagtggaatttttccctacagtataccggcaacattattagtatggcatacatggcaaaagcaaacgcaaagatcaggagtactatgggatgtaccatcacctccagaaacacaaaaagccgagctagaggagggggtttatagaatcaaacaacaagggatatttggaaaaacccaagtaggagttggagtccaaaaggaaggagttttccacacaatgtggcacgtcacgagaggagcagtactcacctacaatggaaaaagactcgaaccaaactgggcatccgtcaagaaagatttaatttcctatggaggtggttggagattatccgcccaatggcaaaaaggtgaagaagttcaggtaatagcagttgaaccaggcaaaaatcccaaaaatttccaaaccatgccaggtacgttccaaacgacgacgggtgaaattggagctatcgccctagactttaaacctggtacatcaggatcacctattattaatcgggaaggaaaagtggttggactatatggcaatggggtcgtaaccaaaaacggaggatacgttagtggaatcgcacagacaaatgcagaaccagacggaccaacacctgaactagaagaggaaatgtttaagaaacgcaatttgactattatggaccttcacccgggatcaggtaaaacaaggaagtacttaccggcaattgttcgcgaagcaataaaacgtcgacttcgtacgcttatcttggccccaacccgtgtagtcgcagctgaaatggaagaagcacttaaagggctaccaatacgatatcagacgactgcaactaaatcagaacatacaggtagagaaatagtcgacctcatgtgtcatgctacgtttactatgcgactcctaagtcctgtgagagtaccgaattataacctcattattatggatgaagcacatttcactgaccctgctagcatagcagcacgagggtatatctcaactcgtgtaggaatgggggaagctgcggcaatctttatgacggctaccccgccagggactgccgacgcctttccgcaatccaacgcacccatacaagacgaagaaagggacatacccgagcggtcatggaactcgggaaacgagtggataaccgacttcgccggaaaaacagtatggttcgtaccaagtattaaagccggaaacgatatcgctaactgcttacgcaaaaatggtaagaaagtcatacaattatcaagaaagacctttgacactgagtatcagaaaacaaaacttaatgattgggatttcgtagtaacaacggatatttctgagatgggagctaactttaaagcagatagagtcattgaccccagaaggtgcctgaagcccgtaatactaacagacggtcccgaacgagtaatacttgcgggaccaatgccagtgacagcagcatccgcagctcagagaagaggaagagtaggaagaaatccacagaaggagaatgatcaatacatcttcaccggtcagccactaaacaacgacgaagaccatgcccactggacagaagctaaaatgctgctagataatattaatacaccggaaggtattatacctgcactcttcgagccagaacgagaaaaatcagcggcaatagatggagagtaccgtttaaaaggtgaaagcaggaagacatttgtggagcttatgagacggggagatttgccagtctggttagctcataaggtggcatcagaaggtattaaatacactgaccgcaagtggtgctttgatgggcagcgtaacaatcaaattcttgaggaaaacatggatgtcgagatatggacaaaggaaggcgagaaaaagaaactacgaccgagatggttggatgccagaacatattcagatcctctagccctaaaagaatttaaagagtttgctgccggccgaaagagtatcgctttagatttggtcactgaaattgggagagtaccctcgcacctagcacaccggacaagaaacgcactagataacttagtaatgctacatacttcagaacatggtggaagggcttatcgccacgccgtagaggaattaccggagacgatggaaacactactacttcttggactaatgatcctacttacaggaggcgccatgctctttttaatctcggggaaggggatagggaaaacttcaatcggactaatctgcgtcatagcatcttcgggtatgttatggatggcagagatcccactgcaatggattgcatcagcaatagttttagaatttttcatgatggttctgctaattcctgaacccgagaaacaacgaacaccacaagacaaccaattagcctatgttgtaattggaatattgactctggcagccattattgcagcaaatgaaatgggattattagagacaacaaaacgtgatttaggaatgagtaaagaacctggtgtagtaagtcctacctcatacttggatgtagatttgcacccagcaagtgcatggacattatatgctgtagctacaacggtaataacacctatgctccgacatactatagaaaattccaccgcaaatgtatccttggcagcgatagctaaccaagcagttgtgttaatgggtttagataagggctggccaatatcaaaaatggatctaggggtaccactactggcactgggctgttactcacaagttaatcccttgactttaacggctgcagtcttactactgatcacacattacgcgattattggtccaggtctacaagccaaagctacaagagaagctcaaaaacgcacagctgcgggaataatgaagaatcccacggtggatggcataatgaccattgatttagacccagtgatatacgactcgaagttcgaaaaacaactaggccaagtgatgctcctcgtcctctgcgcagtacaactactacttatgaggacctcttgggcactttgtgaagcattaacgctggcaactgggcctataactacattatgggaggggagcccaggcaaattctggaataccacaatcgctgtatcgatggctaatatattccgaggtagttatctcgcgggcgcaggtttagccttcagtataatgaaatctgtaggtaccgggaaaagagggactggttcacagggagaaactctaggcgagaaatggaagaaaaagctaaatcaattaagcagaaaggattttgatctttataagaagtcaggtatcactgaagtggatcgaacagaagcgaaggagggtctgaaacggggagaaattacccaccatgctgttagtagaggatctgctaaattacaatggtttgtagaaagaaatatggtgatcccagagggacgagtaattgacctaggatgcggcagaggtgggtggtcatactattgtgcaggcctaaagaaagtgacagaagtacgtgggtacacaaaaggagggcctggacatgaagaacctgtgcctatgtctacttatggttggaatatcgttaagctaatgtccggaaaagacgtgttttacctgccccctgaaaaatgtgataccttgctgtgcgacatcggtgaatcatcaccatcccctaccgtagaagaaagtaggaccataagagtcctaaaaatggtagaaccatggcttaaaaataatcagttttgcatcaaagtactcaatccatacatgccaacagtaatagaacatctggaacgcctgcaacggaagcatggaggcatgcttgttaggtatccactaagcagaaattccacacatgagatgtattggataagtaatgggacaggtaatatcgtggcgagtgtgaacatggtatcaagactactacttaacagatttactatgactcatagacgcccgactatagaaaaagatgttgatcttggtgctggtacaagacacgtaaatgctgagccagaaactccgaacatggacgtaataggcgaaagaatcaagcgtatcaaagaagaacataatagcacctggcattatgatgatgaaaatccgtataagacctgggcataccatggtagttacgaggtaaaagctacagggagcgcttcgagtatgataaacggagtagtaaaattacttacaaaaccctgggacgtagtaccaatggttacacaaatggcaatgacagatactacaccttttggacaacaacgagtgtttaaagaaaaagtagataccagaacgccacggtcaatgccaggaactaggcgagtaatgggaataaccgcagaatggctttggagaacattgggtcgtaacaagaaacctagattgtgcacacgggaggagtttacgaagaaagtgagaacaaacgccgcaatgggtgccgtattcacagaagaaaaccaatgggattcagcaaaagcagcggtcgaagacgaagatttctggaagttagtagacagagagcgtgaactacacaaattggggaaatgtgggagctgcgtctacaatatgatgggaaaacgagagaaaaagttaggcgagttcggaaaagccaaaggttctagagccatctggtatatgtggttgggggcacgatatttggagtttgaggcactaggctttttaaacgaagatcactggttctcacgagaaaattcatattcaggcgtagaaggcgaaggattacataaactaggttacatactccgagatatttcaaaaatcccagggggtgcgatgtatgcagacgatacagctgggtgggatacacgtataactgaggatgatcttcacaatgaggagaaaatcactcaacaaatggaccctgaacatagacagcttgcaaacgcaatattcaaactaacctaccaaaataaagttgtaaaagttcaacgaccaaccccaaccggaacggtcatggatataatatcacgtaaagatcagcgaggttctggacaggtaggaacgtatggacttaatacctttactaatatggaagcccagctgatacgacaaatggagggagaaggggtactaagtaaagccgatctggaaaaccctcatcttcccgagaagaaaattacacagtggttagaaacaaaaggagtggaacgattaaaaaggatggctataagtggagatgattgtgtggtcaaaccgatagacgatagattcgctaatgctttattagcgttaaatgacatggggaaagttaggaaagatataccccagtggcagccaagtaaaggttggcatgattggcagcaagttcctttctgttcccatcactttcatgaattaatcatgaaagatggacgcaaacttgtagttccatgcagaccgcaagacgaactaatcggtagagcaagaatttctcaaggagcagggtggagccttaaagaaaccgcatgccttgggaaggcttatgcgcaaatgtggtcactaatgtactttcacaggagggacttaaggcttgctagcaacgcgatatgttcggccgttccagttcattgggtaccaacgagtagaacaacgtggagcatccacgcacatcaccagtggatgactaccgaagacatgctaacggtctggaaccgcgtatggattgaggataatccatggatggaagacaaaactccggttactacctgggaaaacgtcccgtatttgggtaaaagagaagatcaatggtgtggtagtttaattgggctaacatcacgcgcaacatgggcacagaacataccgaccgcaattcaacaagtaagatccctaatcggaaatgaggagttcctagattatatgccaagcatgaaaagattccgtaaagaagaagaatcggaaggagcgatatggtag

SEQ ID NO: 23168 - RNA, 9873 nt, synthetic construct
  misc_feature 1..9873: note = derived and/or modified CDS sequence (opt6) from DENV-3__FJ850048__SS-prME
  source 1..9873: mol_type = other RNA
acaagtttgtgtttgatgatgattcttccagcagcattagcatttcacttaacatcaagagatggtgagccaagaatgattgttggcaaaaatgaaagaggtaaatctttgttatttaaaacagcgtctggaatcaacatgtgcacattgatcgcaatggatttgggtgaaatgtgcgacgacacagtaacgtataaatgcccacacataacagaagtcgagccagaagacatagactgttggtgtaatctaacatcaacttgggtaacttatggaacatgtaaccaggccggtgaacacaggcgagataaaagaagcgtagcattagcaccacatgtggggatggggttagacacgaggactcaaacatggatgagcgcggaaggagcatggcgacaagtggaaaaagtagaaacttgggctttacgacatccaggatttacgattctggcgctatttctagcacactacatcggaacatcattaacacaaaaagtggtaattttcatcctgttaatgttagttacgccatcaatgactatgagatgcgtaggtgtaggaaaccgagactttgtcgaaggattatcaggggcgacatgggtagatgttgtactagaacacgggggatgtgtgactaccatggccaaaaataaaccaaccttagatatagaacttcagaaaacagaagcaactcaacttgcaactttgagaaaattatgtatagagggtaaaataacaaatattaccaccgattcaagatgtcccacgcagggtgaagccacacttccagaagaacaagatcagaattatgtgtgtaaacacacttacgtcgaccgcgggtggggtaatggatgtgggctttttggtaagggtagcctagttacctgtgcaaaatttcaatgcctggagcctatagaaggaaaagtggtccaatatgaaaacttaaaatatactgtgataataacagtacacactggagaccaacaccaggtaggaaacgaaactcagggcgtaacagctgaaatcacgccacaagcgtctacaacagaagcaatactaccagagtatggtacattgggcttagaatgctcacctcgaactggtttagactttaatgaaatgatacttctgactatgaaaaacaaagcctggatggtccatagacaatggttctttgacttgccgctaccatggacaagtggagcgacaacggaaaccccgacctggaatcgaaaagagttattagttacctttaaaaatgcgcacgcaaagaaacaagaagtcgtagttcttggatcacaagaaggagccatgcacactgctcttaccggagcaacggagattcaaaattctggtggaacaagtatatttgcaggacatttaaaatgcagattgaaaatggataaactcgaattgaaaggaatgagttatgcaatgtgcacaaacacttttgtactcaagaaagaagtgagcgaaacacaacatggtacaatattaattaaagttgaatacaaaggtgaagatgtgccatgtaaaatcccatttagtaccgaagatggtcagggcaaagctcataacggacgccttataacagctaacccagtagtgactaagaaagaagaacccgttaatatagaagcggaacctccctttggagaaagtaacatagtgatcggaataggagacaatgcacttaaaataaattggtataagaaaggatcttccataggaaaaatgtttgaagcaacagctaggggagcaaggcgtatggccatattaggtgacaccgcgtgggactttggatcagtagggggagtcctaaattcgttaggtaaaatggttcatcaaatatttggttctgcttacacagcattatttagtggcgtaagttgggtgatgaaaattggaataggcgttcttttaacttggataggattaaatagtaaaaatacttctatgtcattcagttgtatcgcaatcggcataattaccttatatttgggcgctgtagttcaagcagacatgggatgtgttataaactggaaagggaaagaacttaaatgcggaagtggaatattcgttactaacgaagtacacacgtggacagagcaatataagtttcaggcggattcaccaaagcgcctagcaacagctattgctggagcctgggagaacggtgtatgtggaattaggtcgaccactcgaatggaaaaccttttgtggaaacaaatagcaaacgagttaaactatattttatgggagaataatataaaacttacagttgtggtaggtgatattattggcgtgcttgagcaggggaaaagaactctgacacctcaacctatggagctcaagtacagttggaaaacctggggaaaagcaaaaatagtgacagcagaaacgcaaaactcgtcattcataatcgacggtcccaatacacctgaatgtccgtcagtatcaagagcatggaacgtatgggaagtagaagactacggattcggtgtcttcactactaatatatggctaaaactccgtgaggtttacactcagttgtgcgatcaccgattaatgtcagcagcagtaaaagacgaacgagctgtacacgctgatatggggtattggattgaatcacagaaaaacggaagttggaaattagaaaaggcttcccttattgaagtcaaaacgtgtacctggccaaaatcacatacactatggtcaaatggtgtgttagaatcagatatgattatccctaagtctctagccgggccaatcagtcaacacaatcacagaccgggatatcacacacagacggccggtccatggcaccttggaaaattagaattagactttaactactgcgagggaacaaccgttgtcataaccgagaattgcggaacaagaggacctagtctccgaacaactactgtatctggtaaacttatccatgagtggtgttgcaggtcatgtactctaccacctttaagatacatgggggaagatggctgctggtatggtatggagatacgtcctattagtgagaaagaggaaaacatggtaaagagtttagtgtctgcaggatcaggtaaagtagataattttacgatgggggtattgtgcctggcaatactttttgaggaagtaatgagaggtaaatttggcaagaaacatatgatagccggtgtgttctttacattcgtactcctcttatctggacaaattacttggagagatatggcacatacattgataatgatcggaagtaatgcatccgacagaatggggatgggcgtcacatatctcgccctgattgcaacttttaaaatacaaccatttttggcactaggattctttttaagaaaacttacatcgcgtgaaaatttattactaggcgtaggattagcaatggcgacgacccttcaattacctgaagatattgaacaaatggctaatggcatagcgctaggtcttatggcattaaaattaataacacaatttgagacatatcaactgtggaccgcccttatatcattgacatgctctaacacgatttttactctaaccgttgcttggagaaccgcgacgcttattttagccggagtttcgctccttccagtgtgtcagagttcgagcatgaggaagactgattggttacccatggcagttgcggcaatgggtgttccacctctaccattattcatattttctctaaaggacacgttaaaaagacgatcttggccactaaatgaaggtgtaatggcagtgggattggtgagcatattggcgagcagtttgttgagaaatgatgttcccatggcaggtccactcgttgccggtgggttattaattgcatgttatgtaatcacaggaacgagcgcagacttgactgttgagaaagccgcagatataacttgggaagaagaggcagagcagacgggagtatcgcataacctaatgataacagtagatgacgatggaaccatgagaataaaagatgatgagacagaaaatattctcactgtcctattaaaaacagctctattaattgtctcaggaatcttcccttacagtattccagcaacattattggtctggcatacatggcagaaacaaactcaaaggtccggcgtgctatgggacgtgccctctcccccagaaacgcaaaaagcagaactagaagaaggtgtgtacaggatcaaacaacaaggtatttttggtaagacgcaagtaggtgtaggtgtgcaaaaggagggagttttccacactatgtggcatgtaactagaggagccgtgttaacatataacgggaagagactggaaccgaattgggcaagcgtgaagaaagatttaatatcatatgggggagggtggagactttcagcacagtggcagaaaggagaagaagtacaggtaatagccgttgagcccgggaaaaaccccaaaaattttcagacgatgcctggaacatttcagactacgactggggagatcggagctatagcgctggatttcaaaccaggtacaagtggttctccaatcattaacagagagggaaaggtagttggattatatggcaatggcgtagtcaccaaaaatggaggctacgtttcagggattgcacaaaccaacgcggaacccgatggcccaactccagaattggaggaagaaatgtttaagaagcgtaatctcactataatggaccttcatccaggctcaggcaagacgcggaaatatttgccagcaattgttagggaagcaataaagagacgtctacgaacattaattttggcacctacaagggtcgtagcagcggaaatggaggaggctttaaaaggtctacctataaggtaccagacgacagctaccaaaagtgaacataccggaagagaaattgtcgacttgatgtgccacgccacattcacgatgcgcttattatctccggtcagggtacccaattataaccttattattatggatgaagcacacttcacagaccctgcaagcatagcagctaggggttacatatctacgagagtgggaatgggggaggctgctgctatatttatgactgctactccgcccggtacagcagatgcgtttccacagagtaacgctccgatacaagatgaagaacgtgatattccagaaagaagttggaactcggggaacgagtggataacggactttgctggaaaaacagtgtggttcgttccaagcataaaagctggaaatgatatagctaattgtctcaggaaaaacgggaagaaagttattcagctctcacgaaaaacttttgatactgaatatcagaaaacgaaactaaacgactgggattttgtcgtaaccacggatataagcgaaatgggcgcgaactttaaagctgaccgggtcatagacccacgtcgttgtttaaaacccgtcatccttactgatggtcccgagcgagtcatactcgctgggccaatgccagtcacagcagcaagtgccgcacaaaggagaggtcgtgtaggcagaaatcctcaaaaggaaaacgatcaatacatatttactggtcaaccattaaataacgacgaagatcacgcccattggactgaggctaagatgcttttagataacataaacacaccagaagggataataccagccctattcgaaccagagcgcgagaaatcggcggctattgatggggaatatcggttaaagggagaatcaagaaaaacgtttgtcgaactaatgcgcagaggtgatttacctgtgtggcttgcccacaaggttgcttctgaaggaattaagtatacagatcgtaaatggtgttttgatggtcaacgaaataaccaaatactagaagagaatatggacgtggaaatatggactaaagaaggtgaaaagaagaaactacgacctcgatggctagacgcacgtacttatagcgacccactggcactaaaggaatttaaagaatttgccgcgggaaggaaatctatagcacttgatctagtcacggagatcggacgggttccaagccacttggctcacagaactcgaaatgcattggacaatttagtaatgctgcacacaagcgagcacggagggcgtgcatatcgacatgctgtggaagaactacctgaaacgatggagacgttactcttactcggattaatgattctcttaacaggaggggcgatgctgttcttgatttccggaaaaggtataggaaaaacatccattgggttaatttgtgttatcgcatcaagtggcatgctttggatggcagaaatacctttacaatggattgcatctgcaattgtattagagttctttatgatggtactgctcatcccagaacccgaaaagcagagaacgccacaagataaccaactagcatacgttgtcataggcattctaaccttagcagcaataattgcggctaatgaaatgggactattagagacaactaaacgagatttaggaatgagcaaggaaccaggagtcgtaagccctacttcatatttagacgtcgaccttcacccggctagcgcttggacgctttacgcggtagcaacaactgttattacccccatgctcagacacactatagaaaactctactgcaaatgtaagtctggctgcaatagcgaatcaagcagtggttcttatgggactagataaaggctggcccatctcaaaaatggatctaggagtgccactattagctttaggatgttactcacaagtaaacccgctaaccctaaccgcagctgtgctattattaattacacattatgctataatagggccaggtctgcaagccaaagcaacaagagaagctcagaaacgcacggcagctggaataatgaagaatccaactgtagatggaataatgacgattgacctagatccagtcatatatgactcaaagttcgagaaacaactaggtcaagtaatgttattggttctttgtgcggtgcaattattgctcatgcgaacctcttgggctctttgtgaggcactaacactcgcgaccggtcctataacgacattatgggaaggaagccctggtaaattctggaatactacgatagcagtatccatggctaatatttttagaggaagctacttagcaggggccggattagcctttagtattatgaaatccgtaggcacaggaaaaagaggcactggaagccaaggcgaaacattgggagagaagtggaagaagaaattaaaccaactcagtagaaaagatttcgatctatacaagaaatctggtatcacagaggtagatcggactgaagccaaagagggactaaaaagaggggaaattacacatcatgcggttagtagaggttccgctaaactgcaatggttcgtagaacgaaatatggttatcccagaaggtcgcgtgatagacctaggatgcggaagaggtggatggtcatactattgcgccggcctcaagaaagtcacagaagtcagggggtatactaagggaggaccagggcacgaagaacctgttcctatgagtacttacggttggaatatagtcaagttaatgagcgggaaagacgtattttacttgccacctgagaagtgtgatacactgctctgtgatataggggaatcctcaccctccccaacagttgaagaatcacgaacaatcagagttctaaaaatggtagaaccgtggctcaaaaacaatcaattttgcattaaagtattaaatccttatatgccaactgtgatcgaacacctagaacgtttacaaagaaaacacggcggaatgcttgttcgtaatccattgagtcgcaacagtacacatgaaatgtactggatatcgaacggaacaggaaatatcgttgcgtcagtaaatatggtatcaagattgctactaaatcgttttacaatgacacaccgaagacccacaatagagaaagacgtcgacttaggcgcaggtactagacatgtaaatgcagaaccagagactccaaatatggacgtaataggtgaaagaataaaacgaattaaagaggaacataatagtacatggcattatgacgacgaaaatccctataaaacctgggcctatcatggttcttacgaagtgaaagctacaggaagcgcaagtagtatgataaacggtgttgtgaaactacttacaaaaccgtgggatgtcgttccgatggttacacaaatggctatgacggacacaacgccgtttggacaacaaagagtatttaaagaaaaagtagatacacgtacacccaggtcaatgcccggcacacgacgcgtgatgggaataacagcagagtggttatggcgcacgttgggccgaaataagaaacctagactgtgtacaagagaagaatttacgaagaaagtaagaacaaatgcagcaatgggcgcagtgtttactgaagaaaaccaatgggatagtgcaaaagccgcagtagaagatgaagacttctggaagttggttgacagagaacgagaactacataagctagggaaatgcggatcatgtgtatataatatgatggggaagagagaaaagaagctgggagagttcggaaaagcaaaaggatcacgagctatatggtacatgtggcttggagctagatatttggagttcgaggctttaggttttctaaatgaagatcattggttttcgcgagagaactcatattcaggcgtcgagggagaaggtctacacaaattagggtacattttacgagacataagtaaaatacctggtggggcaatgtatgctgatgatactgccggatgggacacgaggataaccgaagacgatttacacaacgaagaaaagataacacaacagatggatcccgaacataggcaattagcgaacgcgatttttaagctaacttatcaaaacaaggtggtgaaggtacagagaccaactccgacgggtactgtgatggatataatatcacgaaaagaccagagaggatcaggtcaagttggcacatacggcctaaatacctttaccaatatggaagcacaattaattcgccaaatggaaggtgaaggtgtcctaagtaaagccgacttggaaaatcctcatttaccagaaaagaaaataactcagtggttagaaaccaagggagttgagagactaaaaagaatggcgatttcgggcgacgattgtgtagtaaaacctattgatgatcgttttgcgaatgccctactagcgctaaacgatatgggaaaagtgagaaaagatataccacaatggcaaccgtcaaaaggatggcatgactggcaacaggtcccgttttgctcgcaccatttccacgaacttataatgaaagatggaaggaaactcgttgtcccatgccgtccacaagatgaactgatcggcagagcgagaataagccaaggggccggttggtcactcaaagagactgcatgtcttggaaaggcctacgcgcagatgtggtcattaatgtatttccacagacgagacctgagattagcctctaatgccatttgttctgctgtaccagtacactgggttccgacaagccgtactacttggagtattcatgcacatcatcaatggatgacaacagaagacatgttaaccgtatggaatagagtctggatagaagacaatccatggatggaagataagactcccgtcacaacctgggaaaatgtcccatatttaggaaaacgcgaagatcagtggtgtggatcactcataggcttgacaagtcgcgccacatgggcacaaaacatacccaccgcgatacaacaggtacgatcattgattggcaacgaagagtttctcgattatatgccaagtatgaaaagatttcgcaaagaagaagaaagcgaaggcgcgatttggtaa

SEQ ID NO: 23169 - RNA, 9873 nt, synthetic construct
  misc_feature 1..9873: note = derived and/or modified CDS sequence (opt6) from DENV-3__FJ850049__SS-prME
  source 1..9873: mol_type = other RNA
acttccctgtgcctgatgatgattctccctgcggcattggcgttccatctgacttctagagatggtgaaccacgtatgatagtaggtaaaaatgaacgcgggaaatccctgttattcaaaactgcaagtggtattaatatgtgtactctaatagctatggatctaggagaaatgtgtgacgacacagtaacatataaatgcccacacataacagaagtagaacctgaagacattgattgctggtgcaatttaacatccacatgggtaacctacggaacatgcaaccaagcgggcgaacaccgacgagacaaaagatcggtcgcgttagctccccatgtaggtatgggactcgatactcgcacgcaaacatggatgagtgcggaaggcgcatggagacaagtggaaaaagtagaaacttgggcgcttagacatccgggctttacaatcttagcgctgtttttagctcattatatcggtaccagtcttacacaaaaagtggtaatattcattctgttgatgctcgtaacaccatcaatgaccatgcggtgtgttggcgttggaaatcgggattttgtagagggcttaagtggtgcgacttgggttgacgtcgttttagaacatggaggctgtgtaactactatggcgaaaaataaacctacgcttgatatagaactacagaaaactgaagcgacgcaacttgcaactctacgcaaactttgtattgaaggaaaaataactaatatcaccacggactcacgatgcccgacacaaggggaagcaacgttgccggaagaacaagatcaaaactatgtatgtaaacatacatacgtcgatagaggctggggaaatgggtgtgggctattcggtaaaggatcacttgtaacgtgtgctaaatttcaatgcttggaacccatagaaggcaaagtggttcaacatgaaaatttgaaatacaccgttattataactgtacacactggagatcaacatcaagttggaaacgaaacacaaggcgtaactgctgaaataacaccacaggctagcacaacagaggccatcttaccagaatacggaacgctcggactcgaatgctctccgagaacaggactagattttaacgagatgatcttgttaacaatgaaaaacaaagcctggatggtgcacaggcaatggttctttgacctgcctttgccatggacgagtggtgctacaacagagacaccaacgtggaacagaaaagagttgttagttaccttcaaaaacgcgcacgctaagaaacaagaagttgtggttttagggtctcaagaaggcgcaatgcatactgcattaacaggtgctacagagattcaaaatagcgggggcacaagtatttttgctggccacttaaaatgcagattaaaaatggacaaacttgaattaaagggtatgagttacgctatgtgtacaaacacatttgttttaaagaaagaagtgagcgaaactcagcatggcacgatacttataaaagtggagtacaaaggcgaggatgttccatgtaaaataccttttagcactgaggacgggcaaggcaaagctcataacggtaggctcataacagctaacccagttgtgactaagaaagaggagccagtaaatatagaggctgaaccaccctttggagagtcgaacattgtaataggaattggagacaacgcactgaaaataaattggtataagaaaggatcatctataggaaaaatgtttgaagcgacagcaagaggcgctcgacgtatggctatcctcggcgacaccgcttgggacttcggctcagtagggggtgtcctaaattcgttaggtaaaatggtccatcaaatttttggtagtgcatacactgcactgttcagtggcgtttcttgggtcatgaaaatcggaattggagtgttgctcacatggataggtctcaacagcaaaaatacttcaatgtctttctcgtgtatagcaattggaataattacattgtatttaggagctgttgttcaagctgatatgggatgcgtaataaactggaaaggtaaagaattgaagtgcggttcaggaattttcgtaacgaacgaggtacatacctggacagaacagtacaagtttcaagccgattcaccaaaacgtctagccactgcgattgctggtgcatgggagaatggagtatgcggtattcgctcaactactagaatggaaaacttgctttggaaacagatcgccaatgaattgaattacatactatgggaaaataacatcaaactaactgtagtcgtcggggatataattggagtactagaacaaggaaaacgtactttgacgcctcaaccaatggaactaaagtatagctggaaaacctggggtaaggccaaaatagtaacagcagagacgcaaaactcatcgtttataatcgatggtccaaataccccagaatgccccagtgtatctagagcatggaatgtatgggaagtagaggactacggctttggggtttttacaactaatatctggctcaaactccgagaagtttacacccagttatgcgatcacaggcttatgagtgcagcagttaaagacgaaagagctgtacacgcagatatgggttattggattgaaagtcagaaaaacggatcttggaagctagaaaaagcatctctcattgaagtgaaaacgtgtacttggcccaaatcccataccttatggtctaatggcgtattagaaagtgatatgataatccctaaatcgcttgctggtcctatatcacaacataaccatagaccaggctaccacacacaaacagcaggaccatggcacttaggtaaactagaactcgacttcaattactgtgaagggactacagtcgttattacagagaattgtgggaccagaggcccctccctcagaacaacgaccgtatcggggaaattgatccacgagtggtgctgcaggtcctgtactctccctccattgagatacatgggagaagatggctgttggtacgggatggaaatacgaccaatcagcgaaaaagaggagaacatggttaaatcccttgtatccgcaggctccgggaaagttgataattttactatgggagtgctatgcttagccatattatttgaggaagtaatgaggggaaaatttggaaagaaacacatgatcgccggtgttttctttacgtttgtcctattgttaagcggacaaattacatggcgtgacatggcccatacattaataatgataggtagtaacgcatcagatcgaatgggaatgggagtgacctatctcgccctaattgcgactttcaaaatacagccatttttggccttaggcttcttcctacgcaaattaacatcaagagaaaatcttttattgggtgtcggactagcaatggcaacaactttacaactaccggaggatatagaacagatggccaatggaattgctctcggactaatggcactaaaactcattacacaattcgaaacataccaactctggactgccttaatttcattgacgtgttctaacacaatatttacattaacagttgcatggagaacggccacacttatattagctggagtaagcctactgcccatgtgccaaagttcgagtatgagaaaaacagattggctccctatggccgtagctgcgatgggagtaccacccctacctttattcatcttctccctaaaagatactttaaaacggaggtcatggccattaaacgaaggagtgatggccgttgggcttgtctctattctcgccagttcgttattaagaaacgacgtaccaatggcgggccctttagtcgctggtggtctactgattgcctgttacgttataacgggcacctcggcggacctcacagtagaaaaagcagcgaatataacatgggaagaagaagcggaacaaactggtgtttcccataatctaatgataaccgtagacgatgacggtaccatgaggataaaagatgatgaaaccgaaaatattctaacagtactcctaaaaaccgcattactgatagtttcaggaatattcccttacagtattcctgctacacttttggtatggcatacatggcagaagcagacacaaagaagtggcgtgttgtgggacgtaccaagtccacctgagacccaaaaagctgaacttgaggaaggagtataccggataaaacaacaagggatatttggcaaaactcaagtaggagtaggtgttcaaaaagaaggtgtcttccatacaatgtggcacgttactcgtggagcggtacttacatacaacggcaaacgattggaacccaattgggcgagtgtcaagaaagaccttatttcttacggaggcggctggaggctgtcagctcagtggcaaaaaggagaggaagtacaagtgatcgcggttgaacctggtaaaaatcccaaaaatttccaaactatgcctggaacgttccaaacaacaacaggagaaattggagctatagctctagacttcaagccaggaaccagcggaagtccaataattaatcgcgaaggaaaagtggtaggactatatggaaacggcgtagtcactaagaatggagggtacgtatctggcatcgcccaaactaatgcagaacccgatggtccaacaccagaattggaggaagaaatgttcaaaaagcgtaacttaacaataatggacctacatcccggatccgggaagactagaaaatacctgccggctatagtcagagaagcgattaaaagacgcctaagaacacttatcctggcacctacgagagtagtagccgcagaaatggaagaagcactaaaaggattacccataagatatcaaacaactgcaacgaaatcagaacacaccggaagagaaattgtagatttaatgtgccatgctacatttactatgcgtttattgtcgcctgtacgggttccaaactataatttaataataatggatgaggcacattttactgatccagcctccatagctgcaagaggttacatatcaactagggtgggtatgggagaagctgctgcaatatttatgacggcaacaccgccgggcacagcagatgctttcccacaatcaaatgcccctattcaagatgaagaaagagacattccagaacggtcatggaactcgggaaacgagtggattacggatttcgcaggtaagacagtatggttcgtgccgtcaatcaaagctggcaacgatattgctaattgccttcgcaaaaatggcaagaaggtcatacaattatcgaggaaaacatttgataccgaataccagaagacgaaacttaatgactgggatttcgtcgtaacaacagacatatctgaaatgggcgccaattttaaagcagatcgggtaatcgacccacggaggtgcttaaagcccgtgattctaacggacgggcccgaaagagttattcttgctggacctatgccagttaccgcagctagtgctgcacaacgaagaggaagagtcggccgtaatccacaaaaagagaacgatcaatatattttcacggggcaacctctcaataacgatgaagaccatgctcactggaccgaagctaagatgttgttagacaacattaatacgccagaaggaattatcccagcattatttgaacctgaacgagagaaaagtgcggcaatagatggggagtatcgacttaaaggtgagtcacgtaaaacatttgtagagctgatgagaagaggtgatttaccagtttggctagcacacaaagtagcatcggaaggaatcaagtacacagatagaaagtggtgctttgacggacaacgcaataaccaaatcttagaggaaaatatggatgtcgaaatatggaccaaggaaggcgaaaagaagaaattgagaccaagatggctagatgctcgtacatattccgatcctcttgctttaaaagaatttaaagagtttgcagccggtcgaaaatcaatagcattggatctagtcacagaaataggaagagtaccctcgcatcttgcacatagaactagaaacgcattagacaacctcgtgatgttgcacacaagcgagcacggcggtcgtgcatatcgacatgcagttgaagaactaccagaaacaatggaaacacttctattattagggctgatgatattactcaccggaggggcaatgctctttttaatttccggtaaaggaatcggaaaaacatccataggtttgatctgtgtcatcgctagttctggcatgctgtggatggctgagatccctctacaatggattgcatcagcgatcgtattagagttctttatgatggtactcctaatccccgaaccagaaaaacaaagaacaccacaagataaccagctagcctatgtcgtgataggaatcttgacacttgccgcaattatcgcagcaaatgagatgggtcttctcgagacgacaaaacgcgacttagggatgagtaaagaaccgggagtagtatccccaacgtcctatttagatgttgacctccaccccgcttctgcttggacgctatatgctgtggcaacaactgtcatcactcccatgttacgacatacaattgaaaattctacagcaaacgtcagcttagcggcgattgctaatcaggctgttgtacttatgggcttggataaaggttggcccatatctaaaatggatttaggagtacccttattagcactagggtgctacagccaagtcaatccattgactcttactgccgctgtactcctactcatcacccactatgcaataatcggaccgggactgcaagctaaggccacacgtgaagcacagaaacgaacagcagccgggattatgaaaaacccaacagtggatgggattatgaccatagacttagacccagtaatatacgattccaaatttgagaaacaactcggacaagtgatgctcctagtgttatgtgccgttcaactcctcctcatgaggacaagttgggcgttatgtgaagccttaacattagccacgggaccaatcacaaccctctgggaaggtagccccgggaaattttggaataccacaattgcagtgtcaatggccaatattttcagagggagttacttagccggtgctggcctagccttctctataatgaaatcagtaggaacagggaaaagaggtaccggctcgcaaggagaaactctaggagagaaatggaagaagaaattgaatcaattgtctcgaaaagacttcgatttatacaagaaaagtggaataaccgaagttgatcgtaccgaggccaaagaaggactaaaacgtggcgagatcacacatcacgctgtatctcggggatccgcgaaactgcaatggtttgtggaaagaaacatggttattcctgaaggtagagtgatagacttgggatgcggtagaggcggttggagttattattgcgcaggcctgaagaaagttacagaggtacgagggtacactaaaggaggcccgggtcatgaagaaccagtacctatgtcgacctatgggtggaacatagtcaaattaatgagtggaaaagatgtcttctatttaccaccagaaaagtgtgacacattactttgtgatataggcgaatcgtcaccatcacctaccgttgaggagagccgaacaattagggtccttaaaatggtggagccatggctaaagaataaccaattctgcattaaagttttaaatccctatatgcctacggtaatagaacatctagagaggttacaaagaaaacacgggggtatgctggtccgaaatccactaagtcgaaattcaactcacgaaatgtactggatcagcaatggaactggaaatattgtagctagtgtcaacatggtatcacgactgctattaaatagatttaccatgacgcacaggaggccaacaatagaaaaagatgttgacttaggtgcaggaacacgccatgtaaatgcagaaccagaaacacccaatatggacgtaatcggtgaaagaatcaaaagaattaaagaagaacacaattctacatggcactatgatgatgagaacccatacaagacatgggcctatcatggatcatatgaagtaaaagctacgggctcagcttcatcgatgataaacggagttgttaagttgttaacgaagccctgggatgtggtacccatggttacacaaatggcaatgacagataccacaccattcggacaacaacgtgtattcaaagaaaaagtagatacacgcactccgagatcaatgccaggtacaagaagggttatgggcattaccgcagaatggttatggagaacgctaggccgaaacaagaaaccacggctctgcacgagagaagagttcacgaagaaagtacgaacgaacgcagcgatgggtgcagtatttacagaagaaaatcagtgggacagtgcgaaagcggcggtagaagacgaggatttttggaaacttgtagatagagaaagagaacttcacaaactgggtaaatgcggctcatgcgtatataatatgatgggtaaacgagagaagaaactcggagaatttgggaaagcaaaaggttccagagctatctggtatatgtggctaggagcaagatacttagagtttgaggcacttggattcctaaacgaagatcactggttctccagagaaaattcttactcgggtgtggagggcgaggggctgcacaagctagggtatatactcagagatatcagcaagattccaggaggagccatgtatgcagatgataccgcgggttgggatacacgaattaccgaagatgacttgcataatgaggagaaaataacacagcagatggatccagaacatagacaattggctaacgcaatattcaagctaacctaccagaacaaggttgttaaagttcaaagaccaacaccgacaggtacggttatggatattatttcaagaaaagatcaaaggggaagcggacaagtaggcacttatgggctaaacacatttactaacatggaggcccaattaattagacaaatggaaggtgagggggtattaagcaaagccgatttggaaaatccacaccttcctgaaaagaagataacccaatggctggaaacaaaaggtgttgaaaggctaaaaagaatggcaattagtggagacgattgtgtagtaaaaccgatagatgacagattcgcaaacgcattattggccttgaatgacatgggcaaagtacgtaaagatatacctcaatggcagccatcaaaaggatggcacgactggcaacaagtccccttttgttcacatcatttccatgaactcatcatgaaggacggcaggaaactcgtagtcccgtgtcgtcctcaagacgaacttataggacgagcgaggatatcacaaggtgcggggtggagtcttaaagaaacagcatgtctaggaaaagcatacgcgcaaatgtggagtcttatgtattttcacagaagagatctcagactcgcatccaatgcaatctgttctgcggtaccagttcattgggttccaacaagcagaactacctggtcaattcatgcacaccatcaatggatgaccactgaggacatgttaacagtctggaatagagtctggatagaagacaacccatggatggaagataagaccccagttaccacatgggagaatgtaccatacttaggcaagcgggaggatcaatggtgtggtagcctaatagggttgacaagtcgagccacctgggctcaaaatattccaacagcaattcaacaagtgagatcattgattggaaacgaagaatttcttgattacatgccgtccatgaagaggttccgaaaggaggaggagtcggaaggcgctatatggtga

SEQ ID NO: 23170 - RNA, 9873 nt, synthetic construct
  misc_feature 1..9873: note = derived and/or modified CDS sequence (opt6) from DENV-3__FJ898476__SS-prME
  source 1..9873: mol_type = other RNA
acaagtctatgtctcatgatgattctaccagctgcactagcatttcacttgacaagtcgcgacggagaaccgagaatgatcgtcgggaaaaacgaaaggggaaaaagcctcctttttaaaactgctagcgggatcaatatgtgcactctaattgcaatggatctaggagagatgtgcgatgatacagtcacatacaaatgcccgcacataaccgaagtggaacctgaggacatagattgctggtgtaatctcacttccacatgggtaacatatggaacgtgtaatcaagcaggagaacataggagagataaaagaagcgttgccctcgcaccacatgtaggtatgggcttagatacacgtacgcaaacttggatgagcgctgagggtgcgtggaggcaagtggagaaagttgaaacatgggctctccgtcatccggggtttacaatacttgcgttgtttctagcacattacataggaacaagtttaacgcaaaaagtagttatttttatcctattaatgctggtaacacctagtatgactatgagatgcgtaggcgtcggaaatcgcgattttgtagaaggactcagtggggcaacttgggtggacgtagtcctcgaacatgggggatgtgttaccacaatggccaaaaacaaaccgacgctggacattgaattacagaaaactgaagctacacaattagctacgttaagaaaactatgcatcgaaggcaaaataaccaacatcacgacagactcacgctgtcctactcaaggagaggccaccttaccagaagaacaagaccaaaattacgtgtgcaaacacacgtatgtagatcgcggctggggaaacggttgcggcctctttggaaaaggcagcttggttacatgcgctaaatttcaatgcctggagccaattgagggaaaagtggtacagtatgaaaacttgaaatacacagttatcatcaccgtgcatacaggggatcaacaccaagtaggtaacgaaacacaaggcgttacagctgaaataactccacaagcgtctacgacagaagcaatattacctgaatatggtacattaggattggaatgctcgccacgtacaggacttgactttaatgaaatgattcttcttactatgaaaaataaagcatggatggtacaccgacagtggttctttgatcttcccttaccatggacgtccggggcaactaccgaaacacctacatggaaccggaaagaactactggtaacatttaaaaacgcgcacgctaagaaacaagaggtagttgtactaggatcgcaagaaggagcaatgcacactgctttaaccggagcaacagaaattcaaaatagcgggggaacatccatcttcgcaggacatctaaaatgcagacttaaaatggataaactagagttaaaagggatgtcgtatgcaatgtgtacaaacacattcgtactcaagaaagaggtaagcgaaactcagcatggaacgatattaataaaagtagaatataaaggagaagatgtgccctgtaaaataccttttagcacagaagatggacaaggaaaagcacataacggcaggttaataacagcgaacccggtcgtaactaagaaagaggaacccgtgaatatagaagccgaacccccatttggtgaaagcaatatagtaataggtataggagataatgctctgaaaatcaattggtataagaaaggcagttcaataggaaaaatgtttgaagccaccgcccgtggagcaagacgaatggctatcttgggagatactgcttgggactttggatcagtagggggtgtactaaactcgttgggcaaaatggtacaccaaatttttggatcggcgtacacagcattattttcaggagtaagttgggtgatgaaaataggaattggggtcctccttacatggataggtttaaacagcaaaaacacatcaatgagtttctcatgtatagctattggtataataactctttacctaggcgctgtcgtacaagcggatatgggatgcgtcataaattggaaaggaaaagagttgaagtgcggaagtggaattttcgtaacgaatgaagttcatacttggacagagcaatacaaattccaggcagactcaccgaaacgcctagctacagccatagccggtgcatgggagaatggcgtctgcggtatccgctcaactaccagaatggaaaatctcctgtggaaacagatcgctaatgaactgaattatatactctgggagaataatatcaagctgaccgtagtagtgggagatattataggtgtattagaacaaggaaagagaactttgactccacaaccaatggaactcaaatactcttggaaaacttgggggaaggcgaaaatagtaaccgcagaaactcagaatagcagttttatcatcgatgggccaaacacaccagaatgcccgtcggtaagcagggcttggaatgtatgggaagtagaagactatggattcggtgtatttactaccaatatctggttaaaactaagagaagtatatactcagttatgtgatcacagactcatgtcagctgctgtaaaagacgagagggcggtacatgctgacatgggatattggatagaatcccagaaaaatggaagttggaaactagagaaggcatctctaatagaagttaaaacatgcacttggccaaagtcccatacgttgtggagtaacggggttttggaaagcgacatgattattcctaaaagccttgcaggtcctataagccaacacaatcacagaccaggataccacacacaaacagcgggaccatggcatctaggaaaattagagttagattttaattattgtgaaggaaccacagttgtaattacagagaactgcggcacacgtgggcccagcttgaggactactactgttagtgggaaactcattcacgagtggtgctgcagatcgtgcacactgccaccactcaggtacatgggtgaagacggatgctggtatggtatggagataaggccaataagtgaaaaggaagaaaatatggtaaaaagtttagtatcagctggcagtggtaaagtcgacaactttacaatgggggtgttatgtctggctatattgtttgaagaagttatgcgaggaaaatttggcaagaaacatatgatcgcaggggtcttctttacatttgtattacttctaagtggacaaataacgtggcgtgacatggcacatacactgattatgataggaagtaatgctagtgatcgcatgggaatgggcgtaacgtatctagccttaattgctacctttaaaatacaacctttcctagcacttggattctttcttcgaaaattgacaagtcgtgaaaatctacttttaggagttgggttagcaatggctactacgttgcaattaccagaggacattgaacagatggcaaatggcattgcacttggtttaatggctttaaaattgataacgcaatttgaaacatatcaactctggacagcattgatcagcctcacatgtagtaacacgatctttacactaaccgtggcgtggcgtacagccactctaattttagcgggtgtatcgcttctcccagtctgtcaatcgagtagtatgagaaagacagactggttgccaatggcagtagctgcaatgggagtacccccactcccgctgtttatttttggattgaaagatacattaaaacgtagaagttggccattaaatgaaggcgttatggcggttggacttgtcagtatcctagctagctccttgctaagaaatgatgtacctatggcaggacctcttgtagcaggaggattattaatcgcgtgttacgtcattactggtacttcagccgatttaacggtagaaaaggccgctgatatcacctgggaagaagaagccgagcagacaggagtatcgcacaacttaatgattacagtcgatgatgacgggacaatgagaataaaagacgatgaaacagaaaatatactgactgtattactgaaaactgctctactcatcgttagtggaattttcccttattctataccagctacactgttagtatggcacacgtggcagaaacaaacgcaacggagcggagtattgtgggatgtgccaagccctccagaaacgcaaaaagccgagctagaagaaggcgtgtacagaataaagcaacagggaatatttgggaaaacgcaagtaggggtcggggtacaaaaagaaggtgtcttccatacaatgtggcatgtaacacgtggcgctgtacttacttataatggtaaaagactggaacccaactgggcaagtgtgaagaaagatctaataagctacggtggtggctggagattatcagctcaatggcaaaaaggagaggaagtccaagtgatcgcagtagagccgggaaagaaccccaaaaacttccaaacaatgccaggaaccttccaaactacaacgggtgaaatcggagcaattgccttagactttaagcctgggacaagtggatcaccaataattaaccgggaagggaaggtggtaggtctatatggaaacggcgtcgtgactaaaaacggtgggtatgtgtcaggcatcgcgcagacaaatgcagaaccagatggccctacacctgaactagaggaagagatgttcaagaaaagaaacctaacaattatggacctacatccgggttcagggaaaacacgcaaatacttaccagccattgtaagggaggcaattaagcgtcgacttagaacccttatacttgctcctacgagagtcgtagccgctgaaatggaagaagccctaaaaggtttacccattcgttaccaaactactgccaccaagtcagagcacacgggccgagagattgttgacctaatgtgtcatgcgacatttaccatgcggctgctaagtcccgtacgtgtgcctaactataatcttattataatggatgaggcacattttacagatcccgcgtctatcgcagcacgcggttacatcagtacaagggttggaatgggcgaagccgctgcaatattcatgacagcaacaccaccaggtacagcagatgcttttccacaaagtaacgccccgatacaagatgaagaaagggacattccagaacggtcatggaactcagggaatgaatggattacagattttgccggaaaaaccgtatggtttgtgccgagcatcaaggcggggaatgacatcgcaaattgcttaagaaagaatggtaagaaagttatccaattatctagaaaaacctttgatacagaataccagaaaacaaaactgaatgactgggattttgtggtcacgacagatatatctgaaatgggtgcaaatttcaaagctgatcgggtcatagacccgagaagatgtctaaagcctgtcatactcacggacggtcccgaacgggtaatactggcaggccccatgccagtaaccgctgcaagtgccgcacagcgaagaggaagagtaggaagaaaccctcaaaaagaaaacgatcagtacatatttactggacaaccattaaataatgacgaagatcatgcccactggactgaagcaaaaatgttactagacaacatcaacacaccagaaggtattattcctgcactatttgagcctgaaagagaaaaatcggcagccattgatggcgaataccgactaaagggggagagtaggaaaaccttcgtagaactcatgcgcagaggagatctccctgtctggctagctcacaaagtagcaagcgaaggaattaaatacacggatagaaaatggtgttttgatggccaacgcaataaccaaattctggaagaaaatatggacgtcgaaatatggactaaagagggagagaagaagaaattaagaccaagatggctagacgcaagaacatactcagatccactagccctaaaagaatttaaagaatttgccgcagggaggaaatcgatagccctagatctagtaacagagattggacgagtaccaagtcatttagctcatcgaacaagaaatgcacttgacaatctagttatgttacacacgagcgaacacgggggtagagcctataggcacgctgtagaagaacttccggaaacaatggaaacgttgttactcctagggttgatgatactgttgacaggaggggctatgttatttttaataagtgggaaaggtataggaaagacgagcatcggcttaatatgtgtcatagcctctagtggaatgttatggatggcagaaataccccttcagtggattgcatctgcaatagtattggaatttttcatgatggtactactaatcccagaacctgaaaagcaaagaacacctcaagataaccagttagcatacgtagtaatagggatactgactttggcggccattatcgccgcgaatgagatgggtctactggaaaccacaaagcgggatttaggaatgtctaaagaaccaggcgtcgtgtcacctacatcgtacctagacgtggacttgcacccagcttctgcttggaccctttacgcagtcgcaaccactgtaattacacccatgctgagacatacaattgaaaactcaactgctaatgtgagtcttgctgcaatagcaaaccaagccgttgtcctgatgggattggataaaggatggccaatctcaaaaatggacttgggtgttcccttgcttgcactgggatgttatagtcaggtcaaccccttgaccctaacagcagctgtcttattacttataacacactatgcaattataggaccaggtctgcaagcgaaagctacacgagaggcccaaaaacgaacggcagcaggtatcatgaaaaatcctaccgtcgatggtattatgacaatcgatttggatcctgttatatatgattctaaattcgagaaacaattgggacaagtgatgctgctagtactttgcgccgtacaattgctactaatgcgcacctcctgggcattgtgcgaagctctcactctagctacaggtcctataacaaccttatgggaaggttcaccaggtaaattctggaatacaactatagcagtaagtatggcaaacattttcagagggagttacttagctggagctggcctagcatttagcattatgaaaagtgtgggtacagggaaaagaggaacgggttcccaaggtgagacacttggagaaaaatggaagaagaaattaaatcaactctcacgaaaggattttgatttatacaagaaaagcggcattaccgaagtagacagaacagaagctaaagaaggacttaagagaggagaaatcactcatcacgctgtatcaagaggctctgccaagttacagtggtttgtcgagagaaatatggtaattccggagggacgcgtaatagatttaggctgtggacgtggtggttggagctattattgcgcaggattaaagaaagttacagaagtacgaggttatacaaaaggaggaccgggtcacgaggaaccagttccgatgtctacgtacggttggaatattgttaaactaatgagtggaaaggacgtattttacttaccgccagaaaaatgtgatacgcttttatgtgacataggagaatcatcaccctctccaacagtcgaagagtctcgcacgataagagtcctcaaaatggttgaaccatggctgaagaataatcaattctgtataaaagtactgaacccatatatgccaactgttattgaacatctagaaagattacaaagaaaacatggaggtatgcttgtaaggaatccgctaagtcgcaattcaactcatgaaatgtattggatatcaaatggtacaggcaacatagtagcgagtgtcaacatggtttctagattattactgaacaggttcacaatgacgcacaggaggcctacaatagaaaaagatgtcgatttaggagccgggactcgacacgtgaacgcggaaccggaaactccaaacatggacgtcatcggagagagaatcaagcgaatcaaagaggagcataattcaacctggcattacgatgacgaaaacccgtacaaaacgtgggcctaccatggatcgtatgaagtaaaagcgactggtagcgcgtcgtcaatgatcaatggagtagtcaagctattgacaaagccatgggatgtggtaccaatggtaacgcagatggctatgaccgataccactccctttggtcagcaacgggtttttaaggaaaaagtagacacaagaactcccagaagtatgccgggtacgagacgagtaatgggaattacagccgaatggctctggagaactttgggaaggaataagaaaccaagattatgtacgcgggaggagtttactaaaaaggtaaggactaatgctgcaatgggtgccgtattcactgaagaaaaccaatgggatagcgcaaaagccgctgtcgaagatgaggatttctggaaattagtagaccgtgaaagggaattgcataaactagggaagtgtgggagttgtgtctacaatatgatgggaaaacgtgagaagaaattaggagaatttggcaaagcgaaagggtctagagcaatttggtacatgtggttgggtgcaagatatttagaatttgaggctttgggctttctaaatgaagatcattggtttagcagagaaaattcctatagtggggtcgaaggggaaggtctacacaaactaggctatatattaagagacattagtaaaatcccgggtggagctatgtatgcagacgatactgctggttgggatacacgcatcaccgaagatgatttacacaacgaagagaaaataacccagcaaatggatcctgaacataggcaacttgccaatgcaatattcaaacttacttaccagaataaggtggtcaaggtacagagaccaactccgaccggaacagttatggatatcattagtagaaaagatcaacgcggaagtggtcaggttggtacttatggcctaaatacgtttacaaacatggaagcacaattaatcagacagatggaaggtgaaggagttctatcaaaagctgacctagaaaatccacatcttcctgagaagaaaataactcaatggctagagacaaagggagtagaaagattaaaaagaatggcgatttcaggtgatgactgtgttgtaaaaccaatagatgatcggttcgcaaacgcgttattggcattaaatgatatggggaaagtacggaaagacatacctcaatggcagccgtcaaaaggatggcatgactggcaacaggtgccattctgtagtcatcacttccatgaacttataatgaaagacgggcgaaaattagttgttccctgtcggccacaggatgaacttataggcagagctaggatatcacagggtgcaggttggtctttgaaggaaacagcttgcttaggtaaggcatacgcacagatgtggtcattaatgtacttccatagaagagatttaagactggcgtcaaatgccatatgctctgcggtaccagtacattgggtgcccacttcaagaacaacctggagcatacatgcacaccatcaatggatgacaacagaagatatgttaacagtatggaacagagtttggatagaagataatccatggatggaagataaaactcctgtcactacttgggaaaatgtcccatatctgggaaaaagagaggatcaatggtgcggttcgcttatcggactcacttcaagagctacatgggctcaaaatataccaactgctattcaacaggtacgatctttaatcggaaacgaggaatttctggattacatgcctagtatgaaacgatttagaaaggaagaggaaagtgaaggggctatctggtag

SEQ ID NO: 23171 - RNA, 9873 nt, synthetic construct
  misc_feature 1..9873: note = derived and/or modified CDS sequence (opt6) from DENV-3__FJ898475__SS-prME
  source 1..9873: mol_type = other RNA
acatcattatgtttaatgatgatacttccggctgcgcttgcatttcacctaacatcacgtgacggggaaccccgaatgatagtaggcaaaaatgaaagaggtaaaagcctattattcaaaacggcatctggtattaatatgtgtacactgattgcgatggaccttggagaaatgtgcgacgacactgttacttacaaatgcccacacatcacagaagtggaaccagaagatatagattgttggtgcaaccttacgagcacatgggtcacgtacggtacgtgtaatcaagcaggagaacaccgtagggataaaagatccgtggccttagcacctcacgttggaatggggttagatacacgaacacaaacatggatgtctgctgagggagcatggcggcaagttgaaaaagttgaaacatgggcattgagacacccgggattcacgatcttagctctgtttctcgcacactatataggaacatctttaactcagaaagtggttatattcattttgttaatgcttgttacaccaagtatgactatgcgttgtgtcggagtcggaaatcgagattttgtggagggcctaagcggtgcaacgtgggtagatgtagtattagagcatggaggttgtgtaacaacgatggctaaaaacaaaccaacactagatatagaactccagaaaactgaggcaactcaactcgctactctcagaaaattgtgtattgagggaaaaataacaaacataactacagactcaagatgtcctacacagggtgaagcaaccctaccagaagaacaagaccaaaactacgtctgtaaacatacttatgtagataggggatggggaaatggctgtggtttatttgggaaaggatcattagtcacctgtgcgaaatttcaatgcttagaacccatagaaggcaaagtagtgcagtatgaaaatctaaaatacaccgtaataattacagtacacacgggtgaccaacatcaagtgggtaacgaaacacaaggagttactgcggaaattacacctcaagcatcgactaccgaagcaatactaccagaatatggcactttagggctggaatgctcaccgaggacgggactggatttcaacgaaatgattttattaacaatgaaaaacaaagcatggatggtacatagacaatggttctttgatctccctctcccgtggacgtccggagccactacagaaacaccgacttggaaccgtaaagaattattggttacatttaaaaatgctcatgcgaaaaagcaggaagtagttgttctgggatctcaagagggtgccatgcatacggcgctcacaggcgctacagaaattcagaactcaggcggaacgtcgatattcgcaggtcatcttaaatgtagactaaaaatggacaaattggaactgaaagggatgtcgtacgcgatgtgcactaacacattcgtattgaagaaagaggtttctgagactcagcatggtaccatattaataaaagtagagtacaaaggagaagatgtaccatgtaaaatccctttcagcacagaagatggacagggtaaggctcataatggtcggctcatcactgcaaatccagtagtaaccaaaaaggaggaaccagttaatattgaagctgaaccacctttcggcgaaagcaacatagtaatagggatcggagacaacgcacttaagataaattggtacaaaaagggtagttcgataggcaaaatgtttgaagccacagcgcggggagcgaggagaatggcgattttaggagatactgcgtgggatttcgggtcagttggaggcgtattgaacagcttaggtaagatggtccaccaaatatttgggtcggcgtatacagcgctctttagcggtgtttcgtgggttatgaaaatagggattggggtcttacttacgtggatcggactaaacagcaaaaacacaagcatgtctttctcgtgcatagctatcggtataataactttgtatttaggcgcagtggttcaagctgacatgggctgcgtcatcaattggaaaggaaaggagttaaaatgcggatcgggaatatttgtaacaaacgaagtacatacatggacggaacaatataaattccaggctgatagtccaaaacgactggcaacggctatagcaggggcatgggaaaatggagtatgtggaatacgtagcacaactcgtatggaaaacttgttatggaaacaaattgctaatgaactcaactatattctgtgggaaaacaatataaagttaaccgtcgtagttggagatatcataggagttttagagcaaggaaaacgtacacttacaccccagcctatggaattaaagtattcatggaagacgtggggaaaagcaaaaatagtaactgcagaaacacaaaattcttcattcatcatcgatggaccaaacactcccgaatgcccatctgtgagtagagcctggaatgtctgggaagttgaagactatggtttcggtgtgtttacgaccaatatttggttaaaattaagagaggtgtacactcaattatgcgatcatagattaatgtcggctgcagtgaaggacgaaagagcggtgcatgctgacatgggctactggatagaaagtcagaagaacgggagttggaaattagaaaaagcctcccttattgaggtaaaaacttgcacgtggccaaaatcgcataccctatggagcaatggcgttttagagtcagacatgataataccaaaatcgcttgcgggaccaatatcacaacataaccaccgaccagggtaccacacgcaaacagcaggaccgtggcacctaggaaaattagaacttgattttaactattgcgaaggaacaacagttgtaataaccgaaaactgtggtacgaggggaccaagtttacgtaccacaacagtatctggaaaactcattcatgaatggtgctgtagaagctgcacgctacctccactaagatacatgggtgaggatggttgttggtacggcatggaaattcgaccaatatctgaaaaagaagagaatatggtaaaaagtttagtatccgcagggtctggaaaagtagataactttactatgggagtcttatgcttggcaatcctattcgaggaagtaatgcgcggaaaattcggaaagaaacatatgattgctggtgtatttttaacgttcgtactactcctatctggccaaattacttggagagacatggcacacacactgatcatgattggaagcaatgccagtgataggatgggcatgggtgtgacatacttagctttaatcgcaacgtttaaaatacagcctttccttgctctaggattctttctcagaaaactcacatcacgcgaaaatttattactaggggtaggattagcaatggcgacaaccttacaactccccgaagatatcgaacaaatggcgaatggaatagcattaggactgatggcgttaaaattaataactcaattcgaaacatatcaactttggacagcacttatctcactaacgtgctcaaatacgatatttacgcttacagttgcatggaggacagcaacgttaatccttgcgggcgtatcgttgttgccagtatgccaaagctcaagtatgcgaaaaactgattggttaccaatggctgtagcagctatgggggttccacctctaccactatttatattcagtcttaaagatacactaaaaagaagaagttggcccttgaatgagggagtgatggcagttggtcttgtttctattctagcttcatcactattacgcaatgatgtccccatggctggcccactcgtagcaggaggactgcttatagcatgctatgttataacagggacaagtgcagacctgacagtagaaaaagccgctgatataacgtgggaagaggaggcagaacaaacaggagtgtcacacaacctaatgataactgtcgacgacgatggtacaatgagaatcaaggacgacgaaaccgaaaacatactgacagttttactcaagaccgcattactgattgtatccggaatatttccatattcaatacccgccaccttactggtctggcacacatggcaaaaacaaacgcaaagaagtggggttttatgggacgtaccctcaccaccggaaacgcaaaaagctgagctagaagagggtgtatatagaataaagcaacaagggatatttggaaaaactcaggtaggtgtaggcgttcaaaaggaaggagtattccatacaatgtggcacgttacaagaggcgccgtactaacctacaatggtaaacgattggaaccgaactgggcgtcggttaagaaagatctgatttcatacggtggaggttggcgcttgtcggcgcaatggcagaaaggagaggaggtacaggttatagcagtggaaccaggtaaaaatccgaaaaatttccaaacgatgcctggaactttccaaacgacaacaggcgaaataggggcaattgcattagatttcaaaccaggcacaagtggttcaccaatcataaaccgagaaggtaaagtagtcggattatatggaaatggagtcgtaaccaaaaatggtggatatgtgagcgggatcgcacagacaaatgcggagccagacggtcccactccagaattagaggaggaaatgttcaagaagagaaatttgacaataatggatcttcatccaggatcgggcaaaacaagaaagtatctacccgcaattgtcagagaagccattaaaagacgactaaggacactaatattggctcctacaagagtagttgcagcggagatggaggaggctctaaaagggctcccaatacgatatcagactacagcaacaaaatcagagcatactggtagggaaatagtagacctaatgtgtcacgcgacctttacaatgcgactgttatcgcctgtaagagtacctaattataatctgataatcatggacgaagcccactttacggacccagcttcgattgctgctagaggatatatatcaactagggtaggaatgggagaagctgctgcaatattcatgacagctaccccgccaggaactgcagacgcttttccgcaatctaatgcccctattcaagatgaggagcgagacattcctgaaagatcgtggaactctggcaacgaatggattacggactttgcaggtaagactgtatggttcgttccaagtataaaagccggaaacgacatagcaaattgcttacggaagaacggcaagaaagtgattcaactgagtcggaagactttcgacaccgagtaccagaaaacaaaactcaacgactgggacttcgttgtaacgactgatatatctgaaatgggtgcaaactttaaagccgacagggttatcgaccccaggagatgtctgaaacctgtgatactaaccgacggtccggagcgtgtgatactcgctgggccgatgccagtcacagcggcatccgcagcacaacgcagagggagagtaggccgcaacccacaaaaggaaaatgatcaatacatctttacgggccaacctttaaataatgacgaagaccatgcacattggactgaagccaagatgctattggataatataaacaccccggagggcattattccagccttgtttgaaccggaacgtgagaaaagcgcggctattgatggagaatatcggttgaaaggagaaagccggaaaacttttgtagagctaatgagaagaggggatctgcccgtatggctagcacataaggtagcaagtgagggtatcaaatatactgaccggaaatggtgttttgacggtcagagaaataatcaaattctcgaagagaatatggacgtagagatatggacaaaagaaggagagaagaagaaactccggcctagatggttagacgcccgtacctatagcgacccactggctctaaaagagtttaaagaatttgcagcaggtaggaaaagcattgcattggatttagtcacagagataggccgagtaccatcccatctagcacacaggacacgtaacgctctggataacttagtaatgctacacacttcagaacatggaggacgggcgtatagacatgccgttgaggaactgccagaaacgatggaaacattgctactccttggactaatgatattactaacaggaggtgcgatgttatttctcatcagcggtaaaggtataggcaaaacgagcataggtcttatctgtgtaatagcgagttcagggatgttatggatggccgaaataccgttacaatggatagcatcagccatagtcttggagttctttatgatggtattgctgatcccagaaccagaaaaacaaagaacaccgcaggacaatcagctggcgtacgtggttattggaatactaacattagccgcaataatagcagcaaacgaaatgggtttgctagagacaacaaaaagggatttaggtatgtctaaagaaccaggggtagtatcacccacctcctaccttgatgtagatctccacccagcatctgcgtggacattatatgccgtggcaaccacggtcataacgccgatgttgagacacacgattgaaaactcaacagcaaatgtctcactagcggcaatcgcaaatcaagctgtggtattaatgggattggacaaagggtggccaatctccaagatggaccttggagttccgctattagcacttggatgctacagtcaggtcaatccactaaccttgacagctgcagtccttttattaataacccattatgcgattatcggaccgggccttcaagccaaagcaactcgagaagcccagaaacggacagccgccggcataatgaaaaatccaacagtagacggaataatgacaatagatctagatcctgttatttatgactctaagtttgaaaaacagctaggacaagtaatgctattagtgttgtgcgctgtacaattattgctcatgcgaacgtcatgggcattatgcgaagcattgacattggcgaccggacctataaccacgctatgggagggatcaccaggtaaattctggaatacaacaattgctgtgagtatggccaatatttttcgcggatcttatttagcaggggctggtttagctttctctatcatgaaaagtgttggtacaggaaaaaggggtaccggaagtcaaggtgaaacattaggcgagaaatggaaaaagaaattgaaccaactgtcaagaaaagactttgatctatacaagaaatcaggaattaccgaagtagacaggaccgaagcaaaagagggcctgaaaagaggagagatcacacaccacgcagtaagccgcggatctgcgaaactacaatggttcgtcgaaagaaacatggttattcctgaagggagggttatagaccttgggtgtggtagagggggttggtcatattattgcgctgggctaaagaaagtgacggaggtgagagggtatacaaaaggaggaccagggcacgaggagccagttcctatgtccacatatggatggaatatagtgaaactgatgtcagggaaagatgttttctacttgcctcccgaaaagtgtgatactttgctttgcgacatcggggaatcatcaccatcacccacagttgaagagtctcgaacgataagagtactcaaaatggtagagccatggctaaagaataatcagttttgtataaaggtcctaaatccatacatgccaacggtaatagaacacttagagagattacaacgaaagcatggtggaatgttagttagaaatcctttaagtagaaattcaacacacgaaatgtattggatttcaaatggaactggcaatattgtagcaagcgtgaacatggtcagccgactgttattgaaccgatttaccatgactcacaggagaccaaccattgaaaaagatgtcgacttaggggctggtacgaggcatgtaaacgccgagcccgaaaccccgaatatggatgtgataggagaaagaattaaaagaataaaagaggaacataatagtacttggcactacgatgacgaaaacccatataaaacatgggcatatcacggcagttacgaagtaaaagcaacaggatctgcatcatcaatgattaacggagtagtaaaactgctaacaaaaccttgggacgtggtaccgatggtcacccaaatggcaatgacagacacgaccccatttgggcagcaaagagttttcaaagaaaaggtcgatactcgaacaccaagaagtatgccagggacacgaagggtaatgggtatcactgccgagtggctttggcggactctaggcagaaacaagaagccacgtctgtgtacaagagaagaatttaccaagaaagttcgaacaaatgcagcaatgggggcggtattcacagaagaaaaccaatgggactctgcaaaagcagcagtggaagatgaagatttctggaagctagtggatcgtgagcgagaactacacaaattaggcaaatgtgggagctgtgtatacaatatgatgggtaaaagggagaagaaactaggggagttcggtaaagcgaaaggaagtagagctatctggtacatgtggcttggcgcaagatatttagaatttgaagcactcggatttctcaatgaagatcattggttcagtagggaaaactcttattcgggcgtagaaggggaaggcctacataaacttgggtatattttacgtgacatttcgaagatacctggtggagctatgtacgcagatgacactgctggatgggatacgagaataactgaagatgacctacataacgaagagaaaattacccaacagatggatcctgaacatcgccagctggcaaatgcaattttcaagttaacataccaaaacaaagtagtaaaagttcaaaggccgacacccactggcacagtgatggacataatctcgcgaaaggatcaacggggttcaggacaagtgggaacatatggattaaatacctttacaaacatggaagcccaactaataaggcaaatggaaggcgaaggagtattatctaaggcagacctagaaaatcctcatctgccagagaagaaaataactcaatggttggagaccaaaggtgtagaacgcctaaaaagaatggcaatttcaggtgatgattgtgtagtgaaacccatagacgacagattcgcaaatgccctgctcgcgctaaatgatatgggaaaagtaagaaaagatatacctcaatggcaacccagcaaaggatggcatgactggcaacaagtacctttttgttctcatcatttccacgaattaatcatgaaagatgggcgtaaacttgtggtgccatgccggccccaggatgaactaattggaagggctaggatttctcagggcgcgggatggagtttaaaggaaacggcctgtttgggcaaagcctatgctcaaatgtggtctctaatgtattttcacagaagagatctcaggttagcgtcaaatgcaatatgctcggcagttccggtacactgggtaccaacctcaagaacaacctggagtatacatgcccatcatcaatggatgacaaccgaggatatgttaaccgtgtggaaccgcgtatggatagaagacaatccctggatggaagataaaacaccagtcacaacgtgggaaaacgtaccatacctaggcaaaagagaagaccaatggtgtggttcgcttataggattaacatcaagggcgacatgggctcaaaacatacccacagcaatacaacaagtacgctcattaatcggaaatgaagaatttttagattatatgcctagtatgaaacgttttagaaaagaagaagagtctgaaggggcgatatggtag

SEQ ID NO: 23172 - RNA, 9873 nt, synthetic construct
  misc_feature 1..9873: note = derived and/or modified CDS sequence (opt6) from DENV-3__GQ199861__SS-prME
  source 1..9873: mol_type = other RNA
acttccctatgcttgatgatgatactgcctgctgcactagccttccaccttacctcaagagatggagaaccacgcatgatagtcggcaaaaacgaaagaggtaaaagtctgcttttcaaaactgcatcggggataaatatgtgtactttaatcgctatggatctaggtgaaatgtgtgatgacactgtaacatataaatgtccgcatattaccgaagtagaaccggaagacatcgattgttggtgtaatttaaccagcacttgggttacatacgggacatgtaatcaagccggggaacatagacgcgacaaacgttcagtagcattagcgccgcacgtaggtatgggattagatactcgaacccaaacgtggatgagtgcagaaggtgcctggaggcaagtggagaaagtagaaacatgggctctaaggcacccaggattcacgatattagccctgttcctagcacactatataggtacaagtttaacacaaaaagttgttatctttattcttttaatgttagtaacaccatcaatgaccatgagatgtgtaggcgtgggaaacagagacttcgtagaaggattatcaggggcaacatgggttgacgtagtactagaacacggaggatgtgtcacaactatggcgaaaaataaacctactctcgacatcgagctacagaaaacagaagctacccaattagctacgcttaggaaactttgcatcgagggaaaaatcaccaatataacaactgacagcagatgtccaacacaaggtgaagctacgttaccagaggaacaagatcagaactacgtatgtaaacatacttacgtggatcgtggatgggggaacgggtgtggactttttggcaaaggctcgctagtaacctgtgcgaaattccagtgcttagagccaattgaaggaaaagtagtacaacatgaaaatttaaaatacactgttattataactgtacataccggcgaccagcatcaggttggaaatgaaacacaaggggttacagcagaaataacaccgcaagcctccactacggaagcaatcttgccagaatatggcactctcggattagaatgttcacccagaacaggattagacttcaatgagatgatcctactaacgatgaaaaataaagcatggatggtacacagacaatggttctttgacctacccttaccgtggacgagcggagccactaccgaaacaccaacctggaatcgaaaagaactcttggttacctttaaaaatgctcatgcaaagaaacaagaggtagtcgtattaggttcgcaggaaggagcgatgcacactgcattaactggagcaacggaaattcaaaattcgggtggtacaagtatcttcgcaggacatctaaaatgtcgtttaaaaatggacaaattagaacttaaagggatgagttacgccatgtgtacaaatacgtttgtacttaagaaagaagtatctgaaacccaacatggtacaatcttgatcaaagtagagtataaaggagaagatgtaccttgtaaaataccatttagtacagaagacggtcaaggaaaagctcataatggacgtctgattacagctaatcctgtggtcactaagaaagaagaaccggtaaatatagaagcggaacccccgtttggtgagagcaatatagttataggtatcggagataacgctctcaaaattaattggtataagaaaggttccagcataggaaaaatgttcgaagcaactgcaagaggagcccgaagaatggcaattcttggagatacagcctgggacttcggttcagtaggaggtgttctaaactcacttgggaagatggtgcatcaaatattcggttccgcttacacagctttattttctggagtctcatgggtcatgaaaatcgggattggcgtactgcttacttggatcggacttaatagcaagaacacttctatgagtttctcgtgtatagcaataggaatcattaccctatatttaggcgccgtagtgcaagcagatatgggttgtgtgataaactggaaaggaaaagagctaaaatgtggctccggcatctttgtgaccaacgaagtacatacgtggacagaacaatataagttccaagcagactcaccgaaaagattagccactgctatagcaggagcgtgggagaatggtgtttgtggaataaggtcgacaacgagaatggaaaacttactatggaaacaaatagcaaatgaactcaattacattttatgggaaaacaatatcaagctaacggttgtagtaggagatataatcggcgttctcgaacaaggtaaacgaactctcacgccacagccgatggaacttaagtattcatggaaaacatggggaaaagctaaaattgttactgcggaaactcaaaattcttcatttataattgatggaccaaatacccccgagtgtccatctgtaagccgagcatggaacgtatgggaagtcgaagattacggatttggagtctttactaccaatatatggctgaaattgagagaggtctacacgcagctatgcgaccatagactgatgtcagcagcagtgaaagatgaacgggcagtccacgcggacatgggttattggattgaatcacagaaaaatggttcgtggaaactggagaaggcttcacttattgaagttaagacctgcacatggccaaaatcgcatacgctatggtcaaatggagtattagaatccgatatgataatccctaaatcattagcaggaccaatatcacaacataatcatcgaccgggataccatacgcaaacggcaggcccgtggcatctaggcaaacttgaattagattttaattattgtgagggtaccactgttgtaattacagaaaactgtgggactaggggaccctcacttagaactaccaccgtctcaggcaagctaatacacgaatggtgctgtcgatcgtgcacacttccgccactgaggtatatgggggaagatggatgttggtatggcatggagataagaccaataagtgagaaagaagagaacatggttaaaagccttgtatctgctggaagtggaaaagtagataatttcactatgggggtattatgcctcgcaatattatttgaggaagtaatgagaggaaaatttggaaagaaacacatgattgcgggtgtgttctttacatttgttttacttctgtcaggacaaattacatggagagatatggcacatacccttataatgataggttccaatgcatcagatagaatgggaatgggtgttacatatttagcgttaattgcgacatttaagattcaaccatttctagcactgggattctttttaaggaaactaacttcccgagagaatttactgcttggagtagggttagcgatggctactacactacaactaccagaagatatagaacagatggcaaatgggatagcccttggtttaatggctttgaaacttataacacaattcgaaacttaccaattatggacagcattaattagtttaacctgctcgaacacaatatttactctgaccgtggcctggcgaactgccacccttattttagcaggagtatccctattaccgatgtgtcaatcatcgtctatgaggaaaacagattggttaccgatggctgtggcagcgatgggtgtcccacccctaccattgtttatattttcgctgaaagacactttgaagcgtcgatcgtggcctttaaacgaaggagtaatggcggtaggcctggtcagcatactcgcatctagcttgctaagaaacgacgttccaatggcagggccattggtagctggaggattactgatcgcatgttacgtgattactggcaccagtgcagacttaactgtcgaaaaagcagctgacataacttgggaagaggaagccgaacagacgggggtgtctcacaatcttatgattacagtagatgacgacggtacaatgagaatcaaagacgatgagactgaaaacatattaacagtccttttgaaaactgcgttactcatcgtttctggcatatttccatactctatcccggccacgcttctagtttggcatacatggcaaaaacaaacgcaacgaagtggcgttctgtgggacgtaccgagcccaccagaaacacaaaaagcggaacttgaggaaggggtttacaggattaaacaacagggtatattcggaaagacccaagtaggagtcggtgtacaaaaggagggcgtatttcacacaatgtggcacgttacgcgtggtgcagtgctcacgtacaatggaaaacgattagaaccaaactgggccaatgtgaagaaagatttaataagctatggtggaggttggagacttagtgctcaatggcaaaaaggcgaagaggtacaagtaatagcagtagaaccaggcaaaaatcccaaaaatttccaaactatgcctggaacttttcaaacaaccacgggggaaataggagcaatcgcactagactttaaaccgggaacctcaggatcacctattataaacagagagggaaaggtggtcggtctatatggtaatggagttgtcactaaaaatgggggttatgtatcaggcattgcacaaactaacgctgaaccagacggacccacgccagaattagaagaagaaatgttcaagaaaagaaacttaacaataatggatctgcacccaggttcaggcaaaacccgaaaataccttccagcgatagtaagagaagcaataaaaaggagattgagaactcttattctggcacctaccagagtagttgctgccgagatggaagaagcattaaaaggcctcccgatcagataccaaactacagcaacaaagagtgaacacacaggtagggaaatcgtagacctgatgtgccacgcaacatttactatgcgtttgttaagccctgtacgtgtgccaaattataatctaatcattatggatgaagctcacttcacagatccagctagcatagccgcgagagggtatatatctacgagagtaggtatgggagaagcggcagcaattttcatgacagctacaccaccgggtacagccgatgcatttccacaatcaaatgccccaatacaagacgaggagagggatatccctgaacggtcttggaactctggaaacgaatggatcacagatttcgcaggaaaaacggtctggtttgtaccatctattaaagctgggaacgatattgccaactgtctaaggaaaaatggaaagaaagtaatacaattatcccgaaaaaccttcgacacagagtaccagaaaactaaattaaacgactgggattttgtagtcacgacggatataagtgagatgggtgcgaattttaaagcggacagggtcattgatccgaggagatgtcttaaacccgtcatcttaaccgacggaccagaaagggtaattctagcgggcccaatgcccgttacggcagcaagcgcagcacagcgtcgtgggcgagtaggtagaaacccgcaaaaggaaaatgatcaatatatctttactggtcaaccactaaacaatgatgaagatcatgctcattggacagaagcgaaaatgctactcgacaatatcaatacaccagaaggcattataccagccttattcgaaccagaacgcgaaaagagcgcagccatcgacggggagtacaggcttaaaggagaaagcagaaaaacattcgtagaattgatgagaagaggcgacttacccgtatggctagctcacaaagtcgcttctgaaggaataaaatacacagaccgtaaatggtgctttgatggacaacgcaacaatcagatactcgaggaaaatatggacgtggaaatctggacgaaagaaggagagaagaagaaattgcgtccacgatggttggatgcaagaacatatagtgacccgctagctctaaaagaatttaaagaatttgccgctggtagaaaaagcatagcgttagatttagtcactgaaatagggagggtaccaagtcatcttgcccaccgaacccgtaatgcacttgataatttagtgatgctacatacttcagaacatggcggtagagcatacagacatgcggttgaagaattgcctgagacaatggaaactttacttttactgggtctaatgatactcttaaccggtggcgcaatgttatttttaatttcaggtaaagggattggaaagacttctataggcttaatatgtgtaatagcatcgtccggtatgctctggatggcagaaatcccgttacaatggatagcgtccgcgatcgtacttgagttctttatgatggtgttactgataccagaacctgaaaaacaaaggacgccacaggataatcaattagcgtatgttgtaataggtattcttaccctagccgcaataatagcagctaatgaaatgggtttactagaaactaccaaacgagatctagggatgtcgaaggaacccggcgtggtaagtcctacttcgtatttagacgtcgatttgcatccggcttcggcatggaccctgtacgccgttgccactacggttataaccccaatgcttagacatacaatcgaaaactctacggcaaatgtttcattggctgccatagctaaccaagctgtagttctaatggggttagacaaggggtggcccatctccaagatggatttaggagtaccccttctggctttaggttgttactcgcaagtaaatcctcttactctgacagcagcagtgttactattgattacacactatgcaataataggcccaggactacaagctaaagcaacacgagaagcgcaaaaacgaacagcagcaggaattatgaaaaacccgacagtggacggaatcatgactatagacctagatccagtaatctatgactctaaattcgaaaagcaattaggtcaagtgatgctattagtattgtgcgctgttcagctgcttttgatgagaacatcatgggctctttgcgaagctcttactttggccactggtccgattaccacactatgggaaggaagtccaggcaaattttggaatacaacgatagctgttagcatggccaacatatttagaggctcctacctagccggtgctggtttggcgttctccattatgaagtccgtaggaaccggaaaaaggggtacaggtagtcagggtgaaacgctcggagaaaagtggaagaagaaactcaatcaattaagtcgaaaagacttcgacttatataagaaaagtggcattaccgaagtagatcgaacagaagcaaaagaaggattaaaacggggtgagatcactcaccacgcggtcagccgcggaagtgcgaaattacaatggttcgtagaaagaaatatggttataccagagggtagagtaatagatcttggatgcgggagaggaggatggtcctactactgcgcaggcttaaagaaagtgacagaagtaagaggttatacaaaaggtgggcccgggcatgaagaaccagtgccgatgagcacatacggatggaatatagttaagttaatgagtggaaaagacgtgttttacctccctcccgaaaaatgcgacaccttattatgtgacataggtgaatcttctccaagcccaacagttgaagaatcaagaaccatacgagtcttgaaaatggtcgaaccgtggctcaaaaataaccagttttgcataaaggtcctaaacccgtatatgcctacggtgatagaacacttagagcgattgcaaagaaaacatggaggtatgttggtacgtaatccattaagccgtaactcaactcatgagatgtactggataagcaatgggaccggtaatatcgtcgcgagtgtaaacatggtttcaaggttgcttcttaacagatttacaatgactcatcgaagacctaccattgaaaaagatgttgatctgggggcgggtacaagacatgtaaacgctgaaccagagactcctaatatggatgttatcggggaaagaataaaaaggataaaagaagaacacaattcgacatggcattatgatgatgagaatccatataagacgtgggcctaccacggatcgtatgaagtaaaagctacaggtagtgccagttctatgataaatggagtggtgaaattactcactaaaccatgggacgttgttcctatggtaacgcagatggcgatgactgacacaactccctttggtcaacaacgtgtatttaaagaaaaagttgatactcggacaccaagaagcatgccaggaacaaggcgagttatgggtataaccgcggaatggttatggagaactttgggtcgaaacaagaaaccgagactatgtactcgagaagaatttacgaaaaaggtaaggacaaatgccgccatgggggcagtattcacggaagagaatcaatgggattccgcaaaggcagcagttgaagacgaagatttttggaaattagttgatagagaaagagaattgcataaactcggaaagtgtgggagttgtgtgtataacatgatgggcaagagagagaagaaattgggggaatttggaaaagcaaagggcagtagagctatctggtacatgtggttgggagcaagatatttagaatttgaagcgctcggtttcttaaatgaggatcattggttcagcagagaaaacagttattcaggcgtagaaggtgagggattgcacaagctaggatacatattacgcgatataagtaagatcccgggtggagccatgtatgcagacgatacagctggctgggacacaaggattaccgaagatgatctacacaatgaagagaagatcactcaacagatggacccagaacatagacaattagctaatgcaatttttaaattaacttaccaaaataaggttgttaaagttcaaaggcccacgccaacaggaacagtaatggacataatttcccgtaaggatcaacgaggaagtggccaagttggcacatatgggcttaatacattcactaatatggaagcgcagctaatccggcagatggaaggtgaaggtgtactgagcaaggcagatttagagaatcctcatctacccgagaagaaaattacccaatggttggaaacaaaaggtgtcgaaagactcaaacgcatggcaatcagtggagacgattgcgtagtcaaaccaatagacgaccggtttgcgaacgctctattagcacttaatgatatggggaaagttaggaaagacattccacaatggcagccgagcaaaggatggcatgattggcaacaagttcctttttgcagccatcacttccatgaactcataatgaaagacggtaggaaactcgtcgtaccatgcaggcctcaagacgagttaataggacgagcgcgcatatcacaaggagcaggttggagccttaaagaaactgcttgccttggaaaagcatacgcacaaatgtggtccctaatgtactttcatagaagagatttaagattggcatcaaatgctatatgttccgcagtacctgtgcactgggtccctacaagtcggacaacatggtcaatacatgcccaccatcagtggatgacgacagaggatatgttaactgtatggaatcgagtctggattgaagataatccatggatggaagataagacaccagtgactacatgggaaaatgtgccatatttgggtaaacgtgaagaccagtggtgtggatctttaattgggctaacatcaagagcaacttgggcacagaacataccgacggcaatacaacaagttcgtagtctgattgggaatgaagaatttttagattatatgccatcgatgaaacggttcaggaaagaagaagaatcagaaggcgctatttggtga

SEQ ID NO: 23173 - RNA, 9873 nt, synthetic construct
  misc_feature 1..9873: note = derived and/or modified CDS sequence (opt6) from DENV-3__GQ199862__SS-prME
  source 1..9873: mol_type = other RNA
acatcgctgtgtttaatgatgattctacccgcagcactcgcgttccatttaacctcccgtgatggagaacctcggatgatagtcggtaaaaatgaaagaggaaagagcttgttattcaaaactgcatcgggaattaatatgtgcaccttaatagcaatggacctaggggaaatgtgcgacgataccgtaacctacaaatgcccacatataactgaagtcgaaccagaagacatagactgttggtgcaatctaacaagcacttgggtgacatacggtacttgcaaccaagctggtgaacatcggagggataagcggtcagtcgcactcgctccacacgtggggatgggtctcgatactagaacacaaacgtggatgagtgctgaaggggcttggcggcaagttgaaaaagtcgaaacttgggcgttacgacatcccggatttactatattagcattgtttctagcacattacattggcacatcattaacccaaaaagtagtcatattcatacttctcatgttggttacacccagtatgaccatgcgctgtgtaggagtcggaaaccgagatttcgtagaaggtttgtcaggagcgacatgggttgatgtcgtgttagaacacggaggatgtgttacaacgatggccaaaaacaaaccgacgttagacattgaactccagaaaacagaagccacacaattagcaactttgagaaaactgtgtattgaaggtaaaatcactaacataacaaccgattcaagatgcccaacacaaggtgaagcgacactgcctgaagaacaagaccaaaactatgtatgtaaacatacttacgttgacagaggatggggcaatggttgcggtctatttggaaaaggttccctcgtaacatgtgcaaaattccaatgccttgaaccgatcgaaggtaaagtagttcagtacgaaaatctgaaatatacagtcatcataactgtccacactggagaccagcatcaagttggaaatgaaacacaaggagtcactgcagaaatcactcctcaggcgtcgactactgaagcaatcctacctgaatatggaacactgggtttagaatgttcccctcgtactggtctcgacttcaatgagatgatactactaacaatgaaaaacaaagcatggatggttcaccgccagtggttctttgaccttcccttgccttggaccagcggggctacaactgaaacaccaacctggaacaggaaagaacttctcgtcacatttaaaaatgcacatgccaagaaacaggaggtggtagtcttaggaagccaagaaggagcaatgcatacggcacttacaggtgccacagaaattcaaaactctggtggaaccagtatctttgccggacacctaaaatgccgattgaaaatggataaactagagctgaaaggaatgtcctacgctatgtgtacaaatacctttgttctgaagaaagaagtgtcggaaacccaacatggaacaatattaattaaagttgagtacaaaggcgaggacgttccatgtaaaattccattttctacagaagacggacagggcaaagcccacaacggccgtcttatcacagctaatccggtagtaactaagaaagaggaaccagtcaatatcgaagccgaacctccgtttggtgagtcgaatatagtgattgggataggagataatgctcttaaaataaattggtataagaaaggaagcagcatcggaaaaatgttcgaagccacagcccgcggagcacgacgtatggcaatcctgggagatacagcatgggatttcgggtctgtagggggagtactgaatagtttaggcaaaatggtgcatcagatatttggaagtgcgtacaccgccctgttcagtggagtaagttgggtaatgaaaataggtataggtgtcttactaacctggattgggcttaattcgaaaaatacgtcaatgagcttcagttgcatagcaataggaatcatcactttatatctaggagccgtagttcaagcggatatggggtgcgtcatcaactggaaagggaaagagctgaaatgcggtagtgggatcttcgtaacaaatgaggttcatacatggaccgagcagtataaatttcaagcagatagcccgaaacgtctagccacagcaatagcaggggcatgggaaaacggcgtgtgcggaataagatcaacaacgagaatggaaaatctcttatggaaacaaatagccaacgaattgaattacatattatgggagaataatattaaattaacagtagtagttggagacataataggtgttctagagcaaggcaaaagaaccttaacgccccaacctatggaacttaaatactcttggaaaacatggggaaaagcgaaaatagtaacggcagaaacacaaaattcttcattcataatagatggtccaaatacaccagaatgtccgtcagtttccagggcgtggaatgtatgggaggtcgaagactatggatttggagtttttactactaatatttggcttaaactccgggaagtttatacacaactttgtgaccatcgattaatgtcggctgctgtcaaagatgagcgtgctgtgcacgccgatatgggttactggattgaatcacagaaaaacgggagttggaaattagaaaaagcgagcctaatcgaagtaaaaacttgtacctggcccaaaagtcatacgttatggtcaaacggtgtgttagagagcgacatgataattcccaagagtcttgctggtcctataagtcaacataatcacagaccaggttaccatactcaaactgctgggccctggcatctaggtaaattagaattagattttaattactgcgagggaaccacagtagtaattactgaaaactgtggtaccagaggaccatcgttaagaaccacaaccgtgtcgggcaaattaatacatgaatggtgttgtcggagctgcacactgccgcctcttcgttacatgggggaagacggatgttggtacggcatggagataagaccaatttcggaaaaagaagaaaacatggtaaagtcccttgtgagtgccggaagcgggaaagtggacaacttcacaatgggagtattatgcttagctatattattcgaagaagtgatgcgaggaaagttcggtaagaaacacatgatagcaggagtatttttcacgttcgttttactcctgagtggccaaatcacttggagagatatggcgcatactcttataatgattgggagtaatgcgtcagataggatgggaatgggagtaacataccttgctttaatagctacgtttaaaattcaaccatttttagcgttaggatttttcttgagaaaacttacgtctcgggaaaatctgctactcggagtcgggttagccatggcaaccactctacaactccccgaagatattgaacaaatggcaaacggaatagcattgggcttaatggccctaaagttaataacgcaattcgaaacatatcaactttggactgcacttatatcacttacttgttcaaatacaatatttaccttaacagtggcatggagaaccgcaacattaatattagctggagttagtttactacccgtgtgccaaagtagctcaatgcgaaaaactgattggctaccaatggccgtagcagcaatgggagtaccaccattaccactgttcatttttagcctaaaagacacactgaagcgccgctcttggccactaaatgaaggggtaatggcagtgggtttagtgtccatactcgcatcgtcattactacgcaatgatgtgccaatggccggtcccctcgttgcaggagggctccttatcgcttgttatgtgataacaggaacgagtgctgaccttacggtagaaaaagcagcagatataacttgggaagaggaagcggaacaaactggagtttcacataacttgatgataacagtcgatgatgatggaactatgcgcattaaagacgacgaaacagaaaatattctaacagtcttactaaagactgctctattaatagtatctgggatctttccatactcaatccctgcaactctattggtttggcatacatggcagaagcaaacacaacgatcaggcgtcctatgggatgttcctagtccgcccgaaactcaaaaggctgagcttgaagaaggtgtatatagaataaaacaacagggaattttaggcaaaacgcaggtaggtgtaggagtgcagaaagaaggagtctttcacacaatgtggcatgtaacgcgcggtgctgttctgacctacaacggcaaaagattagaacccaactgggcttcagtgaagaaagacctgatctcctacggaggcggatggcgattaagtgctcaatggcaaaaaggagaagaagttcaggtcatagcagtggagccaggcaaaaatcctaagaattttcaaaccatgccaggaacgtttcaaactacaactggtgaaatcggagccatcgcattagactttaaacctggaacaagcggatccccgattataaaccgagagggaaaagtagttggactttacggtaatggcgtcgtaaccaaaaacggaggatatgtgagtggaatcgcgcaaacaaacgcggaacccgatggcccgacgcctgagttagaagaagagatgttcaagaaacgtaacttgacaatcatggacctgcaccctggtagtggaaaaacccgaaaatatctcccggcaattgtaagagaagcaattaaaagaagattaagaacactaattttagcaccaacacgagtcgtggctgcagaaatggaagaggctttgaaaggattaccaattaggtatcagactacggcaactaagagtgaacatactggaagagaaattgttgacctaatgtgccatgctaccttcaccatgagactactctcgccggtgagagtacctaattataacttaataatcatggacgaagcacattttactgaccctgcctccatagccgcgagaggatacatttcaacaagggtaggaatgggggaagcggcagcgatattcatgacagccacacccccgggaacagcagacgcattcccacaaagtaatgcaccaatacaggacgaagaaagagacattcccgaaagatcctggaatagtggaaacgaatggattacagatttcgctgggaagaccgtatggtttgttccaagtattaaagccggaaacgacatcgccaactgcttgaggaaaaatggtaagaaagttatccagctaagtagaaaaacgtttgacactgagtaccagaaaactaagctaaatgattgggactttgtagtgacaacagatataagtgaaatgggtgcaaattttaaagccgatagggtcatagatccaagaaggtgtcttaaaccagtaattttaacggacggacctgaacgagtaatactagccggtccaatgccagtcaccgcagcaagcgctgcacaaagacgaggcagggttggcaggaatccccaaaaggaaaatgaccagtacatattcacaggacaaccattgaacaatgacgaggatcatgcacattggacagaggccaaaatgttattggacaacataaatacaccagaaggcataattccagctcttttcgagcccgaaagagaaaaatctgccgcaatcgatggtgaatatcgattaaaaggagaaagccggaaaacatttgttgaattaatgagacgaggagatttaccggtttggttagcgcacaaagttgcatctgaaggaattaagtatactgacaggaaatggtgctttgacggccaaagaaataaccaaattctagaagagaatatggacgtagaaatatggactaaagaaggagagaagaagaaactacggccgcgatggctggatgcaagaacctattcagatcctctagcacttaaggagttcaaagagttcgcagcaggccgaaagtctatagctttagacctagtcaccgaaatcggcagagtacccagtcatttggctcaccgaacacgaaacgctttggacaacttagtgatgttacataccagtgaacatgggggccgagcttatagacatgccgtagaggagttacccgagactatggaaaccttattactattaggattaatgatccttttgactggaggtgctatgctctttttgatttcggggaagggaatagggaagacttccatcggtttaatatgtgttatagcatcctcaggaatgctatggatggcagaaatacctcttcagtggattgcgtcagctattgtgctggaatttttcatgatggtgcttctcataccagaaccagaaaaacagcgcactccccaagacaatcaactggcctatgtagtgatcggaatactaaccttagctgcaattatagcagctaacgaaatgggtctgttagaaactactaaaagagatctcggaatgtcaaaagagccaggagtagtctcacctacctcatatttagacgtagatctacatccagccagtgcatggacactctatgctgttgcgacaacagttataacgcctatgcttagacatacgatagaaaatagtacggccaacgtaagccttgctgctatagcgaatcaagctgttgtgttaatgggattagataaaggatggccgatatcaaaaatggacttaggagtcccactattagctttggggtgctattctcaagtgaatccactaacgctaacagcagcagtactcctactaataactcattatgctatcattggccctggcttacaagctaaagcaacaagagaagctcagaagagaacagcagccggcattatgaaaaacccaacagtagacggtataatgactatcgatctcgacccagtaatttatgattcgaaatttgaaaaacaactaggccaggtgatgttattagtactctgtgctgtccaactactactcatgcggacaagttgggcactatgtgaggctttgacactagcaaccgggcctgtcacaactctatgggaggggtcaccgggaaaattctggaacacgacaatagcagtaagtatggctaatattttccgtggctcttatttagcgggagcgggcttggcttttagtattatgaagtcagtgggcacgggtaagaggggaacaggcagtcaaggggaaactttaggcgaaaaatggaagaagaaattaaatcaactcagcagaaaagactttgacctctataagaaatcgggaataacagaggtagatcggacagaagctaaagagggattaaaaagaggagagataacacaccacgctgtaagtaggggttctgccaaactacagtggtttgttgaaaggaatatggttatcccggaaggccgggttattgatcttggctgtggacgtggagggtggtcgtactactgcgccggactcaagaaagttaccgaggtccgcggatataccaaaggtggacctggtcatgaagaaccagtcccgatgagtacatatggatggaacatagtaaagttgatgagcggaaaagatgtcttttatttaccgccagaaaaatgcgatacattactatgcgacattggagagtcttccccatctcccacagtcgaagaatcgagaacaatacgagtactaaaaatggtagaaccctggcttaaaaacaatcagttttgcataaaagttctcaatccgtacatgcccacggttatcgagcatttggaacgcctgcaacgtaagcacggcggcatgttagtgcgtaatccgttgagtagaaattcaacacatgaaatgtactggatttcaaacgggacagggaacatagttgcttccgtaaatatggtctctcgtctcctattaaaccgttttacaatgacacataggcgaccaacaatagaaaaggatgttgatttaggagcaggtacacgacatgttaacgcagaaccagaaacgcctaacatggacgtgattggagaacgtattaaacgaataaaggaggagcataattccacctggcattacgacgacgagaatccgtataaaacgtgggcataccacggaagttacgaggttaaggcaacaggatccgcatcttcaatgattaatggtgtagtaaagctactcactaagccatgggacgtagtgcccatggtaacccaaatggcaatgacagacacgaccccgtttggacaacaaagagtattcaaagaaaaagttgacacaagaacaccacgcagtatgcctggaacaagaagggttatgggcattactgctgaatggctatggcgaactcttggaaggaataagaaaccaagactttgtacaagggaagagttcaccaagaaagtaaggacaaatgcagcaatgggtgccgtattcacagaagaaaaccaatgggatagtgccaaagccgctgtggaggacgaagatttctggaaactcgttgatcgagaacgagaactgcacaaattagggaaatgtggtagctgtgtttataacatgatgggcaaaagagagaagaaattaggtgagttcggaaaagcaaaaggtagtagagcaatctggtatatgtggctgggtgccaggtatctggaatttgaagcactcggatttttgaacgaggatcactggttctctagagaaaattcatactcgggagtggagggtgaaggcttacataaactaggatatatattgcgagatatatctaagataccagggggagcaatgtatgcggacgatactgctggatgggatactaggataacagaagacgatttacataatgaagagaaaattacgcaacaaatggacccagagcaccggcaactggccaatgcgatctttaagctcacgtatcagaacaaggtagtcaaagtacaaagaccaacccccaccggcactgtcatggatataatcagtagaaaagatcagagaggatcagggcaagtaggaacatatggactcaacacatttaccaacatggaagcacaacttattagacaaatggagggcgaaggagtattatcaaaagcagacctagaaaacccacatttaccagaaaagaaaataacacagtggcttgaaacaaaaggagtagaaagacttaaaagaatggcgatatctggagatgattgcgtagtaaaacccatcgacgataggtttgctaacgcattactagccttgaatgatatgggaaaagtacgaaaagatattcctcaatggcaaccaagcaagggatggcacgattggcaacaggtgccattctgttcacatcactttcatgaattgatcatgaaagatggcagaaaattagtcgtcccatgccgaccacaagatgaattaatcgggagagctagaattagtcaaggagcaggatggtccttaaaagaaacggcatgtctaggcaaagcctacgcacaaatgtggtctctaatgtatttccaccgacgcgatttacgactggcatcaaacgcaatctgctctgcggttccagttcactgggtaccaacttctcgaacaacatggagcatccatgcacatcaccaatggatgaccacggaggatatgttaactgtgtggaacagggtctggatagaagataacccctggatggaagacaaaactccagttacaacatgggaaaatgttccatacttaggaaagagagaggatcagtggtgcggcagcttaattggcctaaccagtcgagctacatgggctcaaaacataccgactgctattcagcaggtaaggagtttaatcggaaatgaagagttccttgactacatgccgagcatgaaaagatttcgaaaagaagaagaatcagaaggcgcaatatggtaa

SEQ ID NO: 23174 - RNA, 9873 nt, synthetic construct
  misc_feature 1..9873: note = derived and/or modified CDS sequence (opt6) from DENV-3__GQ199863__SS-prME
  source 1..9873: mol_type = other RNA
acttccctctgtttaatgatgatattacctgcggcattggcatttcatttaacttcaagggacggagaaccaaggatgattgtaggcaaaaatgaacgaggaaaatccctactgtttaaaacggcttcaggaattaatatgtgtaccttaatcgccatggacctgggggaaatgtgcgacgatacggttacatacaaatgtccccatataacagaagtagaaccggaagatattgactgttggtgtaatctcacgagtacgtgggttacgtacggtacatgtaatcaagctggagagcaccgccgagacaaaagaagcgttgcgctggctccccacgtaggcatgggacttgacacccgcacccaaacttggatgtcggcagaaggcgcctggagacaagtggagaaagtagaaacatgggcattacgacacccgggctttaccatactggcattgtttttggcgcactatatagggacttcgctaacccaaaaagtcgtaatattcatacttttaatgttagtgacccctagtatgaccatgcgttgcgtaggagttggcaatagagatttcgtagaaggattgagtggggcaacatgggtggatgtagtattagaacatggaggttgtgtcactactatggcgaaaaataaaccgacgctggacatcgaactacagaaaacggaagcaactcaactagcaacactgcgaaaattatgtatagaagggaaaataaccaacataaccaccgattctcgctgccctactcaaggggaggcaacactacccgaagaacaagaccaaaactatgtgtgtaaacacacctacgttgatcgaggttgggggaatggatgcggattattcggaaaaggaagtttagtgacttgtgcgaaatttcaatgcctggagccaattgaaggaaaagtagtacaatatgaaaatcttaaatacacagtgattattacagtccacactggtgatcaacaccaagtcggtaatgagactcaaggagttacggcagaaattactccacaagcaagcacgaccgaagtaatcttgcccgagtacggaactctcggcttggaatgtagtccaagaactggactcgacttcaatgagatgatattactaaccatgaaaaacaaggcttggatggtgcatcgacaatggttcttcgacttacctctgccatggacttctggggcgactacagagacaccaacttggaatagaaaagaactcttagtcacattcaaaaacgctcatgccaagaaacaagaagttgtggtattaggttcacaagagggtgcaatgcatacggctttgactggagcaacagagattcaaaactctggtggaacaagcatattcgcaggacatctcaagtgtcgattaaagatggataagttagagttaaagggtatgtcctatgcaatgtgtactaatacctttgtgctgaagaaagaggtgtctgaaacccagcatggaacgatactgataaaagtcgaatataagggagaagacgtaccgtgtaaaataccattttcaacggaagatggacaaggaaaagctcacaatggccgcttaataacagcaaaccccgttgtcacaaagaaagaggaaccagttaacatagaagccgagccacccttcggcgaaagtaacattgttatcggtataggtgacaatgcgctaaaaataaactggtataagaaaggcagttctatcggtaaaatgtttgaagcaaccgcacgcggggccagaagaatggctatactaggcgatacagcctgggatttcggttcagtcggaggagttctaaattctcttggaaaaatggttcatcaaatatttggatcagcgtacacagctttattcagcggcgtctcctgggttatgaaaattggaataggtgtattactaacatggataggtctaaattctaaaaacacaagtatgagctttagctgtatcgccattggtattattaccttatatttaggagcagtagtacaagcagatatgggctgtgttattaattggaaaggaaaagagctgaaatgcgggagtggaatcttcgtaacaaacgaagtgcacacatggaccgagcaatataaattccaagcggatagtcctaagcgactggcaaccgctatagctggagcatgggaaaacggcgtttgcggtatacgttcaacaacccgtatggaaaacctcttgtggaaacagatagctaatgaattaaattacattctttgggagaacaacataaaactaacggtagtagtaggcgacatcataggagtcctggagcaaggcaaaagaacactaacaccccaaccgatggaattaaaatactcatggaaaacttggggcaaggcaaaaattgtaaccgcagaaacgcaaaatagctcattcataattgacggacccaatacaccggagtgtcccagtgtaagtagagcttggaacgtctgggaagtagaggattatggatttggtgtttttacaactaacatatggctgaaattacgtgaagtatacacacaactttgcgatcacaggctaatgtcagctgcagtgaaagacgagcgggctgttcatgccgatatgggatactggatagaaagtcagaaaaacggttcgtggaaattagagaaagccagcttaattgaggtcaaaacgtgcacatggcccaaatcccatactctatggagcaatggtgtactagagtctgacatgatcattccgaaatcactcgcaggacctatttctcaacataaccataggccgggatatcacacacaaacggcgggaccatggcacttaggtaagttagagctagactttaattactgcgaagggaccaccgttgtaataacagaaaactgcggcacaagaggaccaagcctgcgaactaccacagtttctgggaagctaattcatgaatggtgttgtagaagctgcactttgccgcctttgaggtacatgggtgaagacggttgttggtacggaatggagattcgtccaatcagtgagaaagaagagaatatggttaaatctctagttagcgcgggaagtggcaaagtcgataactttacaatgggagtattatgtctggcgattctattcgaagaagttatgcgcggaaaattcggcaagaaacacatgattgctggagtattctttacctttgttttacttttaagtggacaaattacctggcgagacatggcgcatacgcttattatgataggttcaaatgctagtgataggatgggaatgggtgtaacatatctagcacttatagctacgtttaagattcagccatttttagcattaggattctttcttaggaagttaacaagtagagaaaacttgttactaggagttggattggctatggctactacgctacaattaccagaagatattgagcaaatggctaacggaatagctttaggattaatggcgttaaaactaataactcaattcgagacctatcaattatggactgcactaatatccctcacatgttctaatacaatattcaccttaaccgtcgcgtggagaactgcgaccttaatcttggcgggagtgagtttattaccagtgtgtcagtctagttcaatgagaaaaaccgactggttgccaatggcggtcgcggcgatgggtgtaccacccctgcctttatttatattttcattaaaagataccctcaaacgaagaagttggcctctaaacgaaggcgtaatggccgttggtctcgtttcaatcttagcatcgtcacttctgcgaaatgatgtcccgatggcaggccccttagtggcagggggactattaatagcatgttatgtgataacgggcacaagtgccgatttaacagtagaaaaagccgcagacataacctgggaagaagaagctgaacaaactggtgttagccataacctaatgattacagttgacgatgacggtacaatgagaatcaaagatgatgaaaccgaaaatattctaactgttttactaaaaaccgcactactgatcgtatcagggatttttccctattctattccagcaacccttttagtatggcatacgtggcagaaacaaactcaaaggagcggcgttctatgggatgtaccatcaccaccagaaacccaaaaggcagagctagaggaaggcgtatataggatcaagcagcagggaatattcgggaaaacacaagttggagtaggggtacaaaaagagggagtatttcatactatgtggcacgtaactcgtggcgctgtccttacatataacggaaaaaggctcgaacccaattgggccagcgtgaagaaggacctaatatcctacggcggcggctggagactctctgcccaatggcaaaaaggggaagaagtacaagtgattgcagtcgaaccaggtaaaaaccctaaaaatttccaaactatgccaggaacctttcaaaccacaacgggtgaaataggggcgatagcgcttgatttcaagccagggacgtccgggagtccaattattaatcgagaaggcaaagtagtgggattatatggcaatggtgtagtaacaaagaacggtggctacgtttcaggaatcgcacaaacaaacgcagagccggacggccccactccggagctagaagaagaaatgtttaagaaacgtaacctaacaataatggatctacacccaggatcgggaaaaacacgcaaatacttacctgccatagtaagagaagctatcaaaaggagattacgaaccttgatcctagcaccaacgagagttgtggccgccgaaatggaagaggcgctaaaaggactccctattagatatcagacaacagcgacaaagtcggaacacactggacgtgaaatagtagatttaatgtgtcacgccacgtttacaatgcggttattgtcaccagtacgagtgccaaactataacttaattattatggatgaagcgcatttcactgatccagcttctatcgccgctagaggatatatttccacaagagtcgggatgggtgaagccgcagccatattcatgactgctaccccaccaggtaccgctgacgcctttcctcaaagcaatgcacctatacaggatgaagaaagagacatacctgagagaagctggaactcaggaaacgaatggatcacagattttgcgggaaaaacagtttggtttgtcccatctattaaagctgggaatgatatagcaaactgtttacgcaaaaatggtaagaaagtaatccaactatctagaaagacgtttgatacagagtatcagaaaactaaacttaacgattgggactttgtagtcacgacagatatatcagaaatgggtgcaaatttcaaagccgacagagttatcgacccaagaagatgtttaaaaccagtcattctgactgatggcccagaaagagtgatattagcaggacccatgccagttaccgcggcttccgcagcacaacgaaggggaagagtaggacggaatccgcagaaagagaacgatcaatacatattcacaggacagccccttaacaatgacgaagaccatgctcactggaccgaagccaaaatgctattagataatatcaacactccagagggaatcatccctgcgttgttcgaaccagaacgagagaagtccgccgcgattgacggggagtacagacttaaaggggaaagtcgaaaaacttttgtagagttgatgaggcgaggggaccttccagtttggcttgcacataaagtagcgagcgaagggataaaatacactgatcgaaaatggtgcttcgatggacaacgaaacaaccaaatattagaagagaatatggatgtagaaatctggactaaagaaggtgagaagaagaaacttaggcccagatggttagatgcccggatatatagtgaccctctagcgttaaaagagttcaaagaatttgcggctgggagaaaaagcattgcattagaccttgtaaccgagattggtagagtgccgtcacatcttgcacacagaactcgtaatgccttagacaacttagttatgttgcacacaagcgaacatggcggcagagcttatcggcatgccgtcgaagagttaccagaaacaatggagaccctattactactaggattaatgatactccttacaggaggagcgatgttatttttaataagcggaaagggaattggaaaaacctctatcggcctcatatgtgtgatagccagttcgggtatgctttggatggctgaaattcccttacaatggatagcttcagccatagtcctggaatttttcatgatggtactgttaatacctgaaccagagaaacagagaacccctcaggacaaccaactagcttatgtcgtgataggaatcttgactttggcagccataatcgctgcaaatgagatgggacttcttgagacaacaaagcgggatctaggtatgtccaaagaacctggagtggtatctccgaccagttatcttgacgtagatttgcatcctgccagtgcctggactctatatgcagtagctaccaccgtgataacccccatgctgcgtcatacaatagaaaatagtactgctaatgtatccttagcagcaatagctaaccaggccgtggtattaatgggtttagataagggctggcccataagcaaaatggaccttggtgtccccctgttagcgcttggatgctactcacaggtaaatccattaaccctaacagcggccgttcttctattgataacgcactatgctatcattggccctggtttacaggcaaaagcgacgcgagaagcacagaaaaggacagcagcaggaatcatgaagaatccaactgtagacggcataatgacaatcgacttggatccagtaatatatgatagcaaattcgagaaacaattaggtcaagttatgctactggttctatgcgcagttcaactactattaatgagaacgtcgtgggctttgtgtgaagcgttaacccttgctacaggcccaataacaaccttgtgggaaggttcaccaggtaaattctggaatactaccatagccgtgtctatggcaaatatcttcagaggatcttacttagcaggcgccggcctagctttctcaatcatgaaatcggtagggaccgggaagagaggtacaggcagtcaaggcgaaacattaggagaaaaatggaagaagaaattgaatcaacttagtagaaaagattttgatttatacaagaaatccggtataacagaagtggatcgaacggaagctaaagaaggattgaaacgaggtgaaataacacatcatgcagtatccaggggaagtgcaaagttacaatggtttgtagaaagaaatatggtaatacccgaaggccgcgtcatagatttaggctgtggccgaggcggttggagttactactgcgctggacttaagaaagttactgaagtacgaggttacacaaagggaggtcccggccatgaagaaccagttccaatgagcacatacggatggaacatagtaaagctaatgagcggaaaagatgtattttacttaccaccagagaaatgtgacacattgttgtgtgatattggcgagagctcgcctagccccaccgtagaagaatcacggaccatacgagtactaaaaatggttgaaccctggttaaagaataaccaattctgtataaaagtattaaacccctacatgcccacagtaatagaacacttagaaagacttcagagaaaacatggagggatgctggtacgtaacccacttagcagaaactctacgcatgagatgtactggatatcaaatggcacaggtaatattgtggcctccgtaaacatggtaagtagacttttattaaatcggttcactatgacccatagaaggccaactatagaaaaggatgtagatttaggagccggaacacgtcatgtaaatgcggaaccggaaactcctaacatggatgtaattggtgaacgtattaaacgcataaaagaagaacataattctacctggcactatgacgatgagaatccatacaaaacatgggcgtaccacggaagctatgaagttaaagccactggcagcgctagttctatgattaacggtgtggttaaattactaacaaagccttgggacgtagtgccgatggtaacgcaaatggctatgaccgacactacacccttcggacaacagagggtatttaaagagaaagttgatacaagaacaccgcgcagcatgccaggtaccaggcgggtgatggggataacagcagaatggctttggcggacattagggaggaataagaagccaaggctatgcacgcgtgaagaatttactaagaaagttaggaccaatgcagcaatgggagctgtattcaccgaagaaaatcagtgggattcagcaaaggctgcagtggaagatgaagatttttggaaacttgttgatagagagcgtgaattacacaaacttggaaaatgcggatcttgtgtgtacaatatgatgggaaaaagagagaagaaacttggagagttcggtaaagctaaaggctcaagggccatttggtatatgtggcttggcgcgagatacctggaatttgaagcactgggctttcttaacgaagatcattggttctctagagaaaacagctatagcggagtggagggagaagggctccataaacttggatatattcttagagatataagtaaaataccaggtggagcaatgtacgccgatgacaccgctggttgggatactcggataaccgaagatgacctgcataatgaagaaaagataacacaacaaatggatccagaacataggcaattagctaacgcgatcttcaagttaacgtatcagaataaagtagttaaagtacagaggcccacgccaactggcacggtaatggacataatttctcggaaggaccaacggggatccggccaagttgggacttatggactaaacacattcacaaatatggaagctcaattaataaggcagatggaaggtgagggagtcttatcaaaggcagatttagagaatccacatctgccagagaagaaaatcactcagtggctagaaactaagggagtagaaagacttaaaaggatggcaatttcaggagacgactgtgtcgtgaaacctattgatgacagatttgcaaatgcgctattagctttaaacgatatgggcaaagtacgaaaggatatacctcaatggcagccatcaaaaggttggcacgattggcaacaagttccattttgctcacatcattttcatgaactcattatgaaggatggaaggaaattagtagtcccctgcagaccccaagatgaactaataggaagggccagaatctcacaaggtgccggatggagtctaaaggaaactgcctgcttagggaaggcttacgcacaaatgtggagcttgatgtattttcacaggcgtgatttacgtttagcttcgaacgcaatctgtagcgcagtgccagtacattgggttccgacctcgagaactacttggagtatccatgcccatcaccaatggatgaccactgaagatatgttaactgtttggaatagagtttggatcgaagataatccatggatggaagacaagacgccagtaacaacctgggaaaacgtcccatatttaggaaaacgtgaggatcagtggtgtggttcattaattggcctcacatcaagagcaacatgggcacaaaatatacctactgcaattcagcaggtccgaagtttgatagggaacgaagagttccttgattacatgccttcgatgaagagattcagaaaagaagaagaaagtgaaggggcaatatggtga

SEQ ID NO: 23175 - RNA, 9873 nt, synthetic construct
  misc_feature 1..9873: note = derived and/or modified CDS sequence (opt6) from DENV-3__GQ199864__SS-prME
  source 1..9873: mol_type = other RNA
actagcctttgcctaatgatgattttaccagcagccttagcttttcacctaacgagtagggacggtgaaccacgaatgatagtagggaaaaacgaacgagggaaaagccttttattcaaaacagcatcaggtatcaatatgtgcactctaattgcaatggatttgggggaaatgtgtgacgatacagttacatataaatgtccacatatcactgaagttgaacctgaagatattgattgctggtgcaacctcacatctacgtgggtgacttacgggacatgtaatcaagcaggagaacatcggcgcgataaacgatcggttgcacttgctccacatgtagggatgggtcttaataccaggacccaaacgtggatgtcggcagaaggtgcatggaggcaggttgaaaaagtggaaacctgggccttacgacatccaggttttacgatcttagcactatttttagctcattatatcgggacgtctctaacacaaaaagtagtaatctttatactactcatgctggttactccgtccatgacgatgcgctgtgttggtgttggaaaccgcgatttcgtcgaaggtctatccggggctacatgggtggacgtagtattggaacacggagggtgcgtaactaccatggctaaaaacaaaccgacattggacatagagctacagaaaacggaggcgacccagctcgcgacattacgaaaactatgcatagagggaaaaataactaacataaccactgattcaaggtgtccaacccaaggggaagccactctccctgaggaacaagatcaaaattacgtttgcaaacacacttacgtagatagaggatggggtaatggttgtggattatttgggaaaggctccctggtaacctgcgccaaattccaatgtctagaaccaatagaaggaaaagtagtccaacatgaaaacctaaaatacacggtaataataacagttcacacaggggaccaacaccaagtcggaaatgaaactcagggagttactgcagagatcaccccacaagcatcaacaactgaggccatcttaccagaatacggaactttaggcttagaatgcagtcctagaacaggcttagattttaatgagatgatcctgctcacaatgaaaaacaaagcctggatggtgcacagacaatggttctttgacttacctttaccatggacttctggcgccacgactgagactccaacctggaatcgcaaagagctcttagtaacattcaaaaatgctcacgccaagaaacaggaagtagtcgtgctcggatcacaagaaggtgccatgcatacggccctaacaggtgcgacagaaattcaaaattcaggtggcacatcaatatttgcaggccatctaaaatgcagactcaaaatggataaactagagctaaaaggaatgtcctatgccatgtgcacgaacactttcgttctaaagaaagaagtctctgaaacgcagcatgggaccatactaatcaaagtagagtacaaaggtgaagacgtgccctgtaaaataccattttcaactgaggacggtcagggcaaagcacataacggtagacttattacagcaaatccggtagtgactaagaaagaagaaccagtaaatatcgaagcagaacccccattcggggaatcaaatatagtgataggtatcggagacaacgctttgaaaatcaactggtacaagaaaggaagttcaattgggaaaatgtttgaagcaacagctagaggagccagaaggatggcaattttaggtgatactgcatgggactttggcagcgtaggaggagtcctgaactcactcggtaaaatggtacatcagatttttgggtcagcatatacagcgttattcagcggggtttcttgggttatgaaaataggaataggggtcttactcacgtggataggactcaacagtaaaaacaccagtatgtcattttcctgcattgctatcggaatcataaccttgtacctaggtgccgtcgtacaagcagatatgggatgcgtgattaactggaaaggcaaagaacttaaatgtggtagtggtatctttgtaactaatgaggtacatacatggaccgagcaatataaatttcaagccgatagccccaaaagactggcaaccgccattgcaggagcatgggaaaatggggtctgcggaatacgttccacaacacgtatggaaaatttactatggaagcaaatagcaaacgaactcaactatattctttgggaaaacaatataaaattgaccgttgtagtcggcgacatcataggagtgttagaacaagggaagaggactctaactcctcaaccaatggagctaaaatacagctggaagacttggggcaaagccaaaatcgtcacggcggaaacacaaaactcgagttttataattgacggcccgaacaccccagaatgtccttccgtgtcgcgagcatggaacgtatgggaagtagaagactatggttttggagtatttactacaaacatttggctcaaactccgtgaagtgtatactcaactctgcgaccacagattaatgtcagctgcggtaaaagatgaacgtgcagtacatgcagatatgggttattggattgaatctcaaaagaatgggagttggaagttggagaaagcaagtctaattgaagtgaaaacgtgtacttggcccaaatcacacactttatggtcaaacggagtgctagaatcagacatgatcataccaaaaagtctagcaggtcctatcagtcaacataatcatcgaccaggataccatacgcaaaccgcagggccatggcacctggggaaactagaactggatttcaactattgtgagggaacaacagtagtgattacggaaaactgtgggactagaggcccttcgttacgaaccacgactgtcagcggcaaacttatacacgagtggtgctgtagaagttgcaccttacctccactacgttatatgggtgaagatggttgctggtatggaatggaaattagaccgatttctgaaaaggaagaaaatatggtaaaatcattagtctctgcaggtagcggtaaagttgataactttaccatcggtgtactatgtctagcaattctctttgaagaggtgatgcgaggcaaattcggtaagaaacatatgatagctggcgtattctttacatttgtcttattgttgtccggacaaatcacatggagagatatggcacatacattaattatgataggatctaatgccagcgatcggatgggcatgggagtaacatatttagcactaatagcaacatttaagattcaaccatttctcgcgttgggtttctttttaaggaaactgacatcaagagaaaatctccttttaggcgtaggtcttgcaatggcgacaacactacaattacctgaagatatagaacaaatggcaaacggtatagccttggggcttatggccttgaaactgataacacaatttgaaacctaccaactttggacagctcttataagccttacatgttccaatacaattttcactttaacggtcgcttggagaacagctactctgatcttagctggagttagtctattaccagtctgtcaaagcagtagtatgcgaaaaactgactggttacccatggcagtagcagctatgggtgtaccgcctttaccactcttcatattttcccttaaagatacccttaaaagacgatcttggcccctgaatgaaggtgttatggccgttggacttgtatcaattcttgcaagtagtcttctccggaacgatgtgccaatggcaggtcctctcgtcgctgggggattgctcatagcgtgttatgtcataacgggaacgtcagccgatctgacggttgaaaaagctgctgatatcacctgggaggaagaagccgaacagacaggcgtatctcataatctgatgattactgtcgatgatgatggaacaatgagaataaaagacgatgagaccgagaatatattaacagtgttattaaaaacggctctcctcatagtgtcagggatctttccatattcaatccctgcaacactattagtctggcatacatggcaaaaacaaacacaacgatccggcgtcctgtgggatgtcccaagtccaccagaaacacaaaaggcagaattagaagagggtgtataccgaatcaaacagcagggtatattcggcaaaacacaagtaggagttggagtccagaaagagggggtgttccacactatgtggcatgtaactcgaggagcggtcctgacatataatggaaaacggctcgaaccaaattgggcaagcgtcaaaaaggaccttatctcgtatggaggaggctggcggctaagtgctcaatggcaaaaaggagaggaagtccaagtaatagcagtagaaccaggcaaaaatcccaaaaactttcaaaccatgcccggtacttttcaaaccactactggggaaatcggcgcaattgcattggacttcaagccgggcaccagcggtagtccgatcataaatcgtgagggtaaagtagtaggtttatatggtaacggcgtggttaccaaaaatgggggatacgtatcaggcattgcccagacaaacgcagagccagacgggccaacaccagaattagaagaagagatgttcaagaaaagaaacttaacaataatggatcttcacccagggagcggtaaaaccaggaaatacttaccagcgatcgtccgcgaggccataaagagacgtctaaggacgctcattctcgcacccactcgcgtagtagccgcagaaatggaagaggcgctaaaaggactgcctatccggtatcaaacaaccgccacaaagagcgaacataccggtagagaaatcgtggatttaatgtgccatgcaacattcaccatgcgcttattatcacctgtacgcgtacctaactataatctaataattatggatgaagcacattttacggatccagcgtcaatcgctgccagaggctatatatctaccagagtcgggatgggagaagcagcagcaattttcatgacggcgactcctccaggtacagcagatgcattcccacaaagcaacgcaccaattcaggacgaagaaagggacattccagagagatcttggaactcaggaaatgagtggataaccgattttgcagggaaaacagtctggttcgtaccaagtataaaagctggaaatgatattgctaactgcctaaggaaaaacggaaagaaggtgatccagctatcaagaaaaacatttgacaccgaatatcagaaaacaaaactcaacgactgggacttcgtagtgacaactgatatatcagaaatgggtgcaaactttaaagcagacagagtgatagaccctaggaggtgtcttaaaccagtaatactcacggatggtcccgaaagggtcatactggcaggtccaatgcctgtaacggcagcaagtgccgcgcaacgtagaggtagagttgggagaaaccctcaaaaagagaatgatcaatatatattcactggtcaaccacttaacaacgatgaggatcatgcacactggacagaagctaaaatgctattggacaacattaatacacctgaaggtataataccggcactctttgagcctgaacgagaaaagtccgccgctatagacggtgaataccgtctaaaaggcgaaagtcgcaaaaccttcgttgaactaatgcgacgtggcgatttacctgtgtggttggcgcataaagtggcatcagaggggatcaagtatacagatagaaagtggtgtttcgatggacagaggaacaatcaaatcttagaagaaaatatggatgtagaaatatggactaaagaaggcgagaagaagaaattgaggccaagatggttagatgcgaggacatactcagatccactagctttaaaggaatttaaggaatttgccgcaggccgcaaatccattgcgttagaccttgtaactgaaataggacgtgtaccttcccatctcgcgcatcgaactaggaacgcattagacaacttagttatgcttcacacctctgagcacgggggacgagcttacagacacgcggtagaagaattaccagagacaatggaaaccttactgctgctcggcctaatgattttattaacgggaggagcgatgttatttttaatatcaggaaaaggtatcgggaagacatcaattggacttatttgtgtaattgctagcagcggcatgctatggatggcagaaattcccctacaatggatcgcatcagcgattgtgttggagtttttcatgatggtccttttaattccagaacccgaaaagcagcgaactcctcaagataaccaactggcttatgtggtcatcggcatactcacgctcgcggcaataattgcagcgaatgaaatgggcctactagagacaacgaagcgagacttgggtatgtcaaaagagccaggtgttgtttcgcctacgagctatttagacgttgatttacatccagcaagtgcatggactttgtatgcagtggctaccaccgtcataacacccatgttaagacatactatcgagaactctaccgccaacgtgtcattagcagcaatagctaaccaggcggtagtcttaatgggtctcgacaaagggtggcccattagcaaaatggatttaggagttccacttcttgcgctaggatgttatagtcaagttaatccattaacactcacagctgcggtcttactactgataacacattatgctataattggacctggcttacaagccaaagcaactagagaggcacagaaaagaactgctgcaggaataatgaagaacccgaccgttgatggtattatgacaatagacctcgatcccgttatttacgattctaaatttgaaaaacaactcggtcaagtaatgcttctagtattatgcgctgtacaactcctccttatgcgaacaagttgggcattatgcgaagcgctaactcttgctactgggccaattaccactctttgggaaggcagtccaggtaagttctggaatacaacaatagcagtctctatggcaaatatctttcgaggaagttatttagctggagcaggattagcgtttagtataatgaaatccgtaggtacgggcaaacgtggaacaggctcccaaggagagaccctcggagaaaagtggaagaagaaactgaaccaactatctagaaaagatttcgatctttataagaaatctggaatcaccgaagtcgaccgtacagaagcgaaggaaggcctaaaacggggtgaaataacgcaccacgcagtatcgcgaggcagcgctaaactacagtggtttgtagaaagaaacatggttattcccgaaggcagggtaatagacctgggatgtggtcggggaggctggtcctattattgtgcaggcctcaagaaagtaacagaagttaggggatatacaaaaggcgggcccggacacgaggaacctgtaccaatgtcgacctacggttggaatattgtcaaactcatgtcgggaaaagacgtattttatttgccacctgaaaagtgtgatactctcctttgtgacattggcgagagtagtccttcacccactgtagaagaatcacgcaccattagagtattgaaaatggttgaaccatggctaaagaataatcagttctgtatcaaagtattaaatccgtacatgccaactgtgatagaacatttagaaagactacagcgtaaacacggagggatgctcgtacgcaacccactgtccagaaattctacgcatgaaatgtactggatcagcaacggtactggcaatattgttgcctcagttaacatggtatctagactgttactaaatcgatttacaatgacgcacaggcgaccgactatagaaaaagacgtagacctaggagcaggcactaggcatgttaacgctgagccggaaacccccaatatggatgtaatcggcgaacgaataaaaagaataaaagaagaacacaattcaacttggcattacgatgatgaaaatccatataaaacgtgggcataccatggcagctacgaagtaaaagcgacagggtccgcatctagcatgattaatggtgttgtgaaactgcttacaaaaccttgggacgtagtccccatggttacccaaatggctatgaccgacacaacaccttttggacaacaaagagtattcaaagaaaaagtggacactcgtacgccaaggagcatgccaggaacccgcagagttatgggaataactgccgaatggctttggcgaacattgggaagaaataagaaaccgaggttatgcaccagagaagaatttacaaagaaagttcgaacaaacgcggctatgggcgctgtatttaccgaagaaaatcaatgggatagcgcgaaagccgccgtagaagacgaagacttttggaaacttgttgatcgtgagcgagaactgcacaaactcggtaaatgtgggagttgtgtctataacatgatgggtaagagagagaagaaacttggagaatttggaaaagccaagggaagtcgggcaatttggtatatgtggttaggagcgagatatctagaatttgaggccctaggattcctaaacgaagaccactggttcagcagagagaactcctattctggagtggaaggagaaggattacacaaactaggttacattcttcgagacattagtaagataccaggaggagccatgtacgcagacgatacagctggttgggatactagaataacggaagatgatctccataacgaagagaaaataacacaacaaatggatccagaacatcgacaattagcgaatgcaatttttaaattaacttatcaaaacaaggtagtaaaggttcaacgcccaactccgacaggaacagtaatggatataattagtagaaaggatcaaagaggaagtggccaggtcggtacatatggcctaaatacatttacgaacatggaagctcaattaatcaggcaaatggaaggggagggtgtactctcgaaagctgacctagaaaatccgcacctcccagagaagaaaattacacagtggctagagaccaaaggggttgaacgactcaagagaatggccataagcggagacgactgtgttgtaaaacctattgatgatcgatttgcgaacgctttattagctctcaacgacatgggcaaagtgaggaaagacatcccccaatggcagccatctaaaggttggcacgactggcaacaagtaccattctgctcccaccatttccacgagttgataatgaaggatggaagaaaacttgtcgtaccatgtcgacctcaagatgaacttattggaagggcaagaatcagccaaggcgctggttggagtttaaaagaaactgcctgcctcggtaaggcatatgcacaaatgtggtcactcatgtattttcataggcgtgacttgcggttagcaagtaatgcaatttgttctgcagtcccagtgcattgggtccctacatctagaactacgtggtctatacacgctcaccaccaatggatgaccacagaagatatgttaacagtttggaatcgtgtctggatcgaagataatccgtggatggaagataaaacacctgtaacaacatgggaaaatgtcccatatttgggtaaacgtgaagatcaatggtgcggaagtttaataggcctaacgtcacgggcaacatgggctcaaaacattcccacagcaattcaacaagtgcgcagtttgattggtaatgaggagtttttagattacatgccaagcatgaaacgattcaggaaagaagaggaatcagagggcgcgatttggtaa

SEQ ID NO: 23176 - RNA, 9873 nt, synthetic construct
  misc_feature 1..9873: note = derived and/or modified CDS sequence (opt6) from DENV-3__GQ199865__SS-prME
  source 1..9873: mol_type = other RNA
actagcttatgtctaatgatgattcttcccgcggcactagctttccatcttacaagtcgggatggggaacctagaatgatagtaggtaaaaatgaaagagggaaatcattactcttcaaaacggctagcggaattaatatgtgtacactaatagcaatggatctgggagaaatgtgtgacgacaccgtaacgtataagtgcccacatattacagaagtcgaaccggaagacattgattgttggtgtaacctaactagcacatgggtcacttatggaacctgcaaccaagcgggtgaacatagaagagacaaaagatcggtagcattagcacctcatgtgggtatgggactcgacacgagaactcaaacatggatgagtgcagaaggggcatggcggcaagtagaaaaagtagaaacatgggcactgaggcacccaggtttcacaatattagcattatttttggcacactacataggaacctcactaactcaaaaagtcgttatattcattttactaatgttggttaccccttccatgaccatgcggtgtgtgggggtgggaaatagagacttcgtcgaaggattaagcggagcaacatgggtagatgttgttttggaacatggaggatgtgtgacaacgatggccaaaaacaaaccaacattggatatcgaactacagaaaactgaggctacccaacttgcgacgcttagaaaattatgtattgaaggtaaaattacaaatataacaactgacagccggtgtcccacacaaggggaagcaactttaccagaagaacaagatcaaaactacgtttgcaaacatacatatgtggatagaggctggggcaacggatgcggattatttggtaagggtagcctagtaacctgtgcaaaattccaatgtttagagccaattgaaggaaaagtagtacaacatgaaaacttgaaatacaccgtaataataactgtacatactggagaccaacatcaagtaggaaacgaaacccaaggagttactgctgaaataactccacaggcatcaacaacagaagcaatacttccagagtatgggacactaggattagaatgttcaccacgtacgggacttgacttcaatgaaatgatacttttaacaatgaaaaacaaagcatggatggtacaccgccaatggttcttcgatttaccactaccctggacaagtggcgcaacaactgaaacgcccacatggaataggaaggagttacttgtaacgtttaaaaacgcacatgccaagaaacaagaagtagttgtattaggtagccaagaaggcgcgatgcacaccgctttaacgggcgcaacagaaatacagaactctggtggtacatcaatcttcgcaggccatttaaaatgtagacttaaaatggacaaactagaactaaaaggcatgtcatacgccatgtgtacgaacacattcgtacttaaaaaggaagtttctgaaacacaacacggaaccatactgattaaagtggagtataaaggtgaagatgttccctgtaaaattcccttttccacagaagatggacagggaaaagcccataatgggagattaatcaccgcaaaccctgtagttactaagaaggaagaaccggtcaatatcgaagccgaaccaccattcggggaaagtaatatagtgatcggaataggggacaatgccttaaagataaactggtataaaaagggaagttcgatcgggaagatgtttgaggcgactgcaagaggggcacgaaggatggccattctaggagatacggcatgggacttcggaagtgtgggaggcgttctgaactcactagggaaaatggttcaccaaatttttggttctgcttacaccgccttattttcaggcgtcagctgggtaatgaagatcggaattggcgttcttttgacatggataggcctaaatagcaaaaataccagtatgtcattttcctgcatagcgataggaatcattactttatacctaggcgcagtagtacaagcggatatgggatgtgtaattaactggaaagggaaggagctaaaatgcggatcggggatatttgttacaaatgaagtccacacttggacggagcaatataaattccaagctgatagtcccaagagattggctacagcaatcgccggtgcatgggaaaatggcgtctgtggaattaggtcaactaccagaatggaaaatcttctatggaaacaaatagccaatgaattgaattatatactgtgggaaaacaacattaaacttacagtagttgtgggtgacatcataggagtcttagaacaaggaaaaagaacgcttacacctcaaccaatggagttaaaatattcatggaaaacatggggtaaggctaaaatagtaacagcggagacacaaaatagttcttttattattgatggtccgaacactcctgaatgcccctcagtttcacgtgcttggaacgtgtgggaagtcgaagattacggttttggtgtttttactacgaatatttggctaaaactacgggaagtatatacacagttgtgtgatcatcgtttaatgtctgcagcggtgaaagatgaacgcgctgtacacgcagatatgggatattggattgagagtcagaaaaatggtagttggaaactagagaaagcgtcattaattgaagtcaaaacatgtacctggcctaaaagtcatactctgtggtctaatggagtcttagagagcgatatgatcatccccaaatctttggcaggaccaatctcccaacataaccacagaccaggataccacacacaaacagcaggaccctggcacctaggcaagctggaactcgacttcaactactgcgaaggcacaactgtcgtaataactgaaaattgtgggactagaggtccgtctcttcgaaccacaactgtttctgggaagctaatccatgagtggtgctgtagatcgtgtaccttgcctccactacgatatatgggggaggatggttgctggtatggaatggaaatcaggccaattagcgaaaaagaggaaaatatggtaaaatcgttagtaagtgcaggatcaggaaaagttgataacttcacaatgggtgttttatgtttggcaattttgttcgaagaagtaatgagaggtaaattcggcaagaaacatatgatagctggagtctttttcacattcgtattactattgtcaggacagataacatggagagacatggctcataccctcataatgattgggtctaacgcgtctgacagaatgggaatgggagttacctacctcgccttaatagccacatttaagatccagcctttcttagctctaggatttttcttaagaaaattaacatcaagggaaaaccttttactgggtgtcggcttagctatggcaacaacattacaattaccagaagatattgaacaaatggcaaatggaatcgcactagggctaatggctctaaaacttataacccaatttgaaacctatcaattatggaccgccctaatatcactaacatgttcaaatacaattttcactttgactgtcgcatggagaacagcaacattaatcctagctggagttagtttgttgccgatgtgtcagagttcatcaatgcgaaaaacagactggcttcccatggcggttgcagctatgggagtcccaccattacctttgtttatattttcattaaaggatactttaaagaggagatcgtggccattaaacgaaggtgtaatggctgtaggcctcgtaagtatattagcaagtagcctattgagaaatgacgttccaatggctggccctctcgtcgcgggaggcttgttaatagcatgctatgtaataacagggacatccgccgatctcactgttgaaaaagcggcagatattacatggggcgaagaagctgaacaaacaggcgtctcacacatgctaatgattacagtagaggatgacggcaccatgagaataaaagacgacgagacggagaacattctcaccgtattattaaaaactgcattattgattgtgagcggaatattcccttacagcataccggcgactctcttagtctggcatacttggcaaaagcagacgcaaaggagcggggttttgtgggatgttccatctccacccgagacgcaaaaagctgaattagaagaaggagtttaccgcataaaacaacaagggatatttgggaaaactcaggtgggagtgggggtacaaaaggaaggggtgttccatactatgtggcacgttactaggggcgctgtgctaacgtataacggaaagagactagagccaaattgggccagtgtcaaaaaggatctaataagttatgggggcggttggagattaagtgcacaatggcaaaaaggagaagaggtgcaagtaattgctgtagaacctggcaaaaatcccaagaattttcaaaccatgcccgggactttccaaacaactactggtgaaattggtgcaattgcattagactttaaaccgggaacctcaggaagtcccataataaatcgggagggcaaagtagttgggctatatgggaatggcgtcgtcacaaagaacgggggatatgtaagcggtatcgcacaaactaatgcggaacctgatggcccaacacctgagcttgaagaagagatgttcaagaaaagaaacctaactataatggacctacacccaggaagtggtaaaacaagaaaatatctccccgccatagtgcgtgaagcaatcaaacggcgtttaagaacactcatcctagcaccgacgagagttgtcgcggcagagatggaagaagccttaaaaggactaccaattaggtatcaaacaactgcaaccaaaagtgaacacacaggtagagaaatcgttgatctaatgtgtcacgcgacctttaccatgcgcctcttgtcaccagtacgagtacctaactacaatttaatcataatggacgaagctcattttacagatcctgcatccatcgccgctagaggttatattagtacacgagtaggtatgggagaggcagcagcaatctttatgactgctacccctccaggaactgccgacgcattccctcaaagcaatgcaccaatacaggatgaagaaagagatattccggaacgaagttggaacagtgggaatgaatggattacagacttcgcaggaaaaacggtatggtttgtgccatcgataaaagcagggaacgatatagctaattgtctcaggaaaaacggcaagaaagtgatacagttatcgcgtaagaccttcgataccgaatatcagaaaactaagttaaatgattgggatttcgtcgtgacaacggacatatcggaaatgggggcgaacttcaaagctgatagggttatagatccccggcggtgtttaaagccggtgattctaacagatggacctgaacgagttattttagctggaccaatgccagtaactgccgctagtgcagcacagcgtcgtggacgagttggaaggaatccacagaaagaaaacgaccaatatatatttacaggacaaccgcttaacaatgacgaagatcatgcacattggacggaggcgaaaatgctactagacaacataaatactccagaaggaattataccagcactctttgaaccagagcgagaaaaatccgctgccatagatggggagtacaggcttaagggagaaagcagaaaaactttcgtcgaactaatgcgaagaggagatctaccagtctggctagcgcataaggtggcatcagaaggaattaagtacacagaccgaaaatggtgttttgatggacagcgtaataatcaaatactagaagagaatatggacgtcgaaatctggacaaaagagggtgaaaagaagaaactaagacctcgttggctagatgctcgcacttatagtgatcctctagcattgaaagaatttaaagagttcgcagcggggaggaaaagcatcgctctcgatcttgtaacagaaataggaagagttccatcacacttagctcatagaacacgaaatgctctggacaatttagtgatgctccatacgtcggaacatggaggccgggcttaccgtcatgctgtcgaagaacttcctgaaacaatggagacgctattactattggggttgatgattttattgaccggtggggcgatgttatttttgatatccggtaagggcattggaaaaacaagtattggtttaatatgcgtaattgcaagttcaggaatgctttggatggcagagataccactacagtggatagcatcagctatagtccttgagttcttcatgatggtactcctcatacctgaacctgaaaaacaaagaactccgcaggacaatcaacttgcctatgtagttattggtatactaacattagcagctataatcgccgcaaatgagatgggcctattagagacaacaaaacgtgatcttggtatgtctaaggaacctggagttgtaagtccgacaagttacttagatgtcgatctgcaccccgcaagcgcatggacgctatatgcagtcgcaacaactgtcataacgcccatgttgagacacacaattgaaaattcaaccgcaaatgtgtcattagcagcaattgcaaaccaggcagttgttttaatgggcctagacaaagggtggccaataagtaaaatggatctaggagttcccctgctagcattaggttgttacagtcaagtaaatccactgaccctaaccgcggcagtactattattgattacacactacgctataatcggacccggactacaagctaaagccacacgtgaggcgcaaaagaggacagccgcgggaataatgaaaaatccaacggttgacgggataatgactatagatctcgacccagtaatatatgattcgaaatttgaaaaacaacttggccaagttatgctattagttctgtgtgctgttcaactattacttatgagaactagctgggcattatgtgaagcccttacactagcaactggacccattactacattatgggaaggcagtccaggtaaattctggaatacgacgattgccgtaagtatggccaatattttcaggggttcctatctagcaggggccggattagcgttttcgataatgaaaagcgtcggaactggtaaacgagggacaggaagccaaggtgaaacgttaggagagaagtggaagaagaaactgaatcaacttagtagaaaagactttgacttatacaaaaagtcagggatcactgaagtggatagaactgaagctaaagaaggattgaaacggggcgaaattactcaccatgccgtgtcaagaggctctgcaaaattacaatggtttgtagagcgaaacatggtaattccggagggaagagtcattgatctgggatgcggtagaggaggatggagctattattgtgctggtttgaagaaagtcacagaggtaagaggctacactaaaggcggaccgggacatgaagaacctgtaccaatgagtacatatgggtggaacattgtaaaacttatgtctggaaaggatgttttctatctcccgcctgaaaaatgcgacactcttttatgcgacataggcgaatcatctccatcacccacagtagaggaaagcagaactattcgagtgttaaaaatggtcgagccctggttgaaaaacaaccagttctgtattaaggtcctaaatccatatatgccgacagtaattgagcatttagaaagacttcaacggaaacatggaggaatgctagtaagaaatcccctgagcaggaacagcacacatgagatgtactggattagcaacggcacaggaaacatagtcgcttccgtcaacatggtcagcagattgctattaaaccgatttaccatgacccataggagacctacaattgaaaaagacgtagatctcggggctggaacacggcacgtcaacgcagaacctgaaacacctaatatggacgttatcggcgagagaataaaaagaataaaggaagaacataacagcacttggcactacgatgacgaaaatccatataagacatgggcatatcacgggagttatgaagttaaagcaacaggtagcgcttcaagtatgattaatggggtagtcaaacttttaacaaagccatgggacgtagtacccatggtaacacaaatggcaatgacagacaccactcctttcggccaacaaagagtatttaaagaaaaggtcgatacgaggacaccaagatcgatgccaggtacaagacgcgtaatgggaataactgcggaatggttatggcgaacacttggaaggaataaaaagccacgcttgtgtacaagagaagagttcacaaagaaggtcagaactaacgctgcaatgggtgcagtatttacggaagagaatcaatgggattcagcaaaagccgcagtagaggatgaggatttctggaaactcgttgatcgggaaagggaattgcacaaacttggaaagtgtggatcttgcgtatataacatgatggggaagagggagaagaaacttggtgagttcggaaaagcaaaaggaagcagagccatatggtacatgtggcttggtgcacgatatttagagttcgaggccctgggatttttgaacgaagatcattggttctctagagagaactcgtattctggtgtcgagggtgaaggcctgcataaactaggttacattttacgagatatcagcaaaattccaggaggagctatgtacgcagacgatacagcaggttgggacactcgtatcactgaagatgatttacacaacgaagaaaagataacacagcaaatggaccctgaacataggcaattggcaaatgctatatttaaactaacatatcaaaataaagttgtaaaagtccagaggcccacccctacaggaactgtaatggatataatatctagaaaagatcaacgaggaagtggacaggtaggaacgtacggattaaatacttttacaaacatggaagcacagctcattaggcaaatggaaggggaaggggttttaagcaaagccgatcttgaaaatccacatttaccggagaagaaaattactcagtggttggagactaaaggggttgagcgattaaaaaggatggcaatatcaggtgatgattgcgtcgtgaaaccaatagacgatcggttcgcaaatgcgctgctggccttgaacgatatgggaaaagtccgaaaagatatacctcaatggcaaccatctaaagggtggcacgactggcaacaagttccattctgttcccatcactttcatgaactcataatgaaagacgggcggaaattagtagtaccatgcagaccccaagacgaattaataggccgagctagaataagtcagggcgctggctggtctcttaaagaaaccgcatgtttgggtaaggcttacgctcaaatgtggtctctaatgtatttccatagaagggacctccgtctagccagcaatgctatctgtagcgcggtaccagtacattgggtaccaacgagccgcactacatggtcaatacatgcacatcaccaatggatgacaacggaagacatgttaacggtatggaaccgagtatggatagaagacaacccgtggatggaggacaaaacgcctgtaacaacatgggaaaacgtaccctacttgggtaaaagggaagaccaatggtgtggtagccttatcggacttacatcacgggcgacgtgggcacaaaacattcctactgccatacaacaagtgagatctcttatcgggaatgaggaatttttagattatatgcctagcatgaaacgattcagaaaggaagaagaatctgaaggggccatatggtaa

SEQ ID NO: 23177 - RNA, 9873 nt, synthetic construct
  misc_feature 1..9873: note = derived and/or modified CDS sequence (opt6) from DENV-3__GQ199870__SS-prME
  source 1..9873: mol_type = other RNA
acgtccttatgcctaatgatgatacttccagcagcattagcttttcacttgactagccgtgacggagaacctagaatgatcgtaggcaaaaatgaaaggggaaaatcattactatttaaaacagcatcaggaataaacatgtgtactcttatagcgatggacctaggagaaatgtgtgatgacacggtcacatacaaatgtccccacataactgaagtagaaccagaagacattgactgttggtgcaatttaacaagtacatgggtaacatacggcacctgtaaccaagcgggagaacatcgaagggataaacggtcagtagctctagctccgcacgttgggatgggactagacactagaacgcaaacctggatgagcgcagaaggagcttggcgacaagtagaaaaagtagaaacttgggccttacgtcatccaggatttactattcttgccctctttctggctcattacattggaacatctctcacacaaaaagtcgtaatattcatactcctcatgctagtaacaccatcaatgactatgagatgcgtaggtgtgggaaatagggatttcgtagaaggattaagcggtgcaacctgggttgatgtagtactagaacatggaggatgcgtaacaactatggccaaaaataaacccactttggatatagaattgcagaaaacagaagcaactcaattagcaacattacgcaaactatgcattgaaggtaaaataactaatataactacggacagccgttgcccaacacaaggagaagccaccctaccagaagaacaggatcagaactatgtttgcaaacacacatacgtggatcgcggttggggaaacggatgcggattgtttggaaaaggtagccttgtaacatgcgctaaatttcagtgcttagaacccatagaaggaaaagtagttcagtacgaaaatttaaaatacacagtcataatcaccgttcatactggtgaccaacatcaagtggggaacgaaacacaaggcgttactgcggaaataacgccacaagcaagtactacagaagctatacttccagagtacggcactctcggtttagaatgcagtccaagaaccggtttagattttaatgaaatgatattattgacaatgaaaaataaggcttggatggtgcataggcaatggtttttcgatttacctttaccgtggacttcgggtgctacaaccgagacaccgacatggaatagaaaggaactcttagtaacattcaaaaacgctcatgctaagaagcaagaagttgtagtcctagggtcacaagaaggtgcaatgcacacggctctaacaggtgctactgaaattcaaaattctggagggacatcaatattcgccggacacctaaaatgtagactaaaaatggacaaacttgaattgaaaggcatgtcatacgcaatgtgtaccaatacattcgtactaaagaaagaagtgtcagaaacccaacatggcacaatattaataaaagtggaatacaaaggcgaggatgtgccctgtaaaataccattctctacggaagatggccaaggaaaagctcataatggaagattgataaccgccaacccagtggtaaccaagaaagaagaacctgtaaatattgaagctgaaccgccttttggtgagtcaaacattgtaataggtataggcgacaatgcactaaaaataaattggtacaagaagggatcttcaattgggaaaatgttcgaagcaacagcccgtggagctcgtcgtatggctatattaggggatacagcatgggactttggctctgttggcggggttctaaattccttggggaagatggtccaccagatattcggctctgcctatactgcgttgtttagtggtgttagttgggtaatgaaaatcggcatcggagttctgctaacatggataggactaaattctaaaaatacgtcaatgtcattttcatgcatagctataggaattattacattgtatctaggcgcggtagtacaagcagatatgggatgcgttatcaattggaaagggaaagaattaaaatgtggttcaggcattttcgtgacaaatgaagtgcatacttggacagagcaatataagtttcaggcagacagtccaaaaagactagccacagctattgcaggagcttgggagaatggagtatgcggaattagaagtacaacaagaatggagaatttgctatggaaacaaatagcaaacgaattaaactatattctttgggagaacaacataaaactcacggtagtggtaggagatatcatcggcgtccttgagcagggaaaaagaaccttaacaccacaaccaatggaattgaaatattcatggaagacgtggggaaaggcaaaaatcgtcacagcagagacgcaaaacagctcgttcattatagacggaccaaacacaccagagtgcccctccgtttcacgcgcctggaacgtctgggaagtcgaagattatgggtttggcgtattcacaacaaacatatggctcaaactaagggaagtgtatacgcagctttgcgatcatcgcttgatgtcagctgcggttaaggatgagcgtgcagtacacgcagatatgggatattggattgaaagccagaagaatggttcgtggaaacttgaaaaagcatcactaatagaagttaaaacatgcacctggccaaagtcccataccttatggagtaatggtgtcctggagtcagatatgataatccctaaatcattagcaggacctatttctcaacataaccatcgacctgggtaccacacccaaaccgcgggaccatggcatctaggaaaattagaactagacttcaactattgtgagggtacgacagtagtcataaccgaaaactgcggcacacggggcccctcattacgcaccacaacagtatcaggaaaactcatacacgaatggtgctgtagatcgtgcactctccctcctttacgatacatgggtgaagatggatgctggtacggaatggaaattcgtccaatatcagaaaaagaagaaaatatggtaaaatcacttgtaagtgcaggcagcggcaaagttgataactttacgatgggagtgttatgcttggcaattttatttgaggaagttatgaggggtaaatttggtaaaaagcatatgatagccggtgtattctttacttttgtattgttactatccggacaaataacctggcgggatatggctcatacgttaattatgattggatctaatgcgtcagatcgtatgggaatgggagtcacatacctggcattaattgcaacctttaagatacagccatttttagcactgggcttctttttaagaaaattaaccagtagggaaaatctcctgctgggggtaggattggctatggcgacgacactacaattaccagaagatatcgaacaaatggccaacgggattgctttgggccttatggcactaaaattaataacacagtttgagacctaccagttatggacagcgctaatcagtttaacctgctctaatacaatctttacccttacagtagcctggcgaacggcaacattaatactggcaggggtatcactactaccggtatgtcagagtagttcaatgaggaaaacagactggttgcctatggcagtagctgcaatgggtgtgcctccgctacccctttttatattcggtttgaaagatacgttgaaacggcggtcttggcctctaaacgaaggtgtaatggccgtcggcttagtgtcaatactggcaagttctcttttgcgaaatgacgtgcccatggctgggccattagtggcaggaggtctactcatagcgtgctatgttataacaggaacttcagccgatttgactgttgaaaaagcagctgatattacatgggaggaagaagcagagcaaacaggcgtaagtcataatttaatgataacagtggatgacgacggcactatgaggataaaagacgatgaaacggagaatatcttgacagtactcttaaagacagctttactgatcgtgtcaggaatatttccatatagtatccccgccacgctattggtttggcatacatggcaaaaacaaacacagcggtccggagtactttgggatgtgccttctccacctgaaacacaaaaagcagaattagaggagggagtatacaggataaaacaacaaggcatttttggtaaaacacaggtaggtgtgggggttcaaaaagaaggtgttttccacaccatgtggcatgtaaccagaggagcggttttaacatataatggaaagcgactagaaccaaattgggcttcggtcaagaaagacttaattagttatggcggcggatggagactgagtgcgcagtggcagaagggggaagaggttcaggtgattgccgtagaacccggcaaaaatcccaaaaattttcaaacaatgccagggacctttcaaacgacaacaggggagataggagcaatagccctggatttcaaacctggtacatcgggatcacctatcataaacagagaaggaaaggtggtcggcctatatgggaacggagtcgtaacgaaaaacggcggatacgtatccggtatagcacaaacaaacgccgaaccagatggtccaaccccggagttagaagaagaaatgttcaaaaagagaaacttaactataatggatctacatccaggatcaggaaaaacacgtaaatatttaccggctatagtaagagaagcaataaagcgacgcttgaggacgcttattctggcaccaacacgagttgtagccgccgagatggaggaagcgttaaaaggactcccaataaggtaccagacaaccgcaacgaaaagcgaacatacggggagggaaattgtagatctcatgtgccacgctacattcacaatgagattattatctccagttagagtgccgaattacaaccttataataatggatgaagcacactttacggacccggcgtccatagcagctcgtggctatataagcacgcgagtaggcatgggcgaagccgcagcaattttcatgacagcaactcctcccggaacagcagatgcctttccgcagagtaacgcccctatacaggacgaagaacgtgacatacccgaaaggagttggaactctggtaacgaatggataacagactttgctggaaaaactgtatggttcgttccatcaatcaaagctgggaatgacatagcaaattgcctaagaaagaacgggaagaaggttattcaattatcccggaaaacctttgatactgaatatcaaaagactaaactaaatgattgggattttgttgttacaacggacataagcgagatgggcgccaactttaaagcggatagagtcatagatccacggagatgcctcaaaccagttatactaacagacgggccggaacgtgttatattggcaggtcctatgccagtaactgcagcatctgcagcacaacgtagaggtagagtaggcaggaatccacaaaaagaaaacgaccaatatattttcacgggacagcccctaaataacgatgaagatcatgcgcattggacagaagctaaaatgttactcgacaatatcaacacacccgaaggtatcatacctgcgctttttgagcccgaacgggagaaatccgcagcaatagatggtgaatatcgacttaagggggaaagccgtaaaacgttcgtcgaacttatgaggcgtggcgatttacctgtgtggttagcacataaggtcgcgtcggaaggcataaagtatacagatagaaagtggtgcttcgatggtcaaagaaataaccagatattagaagaaaatatggacgttgaaatttggaccaaagaaggtgagaaaaagaaactccgacctcgatggctggacgcgcgaacatactcagatccacttgcacttaaagaatttaaagagttcgctgcaggaaggaaatcaatagccttagacttagttacagaaataggaagggtaccaagtcatctagcgcaccgcacacgtaacgccctcgataacttggtaatgctgcacacaagtgagcatggcggtagagcatataggcatgcggtagaagaattaccggagacaatggaaacgctattacttctcggattgatgatattattgaccggaggagcgatgctgtttctaatatcaggtaaaggaatagggaaaacaagcataggattgatttgtgttatagcttcttcaggaatgttatggatggctgaaatcccattgcagtggatagcttctgccatagtgttagagttcttcatgatggtattactgattccagaaccagaaaaacaaagaacaccccaagataaccagttagcgtatgttgtaataggaatattgactctggcagcgatcatagccgcaaatgaaatgggcctactagaaactactaagagagaccttggcatgagcaaggaaccaggagtagtaagtcccacaagttaccttgatgtcgacttgcaccctgcaagcgcgtggacgctttatgcggtagccaccacagttataacgccgatgttaagacacactatagaaaactcaacagctaatgtatcgctagccgctatagccaatcaagcagttgtcttaatgggccttgataaaggatggccaatttcaaaaatggatctgggggttcccttgttggcactaggatgttattcgcaagtaaatccattaacactgacggcagcggtacttcttctaataacacactacgcaatcataggacctggactacaggcaaaagcaacgcgagaagcacaaaagcgtacagcagctggaattatgaaaaatccaactgtagacggtataatgacaatagacttagatccggttatatatgattctaaatttgagaaacaactgggtcaggtaatgcttctagttctctgtgcggtgcaactactgctcatgagaacaagctgggcattatgcgaagcattgacgctggccactggaccaattacaacattgtgggaaggaagtccagggaaattttggaacacaacgatagctgttagcatggcaaatatatttagaggtagctatttagcgggtgcaggactggccttctcaattatgaaatccgttggtactggaaaaagaggaacgggatctcaaggcgaaacacttggggaaaaatggaagaagaaattaaaccagttatcaagaaaagattttgacctctacaagaaaagtggcataacagaagtagatcgtactgaggcaaaagaaggattgaaacgtggtgaaataactcatcacgcagtatccagaggttcagctaaattacagtggttcgtggagcgcaatatggtaataccagagggccgagtgatagatttaggctgtggcaggggcggatggagttattattgcgcagggttgaagaaagtgacggaagtgcgcggatatacgaaaggcggtccgggacatgaagaacctgtgccaatgagtacatatggttggaacattgtcaaattaatgagtgggaaagatgtattttacctgccaccagagaagtgcgatacgttactatgcgacataggagaatcgagtccctctccaacagtcgaagagtcgagaaccatacgagttttaaaaatggttgagccttggttgaaaaacaaccaattttgtataaaagtactcaatccttacatgccaaccgtgattgaacacttagaacgtttacagcgaaagcacgggggcatgcttgttcggaatccattgtcaagaaactccacgcatgaaatgagttggattagcaatggtacgggtaatattgttgcttcagtaaatatggtttctcggctattattgaaccgcagtaccatgacacatcgtagacctacgattgagaaagatgtcgacctcggtgctggaccccgacacgttaatgcagacccagagccaccgaatatggatgtgataggtgaaaggataaaacgggttaaggaagaacataattccacttggcattacgatgacgagaacccatacaaaacttgggcataccatggatcctacgaggtcaaagcaacagggtcagcgtcatctatgattaacggagttgtgaagctattaactaaaccgtgggacgtagtcccaatggtaccacaaatggccatgacggacacaacaccctttggccaacaaagagtcttcaaggaaaaggttgacacgaggactccgcggtcaataccaggaacaagaagagtgatggggattacagcggagtggctgtggcgcacccttggcagaaataaaaagccacggctctgcacgagggaggaatttaccaagaaagttcgaaccaatgctgcaatgggagcggttttcactgaagaaaatcaatgggactcggcaaaagctgctgtcgaagatgaagacttctggaaattggttgatcgagaaagggaattacacaagttaggcaaatgcggtagttgtgtatataatatgatgggaaagagagagaagaaattaggagaatttggaaaagcgaaaggcagcagggcgatctggtatatgtggttaggtgcgcgttacctcgaatttgaggccctaggatttcttaatgaagaccattggtttagtcgagagaacagttattcaggtgtggaaggtgaaggattacataaactgggttatattctacgtgacatctcaaaaattccgggcggagcaatgtacgcggacgacactgcaggctgggacacacgaatcacagaggacgatctacataacgaagagaaaataactcaacaaatggacccagaacataggcaattagcaaacgcaatttttaaactcacttatcaaaataaagtggtaaaagtccagaggcctacgccgacaggtacagttatggatattataagtcgcaaagatcaaaggggatctggtcaagtaggaacctatggattaaatacttttaccaatatggaagcgcagctgatccgacaaatggaaggtgagggggtactgagcaaggcggacctagaaaatccacatttaccagagaagaaaattacacaatggctagaaacgaaaggagtagaaagactaaaaagaatggcgatcagcggggatgactgcgttgtaaagccaattgatgatcgattcgcgaacgcgttgcttgcactaaatgatatgggaaaagtaagaaaagacataccccaatggcagccttcgaaaggctggcatgactggcaacaggtcccattttgctcacatcactttcacgaactcattatgaaggatgggagaaagttagtcgtaccatgtagacctcaggatgaattaattggtcgagcaagaatttctcagggagcaggctggtccctaaaagaaaccgcatgtctagggaaagcatatgcgcaaatgtggtctctcatgtactttcacaggcgcgatcttcggctcgcatccaacgcaatttgtagcgccgttcctgtgcattgggtgcccacttctcggactacctggtcaattcacgcccaccaccaatggatgaccactgaggatatgttaacagtttggaacagggtctggatcgaagataacccatggatggaagataaaacacccgtaactacttgggaaaacgtcccatacttaggaaaacgcgaggatcagtggtgcggatctttaataggcttgacttcacgtgcaacctgggcgcaaaatataccaaccgctatacaacaagtaaggagtttaatcggaaatgaagagtttttagattatatgccatcaatgaaaagattccgaaaagaagaggaatccgagggtgctatttggtag

SEQ ID NO: 23178 - RNA, 9873 nt, synthetic construct
  misc_feature 1..9873: note = derived and/or modified CDS sequence (opt6) from DENV-3__JF937630__SS-prME
  source 1..9873: mol_type = other RNA
acgagcctgtgcttaatgatgattttacccgctgccctcgctttccacttgacatcaagagatggagaaccgaggatgatagtcggtaaaaatgaaagaggaaaatcattgctattcaaaactgcctccggaatcaatatgtgtaccttaatagcaatggatctaggtgaaatgtgtgatgatacggttacgtataaatgtccgcacataacggaagtggaaccagaagatatcgactgttggtgtaatttaacttcaacctgggtaacgtacggaacgtgtaaccaagcaggagaacatcgaagagataaacgatcagtagcactggcaccacacgtaggtatggggttggatactagaactcaaacatggatgtctgcagaaggggcatggagacaagtggaaaaagttgaaacgtgggctttgcgacaccctggtttcacgatacttgcactatttctggctcactacatagggacgagtctcacacaaaaagtggtaatctttatactacttatgcttgttacgccgtctatgactatgcgttgtgtgggtgttgggaacagagactttgtagaaggtttgagtggagccacgtgggtggacgtagtactcgaacacggaggttgcgtaactaccatggctaaaaacaaacctacactggatattgaattgcagaaaactgaagccacacaactggcaacactaagaaaattgtgtatagaaggtaaaattactaatattacaacagattccagatgccctacacaaggagaagcgaccttaccggaagaacaagatcaaaattacgtatgtaaacatacatatgttgacagggggtggggcaacggatgcggattgttcggaaaaggatcgttagtgacatgtgcgaaatttcaatgcttagaaccgattgaaggaaaggtcgtacagtatgaaaacctaaaatacacagttattataacagtacatacaggtgatcaacaccaagtaggcaacgaaacccaaggcgtaactgcagaaatcacaccacaagcaagcactacagaagctattttgcctgaatacggaacgttaggattggaatgcagcccccgtacgggattagatttcaatgaaatgattttactaacaatgaaaaataaggcctggatggtacaccgtcagtggttctttgacctgccgttaccgtggacaagcggggcaacaacggaaactccaacttggaacagaaaagaattgctagtaacttttaaaaatgctcatgccaagaaacaggaagttgttgtgttgggatctcaagaaggtgctatgcacaccgccctaacaggagctacagaaattcaaaattcagggggcacctcgatttttgcaggacacttaaaatgtagactaaaaatggataaactggaattaaagggaatgtcttatgccatgtgcactaatgcctttgttttaaagaaagaagtgagtgagactcaacacggcaccatattgataaaggtggagtataaaggtgaagacgtaccctgtaaaataccattctcgactgaagatggacagggaaaagctcataacggaagattgataactgcaaatccagttgtgactaagaaagaggaaccagtgaatatcgaagccgagccgccctttggagagtcaaacatcgtgataggaataggagataatgcattaaagattaactggtacaagaaaggtagttcaatagggaaaatgtttgaagcgacagcaagaggggcaagaagaatggcaattttgggagataccgcttgggatttcgggtctgttggcggtgtactaaacagtttaggtaaaatggtacatcaaatctttggctctgcctatacagcgttattctcaggagttagttgggttatgaaaattggtataggagtactgttgacttggattgggttgaatagtaagaatactagcatgtcttttagttgtatcgcaattggtataatcacattatacttaggtgctgttgttcaagcggatatgggctgcgtaataaactggaaaggaaaggaactcaaatgcggatccggaatatttgtaacgaacgaagtacatacttggaccgaacaatataaattccaagctgacagcccgaaacgcctggccacggctatagccggtgcttgggaaaatggagtgtgcggtatcaggtcaacgactagaatggagaatttactatggaaacaaattgcaaatgaacttaactatattctctgggaaaataatatcaagctgacagttgtagttggggatatcatcggtgtgcttgaacagggcaaaagaacattaacaccgcaaccaatggaattaaaatattcgtggaaaacatggggaaaagcaaagattgttactgcagaaacacaaaatagctccttcatcatcgacggcccaaatacacccgaatgtccgagtgtttcgcgtgcctggaatgtatgggaggtagaggactatggctttggggtgttcacaactaacatttggctaaaactaagagaagtttatacccaactttgcgaccatagactcatgagtgcagccgtaaaagatgagagagctgtacatgcagatatgggatactggatcgagagtcagaagaacggttcgtggaaacttgaaaaggcatccctaatagaagtgaaaacatgtacttggccaaagtctcacactctttggtcaaatggcgtccttgaaagtgatatgataatacccaaatccctagcaggtcccatatcacaacataaccatcgacctggctatcatacacagacagctggaccatggcatttaggtaaactggaactagacttcaattactgtgagggaacaacagttgtaattactgagaattgcgggacacgtggaccatccctacggactacaacagtaagcgggaaactcatacatgaatggtgttgtagatcatgcacactaccacctttaaggtatatgggagaggatggctgttggtacggtatggaaataagaccaatcagtgaaaaagaagaaaatatggtgaaatcactggtgagtgcagggagcggcaaagtagataactttacaatgggagtgctctgtctagcaatcttatttgaggaggtaatgcgtggaaaatttggtaagaaacacatgattgctggggttttcttcactttcgtattattattatcaggtcagattacctggcgagacatggcacacacattgatcatgatagggtcgaatgcatcggacagaatgggtatgggagtaacatatcttgcattaattgctacattcaaaatccagccattccttgctttaggcttctttctgcggaagctaaccagtagggaaaacttattactaggtgttggcctagcaatggcaacaacgttacaattgcccgaagatatagaacaaatggccaatggcatcgcgctaggacttatggcactgaaattgataacccagttcgaaacatatcagttgtggaccgccttaatcagtctaacttgcagcaacacaatattcacacttactgtagcgtggcgaaccgccactctaattttggccggagtgagtttgctgcccgtttgtcaaagcagttcgatgaggaaaacagattggttaccgatggccgtagcagcaatgggtgttcctccgttacccctattcatcttttcacttaaagacacattaaaacgccgcagctggccacttaacgagggagtaatggcagtaggtttagtgtcaattctagcatcaagcctactacggaatgacgtaccaatggccggtcctttggtcgcagggggattactaatagcgtgctacgttataactgggacaagtgcagatctaacagtagaaaaagcggctgacattacgtgggaagaagaagcagaacaaacaggtgtaagtcataacttaatgatcacagtggacgatgacggcacgatgcgtattaaagatgatgagactgaaaatatattaacggtactactgaaaactgctctgttaatcgtttctggtatatttccatactctattccggctactctgttggtgtggcacacatggcaaaagcaaactcagcgcagcggtgtcttgtgggacgtgccgagcccacctgagactcaaaaagcagaactagaggagggcgtctatagaataaagcaacaagggatatttggaaagacccaagttggagttggagtccaaaaagagggtgtctttcatacaatgtggcacgtaacgagaggtgcagtcttgacatataatggaaaaagacttgaacctaactgggcctcagtaaagaaagacttaattagctacggaggagggtggcgtctatcagcccaatggcaaaaaggtgaagaagtgcaagtcatagcagtagagccggggaagaacccgaaaaattttcaaacgatgccagggactttccaaacgacaactggggaaattggtgcgatagcgctggattttaagccggggacatcgggatcaccaatcataaatagggaaggaaaagttgttggcctatacggtaacggagtagtaactaaaaatggaggttatgtgtcaggtatagcacagacgaatgctgaacccgatggcccgacaccagaactagaagaagaaatgttcaagaaacgaaatttgaccataatggacttacacccagggtcgggaaaaacaagaaagtaccttccggcaatagtacgagaagcaataaagcgtaggctgagaactttgatcctagcgccaactagagtagtagctgcagaaatggaagaagcattaaaaggcttgcctatccgataccagacaaccgcgacaaaatcagagcacacaggtagagagattgtggacttgatgtgtcatgcaaccttcacaatgcgactgcttagcccagtaagagtacctaactacaacttaatcataatggatgaggctcacttcacggaccctgcatcaatagcggctcgtggatatatatcgacaagggttggaatgggggaagccgcagcaatcttcatgacggcgacaccacccggtaccgctgatgcctttccccagagtaacgcccctatacaagatgaggagcgagatataccagaacgctcatggaactcaggaaatgaatggattaccgatttcgccggaaaaacggtctggttcgtcccctcgataaaagcgggaaatgacatagccaactgcctacgtaagaatggcaagaaagtaattcaactgagtagaaaaacttttgatactgaatatcagaaaacgaaactaaacgactgggacttcgtggtgaccacggacatatcagaaatgggcgctaattttaaagccgacagggtgatagacccacgaaggtgcctcaagccggtgatactaacagacggaccggagagagtaatactagcaggacctatgccagtgacagctgctagcgcagctcaaagaaggggccgagtcggtcggaatccacagaaagagaatgaccagtacatatttacaggccaaccgctaaataacgacgaagaccatgcgcattggacagaagctaaaatgcttcttgacaacataaatacccctgaaggaattataccggcattatttgaaccagaaagagagaaaagtgctgccatagacggtgaataccgcttaaaaggcgaatcaaggaaaacttttgttgaattgatgcgtcgtggcgacctacctgtatggcttgcacataaggttgcttctgaggggattaaatatacggatcgaaagtggtgttttgatggtcaaaggaataaccaaattttagaagagaatatggatgtcgaaatctggacaaaagaaggcgagaagaagaaactaagaccgagatggctagatgcccgtacatacagtgatccacttgctcttaaagaatttaaggagttcgccgctggcagaaaaagcatcgcacttgatctagtaacagaaattggaagagtccctagtcacttagctcataggacgaggaatgcactagataacctcgtaatgcttcacacaagtgaacatggagggagagcatacagacatgcggttgaagagttgcctgaaacaatggagacgctacttctactcgggctaatgatactcctaacgggaggggcaatgttatttctaatatctggtaaaggaattggtaaaaccagtattggcctgatctgtgtaattgccagcagcggcatgttgtggatggcagaaattccactacaatggattgcatcagcaatagtattggagttctttatgatggtactcctgatccctgaacctgaaaaacaacgcacaccccaagataatcaattagcttatgttgtgataggaatactaaccttagccgcaataatagcagccaatgagatgggccttttggaaactaccaagcgtgacttaggaatgagtaaagaaccaggagtggtcagtccaacaagttatttagatgtagatctacacccagctagtgcatggacattatatgcggtcgctacaacagtaattacaccaatgcttcgtcacactatagagaactcgaccgcaaatgtctctttggcagctatagccaaccaagctgtcgtgctaatgggattagacaaaggctggcctatctccaaaatggatttgggagtcccattgttggcccttggttgttattcacaagtaaaccccctaacgctaacggcagcggttttattattaataacacactatgcaatcatcggtccgggactacaagcgaaagcaaccagagaagcacaaaagagaacagcagcaggcataatgaaaaatcctacggttgacggcatcatgaccatagacttagatcctgtcatttatgatagtaagttcgaaaaacaactcggacaagtcatgttattagtcctctgcgctgttcaattacttttaatgcgcacaagctgggctctatgtgaggctttaactttagcaacggggcccattactacgctttgggaagggtccccaggcaaattttggaataccactatagcagtttcaatggccaatatctttcgagggtcatacttagctggcgcgggactcgctttcagcataatgaagtctgtaggaactggaaagcggggaaccgggagtcagggggagacgctaggggaaaaatggaaaaagaaactgaaccaattatctcgaaaagacttcgatttatacaagaaatcaggaataactgaagtagataggacggaagcaaaagaaggacttaaaagaggagaaataacacatcacgctgtgtcacgaggatcagcaaaattacaatggttcgtagaacgaaatatggtaataccggaaggaagagtaatcgatcttggttgtggcagagggggttggtcttactactgcgctggattgaagaaagtgacggaagtacggggttatacgaaaggaggacctggtcatgaagaaccagttccaatgagcacctatggatggaacatagtaaaactaatgtctggaaaagatgtattctatttacctccggaaaaatgcgacacgttgctatgtgacatcggggaaagttctccttctccaaccgtggaagaatcaagaacaattcgggtattaaaaatggtagaaccctggctcaaaaataaccagttttgcataaaagttttaaatccttatatgccgactgttatagaacacttagaaaggctacaaagaaagcacggagggatgctagtaagaaacccattatcacgcaactcaacacacgaaatgtactggatatcaaatggcacaggaaatatcgtagcgagcgtaaatatggtctcgagactgctattgaaccgattcacaatgacacatcgacgtcccactattgaaaaagatgttgacttaggagccgggacaagacatgttaatgcagaacccgaaactccaaatatggacgtcataggtgaacgaataaaacgaataaaagaagaacataattcaacttggcattatgatgacgagaacccatacaagacatgggcatatcacggatcatacgaagtcaaagcgacaggttcagccagtagtatgatcaacggagttgttaagttgctaacaaaaccatgggacgtagtgccaatggtcactcaaatggcaatgactgacacaacgccattcggccaacaacgtgttttcaaggagaaagtagacaccaggacacctagaagcatgcctggaacgcggcgagtcatgggaattactgcggagtggttatggaggacactaggtagaaataagaaaccacgattatgtacccgcgaagagttcaccaagaaagtccggactaatgccgcgatgggagcagttttcaccgaagaaaaccaatgggatagcgcaaaggcggcggtcgaagatgaggacttttggaaactcgttgatagagaacgggaacttcataaactcgggaaatgtggtagctgtgtttataacatgatggggaaacgagagaagaaattaggtgagttcggaaaagcaaaaggatctcgcgcgatatggtacatgtggttaggagctaggtacttagagtttgaagcattaggatttctaaatgaagaccactggttttcacgagaaaattcatattcaggagtggaaggagaaggattacataaattgggatacattttgagggatataagcaagatcccgggcggcgcgatgtatgcggatgatactgcaggatgggacactcggattacagaagatgatttacataatgaggagaaaataacacaacaaatggatccggaacatagacaactggctaacgccattttcaaattgacttaccaaaacaaggttgtaaaagtgcaacgacctactcccactggcactgttatggacataatatctagaaaggatcaacgaggtagtggacaggttggaacttacggactgaacacatttacaaacatggaagcacaattaattaggcaaatggagggagaaggtgtcttgtcaaaagcggacttagaaaatccacacttgcccgagaagaaaatcacccaatggttagagactaaaggagtagaaagactaaagagaatggcgatttcaggtgatgattgcgttgttaaacctattgatgatagattcgctaatgcattactagcgctaaatgacatgggaaaagtacgtaaggacataccgcaatggcaaccctcgaagggttggcacgattggcagcaagtacctttctgcagtcatcattttcatgagttaataatgaaggatggtcggaaacttgttgtaccatgtagaccacaagatgagctgatagggcgggcaagaatctctcaaggcgctggttggtctttaaaggagacggcctgccttggtaaggcctacgctcaaatgtggtcgttaatgtattttcatcgcagggatctcaggttagcaagcaacgcaatatgtagcgcagtacccgtacactgggtgccgacatcgagaaccacctggtcaatacatgcacatcatcagtggatgacgaccgaagacatgttgacggtatggaacagggtttggatagaggataatccttggatggaggacaaaacgcctgtaacaacatgggagaatgtaccatacttgggaaagagagaagatcaatggtgtgggagcctaataggattaacgagtagagccacttgggcacagaatatacctacagctattcaacaagtaagaagcctaattggaaacgaggaatttcttgattacatgcctagtatgaaacgttttagaaaggaagaagaatcagaaggcgcaatatggtaa

SEQ ID NO: 23179 - RNA, 9873 nt, synthetic construct
  misc_feature 1..9873: note = derived and/or modified CDS sequence (opt6) from DENV-3__JN000936__SS-prME
  source 1..9873: mol_type = other RNA
acttcattatgcctgatgatgatactaccggcggcactagcatttcatctaacatctcgggacggagaacccaggatgattgtaggcaaaaatgaaaggggaaaaagcctcctgtttaaaacagcgtcaggaatcaacatgtgtacattgatcgctatggatcttggggaaatgtgtgacgatactgttacatacaaatgtccacacattaccgaagtggaacccgaagatattgattgttggtgcaatctaacgtcgacctgggttacatatggaacttgcaaccaagcaggagaacacaggcgcgataaaagaagcgtagcgttagcaccgcacgttggaatgggtctagatactaggacacaaacttggatgagtgcagaaggggcatggcgacaagtcgaaaaagtagaaacctgggcattacgacacccaggattcacaatacttgcattatttctcgcacactatataggaacaagtctaacacaaaaagtcgtcatcttcatactactgatgttagtgactcccagtatgactatgcggtgtgtaggggttgggaatagggattttgtcgaagggcttagtggtgcaacttgggtagacgtcgtgctggaacacggaggttgtgtgacaacaatggctaaaaataaaccaactctagacatagaactccagaaaactgaagccacacaactagcaactttaagaaaattatgcatcgaaggaaaaatcacgaatataacaactgacagcagatgtcctacacaaggggaagctacattgccggaggaacaagaccaaaactatgtttgcaaacatacatatgtggataggggatggggcaacggatgtggcttatttggtaaaggctctctagttacttgtgctaaatttcagtgtttagaaccaattgaggggaaagtggttcaatacgaaaacctgaaatatacagttatcatcacggtacatacaggtgatcaacatcaggttggcaacgagacacaaggggtcacagctgagataactccacaagcaagtacgaccgaagctatcttgccggaatatgggacattaggtttggaatgttctccaagaaccggattggatttcaacgaaatgatattactgacgatgaaaaacaaggcttggatggtgcaccgacagtggttctttgatcttcctttaccttggacttctggagctactactgaaactcccacttggaatagaaaagaactcttagtaacctttaaaaacgctcatgcaaagaaacaagaagtggtagtattaggatcacaagaaggagcaatgcacaccgctttaacaggagcgacagaaatacaaaattcaggcggaacatcaattttcgcaggccacctcaaatgtcgcctgaaaatggacaaactagaattaaaaggaatgagctacgcaatgtgtaccaatacttttgtgttgaagaaagaagtctccgaaactcaacatggtacaatcttgataaaagtagagtataaaggggaagatgtcccatgtaaaatcccctttagtaccgaagacggccaaggaaaagcccataatggaagattaataacagctaatcctgtagtcacaaagaaagaagaaccagtcaacatagaggccgaaccacctttcggagagagtaatatagtcatcgggataggagacaacgcgttaaaaatcaactggtataagaaaggttcttctataggtaaaatgttcgaagcgacggctagaggcgcaagacgcatggcgatattaggagatacggcatgggactttggcagtgtaggcggagtattgaatagtcttggtaaaatggtgcatcaaatctttggttcggcatatacagcccttttcagtggtgtatcgtgggtaatgaaaatcgggattggcgtcttattgacttggataggtttaaatagcaaaaatacttcaatgtcattctcatgtatagctataggtataataacactatatcttggagcagtggtacaggctgatatgggctgtgtaataaactggaaaggtaaagagctcaaatgcgggagtggtatatttgttacaaacgaagttcatacttggacagagcaatataaatttcaagcagactcaccgaaaagattggccacagcaattgccggcgcttgggaaaacggagtatgtggaataaggtcaacaacacgaatggaaaacctcttgtggaaacaaattgcaaatgagttaaactatatattatgggaaaacaacatcaaactaaccgtggtggtcggagatataattggtgtactcgaacaaggtaaaaggacattaacaccacagcctatggaattaaaatattcatggaaaacctggggaaaagcaaagatcgtgacagcggaaactcaaaactcctcattcattatcgatggacctaatacccctgagtgtccatcggtttcccgcgcctggaatgtatgggaagtcgaagactatggctttggagtttttaccaccaacatttggcttaaattacgggaagtttatactcaactttgtgatcatagattaatgtcggctgcagtaaaagatgaacgtgcagtacatgccgacatgggctattggatagaatcacagaaaaatggatcatggaaactggagaaagcatcgctcatcgaagttaaaacatgcacatggccaaagagccatacgctatggtcaaatggcgtattggaatccgacatgataataccaaaatcattagctggccctatctctcaacacaaccacagacccggttaccatacacagacggccggaccttggcatctgggtaaacttgaactagattttaactactgcgaaggtacaacagttgttatcactgaaaattgcggtacaagaggaccaagtctacgaaccacgaccgttagtgggaaattaattcacgaatggtgctgtagaagttgcactctgccacccttgcgatatatgggtgaggatggatgttggtatgggatggaaattagaccaatatcggagaaagaggaaaacatggtcaaaagtttagtgtcagccggctctggtaaagtggataacttcacaatgggtgttctatgcttagctattctgtttgaagaagtaatgagaggtaaattcggcaagaaacatatgattgccggtgtcgtattcacctttgtgttattgctaagcggacagattacttggagagatatggcacacaccttaattatgattgggtcaaacgcatcggatcgcatggggatgggtgtcacgtacttagcattaattgcaacttttaaaatacaaccattcttagcactcggattctttctcagaaaattgacctcgcgagagaatttattattgggcgtgggcttagcaatggcaacgactctacaattacctgaagatattgaacaaatggctaacggaatagcacttgggctaatggctctaaaattgataacacaattcgaaatataccaactttggacagctctaatttccctaacttgtagtaacactatatttacgttaacagtggcatggagaacagctacgctgattctggccggagtatctttactacctatgtgccaatcatcatctatgcgcaaaaccgactggctaccaatggccgtagcagctatgggagttccacccctacctctgtttatattttcactgaaggatacgctaaaaaggcgtagctggccactgaacgaaggggttatggccgttggtttggtaagtatattagccagttctttattgcgaaatgatgtgccgatggctggtccactcgtagctgggggtctattaattgcatgttatgtcatcactggtacatccgctgatcttacggtagaaaaagctgctgacataacatgggaagaagaggctgagcagaccggtgtttcacacaatcttatgataacagtagatgatgatgggacaatgcggataaaagatgacgaaacagaaaatatcttaacagtcctgctaaaaactgctctacttatagttagtggtatctttccctactcaatacccgcaacgttactcgtttggcacacttggcaaaaacagactcaacgctcgggagtactctgggatgtaccgagtccaccggaaactcaaaaagctgaactcgaggaaggagtttaccggataaagcaacagggtatattcggtaaaactcaagtgggcgtcggagttcaaaaagaaggagtatttcatacgatgtggcacgttacccgaggtgccgtattgacttacaatggcaagcggttagagcccaattgggcaagtgtcaagaaagatcttatatcatacggcggcggatggcgattaagcgctcagtggcaaaagggagaagaagtacaagttatagcggtagagccaggcaaaaatccaaagaatttccaaacgatgcctggcacgtttcaaacgacaacgggggagataggcgcaattgcactagacttcaaacctggtactagcggctcaccaataataaacagggagggaaaagtagtaggcttatatgggaacggagtcgtaaccaaaaatggaggttacgttagcggaatcgctcaaactaatgcagaaccagatggcccaaccccagaattggaagaagagatgttcaagaaacgaaacctcacaattatggatttacacccaggtagtggtaaaacaagaaaatacttaccagccatagtcagagaagcaataaaacgaagacttcgtacgttgattctcgcgccgacaagggtcgtagcagcagagatggaggaggctttaaagggtttgcccatcagatatcaaacaaccgcaactaagtctgaacatacaggaagggaaatcgtagaccttatgtgccatgcaacgttcactatgagactattatcccctgttagagtaccaaactataatttgatcataatggatgaagcacactttactgacccggcatctattgcagctagaggatacatcagcacgagagtagggatgggcgaagctgcagctatcttcatgacagcgaccccacctggtactgcagatgcgttcccacaatccaatgctcctatccaagacgaagaacgagacattccagaacgtagttggaactcaggcaacgaatggataacggatttcgcaggtaaaactgtttggtttgtaccatctattaaggctggaaacgatattgcgaactgcctacggaagaatggtaagaaggttattcagttgtcaagaaaaacatttgataccgagtatcagaagacgaaattaaatgattgggactttgtcgttacaactgatatcagtgaaatgggagcgaacttcaaagccgatcgtgttatagaccctaggcgttgtttaaaacctgttatactcacggacggcccggaaagagtgatccttgcaggccctatgcccgtcaccgcagcttcagctgcacaacgccgagggagagtgggtagaaatcctcagaaagagaatgaccagtacatattcacaggccagccacttaataacgacgaagaccatgcacattggacagaagccaaaatgctcctagataatattaacacgcccgaaggaatcataccagcactattcgaaccagaaagagaaaagtcagccgcaattgacggagaatacagactaaaaggggaatcaagaaaaacattcgtggagttaatgcgaagaggggacttaccggtatggctagcccataaagtagcctctgagggaataaagtacaccgatcgaaaatggtgttttgacggacaaagaaataaccaaatactagaagaaaatatggatgtcgaaatttggacgaaagaaggagagaagaagaaactacgcccgagatggttagacgctaggacgtatagtgaccctcttgcccttaaagaatttaaagaatttgctgcaggaagaaaaagtatagctttagatcttgtaaccgaaataggacgagtgccaagtcacttggcccatcggacaagaaatgctttagacaacctagtcatgcttcacacctcggaacacggaggacgagcatatcggcatgccgtggaggagctacctgaaacaatggaaaccttgctattgttaggcttgatgatcctgctgactgggggcgcgatgctattcttaatctctggtaaaggcattggtaaaacaagtataggacttatttgcgttataaccagttcaggcatgctgtggatggccgaaatccccctgcagtggatagcgagtgcaattgttcttgagttctttatgatggtacttttaattcccgaaccagaaaaacaaagaacaccccaagataaccaactagcctatgtggtgattgggatactaacgttagcagcaattatagccgcaaacgaaatgggtctcttagaaacaactaaacgagatcttggaatgtcaaaagaaccgggagtggtctcaccaacttcctatctagacgtggatctacatcccgcaagtgcctggacgttatacgctgtcgcaaccacagttataacgcctatgttgcgtcataccatagagaacagtaccgctaacgtatcattggcagccattgctaatcaagctgttgtattgatgggactagataaaggatggccaattagcaaaatggatttaggagtaccattattagcattaggatgctactctcaagtaaatccacttacactcaccgctgcagtcctgctattaatcacgcactatgcgattattggaccaggacttcaagccaaagcaacaagggaagcccagaaacggacagcagcaggtataatgaagaacccaacagttgatggtattatgacgatagatttagatcctgtaatctatgattcaaaatttgagaaacaattgggacaagtaatgttacttgtcctttgtgctgttcaactactattaatgagaacttcgtgggcattgtgcgaagcactaacgttagccacaggacctataacaacgctatgggaagggtcaccagggaaattctggaacactaccattgcagtaagcatggccaatatatttcgcggctcttatttggcgggggcaggactagcgttttcaatcatgaagtcggtaggcactgggaaacgtggaacaggcagccaaggcgaaacgttgggtgaaaaatggaaaaagaaacttaaccaactatctaggaaagattttgatctttacaagaaatctggtataacagaagtagacaggaccgaagcaaaggagggcttgaaacggggtgaaattacacaccatgcggtaagccgcggatcagctaaactacagtggtttgtagaacgtaatatggtaattccggagggaagagtaatagacttgggctgcggaagaggcggttggtcttattactgtgcaggactcaagaaggtcacagaggtcaggggatataccaaaggtgggccaggacatgaggagcctgttcccatgtcaacgtatggatggaatatagttaaacttatgagcggtaaagatgtattctatttacctccagaaaagtgtgacacattactttgcgatataggggaatcgagtccatccccaactgtagaagagtcccggactattagagtcctaaaaatggtggaaccctggctaaagaataatcaattttgtatcaaagtgttaaatccgtatatgcccacggtgattgaacacttggaaaggctacaaagaaaacacggcgggatgctcgtaagaaatcccctgagtagaaattcaacacacgaaatgtattggataagtaatgggactggaaacatagtagcatccgtcaacatggtatcacgattattattaaataggttcacgatgacgcatagaaggcctacaatagaaaaagacgtagacctaggtgctggaacaaggcacgtaaatgcggaaccagagacgccaaatatggacgttataggtgaaaggattaaaaggattaaagaagaacacaattcaacgtggcattatgatgacgagaatccatacaaaacgtgggcgtaccatgggtcatatgaagtaaaggcaacaggatcagcatcatccatgataaatggtgtggtaaagctcttaactaagccgtgggatgtagttccgatggtgactcagatggcaatgaccgatacaacgccttttgggcagcaacgtgtcttcaaagaaaaagtagatacaaggacgccccgtagtatgccaggaacccgaagagtaatgggaatcactgctgagtggttgtggcgtactttgggtcgaaataagaaacctcgactttgcacccgagaagagttcaccaagaaagtgcgcacaaacgccgcaatgggtgccgtttttacagaggagaaccaatgggacagtgccaaagccgcggtcgaggatgaggatttttggaaattagtcgatcgagaacgagaactacataaactgggaaaatgtggtagctgtgtatataatatgatgggcaaaagggagaagaaactaggtgagtttggaaaagctaaaggtagcagagcgatttggtacatgtggctaggcgcaagatacttggaatttgaagctctgggattcctcaacgaagatcattggttctctagagaaaattcctatagtggtgtagaaggtgaaggactacataaacttgggtacatcctaagagatatctcaaaaatacccggaggagcaatgtatgctgacgatacagcaggatgggacacgaggataaccgaggatgacttacacaatgaggagaaaataacccaacagatggacccggaacacagacaacttgccaacgcaattttcaagttgacataccaaaataaagtcgttaaagtccaaagaccaacgcctaccggaacggtaatggatattatctcgcgaaaagatcaaagggggtcaggacaggttggaacttacgggctaaatacatttacaaacatggaagcacaacttatcagacagatggaaggtgaaggagttctaagtaaagctgatttagaaaacccgcacttacctgagaagaaaataacccaatggcttgaaaccaagggagtagaaaggctgaaaagaatggcgatatcgggggatgattgcgtagttaagcccattgatgatcggttcgcgaacgccctactcgctttaaacgatatgggtaaggtaaggaaagacatcccccaatggcaaccctcaaaagggtggcatgattggcaacaagtacctttctgctcgcaccactttcatgaacttataatgaaagatggtcgaaagctagttgtcccttgcaggccacaagacgagctaatagggcgtgcccgcatctcacaaggtgcgggctggtcattaaaagaaactgcatgcttgggtaaagcgtatgcacagatgtggagtctgatgtacttccacaggagagatctaagacttgctagtaatgcaatctgttcagctgtgccagttcattgggtaccaacctcgcgaacaacgtggtcaatccatgctcatcatcagtggatgacaacagatgatatgttaaccgtgtggaatagggtatggatagaggacaatccttggatggaggacaaaactcctgtaacaacttgggaaaatgtcccctacttagggaaacgagaagatcagtggtgtgggagtcttatcggtcttacatcaagagcaacctgggcacaaaatattcctactgctattcagcaagtaagaagtttaattggcaacgaagagttcctagactacatgccaagcatgaaaagatttaggaaagaagaggaatccgaaggggctatatggtaa

SEQ ID NO: 23180 - RNA, 9873 nt, synthetic construct
  misc_feature 1..9873: note = derived and/or modified CDS sequence (opt6) from DENV-3__HQ541796__SS-prME
  source 1..9873: mol_type = other RNA
acaagtctatgtttaatgatgatattgccagcagcattagctttccacctcaccagcagagatggagaaccacgaatgatcgtgggcaaaaacgaacgtggaaaatccttacttttcaaaactgcgagtgggataaacatgtgcacgctaattgctatggatttgggagaaatgtgcgatgacactgtaacttataaatgcccccatataacggaagtagaaccagaagatatcgattgttggtgcaacttaacaagtacatgggttacgtacggaacttgtaatcaagccggcgaacacagaagagacaaaaggtcggtagcactcgccccacatgttggaatgggacttgataccagaacacaaacatggatgtcagcggaaggcgcatggcgccaagttgagaaagtagaaacatgggcattaaggcacccaggattcactatactagcattgtttctcgctcattatataggtacatcacttactcaaaaagtagttattttcatattgttaatgttagtaacgccatcaatgaccatgagatgcgtcggggttggcaatagagattttgtagaaggcttatccggagcgacatgggtagatgttgtattggaacacggcggatgcgttaccaccatggcgaaaaacaaaccgaccttagatatagaattacagaaaacagaagctacgcagttggcaactctcaggaaactttgtatcgaagggaaaattacgaatataaccacagactcaagatgtccgacccagggagaagctacattaccagaggaacaagatcaaaactacgtctgtaaacacacatacgtagacagaggatggggtaatggctgtggacttttcggtaaaggatccctagtaacttgcgcaaaattccaatgtttagaaccaatagaaggaaaggtagtgcaatacgaaaatttaaagtacacggtaataataacagtacatacaggcgaccagcaccaagtaggtaatgaaacccaaggagtgactgcagagattacaccccaagcaagcacgacagaagcaatcctacccgaatacgggactctgggattagagtgtagcccgcgcacgggcttggactttaacgagatgattctattgaccatgaaaaataaggcctggatggtgcacagacagtggttctttgacttaccattaccatggacatccggagcaacaactgaaacacctacctggaaccgaaaagaattgctagtcacttttaaaaatgcccacgcaaagaaacaggaggtagtagtattgggatcacaggaaggcgcgatgcataccgctcttactggtgcaacagaaatccaaaactcgggtggaacctcaatatttgctggacatttaaagtgtaggttgaaaatggacaaactggaattgaaaggtatgagttatgctatgtgcacaaatacttttgttctgaagaaggaagtaagcgaaacacaacatgggacaatcctaataaaggttgagtacaaaggcgaggacgtaccatgtaaaatacctttctcaacagaagatggccagggaaaggcacataacgggcgactaataacggccaacccagtagtaacgaagaaagaagaacctgtaaacattgaagccgaaccaccatttggtgagtcaaacactgttatagggattggtgataacgccttgaagattaattggtacaagaaaggtagtagtattggaaaaatgtttgaggctacagcacgcggtgctaggcgaatggcaatactaggggatactgcatgggattttggctcagtcggaggggtccttaattcactaggaaagatggtccatcaaatatttggttcagcatatactgctctcttttcaggagtaagctgggttatgaaaattggaataggggtcttactgacttggataggacttaatagtaagaataccagcatgagctttagttgtatcgctatcgggataataacattatatctaggcgcggtagtgcaagcagatatgggatgtgtaataaattggaaaggcaaagaactcaaatgtggctctggtatattcgtaacaaacgaggtacatacatggactgaacagtataagtttcaagcggattctcccaagaggttggcaaccgctatcgcaggagcatgggaaaatggagtatgcggaatccgatctacgaccagaatggagaacctattgtggaagcaaatcgcgaacgaattaaattatatcttatgggagaataatattaaacttacagtagtggtaggtgacataataggtgttctggagcaaggaaagagaactctaacaccacaaccaatggagttaaagtatagttggaaaacatggggtaaagcaaagatagttactgcagaaactcaaaattcctcctttataatagacggaccaaatacacctgaatgtccttccgtctcgagagcatggaatgtttgggaagttgaggattatgggtttggcgtgtttacaacaaatatatggttgaaactaagggaagtatacacacaactgtgcgaccatcgtcttatgtccgcggcagtgaaagacgaacgtgcagtacacgctgacatgggttattggatagaatcgcaaaagaatggtagttggaaactcgaaaaagcatctcttatagaggtgaaaacgtgtacgtggcccaaatcacatactttatggtcaaatggtgtattagaatcagatatgataatacctaaatcgctcgctggacccataagccaacataatcacagacccggatatcacacacaaaccgcgggaccgtggcacctaggtaagctagagctagacttcaactattgcgaaggaactacagttgtaattactgaaaactgtggaacgcgaggacccagcttaagaacaacaacggtatctgggaaacttattcatgagtggtgttgcaggtcatgtactctcccgcctcttaggtatatgggcgaggatggatgttggtatggtatggagataagacccatttcggagaaagaagaaaatatggtaaagtcattagtctcagctggtagcggcaaggtggacaattttacaatgggagtattgtgcttagcgatcctctttgaagaagtcatgcgggggaaatttggaaagaaacatatgattgcgggggtattctttaccttcgttcttcttttgtcagggcagattacgtggagggatatggctcacacactcataatgattggatccaacgctagtgatagaatgggtatgggtgttacttacctagcactaatagcaacttttaaaatccagccgtttttagccctcggcttctttctccgtaaattaacgtctcgtgagaatttactcttaggcgtagggttagctatggcgacaacactacaattacccgaggacattgagcaaatggcaaacgggatagccctgggtctaatggcactaaagttaataacacaatttgaaacgtatcaactatggactgcgctaatctctttaacctgtagcaatactatatttacactaactgtcgcatggaggacagccaccctaattttagccggtgttagtttgttgccggtttgccaatcttctagtatgcggaagacagattggctaccaatggctgttgctgctatgggagttccaccgttgcctctatttatattcggcctgaaggacacgctaaaaagaagatcatggccactaaacgaaggtgtaatggcagtcgggctagtttcaatactagcttcatcactgctacgaaacgatgttccaatggcaggtccattagtggccggaggacttttaatagcctgttacgtcatcacaggtacaagtgcagatttaacagtggaaaaagctgcagatataacttgggaagaggaagctgaacaaactggcgtaagtcataatttgatgatcacagtagatgacgatggtaccatgagaattaaagacgatgagaccgagaacatactaaccgtactactgaaaactgcactattaattgtatcgggcatctttccgtactcaatacctgctacgcttctcgtatggcacacgtggcagaaacagacacaacgcagcggagtcttatgggacgttccaagcccacccgagacgcagaaagcggagctagaggaaggtgtataccgaataaaacaacagggaatatttggtaaaacacaagtcggagtcggtgttcaaaaagagggcgttttccacaccatgtggcacgtgacgcgtggagcagtactgacatataatggtaaaaggctagaaccgaactgggcaagtgtcaagaaagacctaataagttatggtggcgggtggagactttctgcgcaatggcaaaaaggagaagaagtacaagtcatagcagtggagcccggcaaaaaccctaaaaacttccaaaccatgccaggtactttccagacgacaacaggcgagattggagcgattgctctcgacttcaaaccaggtacatcaggatcaccaattattaacagggaaggcaaggtagtgggtttgtatggaaacggagttgttaccaaaaatggtggctatgtaagtggaatagcgcaaactaatgcagaacctgatggaccgacaccagaactagaagaagagatgtttaaaaagcgtaatcttaccataatggacttacacccaggatctggaaagacacgtaaatatctaccagcaatcgttcgcgaagcgataaaaaggcgtctccggacactgattttagctcccacaagagttgttgccgcggaaatggaggaagcattgaagggtttacccattcgataccagactactgcaactaaaagcgaacataccggcagagagattgtcgatttgatgtgtcatgcgacattcacaatgcgactactgtcacccgttagagtacctaactataatttgataataatggacgaggctcatttcaccgatccggcatcgattgcggcgagaggttacataagcacacgcgttggaatgggagaagcggcggcgatttttatgacagccacaccaccaggaacggcagacgcctttccacaatccaacgccccgatacaagatgaagaacgcgatatacccgaaagatcctggaactctggtaatgaatggatcacggacttcgccggtaaaaccgtatggttcgttccttcaattaaagcaggaaatgacatagcaaattgtcttagaaagaacgggaaaaaggtaattcaattaagtagaaaaacgtttgacactgagtaccagaaaaccaagttgaatgattgggattttgtcgtaacgacagatatatcagaaatgggagcaaattttaaagccgaccgcgtaattgacccaagacgatgtctgaaacccgttatcctaacagatgggcctgaaagagttattttggccggtcctatgccagtgacagcagcaagcgcagcacagcgacggggccgtgtaggtcgtaatccgcagaaggaaaatgatcagtatattttcactgggcaacctctaaacaatgacgaagatcacgctcattggacggaagccaagatgttgcttgataatataaacaccccagagggaataattcccgcacttttcgagcctgaaagggaaaaatcggctgcgatagatggagaatatagactcaaaggggaatcgaggaaaacttttgttgaattaatgagaaggggagacctgacagtatggctagcccacaaagtagcttcagaaggaataaagtacacagatcggaagtggtgcttcgatggtcaaagaaacaaccagatattagaagaaaacatggacgtagaaatatggacaaaggaaggagagaagaagaaactaagacccagatggttagacgcgcgaacgtacagtgacccattagctctgaaagagttcaaagaatttgcagccggacgtaaatctattgcattagacttagtcacagaaattggaagagttccgtcgcacttggcacacaggacaagaaatgcattagataatctagttatgctacatacaagtgagcatggtggcagggcttatagacacgctgttgaagagttgccagaaaccatggaaactctgctattattaggacttatgattcttctaaccggaggagcaatgctttttctgataagcggaaagggtataggaaaaacatcaatagggctaatttgtgtcatagctagtagcggaatgttgtggatggctgagataccactgcaatggatagccagtgcaatagttttagagtttttcatgatggtccttttaataccggagcctgaaaaacagcgaacaccccaagacaaccagttggcatacgtagtaataggtatattaacattagctgcaatcattgctgctaatgaaatgggactattggagacaacgaaaagggatttgggcatgagcaaggaacctggcgtcgtttcacctacttcgtacttagatgtcgatctacacccagcaagtgcgtggacgctatacgcagttgctacaacagttataacaccaatgttaaggcatacgatagagaatagtacggccaatgttagcctggctgcaatagctaaccaagctgtcgtactcatgggactagataaaggctggccaatctcaaaaatggacttaggggttcctttgttagctttaggatgttacagccaagttaacccgctaacgctaacagcagccgtattgctattgataactcattatgcgataattggacctggtttacaagcaaaagcaacccgcgaagcacagaaaagaactgcagctggaattatgaagaatcccacagtagatggtataatgacaatagacctagatccagtgatatacgatagtaagtttgaaaaacaactcggtcaggtaatgctattagtactatgtgctgtgcaattgctcttaatgcgaacatcctgggcattgtgtgaagctctaactctagcgacaggtccaataactaccctatgggaaggcagtccaggaaaattttggaataccaccatagctgttagtatggcaaatatatttcgcggatcttatctggccggcgctggtcttgcattcagtataatgaagtctgtgggaacaggaaaaagaggtacaggaagtcaaggcgaaacactaggggaaaaatggaagaaaaagctaaaccaactttctcgaaaagactttgacctatacaaaaagtccggtataactgaggttgacagaaccgaggctaaagaaggcctaaaaaggggagagataacacatcatgctgtatcgagaggttctgcaaaactgcagtggtttgttgaaaggaatatggtaattcctgaaggccgcgtcatagacctaggatgtggacgaggcgggtggagttattattgcgcgggcctaaagaaagttactgaggtaagaggttatacaaagggaggcccaggacatgaggaaccggtaccaatgtccacatatggatggaacatagtaaagctaatgagtggaaaggacgtattctatctaccaccggaaaagtgtgacacacttctatgcgatataggagaaagttcaccatctccaacggttgaagaaagtagaacaatcagagtcttaaaaatggtagaaccatggttaaagaacaatcaattttgtataaaagtcttaaatccgtatatgccaacagtcattgaacacctagagagacttcaacgaaaacatggcggcatgttggtcagaaatcctttaagtcggaactcgacacatgaaatgtactggataagcaatggcacgggaaatatagtagcctccgtaaatatggtttcacgactcctattaaatagatttactatgacacatagacgacctacaatagagaaagatgtagacttaggtgcagggacacgacacgtaaacgctgagcctgaaacccctaacatggacgtcattggggaaagaataaaaaggataaaagaagaacataattcgacatggcattacgacgatgaaaacccatataaaacttgggcatatcatgggtcttacgaagtaaaggccacgggatctgcttccagcatgatcaacggagtagtaaagctattaaccaaaccatgggacgtagtaccgatggtaacgcagatggctatgacagatacaacaccatttggacaacaacgtgtatttaaagagaaggttgataccagaaccccaagaagtatgccgggtacaagaagggtcatgggaataacagcagagtggctttggcgaaccttagggaggaataagaagcctagattatgcaccagagaagaatttaccaagaaagttcgaaccaatgcagcgatgggagctgtgttcacagaagagaaccaatgggattccgctaaagctgcggttgaagacgaagatttttggaaattggtagatagagaaagagaattacataaactcggcaaatgcggatcgtgcgtatataatatgatgggaaagcgagagaagaaactaggagaatttgggaaggctaagggatccagggcaatctggtatatgtggctgggagcacggtacctagagtttgaagcactaggtttccttaatgaagatcattggttcagtcgcgaaaactcatattcgggagttgaaggtgaaggtctacacaagctcggttatatcttacgagatatatccaaaataccaggtggagctatgtacgcagacgacactgcaggctgggatacaagaataacagaggacgatcttcacaatgaagagaaaataacacaacaaatggacccagaacatagacaactagctaatgccatatttaaattaacttaccaaaataaagtggttaaagttcagcgtccaactccaacaggaactgtaatggacatcatttctaggaaggatcaacgcggttctggccaagtagggacgtatggactaaataccttcacaaacatggaagcccagttgatacgacaaatggaaggggaaggggtattgagtaaggccgatttagaaaacccacaccttcccgaaaagaagataacacagtggttagaaaccaaaggagtagaaagactaaaaaggatggcaatctcaggtgatgattgtgtagttaaaccaatagacgaccggtttgcaaacgcgttactcgccctgaatgacatgggaaaggtcagaaaagatattccacaatggcaaccatcaaaaggatggcatgactggcaacaagtaccattctgctcacaccattttcatgaactaattatgaaggatggacgcaaacttgtagtcccctgcagaccacaagacgaattaattggtagggcgaggatttcccaaggagcaggttggtcgttaaaagaaacggcttgtctcggtaaggcatatgcccaaatgtggtctttgatgtatttccataggcgtgatctacgtttagcctccaatgcgatctgctccgcagttccagtacattgggtaccaacctcgcgaacaacttggtctatacatgcacaccatcaatggatgactaccgaggacatgcttaccgtatggaatcgagtttggatagaggataacccttggatggaggacaaaactccggtaactacgtgggaaaacgtaccctatttaggaaagcgagaagaccaatggtgtggctctttgataggattaacatcacgtgcgacgtgggctcagaacatcccaactgcaattcaacaagtccgttctcttattggtaacgaagaatttttagattacatgccttccatgaaacgattcagaaaagaagaggaaagtgaaggagctatatggtaa

SEQ ID NO: 23181 - RNA, 9873 nt, synthetic construct
  misc_feature 1..9873: note = derived and/or modified CDS sequence (opt6) from DENV-3__HQ166034__SS-prME
  source 1..9873: mol_type = other RNA
acttcactatgtttgatgatgatcctaccagctgcacttgctttccatttaacaagcagagacggagaaccaaggatgatagttggtaaaaatgaaagaggaaaatccctactgttcaaaactgcaagtggaattaatatgtgtactttgatcgctatggaccttggagaaatgtgcgacgacacagtgacatacaaatgtcctcatataaccgaagtggaacctgaagacatagactgttggtgcaatttaacttcgacatgggtcacttatggaacttgtaatcaagccggagaacatcgaagagataaaagaagcgtggcattagcacctcacgtgggaatgggactagacacaagaacccaaacatggatgtcggctgaaggagcatggcgtcaggttgaaaaagttgaaacatgggcgctaaggcaccctggttttacaattctagctctatttttagcacattatattgggacatccctaactcaaaaagtcgtgatatttatattattaatgctagtaacacccagtatgacaatgcggtgtgtaggtgtaggtaatagagatttcgtagaaggcctttctggggcaacttgggtggacgtagttttggaacacggcggatgtgtaacaaccatggcgaaaaataaacctacactggacatagaattacagaaaacggaagctacccaattagctacattacgtaaactatgtatcgaaggaaaaataactaatatcaccacagacagcagatgcccaactcagggtgaagcaacgttacctgaagaacaagaccaaaattacgtgtgtaaacatacatatgttgatagaggttggggcaatggatgcggattatttggtaaagggagcctagtgacatgtgcgaaatttcaatgtctagaacctatagagggaaaagttgtacaacatgaaaatcttaaatatacggtaataataacagttcatacaggggaccaacaccaagttgggaacgaaacccaaggagtcaccgcagagattacgccccaagcatccactacagaagcaatactaccagaatacggcactctaggattagaatgctctcctaggacaggtttggactttaatgagatgatactattaactatgaaaaataaggcttggatggtacacagacaatggttctttgatttacccttgccatggacgtctggagcaacaacagaaactcccacgtggaacagaaaagaattacttgtaaccttcaaaaacgctcatgctaagaaacaagaggtggtggttttgggttcacaggaaggtgcgatgcataccgcacttactggcgcaacagaaattcaaaactcaggaggaacaagtatctttgctggacacctcaaatgtagattaaaaatggataagttagaactgaaaggtatgagttatgcgatgtgtactaacacctttgtactgaagaaagaagtgtcagaaactcaacatggtacgatattaattaaagtcgaatataaaggggaagatgtcccgtgtaaaatccctttctcgacagaggacggtcagggcaaggctcataatgggcgattaataacggctaatccggtcgtaacgaagaaagaggaaccggtcaatatcgaagctgagccaccatttggtgaatcaaatattgtcatagggattggggataacgcactaaagataaattggtataagaagggatcctcaataggaaaaatgtttgaagcaactgctagaggagcacgaagaatggcaatacttggcgacactgcgtgggactttggcagcgttggtggcgttttgaatagtctaggtaaaatggtccatcaaatattcggatctgcttataccgctctgttttcgggggtgtcttgggtcatgaaaataggaatcggcgtacttctgacttggattggactaaatagtaaaaatacctcgatgtcattcagttgcatagctataggaatcataactctatatctgggtgcagtggttcaagcagatatgggatgcgtaataaattggaaggggaaagaacttaaatgtggctccggaatcttcgtaacaaacgaagtacacacttggactgaacaatacaaattccaagcggattcacccaagcgactagcaaccgcaatcgccggtgcatgggaaaacggggtatgtggaataagatccacgacacgaatggagaatctactgtggaaacaaatcgctaacgagctcaattatattttgtgggaaaataatataaaactaacggtggtagtgggcgacattattggcgtgctagaacaaggaaaaagaactttaacacctcaaccaatggaactaaaatattcatggaaaacttggggcaaggcaaaaattgttacggctgagacacaaaatagcagctttataattgatggtccaaatacaccagagtgtcctagtgtatctcgagcatggaacgtttgggaagtagaggactatggatttggagtattcacgacaaatatatggttaaagctaagagaggtctacacacaattgtgtgatcatagacttatgtcggcagcagtgaaggatgagagagccgtacatgcagacatgggatattggatagagagtcaaaagaatggatcatggaaacttgaaaaagcgtcactgatagaggtgaaaacctgtacttggccaaaatctcatacattatggtctaacggcgtacttgaatctgacatgataatacccaagagtctagctggtccaatatcacaacataaccatagaccaggctaccatactcaaacagcaggaccatggcatttaggcaaattggaattggattttaattactgcgagggaactactgtcgtgatcacagagaattgcggaacaagaggtccgtctttacgaacgacgaccgtgagcggtaagctaatccacgaatggtgctgtagatcctgtacactgccaccacttcggtacatgggcgaagacgggtgttggtatggaatggaaatcagaccaatatccgaaaaagaggaaaatatggtcaaaagcctcgtttcggctggaagtggtaaagtagacaacttcacaatgggagtattatgtttagccattcttttcgaagaggtcatgagagggaaattcggcaagaaacatatgatagcaggggtattctttacttttgtattactattatcaggccaaataacatggagagatatggcccacacccttataatgatcggctcaaatgcatctgatagaatgggcatgggcgtaacctacttggcattaatcgcgacattcaaaatacaaccatttttagccttaggcttcttcttaaggaaactgacatcacgagaaaacttacttctaggcgtaggtctagcaatggctacaacattgcaattaccagaagatattgaacaaatggcaaatggaattgcattagggttaatggctttaaaattaattacacagtttgagatatatcaactatggacagccctaatttcattaacttgttcaaacaccatttttactctgacagtagcctggagaacggcaacactaatcttagcaggagtgtcgttattaccgatgtgtcaatcctcatccatgagaaaaactgattggttaccaatggcggtagccgcaatgggtgtaccaccattaccacttttcatcttctcattaaaagatactctaaagagacgtagttggcccttaaatgaaggggtaatggccgtcggccttgtaagtattttagcatcgagccttctaagaaatgatgtaccaatggcaggcccgttggtcgcaggaggactattaatcgcgtgttacgttataacaggcacttctgcggatttaacggtagaaaaagcggcagatataacgtgggaagaggaagctgaacaaactggtgtatcccacaatctcatgattacggttgatgatgatgggacgatgcgcataaaggacgatgaaactgaaaatatccttacagtattgttaaagacggctctgctcatcgtaagtggaatattcccatactcaatacccgcaactctattggtatggcacacatggcagaaacaaacacagagatccggtgtcttgtgggacgtcccgtcaccacctgaaacacaaaaggcagaattagaagaaggtgtatatcgaatcaaacaacaaggaatctttgggaagacacaggtgggtgttggtgtgcaaaaggaaggagtttttcatactatgtggcacgttactcggggtgctgttcttacctacaatggaaagcggctagaacccaattgggcaagtgtgaagaaagatcttataagttacggaggaggttggcgactcagtgctcaatggcaaaaaggagaggaagtccaagtgatcgcagttgagccaggcaagaatcccaaaaatttccagactatgcccggaacttttcaaacaacaacaggtgagatcggagcgatagcactagattttaaaccaggcaccagcggatcacctattatcaaccgtgaaggcaaagttgtcggattatatggcaatggcgttgttacaaagaatggtgggtacgtctctggaatagcacagacaaacgcggaacctgacgggccgacgccagaattagaagaagagatgtttaagaaaagaaatctcacgatcatggacttacaccctggttcgggtaaaacacgcaagtacctacctgccatagttagggaagcaataaaaagaaggttacgtacattaatccttgctccaacacgagttgtagctgcagaaatggaagaggcactaaaagggcttccaatcagatatcagacgaccgcaacaaaatctgaacacactgggagagaaatagtagacttaatgtgtcatgccaccttcactatgagactattatctcccgtgagggtaccaaactacaatttaataattatggatgaagcacattttacagacccggcgtctatcgcagccagaggttacattagtacgagagtaggtatgggcgaagcggctgctattttcatgacagcaacaccaccggggacagccgacgcgtttccacagagtaatgcaccaatacaggacgaagaacgagatattccagaacgttcctggaactcaggaaatgagtggataaccgactttgcggggaaaactgtgtggtttgtaccaagtataaaggcaggaaacgatattgcaaattgccttcgaaagaatggtaagaaggttattcaattatcacgaaaaacatttgatactgaatatcagaaaactaaattgaacgattgggattttgttgtaacaactgatatatcagagatgggggcaaattttaaagctgacagggtcatagatccaagacgatgtctcaaaccagtcatattaactgatgggccagaacgagtaattctcgcagggcccatgcctgtgactgcggcatccgccgcacaacgacgagggagggttggcagaaatccacagaaagagaatgaccaatacatttttactggtcaaccgctaaacaacgacgaggaccatgcgcactggactgaagcaaagatgctattagacaacataaatacacccgaggggatcattcctgcactttttgaaccagaaagagagaaaagtgcagctatcgacggggagtacagactaaaaggcgagtcgagaaaaacttttgtggagttgatgcgacgaggagatttacctgtttggctcgcgcataaagttgcaagtgaaggaattaaatatactgatcgcaaatggtgtttcgacggacaaagaaataatcaaattttagaggagaacatggatgtagagatatggaccaaagaaggtgagaagaagaaactaagaccaaggtggctagatgcgcgtacttattcagatccattggcgctaaaagaatttaaagaatttgcagcggggcgtaaatcaatagcattggatttagttacagagattggaagggtccctagccatttagctcaccgaacacgtaatgcattagacaatctggtaatgttacacacctcagaacatggaggcagagcctacaggcatgcggtagaagaactaccggagacgatggaaacccttttgttattaggattgatgatactattaacaggaggagctatgctattcttaataagcggaaaaggaatcggaaaaacttcgataggtttaatttgcgttatagcttcgagcggcatgttatggatggcagaaataccattgcaatggatcgcatccgctatcgttctggaatttttcatgatggttctcttaattccggagcctgaaaagcaaagaactccgcaggataaccaattagcatatgtagtcattgggatattaacccttgcagctattatagccgcaaatgaaatgggtctcttagaaactaccaaacgtgacctcgggatgagtaaggaaccgggcgttgtttccccgacaagttatctagatgtcgacctacatccggcatctgcatggacactttatgcagtagcaacaacagtaattaccccaatgttaagacacaccatagagaatagcacggcgaatgtttcattagccgcgatcgctaatcaagccgttgtattaatgggactggataaagggtggccgatttcaaagatggatttgggagtgccattattagccctaggatgctatagccaagttaaccctcttacacttaccgcagcggtcctattgttaataactcactacgccataatcggtccaggattacaagcaaaagcaacacgagaagcgcagaagaggactgctgccggtattatgaagaatccgactgtggatggaataatgacgatagatttagatccagttatatacgactctaaatttgaaaaacaactagggcaagtgatgctcctagtcctctgcgtggtacaactgctcttaatgagaacatcctgggccttatgcgaagcgttgaccttagcaacaggcccaattacgactctttgggaagggtctccaggtaaattctggaacacaaccattgctgtaagtatggcaaatatatttaggggatcctacttggcaggcgctggtctcgctttcagtatcatgaaaagtgttggtactggaaaaaggggtacagggagtcaaggcgaaactttaggtgaaaaatggaagaagaaacttaaccaactctcgcgcaaagattttgatttatataagaaaagtggaataacggaagtggataggaccgaagccaaagaaggcttgaagagaggggaaattacgcaccacgcagtgtctagaggatcggccaaattgcagtggtttgtagaacgaaatatggtaatccctgaaggaagggtaatagacttaggctgcggccgtggaggttggagctactattgtgccggattaaagaaagtaacagaggtaagaggctatactaaaggaggtcctggccacgaagaaccagtgcccatgtcaacatatggttggaacatcgtgaaacttatgtcgggcaaagatgtcttctatcttcctcccgaaaaatgcgatactcttctatgcgatataggagagtcaagcccctccccgaccgtagaagaatctcgtaccataagggttttaaaaatggtcgaaccatggctaaagaacaaccaattctgtataaaagttttaaacccatacatgcctactgtaatagaacatctggaaagattacaacggaaacatggaggaatgctggtacggaatcccctatcgagaaattcgactcatgaaatgtattggatatcaaatgggacagggaatatcgttgctagcgtaaatatggtgtcaagactactactaaataggtttacaatgacgcacagaagacccacaatcgaaaaagacgtagatctaggagcgggtacaaggcacgtcaatgcagaacccgaaactcctaacatggatgttataggagaacgaatcaaacgcatcaaggaagaacataacagtacgtggcactatgatgatgaaaatccgtataaaacgtgggcatatcatggctcatacgaagtgaaagcgactggcagtgcatcgtccatgattaacggtgttgtaaaattactaactaaaccctgggatgtagttcctatggtgacccaaatggccatgaccgatacgacgccttttgggcagcaacgcgtatttaaagaaaaggttgatactagaacgcctaggtccatgccagggacgagacgggtaatgggaattacagcggagtggctttggcgcacgctaggaaggaacaagaaaccaaggttatgtaccagagaggaatttactaagaaagtacgaacaaacgccgcaatgggagcagtcttcacagaggaaaatcagtgggactctgcaaaggccgccgtggaagatgaagacttctggaagctggttgatagagaaagggaactccataaactcggtaagtgtggtagttgtgtttataatatgatgggtaagagagagaagaaacttggtgagttcggcaaggcaaaaggctccagggcgatatggtatatgtggctaggagctcgctatcttgagttcgaagccttaggattcctgaatgaggatcactggttcagtcgagaaaacagttacagcggtgttgaaggggaaggactacataaactcggatatatattaagagatataagtaaaataccgggagcagctatgtatgcggatgatacagccggctgggataccagaattactgaagatgatctacacaatgaagaaaagataacacaacagatggatccagaacacaggcagttagctaatgcaatatttaagctcacataccaaaataaagtagtaaaagttcaaagacccacacctacggggactgtaatggacataatttcacgaaaggaccagcggggttcaggacaggttggaacttatggattgaatacattcaccaatatggaagcacagttaattagacagatggaaggtgagggcgtactttcaaaagcggatctggaaaatcctcatttgccggagaaaaagataacacaatggttggagacaaaaggagtcgagaggctgaaacgtatggcaatatcaggggatgattgcgtggtcaagcctatagatgacaggtttgcaaatgccttattggcactaaacgatatgggcaaagtaagaaaggatattccacaatggcaaccctcgaaaggatggcacgattggcaacaagtcccattttgtagccatcatttccacgaactaattatgaaagacggacggaaacttgtcgtaccgtgcagaccccaagatgaactaatcggccgtgctcggatcagccaaggtgccggttggtcacttaaagaaactgcgtgtcttggaaaagcatacgcacaaatgtggagtttaatgtatttccaccgacgagatttaagattagcaagcaatgccatatgctccgctgttccggtacattgggttcctacatcaaggactacttggagtatccacgcacatcatcagtggatgacaacagaagatatgctcacagtatggaatcgcgtttggatagaagacaatccatggatggaagataaaactccggttaccacttgggaaaatgtaccgtatctcggaaagagagaagatcaatggtgcggttcacttatagggttaacaagccgagcgacctgggcacaaaacataccaacagcgatccaacaagtgcgaagcctaattggtaacgaagagttcctagattacatgcctagtatgaaacgatttagaaaggaagaggaatccgagggagctatctggtaa

SEQ ID NO: 23182 - RNA, 9873 nt, synthetic construct
  misc_feature 1..9873: note = derived and/or modified CDS sequence (opt6) from DENV-3__HM756274__SS-prME
  source 1..9873: mol_type = other RNA
actagcctctgccttatgatgatactaccggcagcgttggcattccatctgacaagtagagacggtgaaccaagaatgatagttggcaaaaatgaacgaggtaaatcactcttatttaaaacagccagtggcataaacatgtgtactcttatagcaatggatttgggagaaatgtgcgatgataccgtaacttacaaatgtccacatattaccgaagtagaacctgaagatattgactgttggtgtaatttgacgagtacttgggtcacttatggtacctgcaaccaagctggagaacatcgaagggataaaagaagcgtagcacttgcccctcatgttggaatgggattagatacccggacacaaacgtggatgtcagcagaaggagcttggagacaagtagaaaaagtcgaaacctgggctttaagacatcccggttttactatattggcacttttcctggcgcactatattggtacatctcttacccaaaaagttgtaatattcattctattgatgctggttacaccgagtatgacaatgcgatgcgtaggagtagggaaccgagacttcgtagaaggattatctggggcaacttgggtagatgtagtcctagaacatgggggctgtgtaaccacaatggcgaaaaataaacctacacttgacattgaattgcagaaaactgaagcaactcaattggcaactttaagaaaattatgcattgaaggtaaaatcaccaacatcaccacggattcgcggtgtccaacacaaggtgaagcaaccctacccgaagaacaagaccagaattacgtttgtaaacatacatacgttgatcgtggctggggaaatgggtgcggattgtttggaaaaggaagcctcgtaacatgcgcgaaattccaatgtcttgaaccaatagaaggaaaagttgtccaatacgaaaatttaaaatatactgtaattataacagttcacacaggggaccagcaccaagttggtaatgaaacgcaaggtgtgaccgcagaaataacgccgcaggcttccaccactgaagcgattttgccggaatatgggactctaggtttagaatgttctcctagaacagggcttgattttaatgaaatgatattacttacaatgaaaaataaagcgtggatggtacaccgtcagtggttctttgaccttcctctaccatggacttcaggtgctacaacagaaacaccaacgtggaacagaaaagaattgttagtaacattcaaaaacgctcatgctaagaaacaagaggttgtggtgttggggtctcaagagggtgcaatgcatactgcgctcaccggcgcaaccgaaattcaaaacagcggaggtacatctatcttcgctggtcacttgaaatgtaggctcaaaatggacaaattagaactgaaaggtatgagttatgccatgtgtacaaatgcctttgtattaaagaaagaagtttcggaaacgcaacacgggacaattttgattaaagttgaatataaaggtgaggatgtcccatgtaaaataccattttcaaccgaagatgggcaaggaaaagcacataatggcagactaatcacagcaaatccagttgtaactaagaaagaagaaccagtaaacatagaagcagaaccaccattcggcgagtcgaatattgtaattggtattggagataatgctttaaaaatcaattggtacaagaaaggctcctcaatcgggaaaatgtttgaggctacagcacgcggtgcacgtagaatggcaatattaggggatacagcatgggatttcggaagcgttggcggcgttttaaatagtcttggaaaaatggtccatcaaatctttggatctgcgtacactgcattatttagtggagtatcctgggtaatgaaaataggcataggagtgcttttaacctggataggactaaactcgaaaaatacctcaatgtcttttagttgtatagcaataggaataattaccttatatttaggcgcagttgttcaagcagatatggggtgcgtaataaattggaaagggaaggaattaaagtgtgggtctggcatatttgtgacaaatgaagtccatacctggactgagcagtacaaattccaagcagatagtccgaagcgtttagcaacagcaatcgccggtgcatgggaaaatggggtctgtgggattcggtcgacgaccagaatggaaaacctattatggaaacaaattgccaacgaattgaattacatcctctgggaaaacaacatcaaactaactgttgtggtaggtgatattataggagtactcgaacagggaaagagaacattgactccacaaccgatggaattaaaatattcatggaaaacgtgggggaaggctaaaatagtgactgcagaaacacaaaattcgagttttatcattgacggacctaacacaccagagtgtccctctgtaagcagagcatggaatgtctgggaagttgaagattacggcttcggagtttttactacaaacatatggctaaaattgagagaagtttatacacaattgtgcgaccatcgtctaatgagcgctgctgtaaaggacgagagagctgtacacgctgatatgggatattggatagaatcgcagaaaaatggcagttggaaactagaaaaagcctccctgatagaggtaaaaacctgtacttggccaaagagtcatacattatggtctaatggcgtattagaaagtgatatgattatacccaaatcgcttgcaggacccatatctcaacacaaccaccgaccaggctatcacacccagacagcaggcccatggcacctcgggaagctagaattagacttcaactattgcgaggggacaactgtggtgataacagaaaactgcggaacgagaggacctagcttgagaactacaaccgtatcaggtaagttaattcacgaatggtgttgtagaagctgtacattaccccctttgagatacatgggggaagacggatgttggtatggaatggagattaggccgatttccgagaaagaagagaatatggtaaaaagcctagttagcgccgggtcgggaaaagtagataacttcaccatgggcgtcttatgtctcgcaatcttgtttgaagaagttatgagaggaaaatttggtaagaaacacatgatagccggggtatttttcacattcgtattgctattatctgggcagataacatggcgtgatatggcacacacgttaataatgataggtagtaatgcttctgacaggatgggaatgggcgttacatatttggcactcattgctacgttcaaaatacaaccatttctagctctcggattctttttaagaaaattaacaagtagagaaaatttattattaggggttggattagcaatggccactacactacaattaccagaagatatcgaacaaatggcaaatggaatcgcgctagggttaatggcattaaaacttataacgcaatttgagacttaccaactatggactgctttgataagtctaacttgctcaaatacaatctttactctgaccgttgcatggagaacagctaccttgatactcgctggtgtgagtctcctcccagtatgtcaaagtagtagtatgcgtaaaactgactggttaccgatggcggtagcagcaatgggagttccaccattaccactgtttatattcggacttaaggacacgttaaaacgcagatcgtggccgctaaacgagggagtaatggctgtaggattagttagtatactagcatcttccttacttcgaaatgatgttccaatggccggccctttggttgcaggaggactgctgattgcttgttatgtaattacaggaacaagtgcagacttgacagtagagaaagctgcagacataacgtgggaagaggaagcggaacaaactggcgttagtcacaaccttatgattacagtagatgatgatggcactatgcgtatcaaagacgatgaaacagaaaatatactaacagtacttctcaaaactgcgctactaatagtaagcggaatcttcccttattcgatacccgcgacattactcgtctggcacacatggcaaaaacaaacacaacgatcaggagtgctatgggatgtaccatcacctcctgaaacccagaaagcagagctagaagaaggtgtttatagaataaaacaacagggaatctttggaaaaactcaggtaggcgtgggagtacaaaaggaaggtgtcttccacacaatgtggcacgtcacccgaggagcggttttaactcataacgggaagcgtttagagccaaattgggcttccgtcaagaaagaccttatatcatacggcggtggatggaggctgtcagcacagtggcaaaaaggtgaagaggtgcaagtcatcgcagtggaacctggaaagaaccccaagaactttcaaacaatgcctggtacatttcaaaccacaacgggcgaaatcggagctatagcactggatttcaaaccaggtaccagtggctcccctattataaatcgggaaggtaaggtagttgggttatacggaaacggggtagtgactaaaaatggaggatatgtttctgggattgcacaaacaaatgcagagcctgacggcccaacaccagaactcgaagaagaaatgttcaagaaaagaaatctaactataatggacttacaccccggatcaggcaagaccagaaaatacttgccagcaattgttagagaagcaataaagcgaagattacggaccctaatccttgcacctacaagagttgtcgcagctgagatggaagaagcattaaaaggactaccgatcaggtaccaaacaacagcaactaagtcagaacatacaggtcgcgaaatagtagatttaatgtgccatgctacattcaccatgcgtctattatccccagtcagagtgcccaactataatctaataattatggacgaagctcatttcaccgacccagcgtccatagcagcgagaggatatatatctacaagagtaggaatgggagaagccgcagcaattttcatgactgccactccaccgggcaccgccgacgcttttcctcaaagtaacgccccaatccaagatgaagaaagggatatccctgaaagatcatggaactcgggaaacgaatggataacagatttcgcgggaaaaaccgtttggttcgtaccatccataaaagcaggcaacgacatcgcaaactgcttgcgtaagaacggaaagaaagtgatacagttatcaagaaaaacattcgatacagagtaccagaaaacgaaattaaacgattgggatttcgttgtgactaccgacatatctgaaatgggtgctaatttcaaagcggatagagttatagatccaagacgttgcttaaaacctgtgatattaactgacgggccagaaagagtaatactagcaggtcctatgcctgtaactgccgcatcggctgctcaacgacgtggtcgcgtaggcagaaatccgcagaaagaaaacgatcaatatattttcacaggccaaccattgaataatgacgaagatcacgctcactggaccgaagctaaaatgcttttggataacataaacacaccagaaggaattatacccgcgttattcgagccagagcgtgaaaaatctgcagcgattgacggagaatatcgactaaaaggcgaatcaagaaaaacattcgttgagttaatgcgcaggggtgaccttccagtatggcttgctcacaaagttgcaagcgaaggcattaaatacacagaccggaagtggtgttttgatggccaaagaaataaccaaatacttgaagaaaacatggatgttgaaatatggacgaaagagggggagaaaaagaaacttaggccacgttggttggacgcaagaacatactcggatcccttagcgcttaaagagttcaaagaatttgcagccgggcgaaaaagcattgcattagatctggtgacagaaataggtagagtcccatcccacttggctcatagaactaggaatgctttggataatctggtaatgctacatacatctgaacacggtgggagagcgtatagacatgccgtagaagaactaccagaaactatggaaacattgctgctacttggtttgatgatactccttactgggggtgccatgttattcctcattagcggtaagggcataggtaagacgtctataggattaatatgtgtgatagcttcatcaggaatgttatggatggcagaaataccgctacagtggatagcgtctgcaatagtccttgagttctttatgatggtacttttaataccggaaccagaaaagcagagaacaccacaagataaccaactcgcttatgtagtaatcggcatactaactttagcagcgatcatcgccgcaaatgagatgggcttacttgaaacaactaaaagagacctgggaatgagcaaagaaccaggtgtagtgtcacctacatcatatctagacgtcgacctgcaccccgcttctgcttggacgttatacgctgttgcaaccacagtaattacaccaatgttacgacacactatagagaatagcactgcgaatgtaagtttagcagctattgctaaccaggcagtagtcttgatgggattagataagggatggccaatttcaaaaatggatttaggcgtaccccttcttgctctaggatgttatagtcaagtgaatccgctaacgcttacagctgcagtactccttttaataacacactacgcgattataggtccagggctacaggctaaggcaacgagagaagctcaaaagagaacggcggctggaattatgaaaaatccaactgtagatggaatcatgacaattgacctagacccagtaatatacgacagcaaatttgaaaaacaattggggcaagtaatgttactggttctatgtgcagtacaattacttttgatgcgaacatcatgggctctatgtgaagccttgacattagcaacaggacctattactacgttatgggaaggttcgccgggtaagttttggaatacgacaatcgcggtgtcaatggcgaatatatttcgaggctcatatcttgcaggagctggacttgcctttagcataatgaaatccgtaggcacaggaaagagaggcactggcagccaaggagaaacactgggggagaaatggaagaagaaattaaatcagttatcaagaaaagactttgatttatataagaaaagcggcattacagaagttgatagaactgaagcaaaagaaggattgaaaagaggcgagataactcatcatgccgtcagccgcggatcagcaaaattacaatggtttgtagaacggaatatggtaattccagaagggagagtgatcgatctaggatgtggacgcggagggtggtcctactattgcgctggtctaaagaaagtaactgaagtacgagggtataccaagggagggcctggccatgaagaaccggttcccatgtcgacatacggatggaacatagtgaaattaatgtccggtaaggatgtattttatctaccaccggagaaatgcgatacattgttatgcgatataggggaaagttctccatcacccactgttgaagaatcaaggacaattagggtgctaaaaatggtggaaccatggctgaagaataaccagttttgtataaaagtattaaatccatacatgccaaccgttatagaacacttggaacgactacaaagaaaacacggcggtatgctagtaagaaatccgttgtcaaggaactcaacccacgaaatgtattggatctcgaacggaaccggaaatatagtggcaagcgttaacatggtcagtcgattgttgcttaatcgatttacaatgacccataggcgacctactatagaaaaagacgtggacctaggtgcgggaaccaggcatgttaacgcggagccggaaacaccaaatatggatgttattggggaacgcattaaacgaataaaagaagaacacaacagcacatggcattacgatgacgaaaatccttataaaacatgggcataccacggttcgtacgaagtaaaagccacaggatcagcaagctcaatgataaatggagtagtgaaacttctaactaagccatgggacgtggtaccaatggtaactcaaatggcgatgacagacacgacacccttcggtcagcaaagggtctttaaagagaaggtagacactaggactccgagatctatgcctggaacgagaagagttatgggaataacagcggaatggctatggcgcacactcggtagaaacaaaaagccaaggctttgtacccgtgaagaatttaccaagaaagtacgaactaacgcagcaatgggagctgttttcacagaagagaaccagtgggatagcgcgaaagcagctgtagaagatgaggacttctggaaattagttgacagggaaagagaacttcacaaactaggaaaatgcgggagctgtgtgtataacatgatggggaagagggagaagaaattgggagaatttgggaaagcgaaaggaagcagagccatttggtatatgtggttaggagcaagatatctagaatttgaggctttaggatttctcaatgaggaccactggttctcacgcgaaaatagctacagcggagtagaaggtgagggacttcataaattaggttatatactcagagatatttctaaaatcccaggtggagccatgtacgcagatgacacagcaggatgggacacacgaatcacagaggatgatttgcataatgaagaaaagataactcagcagatggacccagaacaccgtcaactagctaacgctatattcaaactgacctaccaaaataaggtcgtcaaagtccaaagaccgaccccaactggaaccgtaatggacattataagcagaaaagaccaacgaggttcaggacaggtaggcacatacggcttaaatactttcacaaacatggaggctcaacttataagacaaatggaaggtgagggagtcctcagtaaagcagacctagagaacccccacttacctgagaagaaaataacacagtggctagaaacgaaaggtgtagaaaggctgaagagaatggcgatctcaggtgatgattgtgtggtgaagccaatagatgaccgattcgccaatgccctactagctctaaacgacatgggcaaagtacgaaaggatataccccaatggcaaccttcaaaggggtggcatgattggcaacaagttccattctgctcgcatcattttcacgagctaattatgaaagacgggcgtaagctagtagttccatgtagaccacaggacgaattaataggcagagctagaatatcacagggtgccggatggagcctgaaggaaactgcatgtttaggaaaggcttatgcacaaatgtggtctctaatgtatttccatcgaagagatcttcggttggcatcaaatgcaatatgcagcgcagtaccggtgcattgggtaccaacctcacgtacaacatggtctattcatgcgcatcaccaatggatgactacggaagatatgctaacagtctggaatagagtatggatagaagacaatccctggatggaggacaagaccccagtgactacctgggagaatgtcccatatctgggaaagcgtgaagatcaatggtgcggtagtcttattggacttacaagtagggcaacttgggcccaaaatatccctacagcaattcaacaagtaaggagcttaataggaaatgaagagttcctagattatatgccgagtatgaagcgatttagaaaagaagaagagtcggagggtgccatatggtaa

SEQ ID NO: 23183 - RNA, 9873 nt, synthetic construct
  misc_feature 1..9873: note = derived and/or modified CDS sequence (opt6) from DENV-3__HM756275__SS-prME
  source 1..9873: mol_type = other RNA
acgagtttgtgtttgatgatgatattacctgcagctttggcattccatctgacaagtagggacggggaaccaagaatgattgtggggaaaaatgaacggggaaagagcttactctttaaaactgcatcaggaataaatatgtgcacactgatagccatggacctaggtgaaatgtgtgatgataccgtgacttacaaatgcccccacataactgaagtagaaccggaagatattgattgctggtgtaaccttacatcaacatgggtaacctacggaacatgtaatcaagcaggcgaacatagacgcgataaacgcagcgtagcgctcgcaccacacgttggaatgggtttagatacaagaacacaaacctggatgtcagcggaaggagcatggcgtcaagtagaaaaagttgaaacatgggctctacgacacccaggttttacaattctcgccttgtttttagctcattacatcgggaccagtttgacacagaaagtggtaatatttatactacttatgcttgtgacaccatctatgaccatgcgatgtgttggagtaggtaacagagacttcgttgagggattatcaggagccacttgggtagatgtagttttagaacatggaggatgtgttaccacgatggctaaaaataaaccaactttggatattgagttacagaaaacggaagccacgcaactggcgaccttgagaaaactgtgcatcgaaggtaaaatcacaaatataactacagactcacggtgcccaacacaaggagaagcaacccttcccgaagaacaggatcaaaattacgtttgtaaacatacatacgtagatcgcggctggggaaatggatgtggcttatttgggaaaggatctctagttacttgcgcaaaatttcaatgtttggaacccattgaaggaaaagtagtgcaacatgaaaatcttaaatatacagtcatcatcacagtccacactggagaccaacaccaagtaggaaacgaaacccaaggcgtcactgcagaaataacaccgcaagcatcgacaacagaagctatacttccagaatacggaaccctgggcctagagtgcagcccccgcacaggtcttgattttaacgaaatgatacttttgactatgaaaaataaagcgtggatggtacatcgacaatggttctttgatttacccttaccatggacaagcggggccactacagaaactccaacatggaatagaaaagaattacttgtgacattcaaaaatgcacatgccaagaaacaagaagttgtcgtcctaggaagtcaggaaggggcaatgcatacagctctaactggggctacagaaatacaaaatagtggcggaacaagtatattcgccggtcatttgaaatgtagattgaaaatggataaattagaactcaaagggatgtcttatgcaatgtgtaccaacacttttgttctaaagaaagaagtatctgaaactcagcacggcacaatacttattaaagtagaatataaaggtgaagacgtaccatgtaaaatcccatttagtacggaagacggacaagggaaggcacacaatgggaggttaattacagcaaacccagtggtcacgaaaaaggaagaacccgttaacattgaagctgaacctccatttggtgagagtaacatagtaattggtataggagataacgcattaaaaatcaattggtataagaaaggaagcagtattgggaaaatgttcgaagcaaccgcaagaggggccagaaggatggcaatacttggtgacacagcatgggatttcggtagtgtagggggagttcttaactctttaggtaagatggtgcaccaaatctttggtagcgcatacacggccctattcagtggtgttagctgggtcatgaaaataggtatcggagtattattaacatggatcggtcttaattcaaagaatacatcaatgtcgtttagttgcattgcaataggaataataactttgtacttaggtgcagtagttcaagcagatatggggtgtgtaattaactggaaaggaaaagaattaaagtgtggctcggggatatttgtgacaaatgaagtccacacttggactgaacaatacaagttccaggcagactcccctaaaagactagcaacagccattgcaggcgcatgggaaaatggagtatgtggcattcgttcaacaactagaatggagaatctattgtggaaacaaatcgcaaatgaattgaattacattctatgggagaataatattaaattgaccgtagtcgtaggagatataataggagtcctagagcaaggaaaacgaacattaactccccaacccatggaattaaaatattcctggaaaacatggggaaaggcaaaaatcgttactgcagaaacccagaacagcagcttcataattgatggtcctaatacgccggaatgcccaagcgtgtcacgtgcttggaacgtatgggaagtagaagactacggattcggagtatttacaacaaacatctggctgaaactaagagaagtatatactcaattatgtgatcatcggttaatgagtgcggcagtaaaagacgaacgagccgtacatgccgatatgggatattggattgagtcgcagaaaaacggctcctggaaactagaaaaggcttcccttatcgaagtgaaaacttgcacatggccaaaatctcatacgttatggagcaatggagttttagaatcagacatgataatacctaaatcacttgccgggccgatatcccagcataatcaccggccaggttatcatacgcaaactgcaggaccgtggcacttgggaaaactagaattagattttaactattgcgagggtactaccgtcgtaataacagaaaactgtggcaccagagggccatctttaaggactactacagtttcgggaaaattaatacatgaatggtgctgccgcagttgcacactgccgcctttacgctacatgggagaagacggttgctggtatggcatggaaatacgccctatcagtgagaaagaagaaaatatggttaaatcattagtttccgcaggcagcggcaaagtcgataacttcactatgggtgtactgtgcctagccatattatttgaggaagttatgagaggcaaatttggaaagaaacacatgatagctggcgtgttcttcacatttgttcttttactgtcaggtcaaatcacgtggagggatatggcacatacattaataatgataggatcaaatgcttcagacagaatgggtatgggtgtaacgtacctagctttaatagctactttcaagattcagccatttttagcactaggattctttttgaggaaactaacatcacgagaaaatttacttctgggagtgggtttagcaatggcaaccactcttcaattaccagaggatattgaacaaatggcaaacggaatagcgttgggtttaatggccctaaaactaataacgcaattcgaaatatatcagttatggacggcacttatatcactgacatgttcaaataccatctttacgttaacagttgcctggcgtaccgcaacactaatactagcaggagtatcgctattaccaatgtgccagtctagctcgatgaggaaaacagactggttacccatggcagtagcggcaatgggagttccaccactacccttattcatattctctcttaaggatactctaaaaagacgtagttggccattaaatgagggagtgatggctgtcgggctcgtatctatactggcaagctcattattgagaaatgacgtacccatggccgggccactcgtagcaggaggcctccttattgcttgctatgtgatcacagggacctcggcagatcttaccgtcgaaaaggcagcagacataacatgggaggaagaagcagaacaaaccggagtaagtcataacctgatgattacggtggatgacgacggaacgatgagaataaaagacgatgaaacagagaatatattaacagtactgttgaagacggccctacttatagtttcaggcatatttccttacagtataccagccacgcttctagtttggcacacttggcaaaaacagacccagaggagtggtgtcttgtgggatgttccttcgccacccgaaacacaaaaagctgaacttgaagagggggtgtacagaataaaacagcaggggatcttcggaaaaacacaagtcggtgtaggagttcagaaagaaggagttttccatactatgtggcatgtaactaggggagcagttctcacctacaatggaaaaagacttgaacctaactgggcttcggtcaagaaagacttaatctcttatgggggtggatggcgactgagcgcacaatggcagaaaggagaagaggtacaagtcatagcagtcgaacctggcaaaaatcccaagaactttcaaaccatgcctggaactttccaaaccacaaccggtgaaatcggtgcaatagccctagatttcaaaccaggaacaagtggatcgcccataatcaacagggagggaaaggttgtaggcttgtatggcaatggagtcgtaacaaagaatggcggctacgtatctggcattgcgcaaacgaatgccgagccagatggacccacaccagaattagaagaagagatgtttaagaaacgaaacctaaccatcatggatttacacccaggatcaggtaaaacaagaaaatatttaccggctatagtgcgagaggcaattaagagacgtttaagaacgctgatattagctccaacccgagttgtcgctgcggagatggaggaagcgctcaagggtttgccgataaggtaccaaacaacagcgacaaaatcagagcatacaggtcgcgaaattgtggatttaatgtgccatgcaactttcacaatgcgacttctatctcccgtgcgtgtaccaaattacaatctgataatcatggatgaagctcatttcacagacccagcatccatagcagctagggggtacatctccacacgagttggtatgggtgaagctgcagcaatcttcatgacggccacaccaccaggtaccgcagatgcctttccacaaagtaatgcacctattcaagatgaggaaagagacatcccagaaaggtcgtggaatagcggaaacgagtggataaccgattttgcaggaaaaaccgtatggtttgttccatcaattaaggctggtaacgatattgctaattgtttaagaaagaacggcaagaaagtcatacaactatctagaaaaactttcgataccgaataccagaaaacaaaattaaacgattgggactttgtcgttacaacagacatatccgagatgggggcaaatttcaaagccgacagggttatagatccaaggagatgcctaaagccagtgatactaactgacggaccggagagggtaatactggcaggtccaatgcccgtgacagcagcgtcggcggctcagcgacgcggccgtgtcggtagaaatcctcaaaaggaaaacgatcagtatatatttacagggcaacccttaaataacgacgaagaccacgcgcactggacggaagcaaaaatgctgctagataatataaataccccggaaggcatcatccctgcattatttgaacccgagagagaaaaatcagctgcaattgatggggaatatcgtctgaaaggcgaatcgcgtaaaacattcgtagaattaatgcggagaggtgatcttccagtgtggcttgcacacaaagttgccagtgaaggtatcaaatataccgatcgaaaatggtgtttcgacgggcaaagaaataatcagatactagaggaaaacatggacgttgaaatatggacaaaggaaggtgagaagaagaaattaaggccgaggtggttagatgcaaggacgtatagcgatcccttagcattaaaagaatttaaggaatttgcagccgggaggaaaagcatagccctagatttagtcacagagatcggcagggtcccttcacatttagctcacagaaccagaaacgctctggacaacttagtaatgttacatacctccgaacacggagggcgagcctaccgtcacgcagttgaggaactccctgaaactatggagactttactgttattagggttaatgatactgcttacaggaggcgcaatgctgttcctaataagcggaaaaggaatcggaaaaacatccattggactaatatgcgtaatagcttccagcggtatgttgtggatggctgaaatacccttacaatggatagcgtctgcaattgttctggagtttttcatgatggtcttactaatacctgaaccagaaaaacagagaacgcctcaggataatcagttagcatacgtggttataggtattttaacattagcagccataatagctgcaaatgaaatgggcctattagaaaccacgaaaagagatttgggtatgagtaaagagcccggggtcgtctcgcctacgtcttatcttgacgtggatttacatcccgcctcagcatggactttatacgctgttgctacaacggttatcacacccatgttacgacacaccatcgaaaacagcacagctaatgtttccttagcggcaattgccaatcaagcggtagtgcttatgggactagataaaggatggcccataagtaaaatggacctaggcgtaccgttgctagctttggggtgctactctcaagttaatccattaacattaacagctgctgtccttctcttaataactcattatgccattatcggcccaggactgcaggcgaaagcaacaagagaagcccagaaaaggactgctgctggtataatgaaaaatcctacagtcgacggaattatgacaatcgacctagatccagtaatttatgatagtaagtttgaaaaacagctaggacaggtaatgttattagtattgtgtgtagtacaacttttgttaatgagaacttcatgggcgctatgtgaagcactgaccttggcaaccggtccgataacaacgctttgggaaggtagccctggaaaattttggaatacaactattgcggtgagtatggccaacatatttaggggctcttatctggcaggggctgggcttgctttctcaataatgaaatccgtgggaacagggaagcgaggaacaggaagtcaaggcgaaaccttaggtgaaaaatggaagaagaaacttaaccaattaagtcggaaagatttcgacctatacaagaaatctggcataactgaagtcgaccgcaccgaggcaaaggaaggattaaaacgaggagaaataacacatcatgccgtttcacgtgggagcgccaaactacaatggtttgtggaacgaaatatggtcatacctgagggtcgagttatagacttaggatgtggcaggggaggatggtcttattattgtgcagggttaaagaaagtcacggaagtgagaggatacacaaaaggcggacccggtcacgaagaacctgtgccaatgagcacatatggttggaatatagttaaactgatgagcggtaaagatgtattctacctcccacctgaaaaatgcgataccctgctgtgtgatataggggaatcttcaccgagtccaacagttgaagaaagtcggacaataagagttttaaaaatggttgaaccgtggttaaagaacaaccaattttgtataaaagtcttaaatccttatatgccaacagtcattgagcatttggagaggctacagcgtaaacacggtggaatgctagtcagaaatccgttatcgcggaactcaactcatgaaatgtactggatcagcaacggaacaggaaacattgtggctagtgtgaacatggtatcacgactgctgcttaatcgttttacgatgacgcacaggagaccaaccatagaaaaagatgtagacttgggagcaggtacgagacatgtaaatgcagaaccagagacccctaacatggatgtaataggagaaagaataaaacgcattaaggaggaacataatagcacatggcactacgatgatgagaatccatacaaaacatgggcatatcacggtagttatgaagtgaaagcaaccggctctgcttcgagcatgataaacggagttgtcaaattactgactaaaccctgggatgtagtaccgatggtcactcaaatggcaatgaccgatacaacaccatttggacaacaaagagttttcaaagaaaaagtggatacacgaactccgagatctatgcccggaactcgtcgtgtaatgggaatcacagcagaatggctatggcggacattgggccgaaataaaaagcctcggctatgtactcgagaggagtttacaaagaaagtcagaacaaatgctgccatgggcgcggtttttacggaggaaaatcagtgggattctgccaaggccgcggtcgaagacgaagatttctggaagctagtagatcgagaacgtgaattacataaattaggaaagtgtggaagttgcgtttataacatgatgggaaaacgtgagaaaaagttgggagagtttggaaaagctaaaggctctcgtgctatctggtatatgtggttaggcgcacgatacctggagttcgaagcattgggatttctcaacgaggatcattggttcagcagggaaaacagttattcaggagtagagggagaaggactgcacaaattaggatatatattaagggatatatccaagattcctggtggagcaatgtacgctgatgatactgcaggttgggacacccgaatcacagaagatgatttacacaatgaagaaaagataacacaacaaatggacccagaacatagacaattagcgaacgcaatctttaaactaacttaccaaaacaaggtagtgaaagttcagagaccaactccaacaggtactgtaatggacataatctcgagaaaagaccaacgtggaagtggacaagtaggtacctatggcttaaacactttcacgaacatggaagctcaattaatacgtcagatggagggcgaaggagtattatctaaagcagatttagaaaacccacatctaccagaaaagaaaatcacacaatggcttgaaaccaagggagtagaacgattaaaacgcatggcaatatcaggagacgactgtgtcgtaaaacccatagacgaccgatttgccaatgctctcctcgcactcaacgatatgggtaaagtacgcaaagacatccctcagtggcaaccgagcaaaggttggcatgactggcagcaagttccattctgcagtcatcattttcacgaactaatcatgaaagacggtcgaaaattagtagtaccttgccgcccacaagatgaacttatagggagagcccggatttcacagggagcagggtggagcttgaaggaaaccgcgtgcctcggcaaagcctatgcacaaatgtggagtctaatgtacttccatagacgagaccttagattggcatcaaacgcgatttgctcagcggtccctgtgcattgggttccaacgtcacgaactacatggtctatacacgcacatcaccagtggatgacgactgaagatatgcttacagtctggaacagggtttggatcgaggataacccatggatggaagacaagactcccgtaaccacttgggaaaacgttccataccttgggaagcgcgaggatcaatggtgtggatctcttataggtttaacgtcacgagccacatgggcacaaaacataccgaccgcaatacaacaagtgagatcactgatcggaaacgaagaatttctggattatatgccatcaatgaagaggtttagaaaagaagaagaaagcgaaggtgccatctggtag

SEQ ID NO: 23184 - RNA, 9873 nt, synthetic construct
  misc_feature 1..9873: note = derived and/or modified CDS sequence (opt6) from DENV-3__JF937632__SS-prME
  source 1..9873: mol_type = other RNA
acgtcactatgcctcatgatgattctaccagcagcactggcttttcatctaacaagcagagatggtgaaccaagaatgatcgttggtaaaaatgaaagaggaaaaagtttactctttaaaacggctagcggaataaatatgtgcacactgatcgcaatggatctaggagaaatgtgtgacgacactgtaacctataaatgcccgcacataacagaagtagaaccagaagatatagactgctggtgtaatctaacaagcacatgggtaacttatggaacctgcaatcaagctggagaacatcgtagagacaaacgaagcgtcgcactcgcgcctcatgtaggaatgggattagatactcgaacccaaacatggatgtcggctgagggagcatggagacaagtagaaaaagttgagacttgggcactcagacatccaggatttactatattagctttattcttagcacattacatagggacaagtcttacacaaaaagtagtcatattcatcttgctgatgcttgtcacaccgagtatgaccatgagatgcgtaggagtgggaaacagagattttgtagaagggctgtccggagcgacatgggttgatgttgttctagagcacgggggctgcgtgactacgatggctaaaaataaaccgactcttgacatagaactccaaaagacagaagcaacacaactggcgacactaagaaaattatgcatcgagggaaagattacgaatataacaacagattctcgatgtccaacacaaggagaagctacactgccagaagaacaggatcaaaattacgtttgtaaacatacatacgtggacaggggatggggcaatggctgtggactatttgggaaaggcagccttgtcacttgtgcaaaatttcaatgcctggaaccgatagaaggaaaggttgtacaatatgagaaccttaaatatactgttataatcaccgtgcataccggagatcaacaccaagtaggtaatgaaactcaaggagtaactgcagagatcactccgcaggcatcaactaccgaagcaatactaccagaatatgggacactcggccttgaatgcagtccaaggacggggctcgacttcaatgaaatgatactgctaacaatgaaaaataaggcatggatggtacaccgtcaatggttcttcgatctaccactaccatggacgtcaggagccactacggaaacccctacttggaatagaaaggaactattagttacgtttaaaaacgcacatgccaagaaacaagaagtagtagtgttaggatcacaggaaggtgcgatgcacacagcattaactggagctaccgagatacagaacagcggaggaacatcgatattcgccggacatttaaaatgtcgattaaagatggacaaattagagttaaaaggaatgtcctacgcaatgtgtactaacacatttgtactcaagaaagaagtatcggagactcagcacgggactattctaataaaagttgaatacaagggcgaagacgttccgtgtaaaataccattcagcacagaggacggacaaggtaaggcgcacaatggaaggttaataaccgcaaatcccgtcgtaactaagaaagaagaaccagttaacattgaagctgaacccccattcggtgaatccaacatagtaattggaatcggagacaacgctttaaaaataaactggtataagaaaggtagcagcattggtaaaatgttcgaggctactgcgaggggcgctagacgaatggctattctaggtgacaccgcatgggatttcggatcagtaggaggggtactaaattcgctaggcaaaatggtccatcaaatatttgggagtgcatatacggctctatttagtggagtgtcctgggtaatgaaaataggtataggagtcctattaacatggattggactaaatagtaaaaatacctcaatgagcttcagttgtatcgccataggaataataaccttgtatctaggagcagtagtacaagcagacatggggtgtgtaatcaattggaaaggaaaagagcttaaatgtggaagcggaatattcgtaacgaacgaagtgcatacatggaccgaacaatacaagttccaagctgattcgccaaagcgacttgcgaccgctatagccggagcgtgggaaaatggtgtttgcggtatacgcagcaccacacgaatggagaaccttctatggaagcaaattgccaatgaattaaactacatactgtgggagaacaatataaaattgacagtcgtggttggtgatataataggtgtgcttgaacaaggaaagagaacgctgacaccgcaaccaatggaacttaaatattcgtggaaaacatggggaaaagccaagatagtaacagcggaaacacaaaattctagttttataatagacggacccaatacgcctgaatgtccttcagtatcacgtgcttggaacgtttgggaagtagaagattacgggttcggtgtattcacgacaaatatttggcttaaactgagagaagtatatacccaattatgcgaccatagactcatgtcggcagccgtaaaagatgaacgagccgtacatgcggacatgggatactggatagaaagtcagaaaaacggtagttggaaattagaaaaagccagcttaattgaagtaaaaacctgcacgtggcccaagagtcatacactttggagtaacggagtgttagaatcagacatgataataccaaaaagtttagccggacctatatcgcaacataaccatcgccccggctatcatacacaaacagcaggaccgtggcatctagggaaactggaattggacttcaattattgcgaggggacaactgtagtcattacggagaactgcggtacgaggggacctagcttacgcactactactgtatcgggtaagctaatacatgaatggtgctgtcgcagttgtactctgccgccattgagatatataggggaagacggttgttggtacggaatggaaattcgaccgatatccgagaaggaagaaaatatggtgaaatcattagtatcagcgggtagtggcaaagtggacaactttaccatgggagtcttatgcctagctatcttattcgaagaagttatgcgcggtaaatttggtaagaaacatatgatagccggtgtattcttcaccttcgtcttgctcttgtccggtcagataacttggcgagatatggcacatactctaattatgatcggaagcaacgcctctgatcgcatgggtatgggggtaacttatttagccctaatagcgacttttaaaattcagccgtttcttgcacttggattcttcctcaggaaattaacctcgcgggaaaatctactactcggcgtaggacttgctatggccacaacactacaactaccagaggacattgaacaaatggcaaacgggatagcacttggcctcatggctctaaaattgattactcagttcgagacatatcaattatggaccgcactgataagtttaacatgtagtaacacgatatttacacttactgttgcatggagaacagcaacattaatattagctggtgtcagtctcctacctgtatgtcaaagctcaagtatgcgcaaaactgattggctaccaatggctgtagcggccatgggtgtaccgccccttccattgttcatattttcgctgaaagacactctaaagcgtagatcctggccacttaatgagggtgttatggcggtaggattagtaagcatcctagcctcttcattactaagaaacgacgtacccatggcaggacctttagtagcgggaggactcctaatagcttgttatgttataacagggacatcagcggacttaacagtggagagagcagcagatataacatgggaagaggaagcagaacaaacgggagtttctcataatctaatgataaccgtagatgacgatggaacaatgcgaataaaagacgacgaaacagaaaatatcttgacagtactcctcaaaactgcattgttgatcgttagtggtatttttccctatagtatacccgccacgctactggtttggcacacgtggcaaaaacaaactcaaaggagtggagtattgtgggatgtcccaagtcccccggaaactcaaaaagccgaacttgaggaaggagtatatcgaatcaagcaacagggtatcttcggaaagactcaagtgggcgtaggagttcagaaggaaggagtctttcacacaatgtggcacgtaacaagaggtgcagtcttgacatataatgggaaaagattagaaccaaattgggcaagcgttaagaaagatctgataagctatggcggaggttggcggttatcggcgcaatggcaaaaaggtgaagaggtacaagtcattgctgtcgaaccaggcaaaaatcccaaaaatttccaaactatgccaggaacttttcaaactacaactggtgagataggggctatagcgctggatttcaaaccaggaacatctggctcacccataattaaccgggaaggaaaagtagtaggactatacggcaacggagtagttactaagaatgggggatatgtatctggaatagcacaaacaaacgccgaaccagatggtcccacaccagaactagaagaagagatgtttaagaaacggaacctgacaatcatggatttacatcccggaagcggcaagactcggaaatatctaccagcgattgtcagagaggcaataaaacggcgtttacgcaccttgatcttggctccaactcgagtggtagctgcagaaatggaagaagctctaaagggacttcccataagatatcaaacaacagctacgaaatcagaacatacaggccgggagatagtggacctcatgtgtcacgccacgtttactatgcgactgctatctccggttagagttccaaattataacttaataattatggacgaggcacactttacagatccggcgagtatagcagcaagaggatatatatctacgcgggtcggcatgggagaagctgcagcaatattcatgaccgctactccaccaggaactgccgatgcctttccccaaagtaatgcaccaattcaggatgaagaacgagacattccagaaagatcgtggaactccggcaatgaatggattaccgattttgcggggaagacagtatggtttgtaccatctataaaagcaggcaatgacattgcgaactgcttaaggaaaaacggcaagaaagtcatacaactatcaagaaaaacattcgacacagaataccagaaaacaaagctaaacgattgggatttcgtggtcacaacggacatcagtgaaatgggtgctaacttcaaagcagatagagtaatagacccacgcagatgtctaaagccagtgatattgacagacggtcctgagagagtcattctagcaggaccaatgccagttacggcggcatcagctgcgcagcgaagagggagggtaggtagaaacccacagaaagaaaatgatcagtatatattcactggacagccattgaataatgacgaagatcacgcgcattggacggaagcaaagatgttattggataatataaacacacctgaaggtataattcccgcactgtttgaacctgaaagagaaaaatctgctgcgatcgatggagaatatcgactgaaaggtgaatcccgaaaaaccttcgtagaactgatgagaagaggagatctaccagtttggcttgcacataaagtagcatctgaaggaataaaatacacggaccgaaagtggtgctttgatggacaaaggaacaaccaaatactagaggaaaacatggacgttgaaatttggactaaggagggagagaagaagaaattacggccacgctggcttgatgcgcgaacgtacagtgaccccttggcattaaaagaatttaaagagttcgcagcaggccgcaaaagtatcgcactcgatttagtaactgagataggcagagttcctagccaccttgcacaccgaacaagaaatgcattagacaatctagtaatgctgcacacaagcgaacatggtggcagagcgtacagacatgcagttgaagagttgccagaaacaatggaaactctcttactactagggttaatgatattactgacaggtggagcaatgctgttcctcattagtggtaaaggtattggaaagacatcgattggactaatctgcgtcattgcctctagcggaatgctatggatggcagagatacctttacagtggatagcatcagccatagtcttggagttctttatgatggtactccttatcccagagcctgagaagcaaagaactcctcaggacaatcagctagcctatgtagtaattggaatattaacgttggcggccataattgcagcaaacgagatgggcttgctagaaaccacaaagagagaccttggaatgtcaaaagaaccaggcgtagtatctccaacatcatatttagatgtagatttacatcccgcatcagcatggactttgtatgcggtagctactaccgtgataacacccatgctgagacataccatagaaaatagcactgcgaatgtaagtttggcagcgattgcaaatcaagcggtggtcttgatgggattggataagggatggccaatctcaaagatggatctgggcgttccactattggcactgggctgttattcacaggtgaacccattaacgcttactgctgcagtactactcctaatcacacattatgcaattataggccctggattgcaggcaaaagccacccgtgaggctcagaaacgaaccgcagctgggataatgaaaaacccaacagtggatggaataatgacaatagatttagacccagtaatttacgactctaagttcgaaaaacaattaggtcaggttatgctattagttctgtgtgctgtgcaattattactaatgagaacttcttgggcactttgtgaagccctgactctagctaccggacccataaccacactatgggagggttctccagggaaattctggaacacgacgattgcagtaagcatggctaatatatttcggggctcctatctagccggtgcaggtctggcgttctctataatgaaaagcgttggcaccgggaaaagaggaacgggaccccaaggagaaaccctaggggaaaaatggaagaaaaagttgaatcagttatctcgaaaagattttgacctttataagaagtcaggaataacagaggtggacaggacggaggcaaaagaaggcctaaaaagaggagagataactcaccatgccgttagccgtggctcagcaaagctacagtggtttgtcgagaggaatatggtgattcctgaaggccgtgttattgaccttggttgcggtaggggaggttggtcgtattattgtgctggattgaagaaagttacagaagtccgaggatacacaaaaggtgggccgggtcatgaagaacctgtacctatgagtacatacggttggaacattgtaaaactcatgtcgggcaaagatgtattttatttaccaccggagaaatgcgatactttactctgtgacataggagaatcatcacccagccccacagtggaagagtctcgaaccatacgagtattgaaaatggtcgagccttggttgaaaaataaccaattttgcatcaaagttcttaacccttatatgcctacagtaattgaacacctagagagactacaaagaaaacacggaggcatgctcgtaagaaatcccctttcgcgtaattcaacacatgaaatgtactggattagcaatggaactggaaacattgttgcatcagtgaacatggtaagtagattactactaaatagatttacaatgacacaccggcgtcctacaattgaaaaagatgttgatctaggtgcagggacacgacacgttaatgccgaacctgaaactcctaatatggacgtcatcggagaacgaattaaacgtataaaagaagaacataactcaacatggcattatgacgatgagaatccctataagacttgggcatatcatggatcctacgaagtcaaagcgacagggtcagcatcaagcatgattaacggcgtagtcaagctgttaactaagccatgggatgtggtgcctatggtaactcaaatggcaatgaccgacacaactccatttggacaacaacgagtattcaaagaaaaagtagacacaagaacacccagatccatgcctgggacgcgtcgagtgatggggattacagcagaatggctatggcgaacattgggccgcaataaaaagccacgtttgtgtacaagggaagaatttacgaagaaagtccggaccaacgccgcgatgggagcagtcttcacggaagaaaaccaatgggatagtgcaaaagcagcggtggaagacgaagatttttggaaattagtcgaccgagagcgggagctacataaacttggcaaatgtggttcatgtgtgtataatatgatggggaagcgtgaaaagaaattaggggaatttggtaaggctaaaggttcccgtgcaatttggtatatgtggctaggagctcgatacttggaatttgaagcacttggatttctaaatgaagatcactggttttctcgagaaaattcgtatagtggagtagaaggggagggcctacatcgtttagggtatatattacgagacatatctaaaatcccgggtggagcaatgtatgctgatgatactgccggttgggacacaaggattaccgaagatgacttacacaatgaagagaaaatcacacagcaaatggaccccgaacacagacaactagcaaatgctatctttaaattaacataccaaaataaggtagtaaaagtacaaagaccgacaccaacaggaacggttatggatatcattagccgaaaggaccaacggggcagtggacaggtaggcacatatgggttaaacacctttacaaatatggaggctcaattgattcgccaaatggaaggtgaaggcgtattgtcaaaagccgacctagaaaatcctcacctaccagaaaagaaaatcacacagtggttggaaacgaaaggagtagaaaggttaaaaagaatggcgattagcggtgatgattgtgtagttaaacccatagacgacagatttgcgaatgctttgttggccctcaacgatatgggaaaggttagaaaagacatccctcagtggcaaccgtccaaaggatggcatgattggcaacaagtaccattctgttcacaccactttcatgaactgataatgaaggacggcagaaaactcgtggttccgtgtaggccacaagatgaactcataggcagagctagaatttcacaaggggccggctggtcgctgaaagaaacggcgtgcctaggtaaggcttatgctcaaatgtggtccttaatgtattttcatagaagggatcttagattggcgtctaatgctatttgcagtgcagtaccagtgcattgggtacctacaagccgaacaacctggtcgatacacgcccatcaccaatggatgactaccgaggacatgctgactgtatggaaccgggtttggatcgaagataatccatggatggaagacaaaactccagtaacaacctgggagaacgtaccgtatcttggaaaacgtgaagatcaatggtgcggaagtttaattggtctaacgagtcgtgctacgtgggctcagaacattcctaccgcgattcagcaagtacgatctttgattgggaatgaagaatttttagattatatgccatcaatgaaaagattccgtaaggaggaagaatctgaaggagccatttggtaa

SEQ ID NO: 23185 - RNA, 9873 nt, synthetic construct
  misc_feature 1..9873: note = derived and/or modified CDS sequence (opt6) from DENV-3__HM756281__SS-prME
  source 1..9873: mol_type = other RNA
acatcattatgccttatgatgatattgcctgcagcattggctttccaccttacgtcgcgagatggggaacctcggatgatagtaggtaaaaatgaacgaggtaaaagcctactgtttaaaacggcctcaggtataaacatgtgtacgttaatagccatggatctaggtgaaatgtgtgacgatactgtaacttataaatgtcctcacatcacagaagtggaacccgaagacattgactgttggtgtaatcttacctccacatgggttacttacggaacttgtaatcaagccggtgaacatagacgcgataaacgaagcgtagcattggcaccacatgtaggcatggggcttgatactcgaacacaaacatggatgtccgccgaaggagcatggagacaagtagaaaaagtggaaacatgggcgcttagacatcccgggttcacgatcctagctctttttctcgcacattatatcgggaccagtctcacgcaaaaagtagtgatttttatattgcttatgttggtgacccccagcatgactatgcgttgtgttggagtaggcaatcgtgatttcgttgaaggactatccggtgcaacatgggtagatgtcgtacttgaacatggaggatgtgtaaccacgatggctaaaaacaaaccgactctagatatcgaactccagaaaactgaagcaacacaattagcaactctacgtaaactgtgcatagaaggaaaaataacaaatattacgacagactccagatgtccaacccaaggagaagcgaccttaccagaagaacaagaccaaaactatgtatgtaaacatacatatgtagaccgggggtgggggaacggttgtggtttatttggtaaaggatcacttgtgacctgcgcaaaatttcagtgtttagaacctattgaaggtaaagtcgtacaatatgaaaatctcaaatacactgtgataataacagtccacacgggagatcaacatcaagtaggcaatgaaactcaaggcgtgacggccgaaataacaccacaggcttctactacggaagctatcttaccagaatacggtacattaggtttagaatgtagtcctagaactggcttggatttcaacgaaatgatacttttaacaatgaaaaataaagcctggatggtgcaccgtcaatggttctttgacctacctcttccatggacaagtggagcaacgacagaaacgccaacttggaatcggaaagaacttttggttacttttaaaaatgcacacgcaaagaaacaagaagtggtagttttaggctcacaagaaggggctatgcatacggctttaacgggagctacggaaatacaaaattcaggtggtacttcgatattcgccggacacttaaaatgcagattaaaaatggacaaactcgagctaaaaggcatgagctatgcaatgtgcactaacaccttcgtattgaagaaagaagtctctgaaacccaacacgggaccatcttaataaaagtcgaatacaaaggcgaggatgtaccttgcaaaatacccttttcaaccgaagacggtcaaggcaaagcacataatgggcgactcataacagcaaaccccgtagtaaccaagaaagaagaaccagttaacattgaagccgaacctccttttggtgaaagtaacatcgttataggcatcggcgacaacgcattaaaaataaactggtataagaaaggctcgagtataggaaaaatgtttgaagcaacagcacgtggcgctagaaggatggccattctgggcgacactgcttgggatttcgggtcagtaggtggcgtccttaattctcttggaaaaatggtccaccaaatattcggctctgcatatacagccctattctcaggcgttagctgggtgatgaaaatcggaataggcgtactgctcacatggataggactaaattcgaaaaatacgtcaatgtctttctcatgcatagcgataggaataatcacgttgtatcttggtgcagtagtccaggcggatatgggatgtgtcgtaaattggaaaggaaaagagctcaagtgtggcagcggtattttcgtaacgaatgaggtgcatacctggacagaacaatataaatttcaggcagactctcctaaacggctagcaacagcaattgctggtgcatgggaaaacggagtatgtggaatccggagcactacacgaatggaaaatttattgtggaagcaaatcgcgaacgaattaaactacattctttgggagaataacataaagttaacagttgttgtgggggacatcatcggagtactggaacaaggaaaaaggactctgaccccacaacctaaggaacttaaatattcctggaaaacctggggtaaggctaaaattgtaaccgctgaaacacaaaactcctcattcatcatagatggaccgaatacgcctgaatgtccgtctgttagtcgggcatggaatgtatgggaagttgaagattatggattcggcgtatttacaactaacatctggctaaaactaagagaagtatatacgcagttatgcgaccatcggttgatgagtgctgctgttaaagacgagcgagcagtacacgcagatatgggttattggatagaatctcagaaaaatggttcttggaaattagagaaagcgtcactaatcgaagtgaagacctgcacatggccgaaatcacatacactttggagtaatggagtattggaatcagacatgataatcccaaagagcttagcaggaccaatatctcagcataatcatcgaccgggataccacacacagacagctggtccgtggcacttagggaaactagagttagacttcaactattgtgaaggtacgaccgttgttataacagaaaattgtggtactcgaggtccatccctacgtaccacgacagttagcggaaaattgattcatgaatggtgttgtagatcttgcactcttccccctttaaggtacatgggagaggatggatgctggtatggcatggaaattaggcctatttcagaaaaagaagaaaacatggttaagtcattagtgtcggccggatctggaaaggtagataattttacaatgggtgtactctgtttagcaatcctgtttgaagaagtgatgcgtggaaagttcggcaaaaagcatatgatagcaggagtatttttcacttttgttctacttttatctggacaaataacgtggcgggacatggctcatacattaataatgatagggagtaacgcaagcgatcgaatgggaatgggcgtaacctatctagcattaattgcaacgtttaaaatccagccgtttttagcattgggtttctttctacgtaaacttacatccagagagaatctattgttgggcgtaggactagcaatggcaacaacgttgcaactaccagaggatatcgaacaaatggctaacgggattgctctaggattaatggccttaaaactaataacacaattcgagacatatcagctgtggactgctttaataagtctaacgtgttcgaatacaatcttcacattaactgttgcttggaggactgctacattaatactagcaggagtatcattacttccagtctgtcaaagttcttcaatgcgtaaaactgattggctgccaatggcagtggcagcaatgggtgtgcctccattaccactctttatatttagcttaaaagataccctgaagcgacgtagttggcctttaaatgaaggagtgatggccgttggcttagtatccattttagcttcatcattattacggaacgacgtaccgatggccggccccctagtagctggcgggctgctaatcgcttgttatgtaatcacaggcacttcagctgatctcacagtagagaaagccgcagatataacgtgggaggaggaagcggaacaaaccggagtatcgcataacctcatgatcacagttgatgatgatggtacgatgaggatcaaagatgatgagacagaaaatattctaacagttttactaaaaaccgcactattgatcgtcagcggtatattcccctactcaataccagcaacgttacttgtttggcatacctggcaaaaacaaactcaaagaagcggagtattatgggacgtacccagtccacccgaaacgcaaaaagccgaattagaagaaggagtgtaccgtattaagcaacaaggaatattcggcaaaacacaggttggggtaggcgtccaaaaagaaggcgtatttcatacgatgtggcatgttacaagaggagctgtactgacatataatggcaaaagactagaaccgaactgggcaagcgtaaagaaggacctaatatcatacggtggcggctggaggttgagcgcacaatggcaaaagggagaagaagttcaagtgatcgccgtcgaaccaggcaaaaatcctaagaactttcagacaatgcctggaactttccaaacaacgaccggtgaaataggcgcaatagctctagattttaaacccggaacatcagggagtccaataataaatcgtgaaggtaaagttgtagggctctatggtaacggtgtagtaactaagaacggaggatacgtaagtggaatcgcacagactaacgcagaacccgacgggccaacaccagagttggaagaagagatgtttaagaaacgaaatcttacaataatggacttgcatcccggatcaggtaaaacgaggaaatacctgcctgcaattgttcgagaagcaataaaacgcagactgaggacccttatattagctccaacaagagttgtcgctgctgaaatggaggaggcgttaaaaggacttccaataagatatcaaactacggcgaccaagtccgagcacacgggaagagaaatcgttgacctaatgtgtcacgcaacatttacaatgcgtcttctctcaccagtaagagttccaaattacaatctaatcataatggacgaggctcattttacagatccagcatcaatagcagctcgtggatatatttccactagagtaggaatgggagaagcagctgcaatctttatgacagccacacctccagggacagcggatgcctttccccaatctaacgcaccaattcaagatgaggaacgcgacattccagagcgttcctggaactccgggaatgaatggataacagatttcgcaggtaaaacagtatggtttgtaccatcaattaaagcagggaacgacatagcaaactgtctaaggaaaaacggtaagaaagtaatacaattaagtcggaagacatttgatacagaataccagaaaacgaaactaaacgattgggattttgtagtgacaacggacatatccgaaatgggcgcaaatttcaaggccgaccgagtgatcgaccctcgcagatgcttaaaaccagtaatcttaaccgatggcccggaaagggtcatcttggcggggcctatgcctgtcacggctgccagtgctgcccaaaggcgtgggagagttggacgaaacccacaaaaggagaacgaccaatatattttcactgggcagccattaaacaatgatgaagaccacgcacactggaccgaagcaaaaatgttattagacaatataaatacaccagagggcataatccctgcattgttcgaaccagaaagagagaaatccgcagctatagatggagaataccgcttgaaaggtgagtcccgtaaaacttttgtagaactaatgaggcgcggagatttgcctgtatggttggcccataaagtcgcatccgaaggcataaagtatacagaccgaaagtggtgctttgatggtcagaggaataaccaaatacttgaagaaaatatggacgtggaaatctggacgaaagagggtgagaagaagaaactgagaccccgatggctagatgcacggacatattcagaccccctagcattaaaagagttcaaagaatttgcggcaggcagaaaatcgatcgcattggatctggtgaccgaaattggtagagtgccctcgcacttagctcaccgaacaagaaatgcgctagacaatttagtaatgttacatacatcagaacatggagggcgtgcatatcgacatgctgtagaggaattgcccgaaactatggagacgctattactactcggattaatgattctattaactggaggagcaatgttattcttaatttctggtaaaggaatcggaaaaacttcaataggactaatctgcgtgatagcttcttccggtatgttgtggatggcagagatacccttacaatggatagcatcagctatcgttctagaatttttcatgatggtgttattaatcccagaaccagaaaaacaaagaacaccccaagacaaccaactagcatacgtagtcatcggaattttaaccttagcagctataattgctgcaaacgagatgggactacttgaaactacgaaaagagacttaggcatgtccaaagagccaggcgtcgtttcgccaacctcttatctagacgtagatctacaccccgcaagcgcgtggactttatacgctgtagccaccacggttattacacccatgctaaggcacactattgaaaattcaactgcgaatgtgagtctagcagcaatagccaaccaggctgtggtcttgatgggattagataaaggatggcccatatcaaaaatggacctgggcgtaccattactagccctagggtgctattctcaggttaatccgttgactttaaccgcggcagtactactgctgataacccactatgccattataggtcccggtcttcaagcgaaagctacaagagaagcgcagaaaaggaccgctgctgggataatgaaaaatccgacagttgacggtattatgacaattgatctagatcccgtaatatacgacagtaagttcgaaaaacaacttgggcaagtgatgcttttagttctatgtgcggtgcaactattattaatgcgaacttcatgggccctttgtgaggccttaacactagcgacgggacccatcacgactctatgggaagggagcccgggtaaattttggaacacgacaatcgcagtaagtatggcgaacatcttccggggatcctatctagccggcgctggtttagcattctcaataatgaaatccgttggaaccgggaaacgtggcacaggatcgcaaggtgagactttaggagaaaaatggaagaagaaacttaaccagttaagcaggaaagatttcgacctatacaagaaaagcggaataaccgaagttgatagaacagaagctaaagaaggattaaaacgtggtgagataacacaccacgccgtctcacgggggtctgctaaattacaatggtttgttgaaaggaacatggttattccggaaggaagagttattgatctaggatgtggcagagggggatggtcatactactgtgctggactcaagaaagtaactgaggtgagaggatatacaaaaggaggaccgggacacgaagaaccagttccaatgtcaacatatggttggaatatcgtaaaactcatgagtggcaaagacgttttctacctaccaccagagaagtgtgatacacttctgtgtgatattggtgaatcatcaccaagcccaacagtggaggaatctagaacgataagggtccttaaaatggtcgaaccatggctcaaaaataatcaattctgtattaaagttttaaacccttatatgccaacggtaatagaacacctggaaagacttcaaagaaagcacgggggaatgttagtgagaaatccactgtcaagaaactccacccatgaaatgtattggattagtaacggaactggtaacatagtggcatcggtcaatatggtctcgagacttctacttaatcgatttaccatgactcataggcgaccaactatcgaaaaagacgttgatttaggtgcgggaacgaggcacgtaaatgcagaacccgaaacacctaatatggacgtaataggcgaacgaataaaaagaattaaagaagaacataattctacttggcactacgatgatgaaaatccttataaaacttgggcgtatcatggcagttatgaagtaaaggctactggatctgcgtcatcaatgattaacggggtagtaaaactattgacaaaaccatgggacgtagtacctatggtgacgcaaatggcgatgaccgatacaactccattcggacaacagcgtgtctttagggaaaaagtagatacacgcacgccgcgcagtatgcctggaacaagaagggtcatgggcataaccgctgaatggctatggcgaactcttggaagaaacaaaaagccccgtctatgtaccagagaagagtttaccaagaaagtaagaactaacgcagctatgggtgctgtctttactgaggaaaatcagtgggactctgctaaggcagccgtcgaagacgaagatttttggaaacttgtcgacagagaaagagaactacacaaactaggaaaatgtggtagttgcgtgtataacatgatgggaaaaagagagaagaaattaggtgagtttggaaaagcaaaaggatcacgagctatatggtacatgtggttaggagctaggtatctggaatttgaggctttaggatttttaaatgaagatcactggtttagtcgggaaaactcgtactcaggcgtcgaaggagaaggcttacacaaattgggatatatcttacgcgatatctcaaaaattccaggcggtgctatgtatgcagatgataccgctgggtgggatacacgcataaccgaggacgatcttcacaatgaggaaaagatcactcagcaaatggatcccgaacatagacaattagccaacgcaatctttaaattgacttatcaaaacaaggtagttaaagtacaaagaccgacaccaacaggaacagttatggatattatttcaagaaaggaccaacgaggatccggtcaagtcgggacatatggactaaatactttcactaacatggaggcacaacttattaggcagatggaaggagaaggagttttaagtaaagcagatttagagaacccacatctgccagagaagaaaataacacaatggttggaaaccaaaggtgtagagaggttaaaacgcatggccatatcgggagatgattgcgtggttaaaccgatagatgacagatttgcaaatgcacttctggctctaaatgatatgggaaaagtaagaaaagatatacctcagtggcaaccgtcaaaaggctggcatgactggcagcaagtaccattttgctcacatcactttcacgaacttataatgaaagatgggaggaaactcgtagtcccctgtagaccacaagatgaactaataggaagggccaggattagccagggagcagggtggtcactaaaagagactgcctgcctaggaaaggcttatgcacaaatgtggtcacttatgtattttcatcgacgggatttacgattagcctctaatgcgatctgttcggctgtaccagtgcattgggtgcctactagcaggacaacctggtcgattcacgcacatcaccaatggatgaccactgaagacatgttaacagtctggaatagggtatggattgaagataatccctggatggaagacaaaacacccgtaacgacctgggaaaacgtaccgtatctcgggaaaagagaggaccaatggtgcggaagtttaattggattaacatcacgggctacctgggcacaaaacataccaactgcaatacaacaagttcgaagtctcatcggcaacgaggagttcttagattatatgccatcaatgaaaagattcaggaaagaggaagaaagtgaaggggctatttggtaa

SEQ ID NO: 23186 - RNA, 9873 nt, synthetic construct
  misc_feature 1..9873: note = derived and/or modified CDS sequence (opt6) from DENV-3__JF937643__SS-prME
  source 1..9873: mol_type = other RNA
acttccttatgccttatgatgatcctcccagctgcacttgctttccacctcacatcacgagacggagaaccaagaatgatagtagggaaaaatgaacgcggcaaatcattattattcaaaactgcatcaggaatcaacatgtgtacactaatagctatggaccttggtgaaatgtgtgacgacacggttacttataaatgccctcacatcaccgaagttgaaccggaagacatcgattgttggtgcaatttaactagcacttgggtaacctatgggacttgtaatcaagcgggggaacatagacgagacaaaagaagcgtagcactagcccctcatgtaggaatggggcttgatactagaactcaaacatggatgagcgcagaaggggcatggagacaagtcgaaaaagtagaaacatgggcactaagacatccaggattcaccattttagcactgtttctagcacactatattggaaccagcttaacacaaaaagtagtaattttcatcttgcttatgctggtgactccatctatgacgatgaggtgtgtaggagtcggtaacagagactttgttgaaggattatcaggagccacatgggtcgatgtcgtattggaacatggaggctgtgtaacaactatggccaaaaataaacccacactagatattgaacttcagaaaacggaagcgactcaattagcaactctacgaaaactttgtatagaaggaaaaatcacaaacataacaacagatagcagatgtccgacccaaggagaagccacgcttccagaagaacaagaccaaaactacgtctgcaaacacacctatgtagaccgtggctgggggaatggctgtgggctattcggaaaagggagcttagttacatgcgctaaattccagtgtctcgaaccaatagaaggtaaagtagttcaatacgaaaatctcaaatatactgtgatcataaccgtacacactggtgatcaacaccaagtaggaaatgaaacacaaggtgttactgcagaaatcactccacaagcaagtaccacagaagccatattacctgaatatggaacactcggacttgaatgttcaccacgaacgggtctagatttcaatgaaatgattctattgacaatgaaaaataaagcctggatggtacacagacaatggttctttgatttacctctaccgtggacaagcggcgctacaactgaaacacccacctggaatcgcaaagaattactggttacttttaaaaatgctcatgctaagaaacaggaagtcgtagttttaggatctcaagaaggggcgatgcatacagctcttacaggggcaaccgaaatacaaaattctggagggacatcaatatttgccggacatttaaaatgccgcttgaaaatggataaacttgaactaaaaggcatgagttatgctatgtgcactaataccttcgtcctcaagaaagaagtaagtgaaacgcaacacgggactattttgataaaggtggaatacaaaggtgaagatgtcccctgtaaaataccattttcaacagaagatggtcaaggaaaggcacacaacggtcgattaatcacggccaacccagtcgttactaagaaagaggagcctgtcaacatagaagccgaaccacctttcggggaaagcaatattgtcatcggtattggcgacaacgcactgaaaattaattggtacaagaaagggagctcaataggcaaaatgttcgaagctacagcaagaggtgcaagacggatggccattttgggggatacagcatgggacttcggctctgtcgggggcgtgttaaattcattgggaaaaatggtacatcagatcttcggttctgcgtataccgcactattttccggagtatcatgggtaatgaagataggtataggtgttctacttacatggattggattgaactcaaagaatactagcatgagctttagctgcatagcaattggaattattacgttatatttgggggcagtagtacaagcagacatgggatgcgttattaattggaaaggtaaagagcttaaatgcggtagcggaatatttgttacaaatgaagtacacacctggacagaacaatataagtttcaggccgactctcctaaaagattagccacagcaatcgccggggcatgggaaaatggtgtatgtgggataagaagcacaacaaggatggaaaatttactatggaaacagatcgcaaatgaactgaactacatattatgggagaataacataaaattgactgttgtagttggagacatcataggtgttctagaacaaggcaaacgtacattaacacctcaacccatggaactgaaatattcatggaaaacctggggtaaagcaaaaatcgtcactgcagaaactcaaaatagctcatttattatcgatggtcccaacactccagaatgtccgtcagttagcagggcatggaatgtatgggaagtagaggactacggatttggagtgtttaccactaatatttggctaaaattaagggaagtctatacacaattatgtgaccatcgtctaatgtctgcagctgtaaaagacgaaaaagccgttcatgcagatatgggatattggatagaatcacaaaagaacggctcctggaagctcgaaaaagctagcttgatagaggtaaaaacatgtacatggccaaaaagtcataccttgtggagtaacggagtcctggaaagcgacatgataatcccaaaaagtctagccggccctatatcccaacataaccataggcccggttaccatacccaaactgccggaccgtggcatctagggaaacttgagcttgactttaattactgtgaaggtactacagttgtaattacagagaactgcggtacaaggggaccgtcactaagaaccaccacagtatccggaaaactaatacatgaatggtgttgcaggagctgtacgctaccacctcttaggtacatgggagaagatggatgttggtatggaatggaaattcgtccaatctcggaaaaagaggaaaatatggtgaagagtctggtttcggcagggtccgggaaggtagacaattttactatgggtgtgttgtgtttagctatcctatttgaagaagtcatgagaggcaaatttggtaagaaacacatgatagcgggagtattctttacctttgtattactcctgtcaggccagataacgtggagggatatggcccataccctcatcatgatcggcagtaatgccagcgaccgcatgggaatgggtgtaacttatcttgcattgattgcaacttttaaaatacaaccattcttggcgttaggtttcttccttcgaaaactgacaagcagggaaaatcttctgctcggggtcggtttagctatggccacaacgcttcaattaccagaggatatagaacagatggcaaatggtatagccctgggtttaatggctttaaaattaatagctcaattcgaaacttatcaattatggacagcgctaatcagccttacatgtagcaatacaatctttacacttacagtagcgtggaggacagctaccttgatactcgcaggggtatcacttctaccggtatgtcaaagttcttcaatgagaaagacagattggctaccgatggctgtagcagctatgggggttccaccgctcccactatttatattttcgcttaaggacacgttgaaaagaagaagctggccattgaacgaaggcgtaatggccgtcggactggtttcgatattagcatcttctctattgagaaatgacgttcccatggctggtcccctagttgccggagggctactgatagcttgctatgttataaccggaactagcgcggacctgacagttgaaaaagccgcggatataacttgggaggaggaggccgaacaaactggagtatcccataatttaatgattgccgttgacgatgacggcacaatgcgaatcaaagatgacgaaacagaaaatattcttacagttctacttaagacagctctactaatagtcagcggcattttcccatacagtataccggcgactctattagtttggcatacttggcaaaaacaaacccaacgatcaggtgtgttgtgggacgtgccaagcccgcccgaaacgcaaaaagcggagctagaagagggagtttacaggataaaacaacagggaatttttggaaaaactcaagtgggcgtaggagttcaaaaggaaggcgtatttcacacgatgtggcacgtaacacgaggtgcggttctcacctataatgggaaaaggctggagccaaactgggcaagcgtcaagaaagacctaatctcatacggtggaggttggcgtctttcagctcaatggcaaaaaggtgaagaggtacaagtcattgctgtagaacctgggaaaaacccgaaaaattttcaaaccatgccaggtacattccaaactacaacaggagagataggtgcaatagcactagactttaagcctggaacaagcggaagcccaataatcaatagagagggtaaagtagtaggattatatggcaacggagtagtaaccaaaaatggcggttacgtatcaggtattgcacaaactaatgcggaaccggacggacctactcctgagttggaagaggaaatgtttaagaaacgcaatctaacaattatggatttacatcctggttcaggaaaaaccagaaaatatttacctgcaattgttcgtgaggctattaagcgccgtttgcgaacgttaatacttgctccgacacgcgtcgtagccgcagagatggaagaagctcttaagggtttgcctattcgttatcaaaccacagcgacaaaaagtgaacacaccggacgcgaaattgtggacttaatgtgtcacgcaacatttacaatgcggttgctaagtcccgtgagagtaccgaattacaacctcataataatggacgaagcccactttaccgatccagcgtctatagctgctagaggatatatctcaaccagagttggcatgggagaagcagcagcaatattcatgacagcgacaccaccaggcaccgcggatgcctttccgcagtcaaatgcacccatacaagacgaagaaagagatattcccgaaagaagttggaactctggcaatgaatggataacagatttcgcaggaaaaaccgtctggtttgtacctagcataaaggccggaaatgacattgcgaattgtctccgtaaaaatggtaagaaagtaatccaactgagcagaaaaactttcgacacagaataccagaagacaaaattgaatgattgggactttgtggtgaccacagacattagtgagatgggagccaattttaaggcagaccgtgtaatcgatcctagaaggtgcctgaagccggtaatattaacagatgggcctgagcgcgtgatcttagctggtccgatgccagttaccgcggcatccgcagcacagcggagaggaagggtaggaagaaacccacagaaggaaaatgaccaatatattttcacagggcaacctctaaacaacgacgaagaccatgcacactggacagaagcaaagatgttgttggacaacataaatacgcctgagggtataattcccgcattatttgaacctgaacgggagaaaagcgccgctatagacggagaataccggttaaaaggagaatcaagaaagacattcgtcgaattaatgagaagaggcgacctacctgtatggttagcccataaagtagccagtgaaggcattaaatacacagatagaaagtggtgcttcgatggacagcgtaacaaccaaattttagaagaaaacatggatgttgaaatatggactaaagaaggtgagaaaaagaaattgcggcctagatggctggatgctagaacatattcagatccacttgctttaaaggagttcaaagagttcgccgctggccgaaaatccatagctctcgatctagttacagaaatcggtagagttccaagtcacctagctcatcgaacaagaaacgccttagataacttggtaatgttacatacaagtgaacatggtggccgagcgtacaggcatgcggttgaagaactgccagaaaccatggaaacactattactccttggattaatgatattgttaacagggggagcaatgctgtttctaatctcaggaaaaggaataggaaaaacgtcgattggactcatatgtgttatagcctcgtcaggtatgttatggatggctgagattccactccagtggattgctagtgcaatagtcctagagttcttcatgatggtccttcttataccagaaccagaaaaacaacgaactccccaagacaatcaattggcttatgttgttataggcatcttaacgttagccgcagtgattgctgcaaacgaaatgggccttcttgaaacaactaaaagggatctcggcatgtccaaagaaccaggagtagtgtcaccgacaagctacctagatgtagatttgcatcctgcaagcgcctggacactatatgcggtagctacaacggtcataacacctatgctccgccacacaatagagaactctactgctaacgtaagtttggcagcaattgccaaccaagccgtggtccttatgggtttagataaaggatggccgattagtaagatggatttaggagtccctctcttggccctcggatgttactcacaagtaaatccgctgacgttaactgcagcggtactattactgattacgcattacgctataataggtccgggacttcaagctaaagcaactcgtgaggcccagaaaaggacagctgcgggtatcatgaagaatccaacagtagatgggatcatgacaatagaccttgatcctgtaatctacgattcgaaattcgaaaaacaactcggtcaagttatgttgctagtattatgtgctgtacagcttttactcatgcggacctcatgggctttatgcgaagcgctaacccttgcaactggcccaattacaacactatgggaaggttcgccaggaaagttttggaacacaaccatagctgttagtatggcaaatatcttcagaggaagttatttagccggggctggtctagctttttcaataatgaaaagtgtgggaacgggcaagcggggtacgggtagtcaaggggagacactcggtgaaaagtggaaaaagaagctaaatcaacttagcagaaaagacttcgacctatataagaaatctggaataacggaagtcgatcggacagaagcaaaagaagggttaaaaaggggagagattacacatcacgctgtaagcaggggctcggcaaaacttcaatggttcgttgaaaggaatatggtgatacccgagggtagagtcatagaccttggttgtggcagaggaggttggagttattattgtgcaggactcaaaaaggtaacagaagtgaggggatacacgaagggtggacccggtcatgaagaaccggtgccaatgtctacatatggttggaatatcgttaaactaatgtccgggaaggacgtattttacttaccaccagaaaaatgtgatacacttctttgtgacataggagaaagctctccatcgcctaccgtagaagagtcgcgaacgatacgcgtattaaaaatggtagaaccgtggttaaagaacaatcaattctgtataaaagtattaaatccatacatgccaacagtaatcgaacatctcgaacgtcttcaacgtaaacatggcggcatgctagtacggaatccattatctagaaattcgactcatgaaatgtattggataagtaatggaactggaaatatagttgcatcggtaaatatggtaagtcggttacttcttaacaggtttacgatgacacatagacgtccgaccattgaaaaagatgtagatctaggtgcagggacaagacacgtaaacgcggagccagaaacgcccaatatggacgttataggtgaaagaattaaacggatcaaagaggaacacaattctacatggcattatgatgatgaaaatccttacaaaacatgggcataccatggatcgtacgaagtaaaggcaactggatcagcgtcctctatgatcaatggagtagttaagctattgactaaaccatgggatgtcgtacccatggttacacaaatggctatgactgatacgactccttttggccaacaacgggtatttaaagaaaaggttgacactaggacacctaggagcatgccaggcacccgacgagttatgggtataacagcagaatggctgtggagaacactgggacgaaataaaaagcctagattatgcactcgcgaagagtttactaagaaagtaagaaccaatgcagcaatgggcgccgtatttactgaagaaaatcagtgggatagcgctaaagcagctgtagaagatgaggacttttggaagttagtcgatagggaacgagaattacataaactcggtaaatgcggaagttgtgtatataacatgatgggtaagagagagaagaaacttggtgagttcggcaaagcgaaaggttctcgtgcgatatggtacatgtggcttggagccaggtatcttgaatttgaagcactgggtttccttaatgaagaccattggttttcaagagaaaatagttacagcggtgtggaaggtgaaggcctacacaaactgggttatatactcagagatatatctaaaatacctggaggtgcaatgtacgcagatgacacggctggatgggatacaaggataaccgaggatgacctacataatgaagaaaagataacacagcaaatggatccagaacatagacaacttgctaatgctatatttaagttaacttatcagaacaaggtagtcaaagtacagagacctacgcccacaggtacagtaatggacatcatatcccgtaaggaccaaagaggatcaggtcaagtaggaacctacggcctaaatacatttactaacatggaagcacaattaatacgtcaaatggagggagagggggttttgtcaaaagctgacttagaaaaccctcacttgccagagaagaaaataacacaatggctcgagacaaagggagttgagcgtttaaaaagaatggccatttctggagatgattgcgtagttaaaccaatcgacgatagattcgcgaatgcactactagccttgaacgatatgggcaaagtgagaaaagatatcccccaatggcagcccagtaaaggatggcacgactggcaacaagtacccttttgttctcatcatttccatgagctcattatgaaggatggccgaaaacttgtggtaccatgtagaccacaggacgaactgatcggtagagcgagaattagtcaaggagctggttggagccttaaggaaacagcttgcttaggaaaggcatacgcacagatgtggtcattaatgtattttcatcgaagggaccttagattagctagcaatgcaatatgctcagcggtgccagtccattgggtgccgactagcaggacaacgtggtccatacacgcacatcatcaatggatgacaacagatgatatgcttacggtatggaatagagtgtggatcgaagataacccatggatggaagataaaacaccggtgaccacgtgggaaaatgtaccttacctcgggaaaagggaggatcaatggtgtgggtccctaatcgggttaacttctcgagcgacttgggcacagaatataccaacagcaattcaacaagtcagaagcctcataggaaacgaggagttccttgattatatgccaagcatgaaaagattccgaaaggaagaagaatcagagggcgcaatctggtaa

SEQ ID NO: 23187 - RNA, 9873 nt, synthetic construct
  misc_feature 1..9873: note = derived and/or modified CDS sequence (opt6) from DENV-3__HM181972__SS-prME
  source 1..9873: mol_type = other RNA
acttccctgtgtcttatgatgatattaccagctgctttagctttccacttaacttcaagggatggtgaaccaaggatgattgtaggtaaaaacgaaagggggaaatcgttgttgttcaaaacggcaagcggaatcaatatgtgcacattaatcgctatggacctaggagaaatgtgtgatgacacggtgacatacaaatgccctcacataactgaagttgaaccggaagatatagactgctggtgtaatttaacgtctacatgggtcacatatggcacatgtaaccaagcaggcgaacatcgacgtgataaaagatcagttgcacttgcaccacatgttggtatgggacttgacacgagaactcaaacatggatgagtgcggaaggagcttggagacaagttgaaaaagttgaaacatgggctcttagacacccaggatttacaattctagcattattcctagcacattacataggtacaagcctaactcaaaaagtagtaattttcattttactgatgttagtgactccgagcatgaccatgaggtgcgtaggagtagggaatagagatttcgtagaaggattatccggagcgacatgggtagatgttgtattagaacacggaggatgtgtgactacgatggctaaaaataaacctactttagacatcgaactacagaaaaccgaagctactcaattggcgactttgagaaaactgtgcatagaaggaaaaataactaacattactaccgactcacgttgtccaacacaaggtgaggcaacattaccagaagaacaagaccaaaattatgtctgtaaacatacgtatgtggatcgagggtggggtaacggatgcggcctgttcggaaaaggttcattagtgacatgtgcgaaatttcaatgtcttgaacctattgaggggaaagtagtacaatatgaaaatttaaaatacacagtaataattacagttcacaccggagatcaacatcaagttggtaacgaaacacaaggggtaacagctgaaattacaccacaagctagcacaactgaagcaatactacctgagtatggtaccctcggtttggagtgcagccctaggactggattagattttaatgagatgatactgttgaccatgaaaaacaaagcatggatggttcataggcaatggttctttgatttaccactaccgtggaccagcggcgctactacggaaacgcccacctggaatcgtaaagagcttttagttacatttaaaaacgcccatgcgaagaaacaagaagtagtcgtactaggtagtcaagaaggagcgatgcataccgcgctaacaggagcaacagagatacaaaactctggtggtacaagtatctttgcaggccatcttaaatgtagattaaaaatggataaattggaattaaaaggaatgtcatacgccatgtgtacgaatacgtttgtactgaagaaagaggtatcggagacacaacatggaactattctaattaaagtagagtacaaaggggaagacgtaccatgtaaaatacctttctccactgaagatggtcaaggaaaagcacacaatggacgccttataaccgcgaaccctgttgtaacgaagaaagaagaacccgtcaacatcgaggcagaaccaccatttggagaatctaatatcgtcattggaataggtgacaacgctctaaaaatcaattggtacaagaagggaagtagcatagggaagatgttcgaagcaactgcccgaggagcacgtaggatggccatattgggagatacggcgtgggatttcggaagtgtcggaggagttttaaactcactgggcaaaatggtacaccagatttttggcagtgcgtataccgctctattttcgggggtgagctgggtaatgaaaattggaataggtgtcttactaacgtggatcggactaaattcaaagaatacttccatgtcgttttcctgcatagcaatcggaattattacactctatctgggggcggtcgtccaagccgacatgggttgcgtaatcaactggaaaggaaaagaattaaaatgtggcagcggaatatttgtaaccaatgaagtacatacttggactgaacaatataaattccaagcagactcaccaaagcgactagcaacagccatagccggtgcttgggaaaatggagtatgtggcattcgctctacaacaaggatggaaaatttattatggaagcaaatcgctaatgaactcaactatattctatgggaaaataatataaaactaactgtagtcgtaggcgatataattggcgtattagaacaagggaaaaggacgctaacaccccaacctatggaactaaaatacagctggaaaacgtggggtaaagcaaaaatagttactgccgaaacacaaaattctagtttcataatagatgggcctaatacccctgaatgcccctcagtaagtcgagcttggaatgtttgggaagttgaagattatgggtttggagtttttacgactaacatttggttgaaattaagagaagtatatacacaactatgtgaccacaggcttatgagcgcagcagtaaaagatgaaagggcagtacacgctgatatgggctactggatagaaagtcagaaaaatggaagttggaagctagagaaggcatccctcatagaagtaaaaacttgtacgtggccaaaatcccataccctgtggtcaaatggtgtacttgaatccgacatgattatacctaaatccttagcaggaccaatctcacaacacaatcaccggcccgggtaccacactcaaaccgccggcccttggcatttaggaaaattagagctcgattttaattactgcgaaggcacgaccgtcgtaattacggaaaactgcggtacacgaggaccaagtctcagaacgacaacagtatcaggaaaattgatccatgaatggtgttgtagaagctgcactttaccaccactgagatacatgggtgaagatggctgttggtatggtatggagatccgtccaatatcagaaaaagaggaaaatatggttaaatcccttgtctctgcaggtagtggtaaggtagataattttactatgggtgtactttgtttagccatattattcgaagaggtgatgaggggtaaatttggaaagaaacatatgatagcaggcgtattctttacctttgtactccttctatctggacaaatcacttggagagacatggcccacacactaattatgataggctcgaatgcttcagaccgaatgggtatgggagtaacctatcttgcgttaattgctactttcaaaatacaaccgtttcttgtactaggtttctttctgcggaaactgacctcacgggaaaacctcttattgggagtgggattagcaatggctaccacactgcagctaccggaagatatagaacaaatggcgaatggaatcgcacttggcttgatggctttgaaattgataacacaatttgaaacgtatcaattgtggactgctttaatttcccttacttgtagtaacacaatatttacattaacggtagcatggcggacggccaccttaatattagcaggggtatctctattacccgtctgtcaatcaagttccatgcgaaaaacggattggttgcctatggctgtcgctgcgatgggtgttccacccctaccattatttatcttttcacttaaagacacattaaaaaggagaagttggcctctaaatgaaggtgtgatggccgttggattagtaagcatacttgcatcttcgttactccgtaacgacgtcccaatggctggaccattagtagcagggggactacttattgcctgctatgtaattactggaacatcagcagacctgactgtagaaaaagcagcagacataacgtgggaagaagaagcggaacaaactggagtatctcacaatctcatgataacggtggatgacgatgggactatgcggataaaagatgatgaaaccgaaaacatcctgactgtgttattaaaaactgctctactaattgtatcaggcatctttccttacagtataccagcaaccctcttagtgtggcacacatggcaaaaacagactcagcgttccggggtactctgggatgtcccgtcgccaccagaaactcagaaagcggagcttgaagaaggagtttatagaataaagcaacaaggaatttttggcaaaacacaggttggagtgggagtccaaaaggaaggggtctttcacacgatgtggcatgtaacaagaggtgcggtactaacttacaatggaaaaagactagaaccaaactgggctagtgtgaagaaagacttaataagctacggtggcggttggagactgagtgcgcaatggcaaaagggggaagaagtacaggtaattgctgtcgaaccaggaaagaatcccaagaactttcaaacaatgcccggaacatttcaaaccacaactggagaaatcggcgccatagccctggattttaaaccgggtacaagtggatcacccataatcaacagagaaggtaaagtcgtagggttatacgggaatggcgtggtgacgaaaaatggtggttacgtttcaggtatagctcaaaccaacgcagagcctgacggtccaacacctgagctcgaagaagaaatgttcaaaaagagaaacctgacaattatggaccttcatcccggctcgggtaaaactcgaaaatatctccccgcaatagtacgtgaagctataaagaggcggctacgaactttaattttagcccctactcgcgttgtagccgcagagatggaagaggcactgaaaggtctacctataagatatcagacgacagcaactaaatcagagcatacaggtcgagagatcgtcgacttaatgtgtcacgctacatttactatgcgattgttatcgcctgtgcgcgtccccaattataatctaatcataatggatgaagctcatttcacggacccagccagcatagctgcgcgaggatacatatcaacaagagtagggatgggagaagccgcggcaatcttcatgaccgctacacccccaggtacagcagatgccttcccacagtcaaacgcaccaatccaagacgaagaaagagatattccagagcgatcatggaactcaggaaatgaatggatcactgatttcgctgggaaaactgtttggttcgtaccttcaatcaaagcaggtaatgatatagctaactgtctaaggaaaaatggtaagaaagtcatacagttaagccgtaaaacattcgatactgaataccagaaaactaagctgaatgattgggacttcgttgtcaccactgatatttcggaaatgggcgcaaactttaaagctgatagggtaatagacccacgaagatgtctcaaaccagtaatattgacagacggacctgaacgtgtgatattagcaggtccaatgccagtcaccgctgcgagcgccgctcaacggcgaggacgcgtaggcaggaatccacaaaaagaaaacgaccaatacattttcacaggacaaccgttaaataacgatgaagaccatgcacactggacagaagctaaaatgctattagataacattaataccccggaagggattattccagctctattcgaaccagaaagggaaaaatcagcagcgattgacggagaatatagattgaagggagaaagccgaaaaacatttgttgaattaatgcgaagaggggacctgccggtttggcttgcacataaagtagcatcggagggaatcaaatacacggatcgcaaatggtgttttgacggacagcgcaataaccaaatcctggaggaaaacatggatgtagaaatatggactaaagagggcgaaaagaagaaactacgcccccgttggctcgatgctagaacgtacagcgatccattggcattaaaagaatttaaagagtttgccgccggtaggaagagtatcgcgttggatcttgtcaccgaaataggaagggtaccaagtcacctagctcatagaacgagaaatgctcttgacaacttagttatgctacacacaagcgaacacggaggcagagcgtacaggcatgccgtagaagaattaccggaaaccatggaaacactattgcttctaggtttgatgattctcctgacaggtggtgcaatgctattcctcatatcaggaaaaggaattggaaaaacctcaataggtttaatctgtgtaatagcatcgtcaggaatgttatggatggcggagattccgctacaatggatagccagcgcgatagtactagaatttttcatgatggtattattaataccggagcctgagaaacagaggacaccccaggacaatcaattagcatacgtagtaatagggattttaactctagcagcaattatcgctgctaacgagatgggtctgctagagactaccaagagagatctcggcatgtcaaaagagcctggagtcgtatctccgacttcatatcttgacgtagacttacatcctgcatccgcgtggacgctttatgctgtagccacgacggtaattacaccaatgctaagacatacgattgagaacagcaccgcaaacgtatcacttgcagcaatagcaaaccaagcggttgtactaatgggactagataaagggtggcccataagtaagatggatcttggtgttccccttttagcattaggatgttattcacaagttaatccacttactcttacggctgctgttctactcctaataactcattatgctatcataggcccaggcttacaagccaaagctacacgagaagcccaaaagagaacggcggccggtataatgaaaaacccaacagtcgacggaataatgactatagacttagatcctgtaatttacgactcaaaatttgaaaaacaattaggacaagttatgctacttgtactttgcgcagtacaactgttacttatgagaacgagctgggcactatgcgaagcacttactttggcaacgggtccgataacgacattatgggagggttcgccgggtaaattttggaacaccactattgcggtatcaatggctaacatatttcgtggatcctacttggccggagcaggcctagctttcagcataatgaaaagtgtgggcactggcaaacgaggaactgggagtcagggcgagacattaggagaaaaatggaagaagaaactaaatcaactttccagaaaggatttcgatctatataaaaagagtggtattacagaggtagatagaacagaggcgaaagaaggactgaagcgaggagagataacacaccatgcagttagtaggggaagtgcaaagctacaatggtttgttgagcgaaatatggtaataccggaaggaagagtaattgacctcggatgcggtcgtggtggatggtcttattactgtgcgggattaaagaaagtaacagaggtcagaggttacacaaaagggggtccaggtcatgaggaacctgtaccaatgagtacatacggatggaatatagtgaaactaatgagtggaaaagatgtattctaccttccaccagaaaagtgcgacacattgttatgcgatatcggggaatcctctccttccccaaccgttgaagaaagccgcactattcgcgtccttaaaatggtagaaccctggttgaaaaataatcagttctgcattaaagtcctaaatccatatatgccaacagtaatagaacatttagaaagactccagaggaaacacggaggaatgttggtaagaaaccctctatcaagaaattctacccatgaaatgtattggataagtaatggaacagggaacatagtcgcttctgttaatatggtaagcaggcttttgcttaaccggtttacaatgacacaccgaagaccaaccatagagaaagatgtagaccttggtgcaggtacacgtcatgtaaacgcagaacctgaaacaccaaatatggacgtaatcggagaaagaattaaacggataaaagaagaacataattcgacatggcattacgacgatgaaaatccgtataaaacgtgggcatatcacggttcctacgaggtaaaagcgactggaagtgcttctagcatgatcaatggagttgttaaacttctaaccaagccatgggatgttgttccaatggtaacccaaatggcgatgactgacacaacgccattcgggcaacaacgagtattcaaggaaaaggttgacacaaggacaccccgttcgatgccaggtacgagacgcgttatgggaatcactgcagagtggttatggcgtacattgggaagaaataagaaaccacgattatgtaccagagaagaatttaccaagaaagtacgaaccaatgcagcaatgggggcagtgttcactgaagaaaaccaatgggattcagcaaaagccgctgtagaggatgaggatttttggaagctagtggacagggaaagagaattgcataaattgggaaaatgtggtagttgtgtgtataatatgatgggtaaacgagagaagaaattaggagagttcggaaaagctaaaggatcaagggcgatctggtacatgtggctaggcgctcgatatttggagttcgaggctttaggtttcctaaatgaagatcattggttctcgagggaaaactcatatagcggtgtagaaggagagggtctccataaattgggctacatattaagagacattagtaagattcctggcggagcaatgtatgctgatgacactgcagggtgggacacaaggataacagaagacgatctacacaatgaagagaaaataacacaacaaatggatccagaacacaggcagcttgcaaacgccatttttaaactaacctatcaaaacaaggtcgtaaaagtccaaaggccaaccccaacaggaacggttatggatattatatcaagaaaagaccaaagaggtagtggccaagtagggacatatggactcaatacttttacgaacatggaggcccagttaatcagacagatggagggagaaggagtgttatcgaaggctgatttagagaacccgcatttgcccgaaaagaaaattacccaatggttagaaacaaaaggggtggaacgtcttaaaagaatggcaattagtggggatgactgtgtggtaaaaccaattgatgatcgatttgcaaacgctttacttgcactcaacgacatgggtaaagtacgaaaagatataccacaatggcaaccaagcaaaggatggcacgattggcaacaagttcctttctgctcacaccatttccacgaattaattatgaaggacggtcggaaattagtcgtaccatgcagaccgcaggatgaactgataggacgtgcgagaataagtcagggcgcagggtggtcacttaaagaaactgcatgtttaggaaaggcgtatgcacaaatgtggagtttgatgtactttcaccgacgtgacttaagactggcatcaaatgccatttgtagtgctgtccccgttcactgggtaccaacatctagaactacatggtccattcatgcacaccatcaatggatgacgacggaagatatgctcacagtatggaaccgagtctggatcgaagataatccctggatggaagacaaaaccccagtgaccacctgggggaatgtcccttatctgggaaagagagaagatcaatggtgtgggagtctcattggcctaacaagtagagctacctgggcacaaaatatccctacagcaatccaacaagtcaggagtcttatcggtaatgaagaatttttagactatatgccgtcaatgaagaggttcagaaaagaagaggaaagtgaaggtgctatctggtaa

SEQ ID NO: 23188 - RNA, 9873 nt, synthetic construct
  misc_feature 1..9873: note = derived and/or modified CDS sequence (opt6) from DENV-3__HM631857__SS-prME
  source 1..9873: mol_type = other RNA
acgtcactatgcttaatgatgatattgcctgcggcactagcttttcacttaaccagtagggatggcgaacccagaatgatagttggcaaaaacgaaagaggaaaatcactgctattcaaaacagcttccggaattaatatgtgtactttaatagcgatggatctaggggaaatgtgtgatgatacagtaacatataaatgcccgcacataaccgaagtagaaccggaagacatagattgttggtgtaatctaacatcaacatgggtaacatacggcacatgtaatcaagctggagaacaccggagagataaacggagtgttgcattagcacctcatgtaggtatgggtctagatacccgcactcaaacatggatgagtgccgaaggtgcatggagacaagtggaaaaagtagaaacttgggcacttagacaccctggatttactatcttggcattatttctagcgcactacataggcacgagcttaacccaaaaagtagtgatatttattttgcttatgttagttaccccaagcatgactatgagatgtgtaggggtaggaaacagagacttcgtggagggtttatcaggtgctacatgggtcgatgttgtattagaacatggaggctgtgtaactactatggcgaaaaataaacccacactagacatagaattgcagaaaaccgaagcaactcaattggcaaccctacgaaaattatgcatagaaggaaaaatcactaatataacaacagactcacgatgtccaacacaaggtgaagcgacactgccggaagaacaagaccaaaactatgtttgtaaacatacatacgtagacagaggatggggcaacggttgtggcttattcggaaaaggcagtctcgtaacttgtgcaaaatttcaatgtctggaacccatcgaaggcaaagttgtgcaatatgagaatttaaaatatacagtaataatcacagtacacacaggtgaccaacaccaagtaggaaatgaaacgcaaggggttacagcggaaattactccacaagccagcacgacagaggctatcctaccagaatacggcacacttggactggagtgcagcccacgcacgggactcgatttcaatgaaatgatacttttgaccatgaaaaacaaagcatggatggtgcatcgacaatggttctttgatttaccattaccctggacgagtggtgcaacaactgagacacctacgtggaataggaaagaactattggtaacatttaaaaatgcacacgctaagaaacaagaggtcgtggtattaggaagtcaagaaggggcaatgcataccgctctaactggagccacggaaatacaaaatagtggaggaacttctatatttgcaggacatttaaaatgtcgactaaaaatggataagctagaattaaaaggtatgtcatatgctatgtgcacgaacacttttgttttaaagaaagaagtctccgaaacacaacacggaaccatactaataaaagtggaatacaagggagaagatgttccttgcaagattcctttttcaacagaagacggtcagggcaaggctcacaacggccggctcataacagccaacccagtagtcacgaaaaaggaggagcccgtgaacatagaagctgaaccaccattcggagaatccaacattgtcataggaatcggcgataacgctcttaagattaattggtacaagaaaggatccagtattggtaaaatgtttgaagcaaccgcgagaggtgctagaagaatggccattcttggggatacagcgtgggatttcggaagtgtcggtggtgtattaaactcactaggaaaaatggtacaccagatctttggcagcgcttataccgcattattctcaggagtatcttgggttatgaaaataggcatcggagtattacttacttggataggtcttaatagtaaaaataccagtatgagcttcagttgcatagcaataggaataataactctataccttggcgcagtggttcaggcagatatgggttgcgtcataaattggaaaggaaaagaattaaaatgcgggtcaggaatcttcgtcaccaatgaagtacacacgtggacagaacaatataagttccaagctgattcacctaagcgactagcaacagctattgctggagcctgggaaaatggagtatgtggaatccgtagcacgacgcgcatggagaatttactatggaaacagatagcgaatgaattaaattatatactttgggagaataatataaaactgacagttgttgtaggagacatcataggtgtcttggagcagggaaaaagaacattgactccccaacctatggaactcaaatatagttggaagacctgggggaaagccaagatagtaacagctgaaacacaaaattcttcttttatcattgacggtcctaataccccagagtgcccaagcgtatctcgagcgtggaatgtttgggaagttgaagactacgggtttggagtgttcacaacaaacatatggttaaaacttcgagaagtttacactcaactttgcgaccaccgcctcatgtccgcagcagtgaaagacgaaagagctgttcacgcagacatgggatactggatagagagtcagaaaaatggaagctggaaactcgaaaaggcatcacttatagaggtcaagacttgtacatggccaaaatctcatacactctggagtaacggagtactagaatcagatatgattattcctaaatccttagcaggtcccatctcccaacataatcacagacctggatatcatacccaaacggccggtccctggcatttaggtaaattagaacttgacttcaattattgcgaaggtactacagtagttatcacggaaaattgcggaacaagaggcccatctttaagaacgactactgtttcgggaaaattgatccatgaatggtgttgtagatcatgtacactacctcccctcagatacatgggggaagatggatgctggtacggcatggagataagaccaatctctgaaaaagaggaaaatatggtcaaatcattagtaagcgcgggttcaggaaaggtcgataatttcaccatgggtgtgctatgcctggcgatcttattcgaggaagtcatgcgtggtaaattcggaaagaagcatatgatagctggagtattctttacatttgttctcttactctcgggtcaaataacctggcgagatacagcacacacactaatcatgatagggtcaaatgcatcagatagaatgggcatgggcgtaacatacctagcattgatagcgactttcaaaatccaaccctttttggcattagggttctttctgagaaaattgacatctagagagaatttattattaggcgtaggattggcgatggcaaccaccctccaactgcccgaggatatagagcaaatggctaatggtatcgcattaggccttatggctttgaaattgataacccaattcgaaacatatcaactatggacagcgctaattagtttgacatgttcaaacacaatatttacgttaacggtggcatggcgtacagccactctaatcctcgcaggcgtttctttactaccagtctgccaaagtagttctatgagaaaaaccgattggcttccaatggcagttgctgcgatgggggtacctccattaccgctttttatttttgggttgaaagacacactcaaaagacgatcctggcccctgaacgaaggtgtgatggcagttggattagtatccatactagcaagtagtctattaagaaacgacgtcccaatggctggacctctagtagccggtggccttttaatagcatgttatgtgataacaggtaccagcgctgaccttacagttgaaaaagccgctgatattacatgggaggaagaggctgaacaaacgggagtaagccacaatttgatgataaccgttgatgatgatggaacaatgcgcataaaagatgatgaaacagaaaacatattgacagtattactaaaaacagctttgctaattgtatcgggaatcttcccatactctatcccagccaccttgctggtttggcacacctggcaaaaacaaacccaaagaagcggcgtactctgggacgtaccgtcccctcctgaaacccaaaaagcagaactagaagaaggagtttatcgaatcaaacaacaaggtatcttcggcaagacccaagttggcgtcggagttcaaaaagaaggtgtatttcatactatgtggcatgtaacgagaggggcggttttgacctataatggaaaacggctcgaaccaaactgggcatcagtgaagaaagatctaatatcatacggaggtggatggagacttagtgcccagtggcaaaaaggtgaagaagtacaagtaatcgctgtagaacctggtaaaaacccaaagaactttcagaccatgccaggcacattccaaaccacgactggagaaattggagccattgcattagactttaagccaggaaccagcggatccccaataatcaatagagagggtaaagttgtcggattgtatggaaacggtgttgtcaccaaaaatggaggttatgtatccggcattgcgcaaactaacgctgaacccgatggaccgacaccggagttagaggaagaaatgttcaagaaaaggaatctaacaataatggatctacatccaggttcaggaaaaaccagaaaatatcttccagcaatagttcgggaagctataaaaaggagacttagaacactgatattggctccaactagagtcgtggctgccgaaatggaagaagcacttaaaggtttaccaatacgatatcaaactacagctaccaaaagtgaacatacaggacgagaaatcgcagatttgatgtgtcatgctacgtttactatgcgcttgctatcgccggttcgtgtgccaaactacaaccttataataatggatgaagctcatttcacggacccggcctcgattgcagcacgaggttacattagtacgcgagttggaatgggagaagcagctgctatatttatgacagctaccccacctggtacagctgatgcatttccccaatcgaacgcgccaatccaggatgaggaaagagacatacccgaacggtcctggaactcaggcaatgagtggataacagactttgctggtaaaactgtatggttcgtgccaagtattaaagcaggaaatgacattgccaactgcctccgtaaaaatggtaaaaaggtcatacaactatctagaaaaactttcgacacagaatatcagaaaacaaagttaaatgactgggacttcgttgttacgactgatatatctgaaatgggcgcaaatttcaaagctgacagagttattgaccctcgtagatgcctaaaacccgttatccttactgatggaccagaaagggtaatactagctggcccaatgcctgtgacagcagcaagtgcggcacagcgtcgggggagagtcggacgaaacccacaaaaagagaacgatcaatacatatttaccgggcagccacttaataacgacgaggatcacgcacactggaccgaggccaaaatgctactggataatatcaacactccagaaggaataatacctgcactattcgaacccgaaagagagaagagtgccgcaattgacggggaataccggttaaagggggaatcccgaaagactttcgtggaattaatgcgtagaggagatctcccggtatggctagcgcataaagtagccagtgaaggcattaaatatacggatagaaaatggtgttttgatggtcagcgtaacaaccaaatcctcgaagaaaatatggacgtcgagatatggacaaaagaaggtgaaaagaagaaattgcgccctagatggctagacgcaagaacgtatagtgacccgcttgcccttaaggaatttaaggagttcgccgctggcagaaaaagtattgctcttgatcttgtaactgaaataggcagagttccgtcgcacctcgcccacagaactcgaaatgcactagacaatttagtgatgctgcatacatctgaacacggaggtagagcgtaccgacatgcagtggaagaattacccgagactatggaaactctattattacttggacttatgatattgttaacaggaggagcaatgttatttttaatatcaggaaagggtatcggtaaaacttcaataggcttaatatgcgtaatcgcttcttcgggcatgttatggatggcggagatccctctccaatggatcgctagtgccattgtacttgagttctttatgatggtactcctaatcccagagccggaaaaacaacgaacgccgcaggataaccaattagcatatgttgttattggtatactgacattagctgcagtaatcgctgcaaacgaaatggggctacttgaaactacaaaacgagacctaggaatgtctaaagaacctggagttgtctcacctactagctatttggatgtcgacttacatccggcgtccgcatggactttatatgcagttgcaacaactgtaattactccaatgctgagacatacgatagaaaatagtaccgctaatgtgagtctggcagcaattgccaaccaagcagttgtgttaatgggtcttgataaagggtggcctataagtaaaatggatttaggcgtgccactccttgcactaggatgttattctcaggttaatccactaaccttaacggcagcagtactgctcttaataacccattatgctattataggcccgggtctacaggcaaaagcgacacgagaggctcagaagaggactgcagcaggtataatgaaaaatcctactgtagatggcatcatgacaatagaccttgatccggtcatttacgacagcaaatttgaaaaacaactaggacaggtaatgctattagttctctgcgcagtacagttattactaatgcggacctcttgggctttatgcgaagcattaaccctagcaacaggcccgattacaacactctgggaaggctcaccgggaaaattttggaacaccacaatagcagtgtcaatggccaatatttttagagggtcttatctcgcgggagcggggctcgcattctctataatgaaaagcgttggtaccggtaaaagaggcactggatctcagggggagacactcggtgaaaaatggaaaaagaaactaaaccaattatctagaaaggattttgacctctataagaaatcaggaataactgaagtagatagaaccgaggcaaaagagggattgaaaagaggcgagattacacaccacgccgtttcacgaggctcagcaaaattgcaatggttcgttgaacgaaacatggtgatacctgaaggaagagttatagacctagggtgtgggagagggggttggtcatattactgcgccggactaaagaaagtaacagaagtaagaggctataccaaagggggacccgggcacgaagaaccggtcccaatgtcaacatacggttggaatattgttaaattaatgtcaggaaaggatgtattctacttaccaccagaaaaatgtgataccttattatgcgatattggtgaaagtagcccgtcgcctacagtagaggaatcgaggacaattcgagtactaaaaatggtagaaccttggctcaaaaacaatcaattttgtattaaggtcttaaatccatacatgcctacagtcattgaacatctcgaacggctacaaagaaaacatggagggatgcttgtgaggaatcctctatcgcgtaatagcacacatgaaatgtattggatttccaatggaactggaaatatagtggcctcagttaatatggtttctcgattattattgaacaggttcacaatgacgcaccgcagacccaccatcgaaaaagatgtagatctaggcgcaggtacacgacatgtcaatgtggaaccagaaactcccaacatggacgtaataggtgaaaggataaaacggattaaggaagaacataatagtacatggcactacgatgatgaaaacccatacaaaacttgggcatatcatggaagctacgaagtcaaagcaacgggttctgcaagctcaatgataaatggagttgttaagctcttaactaaaccatgggacgtcgttccgatggtgacacagatggctatgacagataccacgcccttcggccagcaacgcgtattcaaagagaaggtcgatacacgcactccacgaagtatgcccggcactagacgagtcatgggaattactgctgagtggttatggcgaacattaggaagaaataagaaaccaagactatgcactagggaagaatttaccaagaaagttcgcacaaacgctgccatgggtgctgtctttacggaagaaaaccaatgggacagcgcgaaggcggcagttgaagacgaggacttttggaagttagttgatcgagagcgcgaacttcataagctggggaagtgtgggtcgtgcgtttataacatgatgggaaagagagagaagaaattaggtgagttcgggaaagccaaaggaagcagagccatttggtacatgtggctaggcgcacgttacttagaatttgaggccctaggattcttaaatgaagatcactggtttagtagagaaaatagttatagcggcgttgaaggtgaaggtctacacaaacttggatatattctcagggatatatcaaagatacctggtggagcaatgtacgcggacgatacagcaggttgggacactcgaataaccgaggatgacctgcacaacgaagagaagataacacaacaaatggaccctgaacatagacaactagctaatgcaatatttaagttaacctatcaaaacaaagtagtcaaagtacaaagaccaactcctaccggcacagttatggatataatatcaagaaaagatcaaagaggaagcgggcaagtcggaacatacggattgaatacattcacgaatatggaagctcaacttataagacagatggagggagaaggtgtattatctaaagcagatttagagaacccacacctaccagaaaagaaaataacacaatggcttgagacgaaaggtgttgaaaggctaaaaagaatggctattagtggagatgactgtgttgtcaaacctatcgacgaccgttttgcaaatgctctcctggcgcttaatgacatggggaaggtaagaaaagacatcccacaatggcagccctccaagggatggcatgactggcaacaagtaccattctgtagccaccacttccatgaattaataatgaaggatggtagaaaactcgtagtaccatgccgacctcaagatgaacttatagggagagcaagaatctcccagggagcaggatggagtctcaaagaaacagcatgtctagggaaagcctatgcacaaatgtggagtcttatgtattttcatagaagagatctgcgattggcgagtaatgctatatgcagtgcagttccagtgcactgggtaccaacatcacgaacgacttggagcattcatgcgcatcatcagtggatgacaacggaagacatgttgactgtttggaaccgagtatggattgaggataatccttggatggaggacaaaactccggtgacaacgtgggaaaatgtcccatatttaggtaaacgagaagatcaatggtgtggtagtctcataggccttacctcaagagccacttgggcgcaaaatatacccacagcaatccaacaagtcagatctttaatcggaaacgaagaatttttggactatatgcctagcatgaagcggtttagaaaagaggaagagagtgaaggagcgatttggtga

SEQ ID NO: 23189 - RNA, 9873 nt, synthetic construct
  misc_feature 1..9873: note = derived and/or modified CDS sequence (opt6) from DENV-3__HM631860__SS-prME
  source 1..9873: mol_type = other RNA
acttctctatgtttgatgatgatattaccggcggctcttgcttttcacctcacatcaagagatggggaaccacgaatgatcgtaggtaaaaacgaaagaggaaaatctttgctttttaaaaccgctagtggaataaatatgtgcacactcatagctatggacctaggagagatgtgtgatgacacagtcacatataaatgtccacacattacggaggtagaacccgaggatattgattgttggtgtaatctcaccagtacgtgggtgacatacgggacctgcaatcaagcaggggaacaccgaagagacaaaagaagcgttgcgcttgcaccccacgtaggaatgggcttagacaccagaactcaaacatggatgagtgcagagggagcatggagacaagtagagaaagtggaaacatgggcattaaggcacccaggctttacaattctggctttatttcttgcccactatattggtacgtctctgacacaaaaagtggttatttttatacttctaatgcttgtaacaccaagcatgaccatgagatgtgtcggtgttggtaatagggattttgtggaaggactaagtggggcaacctgggtagacgttgttcttgaacatggaggttgcgttacaacgatggccaaaaacaaacctacgctggatattgaactacagaaaacagaggcaacgcaattagctaccttacgaaaactatgtatcgaaggaaaaataactaatatcacaaccgacagtcgatgcccaacccaaggcgaagctactctgccggaagaacaagaccaaaattatgtatgtaaacatacttatgttgatcgtggttggggtaacggatgtggattattcggaaaaggatctttagtcacatgcgcaaaatttcaatgtcttgagcccatagaaggaaaagtagtccaatacgaaaatctaaaatatacggttattataactgtacatacaggagaccaacatcaagtcgggaatgaaacacaaggagttacagctgaaataacaccacaggcttcaactacggaagcaattttaccagaatatggtacactcggtttagagtgtagcccacgcacaggtcttgattttaacgagatgatcctcctaacaatgaaaaataaagcatggatggtacatcgacaatggttcttcgatcttccactcccttggacctcgggagctactacagaaactccaacatggaacagaaaagagctattagtcacattcaaaaatgcacatgccaagaaacaagaagtagtcgttctggggagccaagaaggtgctatgcacacagcactgactggcgctacagagatacaaaacagtggaggcacatcaattttcgcaggtcatttaaaatgcaggttaaaaatggataaattagaattaaagggaatgtcatacgcaatgtgtacaaatacctttgtactcaagaaagaagttagtgagacgcaacatggaacaatcttgataaaggtagaatacaaaggtgaagacgtaccatgtaaaataccattctcaacagaggatggccaaggtaaagcacataatggaagactaattacagctaatccagttgttactaagaaagaagaaccagtcaacatagaagcagaacctccattcggagaatcaaacattgtaattgggattggagataacgctcttaaaatcaattggtacaagaaaggatctagcatcggaaagatgttcgaagctaccgccaggggtgctcgcagaatggcaatcttaggcgatacagcatgggactttggatctgtagggggagtactaaattcattaggaaagatggttcaccaaatattcggaagtgcttacacagctttattttcaggtgtctcctgggttatgaaaattggtattggagtgctgctaacatggataggtttaaactccaagaacacaagcatgtcattttcctgcatcgcaatcggcataattaccctgtatctaggcgctgttgtacaagctgatatgggatgtgtggtgaactggaaaggaaaagaactaaaatgtggttctggaattttcgtgacgaacgaggtacacacttggaccgaacagtataaattccaggcagacagcccaaaacgattggcaaccgcaattgctggagcgtgggaaaacggagtgtgcggaataagatcaactacgagaatggaaaatctactctggaaacaaattgcgaatgaacttaattatatattatgggaaaataatattaaattaaccgtcgtggtcggtgatataattggagtcctagaacaaggaaaacgaacactaacaccacaaccaaaagaattgaaatattcttggaagacatggggtaaagcaaagattgttacagctgagacacaaaacagttccttcataatcgacggccccaacacacctgaatgccccagtgtcagtagggcgtggaatgtatgggaggttgaagactatggatttggtgtatttacaaccaatatttggttaaagctaagagaagtatacacccaattatgcgaccaccgcttgatgtccgctgcagttaaagatgagagagcggtgcatgcggacatgggctactggatagagtcgcagaaaaacggaagttggaaactagaaaaagcaagcctcattgaagttaaaacgtgtacatggccaaagagccacacattgtggagtaatggcgttctagagagcgatatgattattcctaaaagccttgcaggtccaattagtcaacataaccacagacctggctaccacactcaaaccgctgggccctggcatctgggcaaattagaattagacttcaactactgtgaaggaacaactgttgtcatcaccgaaaattgtggaacgagaggaccaagtctcagaacaacaacggtctcggggaaacttatccatgaatggtgttgtagatcgtgtacattaccaccccttcgctatatgggagaagatggctgctggtatggcatggaaataagaccgatatcagaaaaagaggagaacatggtaaaatcattagtaagtgctggttccggaaaagtagataacttcacaatgggagtactttgtctcgcaatcttatttgaagaagttatgcgtggaaaatttggaaagaaacatatgatagcaggcgttttcttcacctttgtccttttattatccggccaaattacttggcgcgatatggcacatactttaataatgatcgggagcaatgcatcagaccgcatgggaatgggcgtgacttacctagcgttaatagcaacgttcaaaattcaaccatttttagcccttggattcttcctcagaaaattaacttcaagagaaaacttactattgggagtaggcttagcaatggccaccactttgcaacttccagaggatatcgaacaaatggcaaacggaatagctcttggcttaatggcattaaaacttatcactcagttcgaaacctatcagttatggaccgcgttgatttcgttaacatgttccaatacctacttcacattaacagtagcctggagaacagcaacactaattctagcgggtgttagcctattacccgtatgccaatcatcatctatgagaaaaactgattggctcccaatggccgttgcagccatgggcgtacctccccttccattgtttatcttttcactcaaagatacccttaagcggagaagttggccactaaacgaaggggtgatggctgtaggcttagttagcatattggcctcaagcctacttcgtaacgacgttccgatggccggaccgttggtagcagggggtttactaattgcatgctacgtaataacagggacatcagctgatctaacagttgaaaaagccgccgacataacttgggaagaggaggccgaacaaacaggcgtctctcataacctaatgataaccgtagatgacgacggcaccatgaggataaaagacgatgaaactgaaaatatattaactgtccttttgaaaactgcgctactgattgtgtcaggtatttttccatactctatccccgcaactctattagtttggcacacatggcaaaaacaaacacagaggagtggtgtattatgggatgtaccgagccctcccgaaacccaaaaagctgaattagaagaaggtgtatatcgaataaagcaacaaggtatatttggaaagacacaagtaggggtaggggtgcaaaaagagggggtatttcatacaatgtggcacgttacaagaggggctgtactaacatataatggtaagaggttggaacctaactgggctagtgtgaagaaagatttaattagttacgggggagggtggagattatccgcccaatggcagaaaggtgaagaagttcaagttatcgcggtcgaaccgggtaaaaatcccaaaaatttccaaacaatgcctggaacatttcagacaacaacaggagagatcggagcaatcgctctggactttaaacccggtacatcaggatctccgattataaatagagaaggtaaagtggtaggattatacggaaatggtgtagtaaccaaaaacggtggttacgtatccggaattgcccaaactaacgctgaaccagacggaccgacacctgaattagaagaagaaatgtttaagaaacgaaatttaacaattatggacttacaccccggctctggtaaaaccagaaaatatctcccagccatcgttagagaagcaattaaacgcaggcttagaaccctgatcttggcacccacgcgggtcgtcgcggcagaaatggaagaagctctgaaggggcttcctatcagataccaaactaccgccaccaaatcagaacataccggcagagaaatagtcgatttaatgtgtcacgctacctttactatgcgtttgttatcgcccgtaagagtgcctaattataacctaattatcatggatgaggcgcactttactgacccggcgtctatcgctgctaggggctacatatcgacgcgcgtaggaatgggcgaagcagccgccatatttatgactgcgactcccccaggaactgcagatgccttcccacaaagtaacgcacctattcaggatgaggaacgtgacatacccgaaaggtcttggaacagtggaaatgaatggattactgattttgctggcaaaacagtatggtttgtcccatctatcaaagcaggaaacgatattgcgaattgtctacgaaagaatggcaaaaaggtaatacaattaagtagaaaaacatttgatacagaatatcagaaaacgaaactaaatgactgggatttcgttgtaacaacggatatatcagaaatgggtgcaaactttaaggccgacagggtaatagatcctcgtaggtgcttaaaaccagtgattttaactgacggacctgagagagtcatactcgcagggccaatgccagtgacggcagcatcggctgctcaaagaagaggaagggtaggccggaatcctcaaaaagaaaatgatcagtacatatttaccggacaacccttaaataatgacgaggatcatgctcattggacagaagctaaaatgttattagacaacattaatacacctgagggtataataccagcactctttgaacccgaaagagagaaaagtgcagcgattgatggagaatatagattgaaaggggaatcgcgcaaaactttcgttgagctgatgcgacgaggtgatttacccgtttggttagcacacaaagtggcgtcagaaggtataaaatatacggatagaaaatggtgcttcgatggacaaagaaataatcaaattttagaagaaaatatggacgtagagatttggaccaaagaaggggagaagaagaaactacgcccacgttggcttgacgcaagaacgtactcggatcctctagctctaaaagaatttaaagaatttgccgctgggagaaaaagtatcgcattagatctagttacagagataggacgggtgcctagtcatcttgctcatcggacgcgcaacgctctagacaatttagtaatgcttcacaccagtgaacacggaggcagagcatataggcacgcagttgaggaactcccggagacaatggaaacactactattacttggcttaatgatattgttaactggaggtgctatgctattcttgattagcggaaaggggataggtaaaacatccataggtcttatctgcgtgattgctagttctggaatgctctggatggctgagatacccctccaatggatcgcgtcagcgattgtactggagttctttatgatggtgttattaatcccagagcccgaaaaacaacgaacgcctcaagataaccaattagcctatgtcgtaattggaatactcaccctagccgccataattgctgcaaatgaaatgggtctattagaaaccacaaaaagagatttgggtatgagcaaagaaccaggagttgttagccctaccagttatttagacgtcgatctacatccagcgtcagcgtggacactctatgctgtagcaactacggttataacaccaatgttacgacacactatagagaatagtacggcaaatgtatctctagcagcaatagcaaatcaagctgtggtattaatgggacttgataaaggatggcctatttctaaaatggatttaggcgtgccattgctagccttaggctgttactcacaggtaaatccattaacattaacagcggctgtactactccttataactcattatgcaatcattggtcccggtcttcaggccaaggcgacgcgagaagcacaaaagcgcacagctgcaggtataatgaagaacccgaccgtcgacggaatcatgacaatagacctggatccagttatatacgacagtaagttcgagaagcagctaggacaagtaatgttgctagtactgtgcgccgtacaattattgctaatgagaacctcttgggcactttgcgaagcactgacactagcaacgggtcctatcacaactctatgggaaggttccccgggaaagttctggaataccaccatagccgtttcgatggctaacattttcagaggttcttatttagctggtgcaggacttgccttctcaataatgaaatccgtgggaacaggaaagagaggaacagggagtcagggtgaaacactcggagaaaaatggaagaagaaactaaatcagcttagcagaaaagactttgatctatataagaaatctggtattactgaagtagacagaacagaggcaaaggagggtttaaaacggggcgagataacccatcatgctgtgtccagaggatcggcgaaattacaatggtttgttgaaagaaatatggttataccggaaggtcgcgtaatcgacttaggatgcggtcgaggaggatggagctattattgcgcgggactcaagaaagtcacggaagttaggggctatacgaaagggggtcctggccatgaggaacctgtcccaatgtcaacgtatggatggaacatagttaaactgatgtcaggaaaagatgtattctatttgccaccagaaaaatgtgacactttattatgcgacataggggaatcaagcccctcaccgactgttgaagaaagcagaaccataagagtgttaaaaatggtagaaccctggttgaagaacaatcagttttgcataaaagtcttaaatccttatatgcccacagtaatcgaacatcttgaaaggctacaacgtaaacacggtggaatgctagttcgaaaccccttaagccgtaactctacacacgaaatgtactggattagcaatggtaccggaaacatcgtcgctagtgttaacatggtatcacgattacttctgaatagattcaccatgacgcataggagacccacaatcgaaaaagacgttgatctcggggcgggaactcgacacgtaaatgctgaacctgagacaccgaatatggatgtaataggagagaggattaaacgaataaaagaggaacataactcaacctggcactacgacgatgagaacccatataaaacatgggcatatcacgggtcatatgaagttaaggcaacggggagtgcgtcgagcatgataaacggagttgtaaaactactgacaaagccatgggatgtggttccaatggtcacacagatggcaatgaccgatactacaccctttggacagcaacgtgttttcaaggaaaaggtagacaccaggacccctagatcaatgccagggaccagaagggtaatgggcataacagcggaatggttatggagaacgctgggaaggaataagaaaccgcgtttgtgcactagagaggaatttacaaagaaggttcggaccaatgcagccatgggagctgtttttactgaagagaatcagtgggacagtgcgaaagcggcggtggaagacgaagatttctggaaactggtggaccgcgaacgcgaacttcacaaactgggaaagtgtggttcatgtgtatataatatgatgggcaaacgggagaagaaacttggtgagtttggaaaagcaaaaggatcacgagctatttggtatatgtggttaggcgcccgttatttagaatttgaagccctaggatttttaaacgaagatcattggttctccagagaaaattcatatagtggagtagaaggtgagggattgcataagctaggttacattctcagagacatcagtaaaatccctggaggagcaatgtatgctgacgacacagctggatgggacactcgtattactgaagatgatttgcataacgaagaaaagataacacaacaaatggatccagaacacagacaattagcaaacgcgattttcaaattaacctatcaaaacaaagtagtaaaagtacaaagacccacaccaactggaaccgtaatggatatcatttctcggaaagatcaacggggatcaggtcaagttggcacttatggactgaatacttttactaatatggaagctcaactgatcagacaaatggaaggagaaggtgtgttgtcgaaggctgaccttgaaaatcctcatctacctgaaaagaaaatcactcagtggttggaaacaaagggagtagagagactgaagcgaatggctataagcggagacgattgtgttgttaaaccgatagatgacaggttcgctaacgcattattagccttaaatgatatgggaaaggtaagaaaagacataccacaatggcaaccgagtaaaggatggcacgactggcaacaggtgccattttgctctcatcacttccacgaattaataatgaaggacggacgtaaattggtagtaccttgccgaccacaagatgaacttattggcagggcaagaataagtcaaggagcgggctggtctttgaaagaaacagcatgcctaggcaaagcgtacgcacagatgtggtcattaatgtatttccatcgtagggacctacggctcgctagcaatgcgatatgcagtgcggtccctgttcactgggtgccaacgagtagaaccacatggagcatacacgcgcatcatcaatggatgactacggaagacatgttaaccgtttggaatcgagtgtggatagaagacaacccctggatggaggacaagacaccggtaacaacatgggagaacgtaccctacttgggcaagagggaagaccagtggtgcggaagtttgattggtctgacctctcgtgctacctgggctcaaaatatccctacagctattcaacaagttcgttccttaatagggaatgaggagttcctggattatatgccatcgatgaagcgattccgcaaagaggaagaatcggagggagctatatggtag

SEQ ID NO: 23190 - RNA, 9873 nt, synthetic construct
  misc_feature 1..9873: note = derived and/or modified CDS sequence (opt6) from DENV-3__HM181977__SS-prME
  source 1..9873: mol_type = other RNA
actagcttgtgcttgatgatgattttaccggcagcgttagcttttcatttgacgtcaagagacggtgaaccacgaatgatagtgggcaaaaatgaaagaggaaaaagtcttctttttaaaacagcaagcggtattaatatgtgtacattaattgcaatggatttaggggaaatgtgtgacgacactgtaacatacaaatgtccgcacatcacagaagttgaacctgaagatatcgattgttggtgcaacttgacaagtacctgggtcacttatggaacctgcaaccaagcaggggaacacaggagggacaaaagaagtgtggcactagctccgcatgtggggatgggacttgatactcgaacgcaaacatggatgtctgcggaaggtgcttggagacaagtagaaaaagtagagacatgggcattaagacacccgggttttacaatattagcgctctttttagcgcattatattggaacctcgctaactcagaaagttgtaatattcattctacttatgctagtgacacctagtatgacgatgcgatgtgtaggagttggtaatcgtgacttcgttgaaggactttctggcgcaacatgggtagatgttgtgctggaacatggaggctgcgtgactacgatggccaaaaataaaccgactcttgacatcgaattacagaaaacggaagcaacgcaattggccacgcttcgtaaattatgtatagagggaaaaataactaacataaccaccgatagccgatgtcctactcaaggagaggcaactctaccagaagaacaagatcaaaattacgtctgcaaacacacgtatgtagatcgcggatgggggaacggatgtggcttatttggcaaaggttcacttgtaacctgcgccaaattccaatgtttagaacctattgaggggaaagttgtccaatatgaaaatcttaaatatacagtcatcataactgtacacacaggtgaccagcatcaagtgggaaacgagacgcaaggagtaaccgcagaaatcaccccacaagcaagcactacggaggctatactacccgaatatggaacacttggtcttgaatgctctccccgaactgggctcgattttaatgaaatgatattgcttactatgaaaaacaaagcctggatggtgcatcgccagtggttctttgacttgccattaccttggacatcgggcgccacaacggagacgcccacttggaatcgtaaagaattgttagtaacatttaaaaacgctcatgcgaagaaacaggaagtagtcgtacttggtagtcaggaaggggccatgcatactgccctaacaggagccacagaaatacaaaattcagggggaacaagtatttttgcaggacatctcaaatgtagattaaaaatggacaaacttgaactgaaaggtatgtcgtacgctatgtgtaccaacacattcgtactaaagaaagaggtatcagagactcaacatggtactattctaataaaagtagaatacaaaggtgaggatgtcccatgcaaaattccattttctactgaagatggtcagggcaaggcccataatggaaggctgataacagcgaatccggtggtaacaaagaaggaagaaccagtgaacatcgaagcggaacctccgtttggagagtcgaatattgtcattggaatcggcgataatgcactgaagataaattggtataagaaaggatcttctataggtaagatgtttgaagccactgcaagaggagcccggagaatggctatactgggtgatacagcatgggactttgggagcgtagggggagtactaaacagcctgggaaagatggttcatcaaatatttggatccgcatatacagctttgttttcaggcgtcagttgggttatgaagatcgggattggtgttcttttaacatggataggacttaacagtaagaatactagcatgtcctttagctgcattgccatcggaataataactctataccttggcgcagttgttcaagcggatatgggctgtgttgtaaattggaaaggtaaggagcttaaatgtggttcaggaatctttgtcacaaatgaggtacatacttggacggaacagtataaatttcaagcagacagtccaaagaggctcgcgacggctattgctggcgcttgggaaaacggcgtctgcggtattcgatctacgaccagaatggaaaatttgctttggaaacaaatcgcgaatgaattaaattacatactatgggagaataatattaaattgaccgtagtagtgggtgacatcataggagtacttgaacaaggcaagagaactttgactccacaacctaaagaactaaaatacagttggaaaacatggggtaaagctaagattgtaactgctgaaacccaaaacagcagtttcataatagatggtcccaatactccggaatgtccatcggtttcacgtgcgtggaacgtatgggaagttgaggattatggttttggagttttcacaacgaatatctggctaaagctgagagaagtatatacgcagttgtgcgaccatagattaatgagcgcggcagtgaaagacgaaagggccgtacatgcggacatgggatattggatagagagccagaaaaacggaagttggaaactagaaaaggccagcttaattgaagtaaagacatgtacctggcctaaatcacatactttatggagtaacggcgtgttagaaagtgatatgataattccaaagtcactagcaggtccaatctcccaacataaccacagacctgggtaccatacccagacagcaggaccttggcatcttggcaaattggaactcgattttaattactgcgagggtactaccgttgttatcactgagaactgcggaacacgagggccttccttgcgcacaaccacggtatcaggaaaactgatacacgaatggtgttgtcgatcttgcactttgccacctctcagatacatgggtgaagacggatgctggtatggtatggaaatccgaccaatctcagagaaagaagaaaatatggttaaatctttagtatcagcagggagtggcaaagttgataatttcacaatgggcgtcttgtgtctagctatattgttcgaggaagttatgcgtggcaagtttgggaagaaacatatgatcgctggggtattctttacttttgtcttactactaagtgggcagatcacgtggcgagacatggctcatactttaataatgataggcagcaacgcttcagatcgcatgggaatgggagtgacttatctagctttaattgctacatttaaaattcaacctttcttagcattaggattctttttaagaaaattaaccagcagagaaaacctacttttaggtgttggactggcaatggctacgactctacaactcccagaagacatcgaacagatggcaaacgggattgctctaggcttaatggcattaaaacttatcacacaattcgaaacgtatcaactatggactgcactaataagtctaacgtgcagtaacacaatttttactctaactgttgcatggagaaccgccacactaatcttagcgggagtttcactactaccagtttgccaatcgagtagtatgcgaaaaacagactggctccctatggctgtcgcagctatgggagttccaccattaccgctgttcatattttcattaaaagatactcttaagcgtcgaagttggccattaaacgagggagtcatggctgtgggcttagtaagtatactagctagttcactattaaggaatgacgttcctatggctggacccctggtcgccggtggtcttttaatcgcatgttatgtaataactggaacctcagcagatctgacagtcgagaaggcagcagacataacatgggaagaagaggccgaacaaacaggtgtatcacataatttaatgataacagtggatgacgacggcactatgagaataaaagatgacgaaactgaaaatatattgactgtgctgctgaagacagcactgttaatagtatccgggatttttccatatagcataccggcaacactcttggtttggcacacgtggcagaaacaaacacaaagaagcggagtattgtgggatgtaccatcgcccccggaaactcagaaggccgaactagaagaaggcgtatatcggatcaaacaacaaggtatatttgggaaaacgcaagttggtgtaggcgtacaaaaagagggagttttccatacaatgtggcacgtaacacgcggtgcggtactaacatacaacgggaaaagactagaaccaaattgggcaagcgtaaagaaggatttaatatcttatggaggaggatggaggctgtctgcacaatggcaaaagggtgaagaggtccaagtaatcgcagtcgaaccaggcaagaacccgaaaaattttcagactatgccagggacgtttcagacgaccacgggagagataggagcgatagcccttgacttcaagcccggaacctctggaagtccgataattaaccgagaagggaaggtcgtgggattatacggcaacggcgttgtgactaaaaacggagggtacgtgtctggcatagcacaaacgaacgcagaaccagatggtccaacgcccgaacttgaagaagagatgtttaagaaacgaaacctaacgattatggacctacatcctggttctgggaaaactcgaaagtacctcccagcgattgtcagagaagcaattaagcgaagactcagaactcttatacttgcgccaactcgggtagtcgcagcagagatggaggaggctctaaaagggttaccaatacgttaccaaactactgcaactaaatcagagcacacaggacgtgagattgtcgacttaatgtgccatgcaaccttcacaatgcgtttactttccccagtgagagtcccaaactacaatttaataataatggacgaggcacactttacagatccagcgtctatcgccgcccgtggatatatatcaacacgtgtaggaatgggtgaagctgcagcaatattcatgacagctacaccacctggaacagccgatgcatttccccagtcgaacgcgcccattcaagacgaggaacgagatattccagaacgttcttggaatagtggaaatgaatggataaccgactttgcaggcaaaacagtatggtttgtgccatcaataaaggcgggaaatgacatagcgaattgcctgaggaaaaatggtaagaaagttattcaattatcaagaaagacatttgataccgaataccagaaaactaagctaaacgactgggattttgtagtgactacagatatttctgaaatgggcgcgaatttcaaagcagatagagttattgatcctagaaggtgtcttaaaccggtaattctaacagatggtcccgaaagagtaattttagcagggccaatgccggtaacagcggcatctgcagcacaaagaagaggacgtgttggacggaatccacaaaaagaaaatgatcaatatatctttacaggacaacctctgaataatgacgaggaccacgctcattggacagaagccaaaatgctacttgacaatatcaatacaccagagggaattatacccgctttatttgagcccgagcgagagaaatctgcagcgatagacggtgagtacagactaaaaggagaatcgcggaagacattcgtggaattgatgagacgtggcgatctaccggtatggttagcccataaagttgcaagcgaaggaataaaatatactgatcgtaaatggtgttttgacggtcaaaggaataaccaaatccttgaagaaaatatggatgttgagatctggaccaaggagggagagaagaagaaactaagacctagatggctggacgctcgaacatacagcgatccactagcactgaaagaatttaaagagtttgcggctggacgaaaaagcattgccctagatctagtgacagaaattggtagagtgccaagccatttggcacatcgaacccgcaacgcattggacaatctagtaatgttgcacactagcgaacatggtggtagagcataccgacacgcagttgaagagttaccagaaacaatggagacattacttcttcttggtttgatgatactactaacaggtggggctatgctgtttctaatttcaggtaagggaataggtaaaacaagtataggtttaatttgcgttatagcaagtagcggaatgctatggatggctgagattccgctccagtggattgcgtctgctatagttttagaatttttcatgatggtattgctaattccagaacctgaaaagcaaaggaccccacaagacaatcagctagcatatgttgttatcggtattctaacattagcagccataattgccgcaaatgaaatgggtttactagaaactacaaaaagagacttgggaatgagtaaagaaccaggagtcgttagtcccacttcatatttggatgtagacctacatcccgcatccgcgtggacgttatatgccgtagcaactacagtaattacaccgatgttaagacatacaattgaaaattcgacagcaaatgtcagtttagcagcaatcgcaaatcaggcggtagtattaatgggattggataaaggttggcctattagtaaaatggacttaggtgtaccactcttagcattaggctgttatagtcaagtaaatcctctgaccttaacagccgcagtactactgttgataacgcattatgcaattataggcccaggattacaggcaaaagctacgcgcgaagcacaaaaacgtacagctgcaggaattatgaaaaatccaactgtagacgggataatgacgatagatttagatccagtcatctatgacagcaagtttgagaaacagctaggtcaagtgatgctgctcgtactgtgtgcagtacaactgctcttgatgagaacttcttgggcgctttgtgaagcactcacattagcaaccgggccgataactacattatgggaagggtcaccgggaaaattttggaatacaacaatagcagtttcaatggccaatatttttcgaggcagttatcttgctggagccggtcttgctttctcgataatgaaaagtgttggtacaggaaagagaggcacaggctcacagggtgaaactttaggcgagaaatggaaaaagaaattaaaccagttatccagaaaagattttgatttgtataagaaaagcggaataaccgaagttgaccggacagaggctaaggaagggctaaaaaggggtgaaataacacatcatgctgttagcagagggagtgcaaaactgcaatggtttgttgaaagaaatatggtaatccctgaaggccgagtaatcgatcttggatgtggccgaggcggatggtcatattattgcgccggattgaaaaaggttaccgaagtgcggggctatactaaaggaggccccggccatgaggagccagtaccgatgtcaacatacggctggaatatagtaaaactgatgtcagggaaagacgtattttatctaccgcccgaaaaatgcgacaccctgctctgtgacatcggggaatcttcgccaagtccaacagtagaggaatcacgaacaataagagttttaaaaatggtagagccgtggctcaaaaataatcaattttgcataaaggtcctaaatccgtacatgcctacagtaatagaacacctagaaagactacaacgaaaacacggcggtatgctagttcgtaacccactctccagaaactcaacccacgaaatgtattggatctctaatggcaccggcaatatagtggcgtcggtaaacatggtatcgcgcctattattaaatcgttttactatgactcacagacgtccgacaatagaaaaagatgtagacctcggagccggaacaaggcatgtaaatgcagaaccagaaacgccaaacatggatgtaataggagaaaggataaagagaataaaagaggaacacaattcaacgtggcactatgatgacgaaaacccttataaaacctgggcctatcacggatcatacgaagttaaagccacgggaagtgccagctctatgataaacggagtcgtgaaattgctaacaaaaccatgggacgtcgtacctatggtgacccaaatggctatgacagacacgacgccatttggacagcaaagagtgttcaaagaaaaagtagacactagaacgccaagatcaatgcccggaactagaagagtaatgggtatcaccgctgaatggctttggagaacacttggaagaaacaagaaacccaggctttgtactagagaggaatttaccaagaaagtaagaaccaatgccgcaatgggcgcagtctttacagaggaaaatcaatgggattccgctaaggcggctgtagaggatgaagatttttggaaacttgtggatagagagcgggaattgcacaaactaggaaaatgcggctcctgtgtgtacaatatgatgggcaaaagagagaagaaactcggagagtttggtaaagctaaaggatcgagagctatttggtatatgtggttaggcgcgcgttacctggaatttgaggcattgggatttctaaatgaagatcattggttctcacgcgaaaacagctatagtggggttgagggtgaaggattacacaaactcggatacatattacgagatatctcaaaaataccaggtggcgcgatgtatgccgacgatactgctggatgggacacccgaatcacagaagacgatcttcataatgaagaaaagataacacaacagatggacccagaacatcggcaactggcaaatgctattttcaagttaacttaccaaaacaaagtggtaaaagtccagaggcctacaccaactggtacggtgatggacataatttcaagaaaagaccaaaggggaagtggtcaggtcggcacatacggactcaatacattcaccaacatggaagcacagttaatcagacaaatggaaggagaaggagtactctccaaggcggatttagaaaatcctcatttaccggagaagaaaataacccaatggttagagacaaaaggagtagaaagacttaaaagaatggcaatatctggagacgattgcgtagtaaaaccaatagatgacaggtttgcaaatgcattacttgcactcaacgacatgggtaaagtcaggaaagatataccccaatggcaaccatcaaagggatggcatgattggcaacaagtaccattctgtagccatcattttcatgaattaataatgaaagatggtcgaaaacttgtagtaccatgtaggccacaagatgaactcattggaagggctaggattagtcaaggagcaggttggtctctcaaagagactgcgtgcctaggtaaggcttatgcacagatgtggagtctaatgtactttcatcgtcgagatctgcggttagcctctaatgcaatttgtagtgctgtacctgttcattgggtaccaacgagtagaactacctggtctatacatgcccatcaccaatggatgaccaccgaagacatgcttacagtttggaatagagtttggatagaagacaatccttggatggaagataaaacacccgtcactacgtgggaaaacgtcccttatctgggaaaaagagaagatcaatggtgcggcagcctcataggcctaacgagtagggctacatgggcacaaaatatacctacagcaatacagcaagtaaggtcactaatcggcaatgaagaatttttagactacatgccaagtatgaagagattccgtaaggaggaggaaagtgagggggcaatatggtaa

SEQ ID NO: 23191 - RNA, 9873 nt, synthetic construct
  misc_feature 1..9873: note = derived and/or modified CDS sequence (opt6) from DENV-3__HM181978__SS-prME
  source 1..9873: mol_type = other RNA
acttctctctgtctgatgatgatattgcctgcagcgctcgcttttcatcttacaagccgagacggggaacccaggatgattgtaggaaaaaatgaaaggggaaagagccttttattcaagacagcaagcggaataaatatgtgtacattgatagctatggatttaggagagatgtgtgacgatactgtcacatataaatgcccccatataactgaggtggagccagaagatattgattgttggtgcaatctaacaagtacttgggtaacatatggcacatgcaatcaagctggagaacacagacgagataagaggtcagtagcactcgcgccgcacgtcggcatgggattagacactagaacccaaacgtggatgagtgctgaaggtgcatggcgacaagttgagaaagtagaaacatgggctttaagacatccggggttcaccattctcgcattgtttttggctcattacataggtacatctcttacacagaaagttgtcatattcatacttcttatgctagtaacgccatccatgacgatgcgatgcgtaggtgtaggtaaccgagattttgtggaaggactttcaggcgcgacttgggtagacgtggtgttagagcatggaggttgcgtcactaccatggcgaaaaataaacctacattagatatagaattgcaaaaaactgaagcgactcaacttgcaactctgcgcaaactttgcatagagggtaaaataacaaatataaccactgacagcaggtgtcctacccaaggtgaagctacactaccagaagaacaagatcagaattacgtatgcaaacacacctatgtcgataggggttggggaaacggatgtggattatttggaaaggggagtctagtaacatgcgcaaaattccagtgcctagaacccattgaagggaaagtagtacaatatgagaatttaaaatacacagtaattataacagtgcacacgggggatcagcatcaggtaggcaatgagacacaaggggtgacggcagaaatcacgccacaagcgtctacaacagaagcaatacttccggaatatggtacgctcggactagaatgtagtcctcgaactggtctcgacttcaatgaaatgatcttgctaacaatgaaaaataaggcatggatggttcatagacaatggttttttgatcttcctctgccatggacttctggggcaacaacagaaacacctacatggaataggaaagagttattagtgactttcaagaatgcacatgcaaaaaaacaagaagtagttgtactaggcagccaagaaggagcgatgcatacggccctaacaggtgctactgaaattcagaatagcggaggaacttccatttttgcaggacacttgaaatgcaggcttaaaatggacaaattggaactaaaaggtatgagttatgccatgtgtacaaatacattcgttcttaaaaaagaggttagtgaaacccaacacggtaccatccttattaaagtggaatataaaggagaagatgtaccctgcaagataccattttcaacagaagacggtcaaggaaaagcccataatgggcgattaataacagcgaatcctgttgttaccaaaaaagaagaacctgtcaatatcgaagccgaaccacctttcggagaatcaaacatcgtaattgggatcggagataacgcactgaagataaactggtataaaaaagggtcaagtataggcaagatgttcgaagccacagcgcgaggcgctagacgcatggccatcttaggagatacagcttgggactttggtagtgtaggaggcgtattgaattcactaggaaagatggtacaccagatattcggaagcgcatacaccgccttgttcagtggcgtaagctgggtaatgaaaataggaataggcgtactgctaacttggattggtctgaacagcaagaacactagtatgtccttttcatgtatcgctatcggaataatcaccctatacctgggtgctgtagtacaagcagacatggggtgcgtaataaactggaaaggcaaggagttgaagtgtggtagtgggatttttgtaacgaatgaggttcacacttggacagaacaatacaagttccaagcagactctccaaaaaggttagcaactgccattgcaggtgcatgggaaaacggagtatgtggaattagaagcacgacacgcatggaaaacttattatggaaacaaatagctaacgaactaaactacattctctgggagaacaacattaaattaacagttgtagtaggagatattataggagtattagaacaaggaaagcgaacactaacaccacagccgatggaactcaagtattcctggaaaacatgggggaaagctaaaatagtaaccgcagaaacacaaaactcgagcttcataatagacgggccaaacacaccagagtgtccgtcagtatcacgggcatggaacgtatgggaagtggaagactatggattcggagtttttacaacaaatatttggctaaaattacgagaagtatatacgcaattgtgcgatcaccgactcatgagcgcagcagttaaagacgaacgagctgtacacgcagacatgggctattggatagaatcacagaagaacggatcttggaaactggaaaaggcgagcttgatcgaagttaagacgtgcacctggccaaaatctcatactttatggagtaatggggtcctagagtcggatatgataatccccaaaagcctagcgggaccaattagccagcacaaccatagaccaggataccacacacaaacggcaggaccctggcatctcgggaaattggaattagatttcaattattgcgaaggaacaacagtagttataacagaaaactgtggaacaaggggcccgtcgttaagaacgacaactgtatctggcaaactgatacatgaatggtgctgtaggagctgcactttacccccgcttagatatatgggagaagatggatgctggtacggaatggaaatcaggcccatatctgagaaagaagaaaacatggtgaaatcattagtgtcagcggggagtggtaaagttgacaatttcaccatgggtgtcctatgtctagcgatcctctttgaagaagtaatgcgtggtaaattcggaaagaagcacatgatagccggggtattcttcacctttgtactactgcttagtggccagataacatggagagatatggcccacacgttaatcatgataggctcaagtgcttcggatagaatggggatgggagtaacatacctagctttgatagcaacattcaagatacaaccttttcttgcattaggatttttcctgcgaaaactaacaagccgagagaatctcttactaggagtggggttagcaatggcaacaactttgcagttgccagaagacatagagcaaatggcaaatggaattgcccttgggttaatggcactcaaactgataactcagttcgagacataccaactgtggacagctctaatctcgttaacttgttcgaacacaatcttcaccttaacagttgcatggaggacagcgacactaatattagctggtgtatcgttattgccagtttgtcaatcaagcagcatgcggaaaaccgactggctccccatggcagtagctgctatgggagttccacctctacctttatttatttttggattgaaagatacactaaagagacggtcctggccactgaatgaaggcgtaatggcggtgggcctagtgtcaattttggcaagtagtttactaagaaatgatgtacccatggccggtccactggtagcaggaggactactaatagcatgttatgtgatcaccggtacaagtgcagaccttactgtcgagaaagctgcagatataacatgggaagaagaagctgaacaaaccggagtttctcataatctcatgatcacagtagatgacgacggaacaatgagaataaaagatgatgaaactgaaaacattttaacggttttattaaaaacagcattgttaatagtaagtggtatctttccttactcaatcccagccacgttgttagtatggcacacttggcaaaagcaaacgcagagatccggagttctatgggacgtgccctcacctcctgaaacccaaaaagcagaactagaggaaggagtttatcgcattaaacagcaaggaatattcggaaaaacacaagtgggagtaggagtccagaaggaaggggtctttcacactatgtggcatgtaacaaggggagctgtgctaacgtacaacggaaaacgtttagaaccaaactgggcgtccgtcaagaaagatctgatttcttatggaggaggttggagattatcagcacaatggcaaaagggagaggaagttcaagtcattgcagtagaaccaggaaaaaatcccaaaaactttcaaactatgcccggaacgtttcagactactaccggagaaattggggcaatagcgttagattttaaacctgggacatcaggaagcccaataataaatagagagggtaaagtagttggattatatggtaacggcgtagttactaaaaatggcggctacgttagtggcatagctcagacgaatgctgagccagacgggcccacgcctgaactagaagaggaaatgttcaaaaagcgaaacctcactataatggacttgcacccgggaagtggtaagactagaaaatatttacccgctatcgtaagggaagctataaaaagaagattacgaacgttaatattggctccgacaagagtagtcgcagctgagatggaagaagcattaaaaggattacctataagataccagacaacagcgaccaagtcggaacataccggaagggaaattgtcgatctgatgtgccacgcaacatttacaatgcgattattaagtcctgtaagagttccgaattataatctcattattatggatgaagcccattttacagatccagcatcaatcgctgcacggggatatatatcaacaagggtgggcatgggtgaggcagccgcaatatttatgactgctaccccgcccgggaccgctgacgcattcccgcaatcgaatgcacccattcaagatgaggagcgagatattccggaaagatcatggaactcagggaatgaatggatcacagactttgctgggaagactgtttggtttgttcccagtataaaggcaggaaatgacatcgcgaactgcttacgtaagaacggcaaaaaagttatacaattgagtcgcaaaacatttgacacagagtatcaaaagacgaaattaaatgattgggattttgtagtcactacagatatatcagagatgggagcaaattttaaagctgacagagtaattgatccccgaagatgcttgaaaccggtcatattgacagacggccccgaacgagtaatattagccggacctatgccagtcacagcggccagtgcggcacaacgtcgcgggagagtagggcgtaatccccagaaggaaaacgatcaatatatcttcacggggcaaccgctaaataatgacgaagaccacgcacactggactgaagcaaagatgctactggataatattaacactcccgaagggattataccagctttatttgaacctgaacgtgaaaagtcagctgcgattgatggtgaataccgtcttaaaggagagagtagaaaaacttttgtggaactaatgaggaggggagatctcccagtatggctagcacataaggtagctagcgaaggaataaagtatactgatagaaaatggtgttttgatgggcagcgcaataatcaaattttagaagaaaacatggatgtggaaatatggacaaaagaaggagaaaaaaaaaaactaagaccacgttggctagatgctcgaacatactctgaccccctagcattaaaagaatttaaagaatttgctgcgggtaggaaaagcattgccctcgacttggtaaccgaaatcggtcgcgttccttcacatcttgctcacaggaccagaaatgccctagataatttggtgatgcttcatactagtgaacatggaggcagagcatacaggcacgcggtggaagaactgccagaaactatggaaacactattactgctcggattgatgatactactgacaggaggagcaatgttgtttttaattagtggcaagggtatcggcaaaacatcaataggcttaatatgtgtgatcgccagttcaggaatgttatggatggcagaaataccccttcagtggatcgccagcgcaatcgtactagaattcttcatgatggtcctgctaataccagaacctgaaaaacagcgaactccacaagacaaccaacttgcatacgtagtaataggtatattaacacttgcagcaattatcgcggctaacgaaatgggattattggaaacgactaagagagacctgggaatgtccaaagaacctggagtggtgtcaccgacctcctacctagatgttgatctacaccccgcgagcgcgtggactctttatgcggtagccaccacggtcataacacctatgttaagacatacgatcgagaattcaaccgccaacgtcagtttagccgctattgcaaaccaagcggtcgtactaatgggcttagataagggatggcctatatctaagatggatctaggagtaccgctacttgcattgggttgctattcacaagttaacccacttacactaacagccgcagtattattgttgattactcactacgccattataggaccaggtttacaagcaaaagcgacaagagaggctcaaaaaagaactgcagcaggtatcatgaaaaacccgacagtagatggcataatgacaatagatttggacccagttatttatgattctaagtttgaaaaacaactcggtcaagttatgcttcttgtcttatgtgcagtacaactattactaatgagaacgtcatgggcactttgtgaagcactgactctagcaacaggcccaattacaactctttgggaaggcagccctggaaaattctggaatacaaccatcgccgtaagtatggcaaacatattcagagggtcctacttggctggagccggtctcgcattttctataatgaaaagcgtgggcacaggcaagcgaggtacaggctcacagggcgagacattgggcgaaaaatggaaaaaaaaattaaatcaactttcccgtaaagattttgatttatataaaaagtcagggataaccgaagtagataggacagaagctaaggagggattaaaaagaggagaaatcacccatcatgcagtatcacgcggatcagcaaagttgcaatggtttgtagagaggaacatggttattcctgagggacgagtaatagatttaggatgcggccgaggggggtggtcgtattactgcgcggggttgaaaaaagtaacagaggtccggggatacacaaaaggaggcccaggacatgaggaacctgtaccaatgagcacgtacggatggaacattgtaaaattaatgagtgggaaagacgtgttttacctaccaccagaaaaatgtgacacactactttgtgatataggggagagtagtccaagtccaacagtagaggaatcaagaacgataagagtactaaagatggtggaaccatggctaaaaaacaaccaattctgcataaaggtactgaatccatatatgcctactgtgattgaacacttggaacgattacaacgtaaacacggaggtatgctagtccgaaaccccctctctagaaacagcactcatgaaatgtattggatcagcaacggaacaggaaacatcgtagcatcggtaaatatggtatcccgtttgcttcttaatcgatttactatgacacaccggaggcccacaattgaaaaagacgtcgatttgggtgccggaaccagacatgtaaacgcggaaccagaaacgccaaacatggatgttattggcgaacgaatcaaacgtatcaaagaagaacataacagtacatggcattatgatgacgaaaacccttacaaaacttgggcatatcacggtagctatgaagtaaaagctacagggtccgcatcatctatgattaatggagtcgtaaagttgttaaccaaaccctgggacgtggttcctatggtaactcaaatggcgatgacagacacaactccatttgggcaacagagggtcttcaaagaaaaagtcgacacaagaactcctagatctatgccgggcacaagacgggtcatgggcataacagcagagtggttatggcgaacattagggaggaacaaaaagccacgtctatgtacacgcgaagaatttacgaagaaagtgaggacaaacgctgcaatgggtgctgtatttacagaggaaaaccaatgggattcagccaaagcagctgtagaagatgaagacttttggaaactagtagacagagaaagagaactacataaactgggaaaatgcgggtcatgcgtttacaatatgatgggaaaaagagaaaagaaattgggagaattcggcaaggcgaagggtagtagagcgatatggtatatgtggcttggggccagatacttagaatttgaagcactgggattcctgaatgaggatcactggttttcgagagagaactcctactcgggagttgaaggggagggactgcacaaattggggtacattttacgggatatctcaaaaatcccaggaggagcaatgtatgccgatgatacggcaggttgggatacaagaataaccgaggatgatttacacaatgaagagaagataactcaacagatggacccagaacataggcagctcgcaaacgccatttttaagttgacatatcaaaataaagtagtgaaagttcaacggcccacgccaacgggaactgttatggacattatctctcgaaaagatcaaaggggaagcgggcaagttggcacgtacggactaaacacattcacgaatatggaagctcagctcattcgacaaatggaaggcgaaggagttctaagtaaagcggacctcgagaacccacacttgcctgagaaaaagattacgcaatggctcgaaactaaaggagtcgaacgactaaagagaatggcaatcagcggagatgattgtgttgtaaagccaatcgacgacaggttcgcaaatgccctactagctctgaatgacatggggaaagttagaaaagacataccacaatggcaaccctcaaagggctggcacgactggcaacaggttccattttgcagccaccacttccacgaactaatcatgaaagatggcagaaaactagtagttccatgtagacctcaagatgaactgattggaagggcgcgaatttcacaaggggcggggtggagcctcaaagaaacagcgtgcctaggcaaagcttatgcgcaaatgtggagtttaatgtatttccatcgtcgggatttacgactcgcctctaatgcgatatgctctgcagtaccggtccactgggtaccaacttcacgaaccacatggagtattcacgcgcatcatcagtggatgacgacagaagatatgctaactgtatggaatcgggtatggatcgaagacaacccatggatggaggataaaactcctgttacaacatgggagaacgtaccctatctgggaaaaagagaagatcagtggtgtggatcattaatcggtttaacatccagagcgacttgggcccaaaatattccaacagctatccagcaagtacgatcactaattggtaatgaagaattccttgattacatgccctccatgaaaagattccgaaaggaagaggaatcagaaggggcaatctggtag

SEQ ID NO: 23192 - RNA, 9873 nt, synthetic construct
  misc_feature 1..9873: note = derived and/or modified CDS sequence (opt6) from DENV-3__JN183884__SS-prME
  source 1..9873: mol_type = other RNA
acttcgttgtgtcttatgatgatcttgccagcagcattggcctttcaccttacttctagagacggtgaaccgcgaatgattgtgggcaaaaatgaacgcgggaagtcattactattcaaaactgcttcaggaattaacatgtgcacactaatagcaatggacctcggtgaaatgtgtgacgacacggtaacatacaaatgtccacacatcacagaagtcgagccggaagacattgactgctggtgtaacttaacctcaacatgggtcacatatgggacatgtaaccaagccggtgaacatcggagagataaaagatctgtggcattggcgccccacgtcgggatgggtctggacaccagaacacagacgtggatgagtgcagaaggagcttggcgacaagtagaaaaagttgaaacatgggctttacggcatcccggattcactattctagccctcttcttagcacattatatcggtaccagtctaactcaaaaagtcgtgatttttatactactaatgctagtaacacctagcatgaccatgagatgtgtcggagtcgggaacagagatttcgtggagggactttccggagcaacatgggtagacgtggttttagaacatggaggatgcgtgacaacgatggcgaaaaataaaccaacattagacatcgaactacagaaaacagaggcaacgcagctggccacactccgtaaactgtgcatagaagggaaaatcaccaatattacaaccgattcaagatgcccaacacagggtgaagctacattgcccgaggaacaagaccaaaactacgtatgtaaacatacgtatgtggataggggttggggaaatgggtgcggcttatttggaaagggtagcctagttacttgcgcaaaattccagtgtctagaacctatagaggggaaagttgtacaatatgaaaatctaaaatatacagtgataatcacggttcatacaggtgatcagcaccaagtgggaaacgaaacacaaggagtaacggcagaaataacaccacaagcaagcactacagaagccatcctccctgagtacgggaccctaggattagagtgttcgcccagaacgggtttagactttaatgaaatgatattgttgaaaatgaaaaataaagcatggatggtccacagacaatggttctttgacttaccattaccatggacgtcaggagcaactactgaaacacctacatggaaccgaaaagaacttttagttaccttcaaaaacgctcacgctaagaaacaggaggtagtagtactagggagtcaagagggtgccatgcatacagctctgacaggcgcaaccgaaatccaaaactcagggggaacctcaatttttgctgggcacttgaaatgtcgactaaaaatggataaacttgaattaaaaggaatgagttacgcgatgtgcacaaacacatttgtacttaaaaaggaagtaagtgagactcaacacgggactatactaatcaaagtggagtataagggtgaggacgtaccttgtaaaatacctttctctacggaggacgggcaaggaaaagcacataacgggcgtctgattaccgcaaatcctgtggtgaccaagaaagaagaaccagtaaatatagaggcagaaccgccattcggcgaaagtaatattgtaattggcattggagacaatgccttaaaaatcaattggtataagaaaggaagctcaataggcaagatgtttgaagcgactgcgagaggtgcacgtagaatggctatacttggcgacacagcgtgggattttggatcagtcggaggcgttctaaacagtttgggaaaaatggtccaccaaatattcggaagcgcttatactgcactattttctggagtatcttgggtaatgaaaatcggtataggagttctattaacctggataggcctaaatagcaaaaatacatctatgagttttagctgtattgcgataggtatcattacactatatctaggcgcagtagtgcaagcggatatgggctgtgttataaactggaaaggaaaagaactcaaatgtggtagtggaatattcgtcactaatgaggtacacacttggacagagcagtataaattccaagctgactccccgaaaagattagcaaccgctatagctggggcttgggaaaacggtgtatgcggtatacggagcactacccggatggaaaatctgttatggaaacaaatagcgaacgaattgaattacatactttgggaaaacaacataaagttgacagtagttgtcggagatattataggcgtgttagaacaagggaaaagaacactaactccacagccaatggaactaaaatattcatggaaaacatgggggaaagcaaagatcgtaacggcggaaacccagaatagttctttcatcatagatggcccaaacacccctgaatgccctagtgtttcacgggcttggaatgtttgggaagtagaggattatgggttcggagtatttactacgaacatatggcttaaacttagagaagtttatacgcaactttgcgatcaccgtttgatgagtgcggcagtaaaagatgaaagagctgtacacgctgatatgggatactggatagaatctcagaaaaacgggtcctggaaattagaaaaggcgtctctaatagaggtaaaaacatgcacgtggccaaaaagtcataccctatggtcaaacggagttctcgaaagtgacatgattatccccaagtctctcgcaggacccatctcacaacataatcatcgcccaggatatcatactcaaacagcagggccatggcatctaggtaagttagaacttgacttcaactactgtgaaggaacaacggtcgtaataacagaaaattgtggcacacgtggaccaagtctcaggacaacgacagtttccggtaaattaatacatgagtggtgctgcagaagttgtacactccctccattgagatatatgggagaagatggttgttggtacggaatggaaatacgaccaataagcgaaaaagaggaaaacatggttaaatcgctcgtgagcgctggcagcggtaaggttgacaatttcacaatgggagtcttgtgtctagcaatattatttgaggaagtaatgaggggaaaatttggcaagaaacatatgattgcaggagtattctttacttttgtgttattactatcaggtcagattacctggcgagacatggcgcacactcttataatgattggatccaacgcgtcagatcgcatgggcatgggtgtgacgtacttagcattaatagcaacgttcaaaatacaaccctttcttgcgctcggattcttcttaagaaaattgacgtctcgggaaaatctattactgggggtaggcctagccatggcaaccactctacaattaccagaggatattgaacagatggccaatggaatagcgctcggattaatggcactaaagctgataacacaatttgaaacctaccagttatggactgctctaatatccttgacttgctcaaacaccatatttacattgacggtagcttggcgtacagctacactaatattagccggtgtgtcattacttccggtatgccaaagttcgagcatgaggaaaaccgactggcttccgatggcggtagcagctatgggagtacctccccttccattatttatatttggactgaaggatacactaaagcggaggtcatggccactaaatgaaggggtaatggcagtaggattagtttccatcttggcaagtagcttattgaggaacgacgtgccgatggccggtccactcgtggcgggtggattacttatagcatgttacgtaattacaggtacatctgccgatctaacggttgaaaaagcggctgatatcacatgggaagaagaagcagagcaaactggtgtaagccataatctaatgatcaccgtagatgatgatggtacgatgcgtataaaggacgacgagactgagaatatcttaaccgttttgctgaaaaccgcactactgatagtaagtggaattttcccatactcgataccagccactcttttagtctggcatacttggcaaaagcaaacacagcgatctggtgtactttgggacgtgcctagtccacctgaaacgcaaaaagctgaattagaagagggagtatacagaataaagcaacaaggaatattcggtaaaacacaagttggagtcggggtacaaaaagagggagtgtttcatacaatgtggcatgtaacgaggggcgcagtcttaacctacaatggaaaacgtttagaacctaattgggcatccgttaagaaagatttaatatcctacggaggcggttggcgcttgagtgcccaatggcagaaaggagaagaagtgcaagtgattgctgtcgaacccggcaaaaatccaaagaattttcaaaccatgccgggtacttttcagacaacgacaggagaaataggggctatagcacttgactttaagccaggcacttctggcagtccaattattaatcgggagggaaaggttgttggtttgtatggcaatggtgtggttacgaaaaacggtggatatgtgtcaggaatcgcacaaacaaacgcagaacccgacggtcccaccccagaactcgaggaagaaatgttcaagaaaagaaatctaacgattatggatcttcatcccggctccggaaaaacccgtaaatatctacctgcaatagtaagggaagcaatcaagagacgattaagaaccctaattttagcgccgacaagagttgtggcagctgaaatggaagaggcccttaagggactacccataagataccaaacaacagctactaaaagcgaacatacaggtagagaaatagtagatttaatgtgtcatgcgacgttcaccatgcgattattaagtccagtaagagtccccaattataatctcatcatcatggatgaagctcactttactgaccctgcgtcaatcgctgcgagaggttatattagcaccagggtaggaatgggagaggctgcagctatattcatgactgcgacaccgcctggaactgccgacgcatttccgcagtcgaacgcaccaattcaagacgaagaaagagatataccagaaagatcatggaactcaggcaatgagtggataacagactttgccggaaaaacagtatggttcgtaccatcaataaaggctgggaatgatattgcaaactgccttcgcaaaaacgggaagaaggttattcaactctctcggaaaacattcgacaccgagtaccagaaaacaaagctaaatgactgggatttcgtagtgacaactgatatttcagaaatgggtgcaaacttcaaagcggatcgagttatagatccgagacgctgtttaaagcccgtaatactcacggatggccctgagagagtcatactagcaggtcctatgcccgtaacagcagcatcagcagctcagcgaagaggccgtgtcggacgtaatccgcaaaaagaaaatgatcaatatatattcactggacaacctttaaacaacgatgaggaccacgctcactggacagaggcaaaaatgctcctagataatataaacactccagaaggaataattccagcacttttcgagccagaacgtgagaaatcggcagcaatagatggagaatacagactaaaaggagagtctagaaaaacctttgtcgaattaatgaggaggggtgatttaccagtttggctagcgcataaggtagcttcagaaggaattaagtacaccgatcgtaaatggtgttttgatggacaaagaaacaaccagatactagaggaaaacatggacgttgaaatatggactaaggagggagaaaagaagaaattacgaccaagatggttagatgcccgaacatatagtgacccactggctttaaaagagtttaaagagtttgcagcaggaagaaaatcgattgccttagatctcgttacggaaatcggtagagtgccatcgcacttagcacatagaaccagaaatgcactggataatttagttatgttacacacaagtgagcacggagggagggcgtaccgacatgcagttgaagagttaccagaaaccatggaaacattactactcttagggcttatgatcctactaacgggaggtgccatgcttttcttaataagcggaaagggaattgggaaaacatcgataggtttaatatgtgtcatagcatcaagcggtatgttatggatggccgagatcccgcttcaatggattgcgagcgctatagtattggaatttttcatgatggtacttttgattccagaacccgaaaaacaaagaacccctcaggacaatcaattagcttatgtcgtaatcggaattttaactttagcggcgataatagcagcaaatgagatgggactactagaaacgacaaaaagagacctcggaatgagcaaagagcctggcgtggtaagccctacttcctatctggacgttgatctacaccccgctagtgcgtggacattatacgcagttgccactactgtaataactcctatgcttagacatacaattgaaaattcgactgctaatgtgtctctagccgcaatagcaaaccaagccgtcgttcttatggggcttgacaaagggtggccaataagtaagatggacttaggtgtccctttgctagcgctaggttgctactcacaagttaacccactaactctgaccgctgcggttctattactaataacacattatgcaataataggtcctgggctccaggcaaaagcgacgcgtgaagcacaaaaacggaccgcggctggcattatgaagaacccgactgttgacggcataatgacaatagatctcgatccagtaatatatgatagtaaatttgaaaagcaactagggcaagtaatgcttttggtactttgcgcagttcaattacttctcatgcgaacgagctgggcactatgtgaagcgctcacccttgcaaccggcccaatcaccacactttgggagggctctccaggaaagttttggaacactaccatagcagtcagtatggctaacatattcagaggctcatatttggcgggtgcaggtcttgcatttagcattatgaaaagtgtcggtactggaaaacgcggtacagggtcacaaggcgaaacgttaggagaaaagtggaaaaagaaattgaatcaattaagtcgaaaagactttgatttatataagaagagtggcattacggaagttgataggaccgaagctaaagagggtctgaaaagaggtgaaataacacatcacgctgtaagccgagggagtgctaaactgcaatggttcgtagagaggaatatggtcatcccagaaggtcgcgtgatagatttaggatgcggaagaggagggtggagttattattgcgccggattgaagaaagttacggaggttcgtggttacacaaagggaggaccaggccatgaagaacccgtgccaatgagcacgtacggatggaacatagtcaaacttatgtcagggaaagatgtgttttatttaccccctgaaaagtgcgacacactgttatgtgacataggtgagagtagtcctagtccgacggttgaagaatctagaaccatccgcgtcttgaaaatggtagaaccgtggctgaaaaacaatcagttttgtataaaggttcttaatccatatatgcctacggttatagagcatttagaacgtctccagcgaaaacatgggggcatgctagtcagaaatccattatcaagaaacagcacacacgagatgtattggatttcaaatgggactggcaacatcgttgcgagtgtaaatatggtgagtagactactattgaatcggtttaccatgactcatagaaggccaactattgaaaaagacgttgatctaggagcaggaacaagacatgtaaacgcagaaccagaaacaccgaatatggatgtaataggagagcggatcaaacgcataaaagaggaacataatagtacatggcattacgacgacgaaaatccttataaaacttgggcatatcacggttcatatgaagtaaaagcaacaggctctgcttcatcaatgataaatggcgtagtaaaattattgactaaaccgtgggatgttgtccctatggtcacccaaatggcgatgacagacacaaccccattcggtcaacaacgtgtctttaaagagaaagttgatacaagaactccgcgatccatgccaggaactagaagagtcatgggaataacagcagaatggttgtggcgaacactggggcgaaataagaaaccccggctatgcaccagagaagagttcacaaagaaagttcgcacaaacgcagcaatgggggcagttttcactgaagaaaaccaatgggattccgccaaagccgcagtagaagacgaggatttttggaaattagtcgatagagaaagagaacttcataaattaggaaaatgtggttcctgcgtttacaacatgatgggcaaacgcgagaagaaactgggtgagttcggcaaagccaaaggcagcagagcaatatggtacatgtggcttggtgcaaggtatctcgagttcgaagccttgggatttttgaatgaggatcactggttcagtagggaaaattcttattctggagtagaaggagagggattgcataaactgggatacatcctacgcgacatatcaaaaatcccaggtggtgctatgtatgccgatgataccgctggttgggatacaaggataacagaggacgacttacataacgaagagaaaataacacaacagatggatccagaacatagacagttggcaaatgccatcttcaagttgacgtaccaaaacaaggtagttaaggtacaaaggcctacgcccactgggacagttatggatataataagtagaaaggatcaaaggggtagcggacaagtgggaacttatggattgaacaccttcacaaacatggaagcccagcttatcagacaaatggagggtgaaggggttttatcaaaagcagatttggaaaacccacacttaccggaaaagaaaataacgcaatggttagaaacaaaaggagtagagcgattgaagagaatggctatttcgggtgatgactgtgttgttaagccaattgatgatcgattcgcgaatgcgttacttgccctaaatgatatggggaaagtaagaaaagatataccccagtggcaaccgtccaaaggctggcatgactggcaacaagtacctttttgctcgcaccactttcatgaactaattatgaaagacgggagaaaattggtagtgccatgcagaccacaggatgaattgattgggagagcccgaataagccaaggagcaggctggtctttaaaagaaacagcgtgtctcgggaaggcatacgctcaaatgtggtcactaatgtactttcatagaagagatcttagactagcatctaacgcaatctgttcagcagtacccgtgcactgggtcccaacatcaaggacaacttggtctattcacgcacatcaccaatggatgactacagaagacatgctgacggtatggaatagagtatggatagaagataacccatggatggaagacaaaactcctgtaactacatgggaaaatgtaccatatctcggtaagagagaagatcagtggtgcggatcccttataggtttgacttcccgtgcgacctgggcgcaaaacataccaactgcaattcagcaagtacgatcgttaattggtaatgaagagttcttggattacatgccctctatgaagagattccgtaaagaggaagaatcagaaggcgccatttggtag

SEQ ID NO: 23193 - RNA, 9873 nt, synthetic construct
  misc_feature 1..9873: note = derived and/or modified CDS sequence (opt6) from DENV-3__HQ541785__SS-prME
  source 1..9873: mol_type = other RNA
acttctttatgcttaatgatgatcttacccgcagctctagcatttcacctgacaagtagggatggagaacctcggatgatagtaggcaaaaatgaaagaggaaaaagcctattatttaaaacggcttctggaataaacatgtgcactcttatagcaatggacctaggagaaatgtgcgatgatacagtaacatataaatgtccgcacattacggaagtcgaacccgaagacatagactgttggtgtaatctaacgtctacatgggttacatatggaacttgtaatcaagccggagaacatagaagggataaaagatcggtagctcttgcgcctcacgtcggcatgggtttagataccagaacacaaacctggatgagtgcagaaggggcatggagacaagtagaaaaagttgaaacctgggcactacgtcaccccggatttactatattggcgttatttctagcccattatattggtacttccctaacacaaaaagtagttatttttatattattaatgttagtgactccatctatgaccatgagatgcgttggagtaggtaatagggattttgttgaaggattatcaggagctacatgggtggacgtggtgttagaacacggaggatgcgtaactacaatggccaaaaacaaaccaacattagatatcgaactacagaaaacggaagcaacacaattagcaaccctacgaaaattatgcattgaaggcaaaataacaaacattactacagatagccgttgtccaacacaaggcgaagcaacattacctgaggaacaagaccaaaattatgtctgcaaacacacatacgttgatagaggatggggtaacggatgcggtttattcggaaaaggctcgttggtcacgtgtgcgaaatttcaatgtctggaacctatagaaggtaaagtggtgcaatatgaaaatctaaaatatacagtaataatcacagtgcacacaggggatcaacatcaagtaggaaatgagacacaaggcgtaaccgcggaaataacaccccaagctagcaccaccgaagctattctaccagaatacggaacactaggcctagaatgtagtccaagaacggggttggattttaatgaaatgatacttttaactatgaaaaacaaagcatggatggtccatagacaatggttctttgatttgccactgccatggacgagtggggctacaacggagacaccaacttggaacaggaaagagctcttagtaactttcaaaaacgcacacgccaagaaacaggaggtggtagtactcgggagccaagaaggtgcaatgcatactgcgcttacaggggctaccgaaattcaaaatagtggtggaacctccatatttgctgggcacctaaagtgtaggctcaaaatggataaattagagctaaaaggcatgagctatgcaatgtgcaccaatacgttcgtcctaaagaaggaggtatcagaaactcagcatggaaccatattaataaaggttgaatataaaggtgaagatgtaccatgcaaaatacctttctccacagaagacggacaaggtaaagctcataacggcagactaataacagctaatccagttgtgacgaagaaagaagaaccagtcaacatagaagccgaacctcctttcggcgaaagtaatatagtaatcggcatcggagacaatgccttgaaaattaactggtataagaaaggcagtagcataggaaagatgtttgaagcgaccgctcgaggggccagaagaatggctatcttaggggatactgcctgggatttcggcagcgtgggaggagttctaaactctctcgggaaaatggtccaccaaatatttggatctgcatatacggcattattctcaggtgtgagctgggtgatgaagataggtataggtgttctattgacatggatcgggttgaacagtaagaacactagcatgtcattctcatgcatagcgatcggcataataaccctgtacttaggggcagtcgttcaagcagacatgggctgtgtaattaattggaaggggaaggaacttaaatgtgggtctggcatattcgttacgaatgaagtgcatacatggacagagcaatataagttccaggcggattcgccgaaaaggctcgctacagctatagccggtgcatgggaaaatggcgtgtgcggtataaggtcaacaacccggatggaaaatttattatggaaacaaatagcgaacgaacttaattatatcctgtgggaaaataatataaaactaacagttgtggtgggagatataatcggagtattagagcagggaaaacgtactttgactccccagcctatggagttgaagtatagttggaaaacgtggggcaaagcgaaaatagtaacagctgagacgcaaaatagttcatttatcatagatggaccaaacacaccagaatgtccgagcgtgagccgagcgtggaatgtatgggaagtcgaagactatggttttggagtatttacaaccaatatatggttgaaattacgagaggtctacacacaattatgcgaccacagattaatgagcgcagcagttaaggatgaaagagccgtacatgctgatatggggtactggattgaatctcaaaagaatggtagttggaagctagaaaaggcttcgttaatagaagttaagacatgcacttggccaaaatcacatactctatggagtaatggggtactagaatcagacatgataatacccaaaagcctagcaggcccgatatctcaacataaccacagaccaggatatcacacgcaaactgcgggaccctggcatctcggaaaactagaattagactttaattattgtgagggaacgacggttgtcatcaccgaaaactgcggtacaagaggtccgagtttaaggacgacaacagtatcagggaaattaattcacgaatggtgttgcaggagctgcacactgcctccactgcgttacatgggagaagatggttgttggtacggtatggaaatacgccctatctcagaaaaagaagaaaatatggtaaaaagtttagtttcggcgggctccggaaaagtagataacttcacaatgggggttttatgtttagccatcctattcgaagaggtaatgaggggaaaattcggcaagaaacatatgattgctggagtatttttcaccttcgtattattattatcaggccaaattacatggagagacatggcacacaccctaataatgataggaagtaatgcgagtgataggatgggaatgggggtcacttatctcgctttaattgcaacattcaaaattcaaccgttcttagcgttagggtttttcttgagaaaactcacctcaagggagaatttgttgctgggagtaggtctagctatggcgacaactctgcagctacccgaagacatcgaacaaatggcgaacggcattgccttgggtcttatggccctaaaattaataacccagtttgagacttaccagctatggacggctttaatttcattgacctgctccaatacaattttcacactaacagtggcttggagaactgctacattaattctagctggggtaagtcttttaccagtatgccaaagttcatcaatgaggaagacagattggctaccaatggcagtagcagccatgggagtgcccccacttccattatttatattctcgttaaaagataccttaaaaagaagatcatggccactaaatgaaggggtcatggctgtaggacttgtaagtatactagccagctcactactaagaaatgatgttccgatggcgggaccgctagtggctggaggacttttaatagcttgttatgtgattacgggtacaagtgcagatttaacagtcgaaaaggcagctgatattacttgggaggaagaggccgaacaaaccggtgtaagtcataaccttatgatagccgtcgatgatgatggtaccatgagaataaaagatgatgaaacggagaacattctaacagtattactgaaaacagcacttctcattgtgagtggcatatttccatacagcataccagccaccttgctagtctggcacacatggcagaaacaaactcagaggtcaggtgtactttgggacgtgccgtctccacctgaaactcagaaagccgagttagaggaaggagtatatagaattaaacaacaaggaattttcgggaaaacacaggtaggcgtaggtgtacaaaaagaaggtgtctttcatactatgtggcatgtcacaagaggggcagtactaacatacaacggaaaaaggctcgaacccaattgggctagtgttaagaaagacctgataagctatggtggcggttggcgcttatcagctcagtggcaaaagggggaagaagttcaggtcatagcagttgaaccgggcaagaaccccaaaaactttcaaacaatgccaggcaccttccagacaacgacaggagaaattggggccatcgctctagatttcaagcccggaacttctgggagccctattatcaaccgagaaggtaaggtggtaggactctacggtaacggagtggtgactaagaacggtggttatgttagcgggatagcacaaactaatgccgagcccgatggaccaacaccagaattagaagaggaaatgtttaagaaacgaaatttgactattatggatcttcacccagggtcagggaaaacaaggaagtatctacctgcaatagtaagagaagcgataaagagaagattaaggacattaatactagctccaacaagagttgtggcagcagaaatggaagaggctttaaaaggattaccaattagataccaaacaacagcaacaaaaagcgaacatacaggacgcgaaatcgttgatttaatgtgccatgcgactttcacaatgaggctactatctccagttagagttcctaactataatttgataatcatggacgaagctcattttacagatcctgcaagtattgccgccagaggttatattagcacaagagtaggaatgggagaagccgccgcgatcttcatgactgcaacaccacccggtactgcagacgcattcccacaatcaaatgctcctatacaagatgaagaaagagacatccctgaacgatcgtggaactcaggcaatgaatggatcaccgattttgccggtaagacagtatggtttgtacctagcataaaagccggcaatgatattgctaattgcttaaggaaaaacgggaagaaagtcattcagcttagtagaaaaacttttgatacagaatatcagaagactaaactgaacgattgggacttcgtggtcactaccgacatctctgaaatgggggcgaattttaaagccgaccgagtaatagacccaagacgatgtcttaagcctgttattctgacggatggcccggaaagagttatattagcaggtccaatgccagtaaccgcagcatccgccgcacaaagaagaggtagagtggggagaaatccgcaaaaagagaatgaccagtatatttttacaggccaacctcttaataacgacgaagatcacgcgcattggacggaagcgaaaatgctattagacaacatcaacactccagaaggaataattccggctctatttgagccagaaagagaaaaatccgctgctatagatggtgaatatcgcctaaaaggagaaagccgaaaaacctttgttgaattgatgcggagaggggatttgcccgtatggctggcacacaaggttgcatcggaagggataaaatacacggatcgcaaatggtgctttgacggacagaggaacaatcagatcttagaagagaacatggacgtcgaaatttggactaaagaaggagagaagaagaaactacgaccacgatggctagatgcaagaacatactctgacccactggcactgaaagagttcaaagagttcgctgccggcagaaaaagtatagccctagacctcgtaactgaaattggacgcgtcccgagtcatttagcacataggactcgaaatgcactagataacttagtcatgttacacacatctgaacacggtgggcgagcatatagacacgcagtagaagagttgcccgagacaatggaaacgttattgctactaggacttatgatacttctaacaggaggggcaatgttattcctaattagcggaaaaggtatagggaaaacatctatcggcttgatatgtgtaattacatcgtccggaatgctatggatggcagaaattccactacaatggatagcgtctgcaatcgtattagaatttttcatgatggtcctcttgataccggaaccagagaagcaaaggactccacaagacaaccaattagcatatgttgtaataggcatattaacgcttgccgcaatcatagcggccaacgaaatgggattacttgaaacaaccaaaagagatctcggaatgtccaaagagccaggagttgtcagtccaacgagttatttagatgtcgatctccaccctgcatctgcatggacattatatgccgttgcaacaacggtgattacccccatgttacgtcacaccatagagaatagtacagcaaacgttagcttagcagcaatcgcaaatcaggcggtggtactaatggggctcgataaaggttggccgataagtaaaatggatctcggcgtaccgttactagccttgggatgctattctcaagtaaatccgttgaccttaacagcagcagtgctattgttgattacgcactatgctattatcggaccggggttgcaggccaaagcgacgagagaagctcagaaaagaacagcagctggtatcatgaagaaccctacagtggacggaattatgactattgatttagatccagttatatacgacagtaagttcgaaaaacaacttggacaagtcatgcttttagtgctgtgtgctgttcagttgttactcatgaggacttcgtgggctttatgtgaagcactcactctagcaacaggacccataacaactttatgggaaggtagcccagggaaattctggaatactactattgcagtaagtatggcaaatatttttagaggtagttatttagcaggagcaggcttggccttcagcataatgaaaagtgtaggcaccggcaaacgcggtacagggagtcaaggcgagaccctaggagaaaaatggaagaagaaactaaatcaattatctcgtaaagacttcgacctttataagaaatcaggcattactgaggtagacagaaccgaagcgaaagaaggtttaaaacgtggggaaataacgcatcatgccgtaagtcgggggagtgcaaaacttcaatggttcgttgagcgcaatatggttatcccagaaggacgcgtaatagacttaggatgcgggcgaggcggatggagttattattgcgccggcctgaagaaagtaaccgaagtaagaggatatacaaaaggagggcccggacatgaagaaccagttcctatgagtacttatggatggaacatagttaagttaatgtccggtaaagatgtcttctatttaccacccgagaaatgtgacactttgctatgcgatattggagagagttccccctcaccaactgtagaagaaagtaggacgattcgcgtattaaagatggttgaaccatggctaaagaataatcagttttgtattaaagttttaaatccttacatgcctacagtaatcgaacatttagaaaggttacagcgaaaacatggaggcatgttagtaagaaacccattatccaggaatagcacacatgaaatgtactggataagtaacgggactggtaatatagtggcaagtgttaacatggtttcaagactattacttaatcgtttcaccatgacgcacagacgcccgacaatagagaaggacgtggatctaggtgccggcacgagacatgtaaacgcggaacccgaaacgccaaatatggatgtcatcggagaacgtataaaacgcatcaaagaagaacataactctacatggcactatgatgacgaaaacccatacaaaacttgggcatatcatgggtcatatgaagtaaaggccacagggtcggcatcaagtatgattaacggagtagttaaacttttgactaaaccatgggacgtagttcctatggtaacgcaaatggcaatgacagacactacgccatttggccaacagagagtgtttaaagaaaaggtcgatacaagaaccccgagatccatgcctgggaccagaagagttatgggcataacggctgaatggctgtggagaacacttggaagaaacaaaaagccgagattatgtacccgcgaagagttcacgaagaaagtacgtactaatgcggcaatgggtgcagtatttacagaagaaaatcaatgggacagcgctaaagctgcagtagaagatgaagatttctggaaacttgtggaccgcgagcgagagctacataagctgggaaaatgtggaagctgtgtatataacatgatggggaaacgagaaaagaagctaggagaatttggaaaggccaaggggtcaagagccatttggtatatgtggctcggtgccagatacttagagttcgaagctctcggattcctaaacgaagatcactggttttcacgtgaaaactcatactcaggagttgaaggagaaggcctccataaactaggatacatacttagagacataagcaaaattccaggaggagcaatgtacgcagatgacaccgctggatgggatacacgaataaccgaagacgacctacataatgaggagaaaataacacagcaaatggatccagaacacaggcaattggctaatgccatattcaaactcacctatcaaaataaagtagttaaagtacaacgcccaacgccaaccggtacagttatggacataatttcaaggaaagatcaaagaggttcaggtcaggtaggaacatatggcttgaacacattcaccaacatggaagcacaactcataaggcaaatggaaggtgaaggagtgctaagtaaagctgatttagaaaatcctcatctaccagagaaaaagatcacacaatggctagaaacaaaaggtgtagaacgtcttaaaagaatggccatatcaggtgacgattgtgttgtaaaaccaattgatgacagattcgccaatgcattactagcactaaacgatatgggtaaggtccggaaagatataccgcaatggcaaccaagcaaaggctggcacgattggcaacaggtaccattctgttcccatcactttcacgaactaataatgaaagatggtaggaaattagtagtaccatgccgaccacaagacgagctaatcgggagagcaagaataagtcaaggagccggttggagtctaaaggaaactgcttgtttgggaaaagcatacgcgcagatgtggtcattaatgtatttccatcgaagagacctaaggttggcgagcaatgcaatatgttcggctgttccagtccactgggtgcccacaagtcgaacgacatggtctatacatgcgcaccaccaatggatgacgacagacgatatgctcacggtctggaacagggtctggatagaagataacccatggatggaagacaaaacacctgtaaccacttgggagaacgttccttatttaggaaagagagaagatcaatggtgtggctcattaataggtttaactagccgggctacttgggctcagaatattcccacagcaatccaacaagttaggagtttaattggaaatgaagagttcctagactatatgccaagcatgaagagatttaggaaagaggaagaatctgaaggtgcaatatggtaa

SEQ ID NO: 23194 - RNA, 9873 nt, synthetic construct
  misc_feature 1..9873: note = derived and/or modified CDS sequence (opt6) from DENV-3__HM181975__SS-prME
  source 1..9873: mol_type = other RNA
acaagcttatgtttaatgatgatccttccagcagcgttagcatttcatttaacgagtagagacggagaacctagaatgatagtaggaaaaaatgaaagaggaaagtcgcttttattcaaaacagcatccggtattaacatgtgcactttgatcgcaatggatctaggagaaatgtgcgacgatacagtgacatacaagtgtccccacataacagaggtagaaccagaagacatcgattgctggtgcaacctcacgtctacctgggtcacatatggcacttgcaatcaagctggcgaacatagacgtgataaaagaagcgtcgctcttgcaccgcacgttggaatgggattagataccaggacacaaacatggatgagcgccgaaggagcttggaggcaagtcgaaaaggtagagacatgggctctccgacatccaggatttactattcttgccttattcttagcgcattacatcggtacatcattaacacaaaaagtcgtaatctttgtattattaatgctcgtgactccttctatgacaatgaggtgtgttggagtagggaatagagattttgtagaaggactatccggtgccacctgggttgatgtagtccttgaacacggcggatgtgtgacaaccatggccaaaaataaaccaacgctggacatcgaattacagaaaactgaggcaactcaacttgccactttgagaaagctttgtatagaaggcaaaataacaaatatcacgacagatagtaggtgtccaactcaaggcgaagccacactcccagaggagcaggatcagaattatgtttgtaagcacacttatgtcgaccgaggttgggggaatggatgtggactatttggaaaaggatccttggtcacttgtgctaaattccaatgtttagagcctattgaaggaaaagtagtacaacatgaaaatttaaagtatacggttatcattaccgtacacacgggtgatcaacaccaggtcggaaatgagacgcaaggtgttactgcggaaataacaccacaagctagtacgactgaggccattctacctgagtatggtacactaggactcgagtgttccccgcgcacaggacttgattttaacgaaatgatattgctaaccatgaagaataaagcttggatggttcatcgacaatggtttttcgacttgccattaccgtggacctcaggtgcaaccacagaaaccccaacatggaacagaaaagaactcctagtaacattcaagaatgcacacgcaaaaaagcaagaggtagtggttctaggaagccaagagggagccatgcatacagcactgactggggctaccgaaatacaaaattcaggaggaacatcgatctttgccggacatctcaaatgcagactgaagatggataaactcgaattgaaaggaatgagttacgccatgtgtaccaacaccttcgtgttaaagaaagaagtaagtgaaactcaacatggaaccatacttattaaagttgaatacaaaggagaagatgtaccatgtaaaattccattctcaacagaagacggccaaggtaaggctcacaatggccgactcataacggctaatccagttgttacaaaaaaagaggaaccggtaaacatagaagcggagccccctttcggagaaagcaatatagtgataggaattggtgataacgcattgaagataaattggtataagaaggggtcatcaataggaaaaatgtttgaggcaaccgctaggggagccagaaggatggcaatcttaggcgatacagcatgggactttgggtctgttggaggcgtacttaactcgcttggtaaaatggttcatcagatatttgggtccgcttacacagcccttttttcaggggttagctgggtcatgaaaattggcataggagtcctcttaacgtggatcggtctaaactccaaaaacacgagcatgtcttttagttgtattgcaatcgggataataacattatatctaggggcggtagttcaggcagacatggggtgtgtaatcaactggaaaggaaaagaattaaaatgcggttccggaatattcgtaactaacgaagtgcacacatggacagaacagtacaaatttcaagcagatagtcctaaaagactagctacagccatagcgggagcatgggaaaatggcgtgtgtggtataagatctacaacgagaatggaaaatttgctctggaaacaaattgcgaatgaattaaactatatactatgggaaaacaatataaaacttaccgtagtagtcggtgatattataggcgtattggagcaaggtaaaaggacattaacaccgcaacctatggaattaaagtatagttggaagacatggggtaaagcaaaaatagtcacagcagagacgcaaaattcatcctttattatagacggcccaaacacacctgaatgtccaagcgtctctagagcatggaatgtttgggaagtagaagactacgggtttggagtctttacaaccaatatttggctgaaattgagggaagtctacactcagctatgcgatcatagattgatgtcagcagctgtaaaggacgagagagccgtacatgcagatatgggttattggattgagtcacaaaaaaatggatcgtggaaactcgagaaagctagcctaatagaagtcaaaacttgtacgtggccaaaatcccatacactatggtcaaatggagtgttagaaagcgatatgattattccaaaatcactagccggtccgatatctcaacacaatcataggccaggataccacacccaaaccgccggaccatggcacctaggaaaattggagctagatttcaactattgtgaagggacgaccgtagtaattactgagaactgcggtaccagaggacccagtctacgcacaactacggtttccggtaaattaattcatgaatggtgttgtcgtagctgtacactccctccactacgctatatgggcgaagatggctgttggtatggtatggaaatacgaccaataagcgagaaggaggagaatatggtcaagtcgctagtttcagctggaagtggtaaagtagataattttactatgggggtcctatgtttagcaatactttttgaagaagtgatgaggggaaaatttggaaaaaaacatatgatcgctggagtctttttcacgtttgttttactgttaagcggacaaatcacctggagggacatggctcatactctaataatgataggttcgaacgcatctgacaggatgggaatgggggtcacatacctagcgctaatagcaacattcaagatccaaccattcctagcactagggttttttttaagaaaactaacatcgagagaaaacttactattaggagtggggctagccatggcaacgactctgcaattgccggaagatatcgaacagatggcaaatggaatcgctttaggcctcatggctctcaaacttattacacaattcgaaatttaccaactttggaccgcattaatttccctcacatgctcgaacacgatttttacattgaccgtagcatggcgaacggctaccctaattttggctggagtatcattgttaccaatgtgccagtcgagtagtatgcgcaaaaccgattggttacctatggcagtggcggcaatgggagtcccaccattaccactgtttatattctcattaaaggacacattaaaaagaaggtcttggcccctgaatgaaggggtaatggcagtaggtttggtatcaattttagcttcctcattacttcgcaacgatgtacccatggcaggcccacttgttgccggaggattactgattgcgtgctacgtgataacaggtacatccgccgacttaaccgttgaaaaggcggccgacattacatgggaagaagaagctgaacaaacaggggtaagtcataatctaatgataacagttgacgacgatggaaccatgagaatcaaagatgacgagactgaaaatatccttacagtgctattaaaaactgctcttctaatagtaagcggaatatttccatacagtataccggcaaccttactagtgtggcatacctggcagaaacaaacgcaaaggtcgggtgtattgtgggatgtacccagtccccccgaaactcaaaaagcagagttagaagaaggggtatacagaataaagcaacagggaattttcggtaaaacacaggtaggagtaggagtacaaaaagaaggcgtatttcatacaatgtggcacgtgacgcgaggagctgtacttacatataatggcaaaagactagagcctaactgggcatcagtcaaaaaagacctaatctcatacggtggtgggtggagattatcagctcaatggcaaaagggtgaagaagttcaagtgattgcagtagaaccaggtaaaaaccctaaaaatttccaaaccatgccaggtactttccagacaacaactggggaaataggagctattgcacttgacttcaaacccgggacaagtggatcgcctataatcaatagagaagggaaagttgtgggattatacggaaacggggtagtaactaaaaatggtggatatgtgagtggtatagcccaaacaaacgcagagccagacggtccaacaccagaattggaggaagaaatgttcaaaaagcgtaatctaacaattatggacttacacccaggctcaggtaaaacacgaaagtaccttccagcgattgttcgagaagcaataaaaagaagacttagaacgcttattcttgctcccacccgagtggtagcagcagaaatggaagaagccttaaagggattacctattcgatatcaaacgacagctacaaagagtgaacataccggaagagaaattgtcgatttaatgtgtcatgcaacattcactatgaggttattgtcccccgttcgtgtaccaaactataatcttataataatggacgaagctcattttacagatcctgcgtctatagctgccaggggatatatcagcactagggtcggaatgggagaggcagcagcaatattcatgaccgcaactccacccggcacagccgatgcgtttccccaaagtaacgcaccaatacaagatgaagaaagagatataccggaacgtagttggaatagtggaaacgagtggataacggacttcgctggcaaaacggtatggtttgtaccctccataaaagcgggaaatgacattgcgaattgtctacgaaaaaatggaaagaaagtgatacagctgagccgaaagacattcgacactgaatatcaaaaaacaaaacttaacgactgggactttgtcgtgactacagacatatcagaaatgggagctaactttaaggctgatagagttattgatccacgtagatgtctgaagcctgtgatcctgacagatggtcccgagagagttattttagccggtccaatgccagtaacagccgcatccgcggctcaaagacgagggcgcgttggcagaaacccacagaaggaaaatgatcagtatatttttacaggtcaacccttaaataacgatgaggaccatgcacactggactgaagcaaaaatgttattagacaatattaatactccagaaggtataataccggcactatttgaaccagaaagagaaaaaagtgcagcaatagatggtgagtatagattaaaaggcgaatcacgcaaaaccttcgtcgaacttatgagaagaggagatctaccagtctggctagcacacaaagttgcgtcggagggaataaaatacacagaccgaaaatggtgttttgacggacaacgtaataaccaaatcctagaggaaaatatggacgtagaaatctggacaaaagaaggtgagaaaaagaagttaagacctagatggttggatgctagaacttattcagaccccttagccctgaaagaatttaaggagttcgccgctggccgtaaatctatagcgttagacttagtaactgaaataggtcgtgtcccatctcatcttgctcatcgaacaagaaatgctctcgataaccttgtgatgttgcatacaagcgagcatggcgggagagcgtatcggcatgctgtagaagagctgcccgaaactatggaaaccctgctacttttaggtttgatgattctcctgacgggaggagcgatgctttttttaatatcaggaaaaggaataggtaagacatcaataggactcatttgcgtaatagcttcatccggaatgctttggatggcagagatcccactacaatggatagcttcagcaatagttctagagttcttcatgatggtcctacttataccagaaccggaaaaacaaagaactccacaagataatcaattagcctatgtagttatcggcatcttaacattggcagcaataatagcagcaaatgagatgggcctcttggaaacaacaaaacgcgatctgggcatgtctaaagaacccggcgtcgtttcgccgacaagttatttagacgtcgacttgcatccagcaagcgcatggacgctatacgctgtagcgactactgtgatcacgccaatgctaaggcatacaattgaaaattcaactgcaaacgtgtcccttgctgcaatagcaaatcaagctgtagtactaatgggactagataaaggatggccaattagcaaaatggacctaggggtaccgttgctggctctgggctgttatagtcaagtaaatcccctaactctaactgcggcagttttgttattaataacgcattatgcaattatcggaccaggtctacaagcaaaggctactcgagaagcgcagaagcgaacagcagctgggattatgaaaaatccaacagttgatggaataatgacaatagatctggaccctgtgatatacgacagtaagttcgagaaacaattaggacaagtaatgctcttagttctatgtgtagtacaattattattaatgaggacaagctgggcactgtgtgaagcgttaaccttggcaacaggaccgattacaactttatgggaaggtagtcccggcaaattttggaacactactatcgcagtgtctatggctaacatattccgaggctcctatctagccggcgcgggcctggcgttttccataatgaaatcagttggaaccggtaaaagggggactggatcccaaggagagacgttgggtgaaaaatggaagaaaaaacttaatcaactaagcagaaaggatttcgatctatataaaaagagtggcataacggaggtagacagaaccgaagctaaagaaggattaaaacgaggagaaataacacatcacgctgtaagtagaggttccgccaaattacaatggttcgtggaaaggaatatggtgatccccgaaggaagggtaatcgatcttggttgcggaaggggcggttggtcatattactgtgcaggtctaaagaaagtaacagaggttagaggttatactaaaggtggacccggccacgaagagccagtacctatgtccacctatggatggaatatagttaaacttatgagtggcaaagatgtattttacttacctcctgaaaagtgcgacacactactttgtgatattggtgaatcaagcccatctccgacagttgaagaatcaaggaccatcagggttctaaaaatggttgaaccatggttaaaaaacaaccaattttgtataaaagtgctaaacccttatatgcccacagttatcgagcacttggaacggcttcagaggaaacacggaggaatgctagtacgcaaccccctttcccgcaacagcactcacgaaatgtattggatatctaatggcacgggtaacatcgtagcttctgtaaatatggtaagtagacttcttttaaatagattcacaatgattcacagaaggcctacaatagaaaaagacgtcgatttaggcgctggtactcgtcatgtgaatgcagagcctgagacaccaaatatggacgtaataggtgagcgaataaagagaataaaggaagagcataattctacatggcactatgacgacgagaatccgtacaaaacatgggcataccacggtagctatgaagttaaagcgacgggttcagcatcttcgatgataaatggagtggtaaagcttttgactaaaccctgggatgtagtacccatggtgacccaaatggcaatgaccgacaccacacctttcgggcaacaacgagtttttaaggagaaagttgatacacgaacaccaagatccatgcctggtactagacgagtaatgggtattacagcagaatggctatggagaactcttggccggaataaaaaacctagactatgtactagagaagaatttactaagaaagtaaggactaatgccgcaatgggcgcggtgttcactgaagagaaccaatgggatagtgccaaagctgcagtagaggatgaagacttttggaaactcgtagaccgagaacgcgaattgcacaagttaggtaagtgtggcagttgcgtttataatatgatggggaaaagagaaaagaaattaggggaatttgggaaagccaaaggtagccgagccatatggtatatgtggctgggtgccagatacttggaatttgaggcactaggctttttaaacgaagatcattggttttccagagaaaacagttactcaggtgttgaaggggagggactacataagcttggatatatacttagagacattagtaaaatcccaggaggggcaatgtacgcagatgatacggccggatgggacacccgtattacggaagatgacttacacaatgaagaaaaaataacacagcaaatggatcccgaacataggcaacttgcgaatgccatttttaaactaacttatcaaaacaaagtagtgaaagttcaacgcccgacacctacaggtacggtaatggacattatatcccgaaaagatcaaagaggatccggacaagttggaacatatggactcaatacttttactaacatggaagcacaattgatccgccaaatggaaggagaaggtgttctaagcaaagcggatcttgagaatccacacttacctgaaaaaaaaatcactcaatggttagaaacaaagggagtggaaaggttaaaacgtatggccatatctggagacgactgcgtcgtcaagccaattgacgatcgtttcgccaatgcattattagccctcaatgatatgggaaaagtcagaaaggacattccacaatggcagccgtcaaaaggatggcacgactggcagcaggttcctttttgttcacatcactttcatgaacttatcatgaaagatggccggaaactagtcgttccatgtaggccacaagatgaactaataggtcgggcgcgcatatctcaaggggcaggatggtcattaaaagaaacggcctgtttaggaaaagcttatgcacagatgtggtccctaatgtatttccatagacgagacctccgtttagcctcaaacgcaatctgcagcgctgtaccagtacattgggtacccacttctagaacaacatggtcaatacatgcccatcatcaatggatgacgactgaggacatgctcacagtatggaatagagtgtggatagaagataacccttggatggaagacaaaacacccgttacaacatgggaaaacgtgccgtacctagggaagagagaagatcaatggtgtggttccttaattgggttaacgagtcgtgctacatgggcccagaatattcctacagcaatacagcaagtgcgaagcttaatcggtaacgaagaatttctggattatatgccctcaatgaaacgattcagaaaagaggaggagagtgaaggggctatatggtga

SEQ ID NO: 23195 - RNA, 9873 nt, synthetic construct
  misc_feature 1..9873: note = derived and/or modified CDS sequence (opt6) from DENV-3__HM631864__SS-prME
  source 1..9873: mol_type = other RNA
acgagcttatgtctcatgatgatattgcctgctgcactcgcatttcatctaacaagtcgagatggagaacccagaatgatcgtaggtaaaaacgaaaggggaaaatcacttctttttaaaacagcaagtggaataaatatgtgtaccctaatagcaatggatctgggtgaaatgtgtgacgacacagtaacctataaatgtccacacattacggaagttgaacctgaagacatcgactgttggtgtaatctaacctcaacttgggtgacatacggaacgtgtaatcaagccggcgaacatagaagggataaaagaagtgttgcattagctccacatgtcggaatgggattggatactaggacgcaaacatggatgagtgcggaaggcgcatggcgacaagtcgaaaaagtggaaacgtgggccttaaggcacccgggttttacgatcttggcactatttttagcacactacataggtacatccctcacgcaaaaagttgtgatctttattttattgatgttagtgacaccgtccatgactatgcgttgcgtgggagtaggaaatagagattttgtcgaaggattgagtggggccacttgggtagacgtagtactagaacatggagggtgtgtcacgacaatggccaaaaataaacctactcttgacatagaattacagaaaacagaagcaacacaacttgccacacttaggaaactttgtattgaagggaaaattacaaatataactacggatagtcgttgtccaacccaaggggaagcaaccttacccgaagaacaagaccaaaattatgtctgtaaacatacctatgttgacagaggatgggggaatggatgtggtctatttggaaaaggttcacttgttacctgtgctaaatttcaatgcctggaaccaatagaaggaaaagtagttcaatacgaaaacctgaaatacacggtaataataacagtccatactggagatcaacatcaagtgggaaatgaaacacaaggagtgacagctgaaataacgccccaagcatcaactacagaagctatattaccagaatacggtacgctggggttggaatgttcgcctagaaccggtttagattttaacgaaatgattttgcttacaatgaaaaataaagcatggatggtgcatagacaatggttctttgacctaccattaccttggacatcgggagcgactactgagaccccaacatggaatcgtaaagaattgcttgttacatttaaaaacgctcacgccaagaaacaagaagtagtggttctaggatcccaagagggagccatgcatacagctcttacaggggcaacagaaatccaaaactcaggaggaacttcaatattcgcaggtcacttaaaatgcaggctaaaaatggacaagctcgaattgaaaggaatgtcgtacgctatgtgcaccaataccttcgtactcaagaaagaggtaagtgagacgcaacatggtactatactaatcaaagtagagtataaaggagaagatgttccatgcaaaatacctttctcaacagaagatgggcaaggcaaagcccataatggacggttgataacagcaaacccagtagttactaagaaagaagaacctgtgaacattgaagcggaaccaccatttggagaatcaaatattgtcattgggattggtgacaatgccctaaaaataaactggtataaaaagggatcctcaatagggaaaatgtttgaagcaacagcacgtggtgcgagaaggatggcaattttaggtgatacggcatgggatttcggatcagtaggaggtgtattaaactcgctaggtaaaatggtgcatcagatatttggttccgcttacaccgctttattttctggtgtttcctgggtaatgaaaattggtatcggtgtattgctgacatggataggacttaactctaaaaatacctcaatgtccttcagctgtatcgcaatcggaattataacactatatcttggtgcggttgtgcaagcagacatggggtgtgtcataaattggaaaggaaaagaactgaaatgcgggtctggaatatttgtcaccaatgaagtacacacgtggacagaacaatataaattccaggcagattcacccaagcgcctagcaactgctatagcaggagcgtgggaaaatggggtttgtggaatccgctccactacaagaatggaaaacctattatggaaacaaatagcaaatgaactcaattacatcttatgggagaataatataaaattaacagttgtagtaggagatataataggagttctagaacagggaaaacggactttgacaccccaacctatggaactaaaatatagttggaaaacttggggcaaagcgaaaattgtaacggctgaaacacagaacagttctttcatcatagatggaccgaataccccagaatgtccaagtgtgtctagagcgtggaatgtatgggaagtagaagactacggcttcggcgtgttcacaactaatatttggttaaaactacgagaggtttacactcaactgtgcgatcatagattaatgtcagcagcggttaaggacgagaaagcagtccatgcagatatggggtattggattgaaagccagaagaacggaagttggaaattagagaaagcctctctaatagaagtaaagacatgtacatggcccaaatcacatacattatggtcaaatggcgttttagaaagtgacatgataatcccaaaatctctcgccggaccaataagtcaacacaatcacagaccagggtatcatacgcagacagcaggaccgtggcatctcggcaagctcgaattggactttaactattgcgaaggaacaacggtagttattaccgaaaactgcggcacaagaggtccttcactacgtactaccaccgtgtcaggaaaattaatacatgaatggtgctgtagatcgtgcactctacccccactccgatatatgggggaggatggttgttggtacgggatggaaatcagaccaataagcgagaaggaagaaaatatggtgaaaagtctcgtttccgccggatctggtaaggttgataatagtacaatgggagtcttatgtttggcaattttgttcgaagaagtcatgcgtgggaaatttggtaagaaacatatgatagccggcgtgttctttacattcgtgttgctcttaagtggccaaattacatggcgcgatatggctcatacattaataatgatagggtcaaatgcatctgataggatgggcatgggagtgacctacctcgcactgatagcgacgttcaagattcaaccgttccttgcgctaggtttcttcctacgaaaactaacaagtagagaaaatttacttctaggggttggtctggctatggcaactacattgcaacttcctgaagatattgagcagatggctaatgggatagccctcggattgatggctttgaaactaataactcagttcgagacataccaactatggactgcgcttatttcacttacttgttcaaacacaattttcacacttactgtagcttggcgaaccgcaacgttgatacttgctggcgttagcttattaccagtatgtcagtcatcgagtatgagaaaaacagattggcttccaatggctgtagcagcgatgggcgtgcctccgttgccgttgtttatcttttcattaaaggatacacttaagaggcgaagttggccgttaaatgaaggcgtgatggcagtcggactcgtttctatactagcctcatcactgctgcgtaatgacgttcctatggcagggcccctagtagctggaggcttacttatcgcgtgttacgtaataacaggtacatctgcagatcttaccgtggaaaaagctgcagatattacctgggaggaagaagctgaacaaacgggtgtctcacataacttgatgattgctgtcgatgatgacggcacaatgaggataaaagatgatgaaactgaaaacattctaactgttctcctcaagaccgcattattaattgtgagcggcatttttccatattccattccggcaacccttttggtttggcatacgtggcaaaaacaaacgcaaagatctggtgtattatgggacgtcccatcaccccctgaaacccaaaaagcagaattggaggagggtgtatatagaattaagcaacaaggtatttttggcaaaacccaagtgggtgtcggggtacaaaaggagggagtttttcacaccatgtggcatgtcacgcgtggagcagtcttgacatataatgggaaaaggcttgaaccaaattgggcttccgttaagaaagatctgatcagttatgggggtggttggcgactaagtgctcaatggcaaaaaggagaagaagttcaagttatcgcagtcgaaccgggcaaaaatccaaagaacttccagacaatgcctgggactttccagacaactacgggtgaaataggtgcgattgcgctagattttaaaccaggtacaagtggaagtccaattattaatagggaggggaaggttgtgggactatatggcaatggagtagttacaaagaatggagggtacgtaagcggtatagcgcaaacaaatgcagaaccagatggaccaacccctgagctggaggaagaaatgtttaaaaagaggaatcttacaataatggatttacaccctggctcgggcaagaccagaaaatacttgccagccatcgtcagagaggctattaagagacgactgagaaccctcatattagctcccaccagggtagtggcagcagagatggaagaagcattaaaagggttgcccatcagatatcaaacaactgcgactaaatctgaacacactggtcgggaaattgttgatctcatgtgccatgctactttcaccatgagattattgtcgccggtacgagtcccgaattacaaccttataataatggatgaagcacactttaccgatccagcatcaatcgcggctcgaggctacatctcaacaagagtaggtatgggagaagccgctgcaatatttatgacagccacgccacctgggaccgctgatgccttccctcaaagcaacgcacccattcaagacgaggaacgcgacataccagaacgttcgtggaactcggggaacgaatggattactgacttcgcaggaaaaactgtttggtttgtcccatcaataaaagcagggaatgacattgcaaactgtctcaggaaaaatggtaagaaagtcatacaattatcaagaaagacctttgatactgaataccagaaaacaaagctaaacgattgggattttgtagtcacaacggatataagtgaaatgggtgcaaatttcaaagcagaccgcgttattgatccacgtcgatgtctaaaacctgtaatactaacagacgggcctgaaagagtcatacttgctggaccaatgcccgttacggcagcgagcgctgctcagcggcggggcagggtgggaagaaatcctcaaaaagaaaatgatcaatatatattcacaggccaaccactaaataatgacgaagatcatgcacattggacggaagcaaaaatgctcctagacaatattaatacaccagagggaattataccggcactatttgagccggaaagagaaaaatcggcggccattgatggtgaataccggttaaagggagaaagtcgaaaaacatttgttgaattaatgagaagaggtgatttacccgtctggttagcacataaagtcgcctcagaaggaatcaagtataccgatcgaaagtggtgttttgatggtcaacgtaataatcaaattttagaagaaaatatggatgtagaaatatggacgaaagagggagagaagaagaaactccgaccaaggtggttagacgctagaacatattccgatccgctagctcttaaggagttcaaggagttcgccgcgggaagaaaatcgatagcattagacttagtaactgaaataggacgagtgccttcgcatctcgcgcacagaactaggaatgcgttggataatctcgttatgcttcatacttcagaacatggaggtagggcttatagacatgcagtggaagaactacctgaaactatggagacacttcttttgttgggactcatgattctactaactggaggagctatgctatttttgataagcggaaaagggataggaaagacatccataggacttatatgtgtaatcgcttcatctgggatgctatggatggcggaaatcccattacaatggatagcaagcgccatagtcctagaatttttcatgatggttttattgataccggaaccagaaaagcaacgcacacctcaagacaaccaattagcatacgtcgttattggaatactcacattagccgcagtgattgcagctaatgaaatggggctattagagactacaaagagagatttgggcatgtcaaaagaaccgggggtcgtaagtccaacttcatatctggacgtcgatctacaccccgctagtgcatggaccttatatgcagtggctacaacggtaataacacccatgcttaggcacacaattgaaaactcaacggctaatgtctctttagcagccatcgcaaaccaagctgtggtgctgatgggactagataaaggatggccaatatcaaagatggatctaggagtcccgctgctcgctctagggtgttatagtcaggttaatcctttaacgttaaccgcagctgtcctattgctaattacccactatgcgattataggcccgggcttgcaagctaaagcaactcgagaagcccaaaaacgaacagcagcaggaataatgaagaacccaactgtggacggaataatgactatagacttagatccagttatctacgacagcaagtttgaaaagcagctcggtcaggtaatgctacttgtcctttgcgctgttcaactattgcttatgagaacctcctgggctttatgcgaggcattaacattagcgaccggacctataacaactttatgggagggcagtccaggtaagttttggaacacaacaattgccgtctcaatggcgaatatctttcgaggaagttatctcgccggagctggactcgcctttagtattatgaaatcagtaggaaccggtaaaagaggtaccggatcacaaggcgaaacattaggagaaaaatggaagaagaaattaaaccaacttagtaggaaagacttcgatttatacaagaaatctggaatcaccgaagtcgataggacagaagctaaagagggactaaaacgtggagagatcacccatcatgcagtgagccgaggttcagcaaaattgcaatggtttgtggagagaaatatggtaataccggagggaagagtaatagacttaggttgtggtcgtggaggatggtcatattactgtgctggcctaaagaaggttacagaggttagaggatatacaaaaggaggcccaggacacgaagaacctgtgccaatgagcacatatggttggaacatagtcaaattaatgtcaggtaaagacgtattttatctaccaccagaaaaatgcgatacgcttttgtgcgacataggagaatcgagccctagtcctacagtagaagaatcgcggacgatcagagtcttaaagatggtagaaccctggctcaaaaacaaccagttttgtatcaaggtcctaaatccatatatgccgactgtcatagaacacttggaaagattacagcggaagcatggaggcatgctcgtgaggaatcctctctccagaaatagtacgcatgagatgtattggatctcgaacggtaccggcaacattgttgcttccgtaaatatggtatctcgtttgttgcttaacaggttcacaatgacccatagaagaccaacgattgaaaaagacgtagatttaggagctggaacgaggcatgtaaatgcagagcctgagactcccaacatggacgttattggagagagaattaaaagaataaaagaagaacataactcgacatggcactacgatgatgagaacccatataagacatgggcatatcacggctcttatgaggtgaaagcaacaggtagtgctagcagtatgatcaatggtgtagttaagttattaaccaaaccttgggatgtagtcccaatggtaacgcaaatggcaatgacagacacaacgccttttggtcaacaacgcgtatttaaagaaaaagtcgacacaagaacaccaaggtcaatgccaggtacacgtcgagttatgggaattactgcagagtggttatggcgtactctagggaggaataagaaaccacgactttgtacaagagaagagttcaccaagaaagtacgtaccaacgcagctatgggagccgtatttaccgaggagaaccaatgggactcggccaaagctgctgtagaagatgaagatttttggaaacttgtggatcgcgaaagggaattacacaaactgggtaagtgcggctcttgtgtatataacatgatgggaaaacgcgaaaagaagctgggagaatttgggaaagccaaggggtccagagcaatatggtatatgtggcttggagctagatacttagagttcgaggcactcggatttttaaatgaagaccattggtttagcagagaaaatagttatagtggcgtcgaaggggaaggtttgcataaactcggatatatattgcgagacatcagtaaaatacctggaggggcaatgtatgcggacgacacagcaggatgggacacgaggatcacagaggatgacttgcacaacgaggagaaaattacacaacaaatggacccagagcataggcagttagccaatgcaatatttaaactcacttaccaaaataaagtcgtaaaggtgcaacgaccaacgccaacaggaaccgtaatggacataatcagtagaaaagatcagaggggatcaggacaagtaggaacatatggcttaaatacgttcacgaatatggaagctcaattaattagacaaatggagggcgaaggagtgctaagtaaggctgatttggaaaacccacaccttccggagaaaaagataacacagtggctagagaccaaaggcgttgaaagactgaaaagaatggctatttcaggggacgattgcgttgtaaaacctatagatgatagattcgctaatgcactactagcacttaacgacatgggtaaagtacgaaaggatatacctcagtggcaaccctctaaaggctggcatgactggcaacaagttccattttgtagtcatcacttccatgaactaattatgaaggatggtagaaagttagtggtaccttgtcgacctcaggatgagctgataggtagggctaggattagtcaaggagctggctggtcgctcaaagaaacggcatgcctgggcaaagcctatgcgcaaatgtggagtctaatgtattttcaccgccgtgatttgagattagcaagcaatgccatctgttcagccgtaccagtacattgggtacccacaagtagaacaacatggagtatacatgctcatcatcagtggatgacaactgatgacatgttaacagtatggaatagggtatggatcgaggataacccatggatggaggataaaactccagtaactacttgggaaaatgtaccttacctgggaaagagagaagaccaatggtgtggttcattaatagggttaacatccagagcgacgtgggctcaaaacatcccaacagcaatccagcaagttcggagccttattggcaatgaagagttcttagattatatgccaagcatgaagcgttttcgaaaagaagaagaaagcgaaggagccatctggtga

SEQ ID NO: 23196 - RNA, 9873 nt, synthetic construct
  misc_feature 1..9873: note = derived and/or modified CDS sequence (opt6) from DENV-3__HM631859__SS-prME
  source 1..9873: mol_type = other RNA
accagtctttgcttgatgatgatacttcctgcagcactggcgtttcaccttacatcaagagatggagaaccgcgcatgatagtcggtaaaaatgaacgaggtaaatcgctactgtttaaaacggcttctggaataaatatgtgtacgttaattgcgatggacttaggggaaatgtgtgatgataccgttacatacaaatgtcctcatataacagaagttgagccagaagacatagattgttggtgtaacttaacaagcacatgggtcacatatggtacatgtaaccaagcaggagaacatcgtcgagataaacgtagcgtggcgcttgctcctcatgtgggaatgggactggatacccggacccaaacttggatgtccgcggagggggcatggcgccaagtcgagaaagtcgaaacatgggcactacgacatcccggttttacaatactcgcattatttctagcacattacataggaacctcgttaacgcaaaaagtggtgatctttatcttgttgatgcttgtcactccgagtatgacaatgcgttgtgttggtgtaggaaaccgggatttcgttgaaggactaagtggagcaacatgggtggatgtggtactggaacacggagggtgcgttaccaccatggccaaaaataaacccacattggatatagaactccagaaaactgaagccacacaacttgctactcttagaaaactttgtatagaaggaaaaattacgaatattacaactgacagcagatgtcctactcaaggagaagctacccttcctgaagaacaagaccaaaattacgtgtgtaaacatacatatgtggaccgaggttggggaaatggatgtgggttgttcgggaaagggagtttagttacttgtgccaaattccaatgtctagaacctatagaaggcaaagttgtacaacatgaaaacctaaaatataccgttattataacggtacatacaggggatcaacaccaagtaggaaacgaaacgcagggagtaactgctgagataactccacaggcttcaaccactgaagccattttaccggaatatggcacattaggactggagtgttctccacgcacaggcctcgatttcaatgaaatgatattgctaactatgaaaaacaaagcatggatggttcatcgccaatggttctttgatcttccgttaccgtggacaagtggtgcaaccactgagactcctacatggaacagaaaagaattattagtcacatttaaaaatgctcatgctaagaaacaggaggttgtagttttaggcagtcaagaaggggcaatgcataccgctctaactggagcaacggagatccaaaattctggtgggacaagtatatttgcaggacacttgaaatgccgtctgaaaatggataaattagaattaaaaggaatgtcctacgctatgtgtacaaacacgtttgtgttaaagaaagaagtcagtgaaacacaacatggaacaattttaattaaagtagaatataaaggagaagatgttccttgtaaaattcctttctcaacagaagacggtcaaggcaaagcccataacggcaggttgataacagcgaatccggtagttactaagaaagaagaaccagtgaacatagaagctgaaccaccttttggcgaatcaaatatagttattggaattggcgacaatgcattaaagattaactggtacaagaagggtagctccatcggaaaaatgtttgaagctactgccaggggcgcaagaagaatggcgatactaggggacactgcgtgggatttcggttcagttggtggtgtattaaattcgttaggcaaaatggttcatcaaatattcggtagtgcatatacagcattattcagtggagtctcatgggttatgaaaattggcattggagtcctcttaacctggattggactgaactccaaaaacacttctatgtcttttagttgtattgcaataggaatcattacgctctatttaggagcggtagttcaggcggatatgggatgcgtaattaattggaagggcaaagaacttaagtgtggaagcggcatattcgtgacgaatgaagtacacacatggacagaacagtacaagttccaagcagattcacctaaaaggcttgcaaccgctatcgccggtgcttgggagaatggcgtttgtgggatacgttcaaccactcgtatggagaacttattatggaaacaaatagcaaacgagctaaactacatattatgggagaataatataaagttaaccgtagtggtcggcgatatcattggagtgctcgagcaaggcaagcgcacactgactccccaacctatggaattaaagtacagttggaagacatgggggaaagcaaaaatagtaactgctgagacccaaaattcatcgttcataatagacggacccaatacaccggaatgcccatcggtatctagagcttggaatgtgtgggaggttgaagactatgggtttggggtattcactaccaatatatggcttaaattaagagaggtatacactcaactttgtgaccacagactaatgagtgctgcggtcaaagatgaacgtgctgtgcacgcggacatgggatactggatagagtcacaaaagaacggatcttggaaactagaaaaagcctcacttatagaagttaagacatgcacatggccaaagagccacacactgtggtcgaatggtgtccttgaatcagatatgataataccaaaatccttagcaggcccaatttcgcaacataatcatagaccgggctatcatactcagactgccggcccttggcatctaggaaaattagaattagatttcaactactgtgaaggcacaacagtcgtaattacagagaattgtggaacgaggggtccttctcttcgtactactactgtttcgggtaaacttatacatgaatggtgctgtagatcttgtacactcccgccactaagatatatgggagaggatgggtgttggtatgggatggagataagaccaatatctgaaaaagaagaaaatatggtgaaatctctcgtatccgcaggttcaggaaaggtagataacttcactatgggtgtgttgtgcctagcaattttatttgaagaagtcatgagaggcaaatttggcaagaaacatatgatagctggtgtattctttacattcgtcttactattaagtggacaaatcacttggagagacatggcacacaccttaataatgattggtagtaatgcaagcgaccgtatgggaatgggtgtcacctacctagctttaattgctacattcaaaatacaaccctttttagcattaggcttctttcttcgtaaattgacatctagagagaatcttttattaggtgtcgggttggctatggcaaccaccctacagctaccagaagacattgagcaaatggcaaacggtattgcactgggattgatggcactgaagttgataacgcaatttgagatataccaactctggacagcactaataagccttacttgttcaaacaccatatttactttaacagttgcctggaggacggcaaccttaattctagcgggggtatctttactgcctatgtgccaatcgtccagcatgagaaaaacagactggctcccaatggcagttgcagctatgggagtaccacctttgccattatttatattcagtttaaaagatacattaaaacgaagaagttggccccttaacgaaggagtaatggcagtaggtctagtatcgattttggcatcatccttactaagaaatgatgtaccaatggcgggtcctttagtggctggagggttattaatagcgtgctatgttatcacaggaaccagtgcagacctaactgtggaaaaggcggctgatatcacatgggaagaggaagcagaacaaacaggtgtgtcacacaaccttatgattactgttgacgacgacggtactatgcgtattaaagatgatgaaaccgaaaatattcttacagtattacttaaaacagcactccttatagtgagcggtatatttccatattcgataccggcaacgctattagtatggcatacctggcaaaaacaaactcagagatcaggggtactttgggatgtccctagtccaccggaaacgcaaaaggcagaattagaagaaggggtgtaccgaattaaacagcaggggatcttcggaaaaacacaggtgggcgtaggagtacaaaaagaaggagtttttcacaccatgtggcacgttacgaggggagctgttcttacatataacggaaaacgattagagccgaattgggcaagtgtaaagaaggatctaatttcatatggtggaggttggcgtctttctgcacaatggcaaaaaggagaagaagttcaggtaattgctgttgagcctggtaaaaatcctaagaacttccagacaatgcctggaacgtttcaaacaacaacaggtgagattggtgccatagccctcgattttaaaccgggtacgagcggatcaccaattattaatagagaaggaaaagttgtagggttatatggcaatggtgtagtcacgaagaatggaggatatgtgtccggtatagcccaaacaaatgcagaacccgatggaccaacaccagaactagaagaggaaatgtttaagaaacgaaatttaacaataatggacctacaccccgggtcaggtaaaaccagaaaatacctaccagctatagttagagaggcaataaaacgtagacttaggactctgatacttgcgccgacaagggttgtcgcagctgaaatggaggaggctttaaagggtttaccaataagatatcaaacaactgcaacaaagagtgaacataccggtagggaaatagtggacctgatgtgtcacgcaacttttactatgagacttttatctcctgtgagagtccctaactataacttaataattatggacgaagcgcattttactgatccagcatctatcgcagcgagaggatacataagtactcgtgtgggcatgggtgaagcggccgcgatatttatgactgccacaccccctgggacagccgacgcatttcctcaatccaatgcacctattcaagatgaagaacgcgatatacccgagcgatcttggaactctggaaacgagtggataaccgactttgcgggtaaaacagtgtggtttgttccctcgataaaagccggtaatgacattgccaattgtttaaggaaaaacggcaagaaggtaattcaattatcaaggaagaccttcgatactgagtatcagaaaaccaaactaaatgactgggactttgtagttactacagatataagcgaaatgggagctaattttaaagctgatcgagttatagatcctaggagatgtttaaaaccagtaatattaacggacggtcccgagcgtgtaatactagcagggcctatgccagtaaccgcagctagcgctgcacaacgtaggggacgagtaggcagaaatccccaaaaagagaatgaccagtacatttttactgggcaacctctaaataacgatgaagaccacgcacattggacagaggcaaaaatgttattagacaatatcaacacacccgagggcataataccagcattatttgaacccgagcgggagaaaagcgctgctatcgacggggaataccgacttaaaggcgaaagtagaaaaacatttgtagaattaatgagaaggggagatctcccagtatggttggcacacaaggtagcaagtgaaggaattaaatatactgatcgtaaatggtgcttcgatggacaacgaaataatcagattcttgaagaaaacatggatgttgaaatttggacgaaagagggggagaagaagaaactaaggccgagatggttggacgcacgcacatatagcgatccactagctttaaaggagttcaaagaatttgcggcaggaaggaagtctatcgctttagatttagtgactgaaatagggcgcgtaccatcacacctagcacacagaactagaaatgcattggacaatttagttatgctacatacctcagaacatggcggcagagcataccgacatgctgtagaggaattaccagaaacaatggaaacattattgttactcggtttgatgatcttacttactggaggagcgatgttattcttaataagtggaaaggggattggcaaaacttcaatcggtcttatctgcgttatagcgtctagtggtatgttgtggatggcagaaatccctctccaatggatagcatcggcaattgtactagagttctttatgatggtattattaatcccagaaccggaaaaacaaaggacacctcaagacaaccaactagcatacgttgtcatcggtatactgactcttgccgcaataatagccgctaacgaaatgggtttattggaaaccacgaaaagagatctaggaatgtccaaggaaccaggagtggtgtcccccacttcatatttagacgtggacttgcaccctgccagcgcttggaccttatatgccgtagccacgacagtaataaccccaatgttgcgacataccatcgagaacagtaccgcgaatgttagcctagccgcgattgctaatcaagctgtcgtattaatgggtctggataaagggtggcctatcagtaaaatggatcttggggtacccctgttggctctaggatgttattcacaagtcaatccactaactctaactgctgcggtacttcttctaataacacattatgctatcattggaccaggactgcaagcaaaagcaacacgagaagcccagaaaaggactgcagctggcataatgaaaaatccgaccgtggatggaatcatgacaatcgatctggatccagtcatatatgacagcaagtttgaaaaacaactaggtcaagtaatgctgttagtactatgcgttgtacaactcctattgatgcggactagctgggccttgtgcgaagccctaacattagccactggccctataactacattatgggaaggatcaccaggaaaattctggaatacaactatagcagtcagtatggcaaatatctttcgagggtcgtacttagcgggggccggtctggccttctcaatcatgaaatctgtcggaactggtaaaagagggaccggttcacaaggagaaaccttaggagaaaaatggaagaagaaacttaatcagctaagcagaaaagatttcgacctatataagaaatctggcattactgaagttgacagaaccgaggcaaaagaaggattaaaacgaggtgaaattacacaccatgccgtatctagaggttctgccaaattacaatggttcgtggagcgaaatatggtgatacccgaaggaagagtaatcgatttaggatgcggtcgtgggggctggagttactattgcgccggtctaaagaaagtgacagaagtacgggggtataccaaaggcgggcccggtcacgaagaaccggtgcccatgagcacatacgggtggaatatcgtaaagctgatgagtggaaaagatgtattttatttgcctccagaaaaatgcgatacacttttatgcgatataggcgaaagctcgccttcaccaaccgttgaagagtcgagaactatcagagtcttaaagatggtagaaccttggctaaagaataatcaattttgcattaaagtactaaacccttacatgcctactgttattgagcaccttgaaaggttacaaagaaaacatggtggaatgctagttaggaatccattgagtagaaactccacgcacgagatgtactggatctcaaacggaaccggaaacatcgtggccagtgtaaatatggtatcaagactattgttaaatagattcacaatgacacatcgaaggccgacgatagaaaaagatgtagacttaggcgcaggcacacgccatgtaaatgcagaacccgagacgcccaatatggatgtaataggagaaaggataaaaagaataaaagaggaacataactctacatggcattatgatgacgaaaatccatacaagacatgggcatatcacggttcatatgaggtaaaggctactggatcggcatcgagcatgataaatggagtagttaaactacttaccaaaccttgggatgttgtccctatggttacgcaaatggctatgacagatacaactcctttcggacaacaaagagtatttaaggaaaaggttgatacaagaacacctagatcaatgccaggtactagaagagtaatgggaattacggctgaatggttatggagaacactaggtagaaataagaaacctcggttgtgcactcgagaggaatttactaagaaagtgagaactaacgctgcaatgggtgcggtatttacagaagagaatcaatgggatagtgctaaagcagccgttgaagatgaagatttttggcgattagttgaccgggaaagagaattacacaaactaggtaaatgcgggagttgtgtctacaacatgatgggcaaaagagagaagaaattaggagagttcggaaaagctaaaggttctagggcgatatggtatatgtggttgggcgctagatacctagaatttgaggctttaggattcctcaatgaagatcattggttcagtagagaaaattcatattcaggtgttgaaggagagggcctacacaaattaggatatattttacgcgacattagcaaaataccgggaggagccatgtatgctgacgataccgcaggatgggacacccggataacagaagacgacctacacaatgaggagaaaattacgcaacaaatggatccagaacaccgacagctggcaaacgcaatatttaagctaacataccagaataaggtagtaaaggttcaacgacctacacctactggcacagttatggatataatatcaagaaaagatcaacgaggctcgggccaagttggaacctatggattaaacacgtttacaaatatggaagcacaattgataaggcaaatggaaggagaaggagtactgtcaaaagctgaccttgaaaatccacaccttcccgagaagaagataacacagtggttagaaacgaaaggagtagaaagattaaaacgaatggcgatatcaggagacgattgcgttgtaaaaccaatagacgaccgatttgcaaatgcactattagcattaaacgacatgggaaaggtgcgcaaggatataccacagtggcagccctcaaaggggtggcacgattggcaacaggttcctttttgctcacatcactttcacgaactaataatgaaggatggccggaagctagtagtaccctgtcgaccccaagacgaattaattggtcgtgcccgaatatcgcaaggggcgggttggagtctaaaggaaaccgcttgtttaggaaaggcttatgcacaaatgtggtccctcatgtacttccatagacgggatctgaggctagctagtaatgcaatttgctcggcagtacccgttcactgggttccgacatccagaacaacttggagcatccatgcacatcaccaatggatgactacggaagacatgcttaccgtatggaatagagtatggattgaagacaacccttggatggaggacaagacacctgtaactacctgggagaatgtaccatatttaggtaaaagggaagaccaatggtgtggttcccttatcggcctaacaagcagagcgacgtgggcacaaaatataccaacagcaattcaacaggttagatcattaataggtaacgaagaatttctagactacatgcctagtatgaagagattccggaaggaggaagagagtgaaggagccatatggtaa

SEQ ID NO: 23197 - RNA, 9870 nt, synthetic construct
  misc_feature 1..9870: note = derived and/or modified CDS sequence (opt6) from DENV-3__HM631856__SS-prME
  source 1..9870: mol_type = other RNA
acctcactctgcctgatgatgatattgccagctgcactcgcatttcaccttacatcacgagacggcgaaccacggatgattgtgggcaaaaatgaacgaggaaaatcgttactgttcaaaacagcatcaggaattaatatgtgcacgctcatagcaatggatttaggagaaatgtgtgatgatacagtcacttacaaatgtccacacataactgaagtggaacccgaagatatcgactgttggtgcaatttaacatccacctgggttacgtacggaacatgtaaccaagcgggtgaacataggcgggacaaaagatcagttgcacttgcccctcatgtcggaatgggattagacactagaacacaaacttggatgagcgctgaaggagcttggaggcaagttgaaaaagttgagacctgggcactccgacatccgggattcaccattctcgcactgttcttagcacactatataggaacctcactcactcaaaaggtagtaatattcatcttgttaatgctcgtcaccccgtcgatgacaatgcgctgcgtcggcgtaggaaacagagattttgttgaaggattaagtggggctacatgggtcgacgtggttcttgaacatggcggttgtgtaactacaatggcgaaaaataagcctactctggacatagagctacaaaagacagaggctacacaactagccacactacgcaaactctgtatcgaaggtaaaatcacaaatattacaacagacagtaggtgcccaacccagggggaggccacattgcctgaagagcaagaccaaaattacgtatgtaaacacacttatgtagataggggctggggcaacgggtgcggactatttggtaaaggttcactagtcacgtgcgccaaattccagtgtctggaaccaatagaaggaaaagtagttcaatacgaaaacctaaaatatacagtaatcataacagtacatacaggtgaccaacaccaagttggaaatgaaacccaaggtgtaactgcagagattacaccccaagcgagcactacagaagcaattctcccggagtacggaaccttaggattggaatgtagtcctcgaacaggtctggactttaatgaaatgattctgttaactatgaaaaataaggcatggatggttcatagacagtggttcttcgacctgcccctgccttggacgtccggagctacaaccgaaaccccaacgtggaataggaaagagttgctagtcacctttaaaaacgcacatgcaaaaaaacaggaagtggttgtacttggtagtcaagaaggcgcgatgcatacggcattaacgggggcaacagagatccagaattctggaggaaccagcatatttgcgggtcatctaaaatgcagactaaaaatggataaactcgaattaaaaggtatgagttacgctatgtgtacgaatacgtttgtgctaaagaaagaagtaagcgagacacaacacggtacgatattaataaaagttgagtataaaggagaagatgtgccctgtaagataccttttagcacagaagatggacagggaaaagcccacaacggaaggctaattacagctaacccagtggtaacaaaaaaagaagaacctgtaaacatagaggcagaacctccattcggcgaaagtaatattgtgataggaataggcgacaatgccttgaaaatcaactggtataagaaggggagctcaataggaaagatgttcgaagccacagctaggggggctagaagaatggcgatactgggtgatacagcgtgggacttcggtagcgtcggtggggtgttgaattcactaggtaaaatggtccatcaaatttttggatcagcttatactgcactgtttagcggagtgtcctgggtaatgaaaattggtatcggggtattgttaacctggataggcctgaatagtaaaaatacatcaatgagcttttcttgcattgccattgggattatcacactctacctaggtgcagtagtacaagcagatatgggatgcgtcgttaactggaaaggtaaggaactcaagtgtgggtctgggatttttgtaacaaatgaagtccatacttggacggaacaatataagtttcaggctgactccccaaaaaggttagcaaccgccatagcaggagcgtgggaaaacggcgtatgcggcataagatctacgacacgaatggaaaacttgttatggaaacaaattgctaacgaattaaactacatactgtgggaaaacaatataaagctgacagtagtcgtaggggacattataggtgtcctagaacaaggaaaacgaacactaacgccccagccaaaggagttaaaatatagttggaaaacgtggggcaaggccaaaatagttacagccgagacacaaaatagctccttcatcatagatggcccaaatactccagagtgtccatctgttagtagagcttggaatgtctgggaggtagaggattacgggtttggtgtatttacaactaacatttggttaaagctacgtgaagtatatacacaactttgtgaccatcgtttaatgtcagcagccgtaaaggacgaaagagcagtacatgcagacatgggatattggatagaatcacagaagaatggttcatggaaactcgaaaaagctagcctgatcgaagtaaaaacatgtacatggccgaagagtcataccttatggagcaatggagttcttgaatcggacatgatcatcccgaaaagtttagctggaccaatatcacaacataatcatcgacccggctaccacacgcaaacggcaggaccgtggcatttaggaaaactagaattagacttcaattattgtgaaggaacaacggttgtaataacagaaaattgcggtactagaggaccatcactgaggaccactactgttagtggaaaattaatacatgaatggtgttgtagatcttgtactttacctccactaaggtacatgggagaagatggttgttggtacggcatggaaataagaccaataagtgaaaaagaggagaacatggttaagagtctagttagtgctggttcagggaaagtcgataacttcaccatgggggtcctatgtttagcgattcttttcgaggaagtaatgcggggtaaatttggaaaaaaacatatgattgctggggtttttttcacttttgttcttctactcagcggacaaattacttggcgagacatggctcacacattaattatgatagggagcaacgcaagcgatcgaatgggaatgggcgtaacctacttggcattgatagccacttttaagattcagccgtttcttgcactgggtttttttcttcgcaaactaacaagcagagaaaacttactattaggcgtaggacttgccatggcgacgacccttcaattacccgaagatatcgagcagatggcgaacggcatagcattaggattaatggcgctaaaacttataactcaattcgaaacttatcaactatggactgcactgatatccctgacgtgttcaaatacaatttttaccttaactgttgcgtggcggactgcgacccttatactggccggcgtcagtttattacctgtctgccaaagttccagtatgagaaaaactgactggttacccatggcagtagcggctatgggagtcccacccctccctctatttattttctcactaaaagacaccctaaaaaggagatcgtggccacttaacgaaggtgtaatggcagtagggcttgtaagcatcctagcttcatctttacttcgtaatgatgtgccaatggcaggaccattggtggcaggggggttattaatcgcatgttacgtgattacgggtactagtgcagatttaacggtagaaaaagccgcagacattacatgggaagaggaagcagaacaaacgggagtttctcataacctaatgatcacagtagacgacgacgggacaatgaggattaaagacgatgaaaccgaaaacattcttactgtacttttaaaaacagcattattaatcgttagcggtatctttccgtatagtattcctgcaaccttattagtgtggcacacgtggcaaaagcagacacagagatctggcgtattgtgggatgtcccttctccacctgagactcaaaaggcagaacttgaagaaggagtctatcgaatcaaacaacaaggaatcttcggtaaaacacaagttggagtaggcgtacaaaaagaaggcgtattccataccatgtggcatgtcacaaggggggcagttctaacctacaatggaaaaagattagaacctaattgggcaagcgtcaagaaggacctaatttcttatggtggaggttggcgtctatctgcacagtggcaaaaaggcgaagaagtacaagttatcgcagtcgaaccaggaaaaaaccccaaaaatttccaaacaatgcccggaacatttcaaacaaccacgggagaaatcggtgcaatagctcttgactttaaacctggtacttcaggctcacccattataaacagggaaggtaaagtcgttggactatatggaaatggagtcgttaccaagaacggaggatacgtctccgggatagcccaaacaaatgcagaacctgatggtccgactccagaattagaagaggagatgtttcggaaacgtaacctaacgataatggatttacacccaggttcaggaaagacaaggaaatatttaccagctattgtaagagaagcaataaaaaggcgtttacggactttgattcttgcgcctacaagagttgttgcagccgaaatggaagaagcattaaagggtctcccgataaggtatcaaacgacagccactaaatccgaacacactggtagagaaatagtggatttaatgtgtcatgcaaccttcacgatgaggttgttatcaccagtaagagtaccaaactacaatctaataataatggacgaagcacacttcacagacccagcatcaatcgcggcaagaggttatattagtactagagttggcatgggagaagcagccgcaatatttatgacagcaacgccaccaggcactgcagatgcatttccccaatccaacgctcccatacaggatgaggaaagagatattccggaaaggagttggaacagcggaaacgaatggatcacggattttgcaggtaaaaccgtctggttcgtaccgtcaataaaagcaggaaatgacattgccaattgtctcagaaaaaatggtaagaaagtcatccagctgtctcgaaagacatttgataccgagtaccaaaaaacgaagctaaatgactgggatttcgttgtcaccacggatatatctgaaatgggcgcgaactttaaagctgacagagttattgatccaaggcgttgcctaaaaccagtaatattgaccgacgggccagaaagagtgattttagctgggcccatgcctgtcacagccgcttctgctgcccaaaggcggggacgcgtaggacgaaacccgcaaaaagagaatgatcaatacattttcacaggacaaccgctcaacaatgacgaagaccatgcacactggactgaggcaaaaatgttactagacaatattaacactcccgaaggaataattccagcgctttttgaaccagaacgggaaaagtctgcagccattgatggtgaatatagactcaaaggggaaagtagaaaaacatttgtagaattaatgcgtagaggagatttgccagtgtggctagcacataaagtagccagtgaaggaataaagtataccgacagaaagtggtgtttcgatggacagagaaataatcaaatcctagaagagaacatggatgtggaaatatggactaaagaaggtgagaagaaaaaacttcgtcctagatggctcgatgcgagaacttatagtgacccgttagcgctaaaggaatttaaagaatttgctgccgggagaaaatcaattgcacttgatctcgttaccgagatagggcgagttccatcacacctagcacaccggacgcgtaatgcactagataatttagtaatgctacacacatcagagcatgggggccgagcataccgtcatgcggttgaagaattgcccgaaacgatggagaccttactgcttctaggcttaatgatcctactcactggaggagccatgctatttctcataagtggcaaaggtatcggaaaaacatccatcggattaatatgtgttattgcaagctcgggaatgttgtggatggccgaaatcccgctccaatggatcgcaagtgcaatagttttagaattctttatgatggtattactaatcccagaaccagaaaaacaaaggacaccacaagacaaccaattggcctacgttgtaataggcattttaacattggccgcaattattgcggcgaacgaaatgggactccttgaaactacaaaaagagacctgggaatgagtaaagaaccaggtgtcgtatcaccaacaagctacctagatgtcgatttgcatcccgccagtgcttggaccctttacgcggtcgcaacaacagtcattacaccaatgctgagacatacaatagaaaactcgacagccaatgtaagtttagcggcaatagcaaaccaagcggttgttcttatgggactcgataaaggatggccaatttctaaaatggatcttggagtcccattactagcattaggctgctatagccaagtaaaccctcttacattgacggcagccgtactcctattaatcacacactacgctataataggtcctgggttacaagcaaaagcaacaagagaagcgcaaaaaagaacagcagctggaataatgaaaaaccccacagtcgacggcattatgactatcgatctcgacccagttatatacgactctaagttcgagaagcaactaggccaagtaatgctgttggtcttgtgtgcggtgcaactgctattaatgcgaactagttgggcattgtgcgaagccctaactctggcaactggccccataacaacattatgggagggaagtccaggtaaattttggaacacgacgattgctgtctcaatggcaaacatttttcgaggatcctacctggctggagcgggtcttgccttctcaataatgaaatctgtaggaaccggcaaaagaggtacaggctctcaaggcgagactttgggagaaaaatggaagaaaaaactgaatcaacttagtcgaaaggattttgacctttacaagaaatcaggcatcacagaagtcgatagaacagaggccaaagaaggacttaaacgcggcgaaatcactcatcatgctgttagccgaggatcagctaagcttcagtggttcgtcgaacgaaacatggtaatacctgaaggaagggtaatagatttaggttgtggcagaggaggatggtcctattactgtgcagggttaaaaaaagtgacggaagttagagggtatacgaaagggggacccggacacgaagagccagtgccaatgagtacgtatggatggaacatagtaaagctaatgagtggtaaggatgtcttctacctgccgccagaaaaatgtgacacactactctgcgatataggtgaaagttctccgtccccaacggtggaagaatctagaaccattcgcgttttaaaaatggtggaaccatggctaaagaataatcaattttgcataaaagttctgaatccatatatgccaacggtgattgagcacttggaacgtctccaacgaaagcacggtggcatgcttgttcgcaatccgttatctagaaactcaactcacgaaatgtattggattagtaacggtacaggtaatatagtagcctcggtcaacatggtatcccgtctgctactcaatagatttactatgacacatcgacgtccaactattgagaaggacgttgacttgggagctggcacaagacacgtcaatgcagaacccgagaccccaaatatggacgtaataggagaacggataaagcgaataaaagaagaacataacagtacttggcactatgatgatgaaaacccgtataaaacctgggcctaccatgggtcatatgaagttaaagccaccggcagtgcctcaagtatgattaacggcgtggtaaagttactgactaaaccatgggatgttgtcccaatggttacacaaatggctatgacagatacaacaccatttggacaacaaagggtattcaaagagaaagtggatacaagaacacccagatctatgccaggtacccgtagagttatgggtattacagccgagtggttatggagaacattaggacgaaataaacctcggttatgcacaagagaggagtttaccaaaaaagtacgaacgaatgcggctatgggggctgttttcacagaagaaaaccaatgggattcggccaaagctgcagtagaagacgaagatttctggaaattagttgatcgagaaagggagcttcacaaattgggaaaatgtggcagctgcgtgtataatatgatggggaagcgagagaaaaaactaggcgaattcgggaaagccaaaggatccagagcgatttggtacatgtggttaggagctagatatttagagttcgaagcactaggtttcttaaatgaagatcattggtttagcagagaaaacagttactccggagtagagggcgaaggtctgcataaacttggttatatcctacgagacatttcaaagatacccggcggagctatgtatgccgacgatacggcaggatgggacacgaggattactgaagatgacttgcacaatgaagaaaagataacccagcaaatggatcctgaacatagacaactagctaatgcaatattcaagttaacatatcaaaataaggttgttaaggttcaaagacccacaccaacaggaacagttatggatattatttcaaggaaagatcaacgaggatcagggcaggtaggaacttatgggctcaatacattcacaaatatggaagcacagttaataagacaaatggagggagaaggagtactcagtaaagccgatctagaaaacccccatttacccgaaaaaaagataactcaatggttggaaactaaaggtgttgaaagacttaaacgaatggcgataagcggtgacgattgcgttgttaaacccatcgatgatagatttgcaaatgcacttttagccttgaatgacatgggtaaggtcagaaaggatataccacaatggcagccgtcaaaaggatggcatgattggcagcaagtacccttttgtagtcaccatttccatgagctcattatgaaagatggtcgtaaattagtcgttccctgtagaccgcaagacgaattaatcggaagggctagaatatcccaaggagcgggctggagtttaaaagaaacagcatgtctaggtaaagcgtatgcacaaatgtggtctttaatgtatttccaccgacgcgatttacgtctagcaagtaatgcgatctgttcagctgttcccgtacactgggtgccgactagtagaacaacttggagtatacacgctcaccatcaatggatgaccacggaagacatgctgacagtttggaatagagtatggattgaagacaatccgtggatggaagacaagacaccagtaacgacttgggaaaacgtaccgtatttaggaaaaagagaagatcagtggtgcggaagtttgataggtctaacctcacgtgctacatgggcgcaaaatataccaacagctatccaacaagtccgctccctcattggtaatgaagaattccttgattatatgcctagtatgaaacgctttagaaaagaggaagagtccgaaggtgctatatggtaa

SEQ ID NO: 23198 - RNA, 9873 nt, synthetic construct
  misc_feature 1..9873: note = derived and/or modified CDS sequence (opt6) from DENV-3__HM756276__SS-prME
  source 1..9873: mol_type = other RNA
actagcttatgtttaatgatgatattaccggctgctcttgcatttcacctgacatcaagggacggtgagcctagaatgattgttggcaaaaacgaaagggggaaaagtttactctttaaaacagcaagtggaatcaatatgtgcacacttattgctatggacctgggtgaaatgtgtgacgacacagtaacatataaatgcccgcatatcacggaagtagaacctgaagatatagactgttggtgcaatttaacatcaacttgggtcacttatggtacgtgtaaccaagctggagaacacagacgagataaacgatcagtggcattagcgccccacgtaggtatgggattagatactagaacacaaacctggatgtcagcagaaggagcatggagacaagttgaaaaagttgagacctgggcactaagacaccctggatttaccatcctggcgctatttctagcacactatattggtacgagtctgacacagaaagttgtcatcttcattctcttgatgttggtaacaccttcaatgacaatgagatgtgttggagtaggaaatagggatttcgtggaaggtttatccggcgccacgtgggtagatgttgtgcttgagcatggtggctgtgtaacaactatggccaaaaataaaccaaccttagacattgaattacagaaaactgaggcaacacaattagctacccttcgaaaactgtgcatagagggaaaaataacaaatataacaacggattcaaggtgtccaactcaaggtgaggctacactacctgaagaacaagatcaaaactatgtatgcaaacatacttacgtagatcggggatggggtaacggctgtggtctatttggaaaagggtcactggtcacatgtgcaaaatttcaatgcctcgagcccatagaggggaaagtggttcaatacgagaatttaaaatacactgttatcataaccgtacacacaggagaccagcatcaagtaggaaacgaaacacagggagtgacagccgaaattacaccccaggcatcaacgacggaggctattttacctgagtacggtaccctaggcttagaatgttctcctaggaccgggctagatttcaatgaaatgatactattaacgatgaaaaataaagcgtggatggtacaccgtcaatggttctttgacttacccctaccgtggacaagcggtgctacgactgagacaccgacatggaatagaaaagagttgttagtcacttttaaaaatgcgcacgccaagaaacaagaagtggtggtactcggatcacaggagggtgccatgcacacagctttaaccggcgctacggagatacaaaacagcggagggacttcaattttcgctgggcatctaaaatgtagacttaagatggacaaattagagcttaaaggaatgtcatacgccatgtgtacaaatacatttgtactgaagaaagaagttagcgagacccaacatggtacgattttaataaaagtcgaatataagggtgaagatgtaccatgtaaaataccttttagtacggaggatgggcaaggaaaagcacacaatggtagactcataaccgcaaacccggttgttaccaaaaaggaggaaccagtcaatattgaagcagaacccccattcggagaatctaacattgttattgggataggagacaatgcactcaaaataaattggtacaaaaaggggtcttcaattgggaagatgttcgaagctacagctaggggagcccgaagaatggcaatactaggggatactgcgtgggacttcggttcagtaggcggagtcctaaacagcttgggcaaaatggtgcatcaaatttttggatccgcctatacagcattattctccggtgtaagttgggtcatgaaaataggaatcggggtgcttttaacatggatcggattgaatagtaaaaacacttcgatgtctttttcatgcatagctatcggcataataacattatacctgggggccgtagtacaagcagatatgggatgtgttgtaaattggaagggaaaagaactaaaatgcggctcaggaatttttgtaacaaatgaagtacacacctggaccgaacagtataagttccaagccgactccccaaaacgtttagcaactgctattgctggagcttgggaaaatggtgtttgtgggataaggtccacgacccgaatggaaaacttactatggaagcaaatagcaaatgaacttaactatatcttatgggaaaacaacattaaacttacggtagtcgtaggagacattattggagtcctagaacaaggtaagagaacgttaacacctcaacctatggaattaaaatattcatggaagacatggggaaaggctaaaattgtgacagccgaaacccaaaactcatcatttatcattgacggaccgaatacaccggaatgccctagcgtctcgagagcatggaatgtatgggaggtagaagattatggatttggtgttttcacaactaatatatggctaaaattgagagaagtctacactcagctgtgcgaccaccgcctgatgagcgcagcggtgaaagacgaaagagccgtacatgcggacatgggctattggattgagtctcaaaagaacggttcatggaaattagaaaaagcgtcgctgattgaggtaaaaacatgcacatggccgaaatcacacaccttatggagtaacggtgttttggaatcagatatgataattcccaaatctctggcaggccctatatcgcaacacaatcataggcctggatatcatacccagacggccggtccttggcatctaggaaaactagagctagactttaattattgcgaaggcaccacagttgtgatcacagaaaattgtgggacacgaggaccatcgttacgaactactacagtgtccggtaaacttatacacgaatggtgttgtaggtcctgcacattgcctccgctgagatatatgggcgaggacggatgctggtacggaatggaaattagacctatttcagaaaaagaggaaaacatggtgaagtcattggtttctgccggatcaggtaaagtggataacttcacaatgggtgttttatgtctggcaattctattcgaagaagtaatgaggggaaaatttggcaagaaacatatgatagccggtgtattctttacatttgtacttctacttagtggtcaaataacgtggcgcgatatggcacacacattaataatgataggaagtaacgctagtgataggatgggcatgggagttacatatttagcacttatagctactttcaagatccaaccatttttagcacttggattctttcttagaaaactcacctccagagaaaatctcctattaggagttggacttgcgatggcaactaccctacaacttccagaggatatagagcaaatggctaatggaatcgcgctggggctgatggcactcaagttaataactcagtttgaaacatatcaactatggaccgctttaatctctctcacatgctcgaatacaatattcactctaactgtagcatggcgaacagccacattaatacttgcaggggtaagcctgttacctgtctgtcagagctctagcatgaggaagacagattggctcccaatggctgtcgccgcaatgggagttcccccactaccattattcatattcagcttgaaagataccctaaaacggagatcatggcctttaaatgaaggcgtgatggcagtaggtctagtaagtatactagccagttccctactaagaaatgatgtaccaatggccggccccttggtagctggaggactccttattgcttgttacgtaattactggcacaagtgcggacttgacagtagaaaaagcggctgacatcacttgggaggaggaagcggaacaaacaggagtaagtcataaccttatgattactgttgatgacgacggaactatgagaattaaggatgatgagactgagaacatattgaccgttttgctaaaaactgcattactaatagttagcggaatttttccatattcgatacctgcaacactgttggtttggcacacatggcaaaagcaaactcaacgttcaggtgtattatgggacgtaccttcaccccctgaaactcaaaaggccgaattagaggaaggggtatatcgaatcaaacagcagggaatatttggaaaaacacaagtcggagtaggcgttcaaaaggagggagtatttcatacaatgtggcatgttacaaggggcgcagtattaacgtataacgggaaacgattggagccaaactgggcatccgtcaagaaagatctgattagttacggaggcgggtggaggttatcagcgcaatggcaaaagggtgaagaagttcaggtgatagcggttgaacctggcaaaaatcctaagaatttccaaactatgcccggcacatttcaaacaacaaccggtgaaataggagctattgcattagactttaaacctggtacgtcaggatccccaataataaatcgagagggaaaagttgtcggactgtacggaaatggagttgtaaccaaaaacggcggatatgtgtcgggaatagcacaaactaatgcggaaccagacggacctaccccagaattagaggaagagatgtttaaaaagcgaaatctgaccataatggacctacatcctggaagcggtaagacgcggaaatatcttcctgcaatcgtgcgtgaagctataaaacgacgactacgaacactgatcttagccccgaccagagtcgtagcagctgaaatggaggaagctctcaaagggctgcctataaggtatcagacaaccgctacaaaaagtgaacatacagggagagaaattgttgatcttatgtgtcatgctacattcacaatgagactgctttcgcccgtgagagtgccaaactataatctaatcattatggatgaagctcacttcacggatcccgcatcaattgcggcacggggttatattagcacaagagtagggatgggagaagcagctgccatttttatgactgcaaccccaccaggtacagcagatgcattcccccaaagtaacgcgccaatacaagacgaagaaagagacattccggaaaggagctggaactcagggaatgaatggataacggatttcgccgggaaaacggtatggtttgtcccatcaataaaagccggaaatgacattgcgaattgcttaaggaagaacggtaaaaaggtaatacaactgagtagaaagacgttcgatacagaatatcaaaagacaaaactgaatgactgggacttcgtagttacgacagatataagtgaaatgggggccaattttaaagcggaccgggtaattgatccaagacgctgtttaaaacccgtgatcttaactgatggccctgagcgtgtcattttagcgggcccaatgccagtaaccgccgcttcagcagctcaaagacgtggcagagtaggccgaaatccacaaaaggaaaatgatcaatacatttttacaggacaaccacttaataacgatgaggaccatgcgcattggacagaagcaaaaatgctacttgacaatataaacacacccgagggtatcattcctgccttatttgaaccggagcgtgaaaaatccgcagctatagatggggaataccggctcaaaggggaatcccgcaaaacttttgttgaacttatgagaagaggcgacttaccggtgtggttagctcataaagtagccagcgaagggattaaatacacagaccgtaaatggtgtttcgacggtcaacgtaacaaccagatcctggaagagaatatggacgttgaaatatggacaaaagaaggtgaaaagaagaaactaagacctagatggctggatgcaagaacatattctgatccgttggctttaaaagagttcaaggagttcgcggcaggacgaaaatctattgctttagacctggtaactgaaatcggtagagtcccgagccatctagcacaccgaacaagaaacgctctagataatctagttatgttacacacctcagagcacggtggcagagcttatagacatgcagtggaggaacttccagaaacaatggaaaccctacttttacttggtcttatgattttgctaactggaggtgccatgttgttccttatatcaggcaaaggtattggaaagacgagtattggattgatttgtgtaatagcttcatctggaatgctatggatggcagaaatcccgctacagtggatagcctcagcaatcgtcttagaatttttcatgatggtgctattgataccagaacctgagaagcaacgaacaccacaagacaatcaactagcatatgtcgtaatcgggatattaacattagctgctatcatcgcagctaatgaaatgggactgcttgaaactacaaaacgggatttaggaatgagcaaggagcctggagttgtttctcccacaagctacttagacgtggacttacatccagcatcagcatggacactttatgctgtagcgactacagtaataacaccaatgttacggcatacaatcgaaaattcgactgctaatgtatcactcgcagctattgccaaccaggctgtggtactaatgggtcttgataaaggttggcccataagtaaaatggatttaggcgttcctctattggcattaggatgctactcacaagtcaatcctttaaccctaactgctgcagtgttattattgataacacattatgctatcatagggcctggcttacaagcgaaggctacacgtgaagcacagaaaagaactgctgcgggcatcatgaaaaatcctacggtcgatggaataatgaccattgacttagatccagttatatatgactcgaaatttgaaaaacagttgggtcaggttatgctattagtattatgcgctgtacaattacttctcatgaggacgagctgggccttatgcgaggccttaacattagcaacaggtccaatcactactctatgggagggtagtccaggtaaattttggaacacaacaatcgccgtatcaatggctaacatatttcgcggatcctatttagctggcgcgggattagcattttcaataatgaaatcagttggaaccggcaaacgggggacgggctctcaaggtgaaacattaggagaaaaatggaagaagaaattgaatcaactatcaagaaaggatttcgatctatacaagaaaagcggaattacagaagttgatagaacagaggcaaaggagggactaaagagaggtgaaattacgcatcatgcggtatcccgagggtcagcaaaattacaatggtttgtggagagaaacatggtaatacctgaggggagagtaattgatttgggctgtggacgcggtggatggagctattactgcgccggactgaaaaaggtaacagaggttaggggctatacaaaagggggacccggacacgaggaaccggtacctatgtcaacgtacggatggaatatagtcaagttaatgagcggaaaggacgtattctaccttccaccggagaaatgcgataccctattatgtgacataggagaaagtagtccatctcccacagtagaagaatcacgaacaataagagtgttaaaaatggtcgaaccctggttaaagaataatcaattttgtataaaagtgttaaatccatatatgccaacagtaatcgagcaccttgaaaggctacagaggaaacatggaggtatgcttgtccgaaacccactcagtagaaatagtacacatgaaatgtattggatatcaaacggcactggcaatatagtcgcctctgtaaatatggtgtccaggttgttacttaaccggttcacaatgacacacagacgacccacaatcgaaaaagatgtagacttaggggccgggacccgccatgtgaatgcggagcccgagactcccaatatggatgttattggagagcgcataaagagaattaaggaagaacacaattctacatggcactatgatgatgaaaatccatataaaacctgggcttaccacggttcctatgaggtgaaagcaacaggatctgcttcaagcatgatcaacggtgtggttaaattactaactaaaccatgggatgtcgtaccgatggtaacccaaatggcaatgacagacactaccccattcggacaacaacgagtctttaaagagaaggtggacacaagaacacctcgtagcatgccaggaacgcgtagagtgatgggcataaccgccgaatggctgtggaggacattaggtcgaaataagaaaccacggttatgtacacgagaagaatttactaagaaagtcagaaccaacgcagcaatgggtgcagtatttacagaagaaaatcaatgggattcagcaaaagcagcggtagaagatgaggatttttggaagctagtagaccgagagagggagctccacaagttgggaaaatgcggaagttgtgtatataatatgatgggcaaaagggagaagaaactcggggaatttggaaaggcaaaaggtagtagggcgatatggtatatgtggttgggggcaaggtacttagagtttgaagccctaggattcctaaatgaagaccattggtttagtcgtgaaaactcttacagtggcgttgaaggtgaaggacttcataagttgggttatatacttcgagacatatcaaaaataccaggtggggcaatgtacgccgatgatacggcaggttgggacacaagaatcacagaagatgatttgcataacgaagagaaaattactcaacaaatggacccggaacaccgacaactagcgaatgcaatatttaagttaacctaccagaataaagttgtaaaagtccaaaggccaaccccaacaggaacagtgatggacataatcagcaggaaagatcagcgaggaagtggacaagtggggacgtatggtttgaatacatttactaacatggaagcacaattgattcgacagatggagggagaaggtgtattaagcaaagcggacctggaaaatccccatttgcccgagaagaaaataacacaatggttagaaaccaaaggcgtcgaacgtctaaagagaatggcgatcagtggtgatgattgcgtagtaaaaccgattgatgatagatttgcaaatgcgttgctcgcattaaatgacatgggtaaagtgagaaaagatattccacaatggcaacccagtaaaggttggcatgattggcagcaagtacctttctgtagtcaccattttcatgaattgatcatgaaagatggtcgcaaactcgtagtgccatgtagaccacaagacgagttgataggtcgagcacgtatttcgcaaggagccgggtggtctttaaaagagaccgcttgcttgggaaaggcttatgcccaaatgtggtcactaatgtactttcatagacgagacttacgattagcaagtaatgcaatatgctcagcggtaccagttcattgggtacctaccagtcgtacgacatggtcaattcatgcacatcatcaatggatgacaacggaagacatgttgaccgtatggaatagggtctggatagaggataatccgtggatggaggacaaaaccccagtaaccacttgggagaatgtaccttacctgggaaaacgggaagaccaatggtgtggctcccttataggattaacaagtcgggccacatgggcccaaaacataccaactgcaatccaacaagtgagatcgttgattggtaacgaggaatttctcgattatatgccttcaatgaagaggttcaggaaagaagaagaaagtgaaggagcaatttggtaa

SEQ ID NO: 23199 - RNA, 9873 nt, synthetic construct
  misc_feature 1..9873: note = derived and/or modified CDS sequence (opt6) from DENV-3__HM756279__SS-prME
  source 1..9873: mol_type = other RNA
acgtcattatgccttatgatgatcctacctgcagctttggcatttcacttgacttccagagacggtgaacccagaatgatagtaggtaaaaacgaacgaggaaaatcactgttatttaaaacagccagcggtataaatatgtgtacgctaatagctatggatctaggggaaatgtgcgacgacacagtaacctataaatgcccgcatatcactgaagtggaacctgaagacatcgattgttggtgtaacttaacctcaacatgggttacatatggtacatgtaatcaagccggcgaacatagaagagacaaaaggagcgtggcgttagccccacatgtcgggatgggcctcgacactagaacccaaacgtggatgtccgctgaaggggcatggagacaagtagaaaaagtggaaacatgggctttacgtcatccaggcttcaccatactcgcactatttctagctcactacatcggcacaagcctaacccaaaaagtcgttatcttcatattattaatgcttgtgactcctagcatgacaatgaggtgcgttggggttggaaaccgagatttcgtagaaggtttatctggagcaacatgggtagatgtagtgctagaacatggaggatgtgtaacaacgatggcgaaaaacaaaccaactttagatattgaactgcagaaaactgaagcaactcaattagcgacactaagaaaactatgtatagaaggaaaaataactaacatcacaactgacagcagatgtccaactcaaggagaagcaaccctgccagaagaacaagatcaaaactacgtatgtaaacatacgtatgttgaccgaggctgggggaacggatgtggactcttcggaaaaggctcgctagtgacgtgcgctaaatttcagtgcctcgaacctatagaaggtaaagtagttcaatatgaaaacctaaaatatacagtaatcataaccgtacatacgggggaccaacatcaggtaggcaatgaaactcaaggagtaaccgctgaaatcacaccacaagccagcaccaccgaggcaattctccccgaatacggcaccttaggcctagaatgctcacccagaactggtctagacttcaacgaaatgattttgctaacaatgaaaaacaaagcgtggatggtccatagacaatggttcttcgacttgccacttccttggacttcaggagcaaccactgaaactccaacttggaatagaaaagaattgctagtcacatttaaaaatgcccacgcgaaaaagcaggaggtagtggtcctaggtagtcaagagggcgcaatgcatacagctttaacgggtgcgacagaaatacagaacagcggtggaacatccatctttgctggacatctaaaatgtcgattgaaaatggataaactagaattgaagggaatgtcttacgctatgtgcactaacactttcgtcttaaagaaagaagtatcagaaacacaacatggaacgatcttaattaaagtagagtataaaggcgaagatgtaccatgcaaaatccctttctctactgaagatggccaaggaaaagctcataatgggcggttgattacggcaaaccccgttgtaacgaagaaagaggaaccagtaaatatagaagctgaaccgccatttggggaatcaaacacggttataggtatcggagacaatgcactaaagattaattggtacaaaaagggttcgagtattggcaaaatgtttgaagcgacagcacgtggagcccgacggatggcaattctaggtgatacagcatgggacttcggtagtgttggaggggtacttaatagcttaggcaaaatggtccatcagatttttggatcagcatataccgcattattcagcggagtctcatgggtcatgaaaataggcataggcgtacttttgacatggattgggctaaacagcaagaacacttctatgagcttcagttgtatagcaataggaattatcacgctgtatttaggagcagtcgtgcaagcagatatgggttgcgtaatcaactggaaaggtaaagaattgaaatgcggatccggtatattcgtcacaaacgaagttcacacttggacggagcaatataaatttcaagcggatagccccaaacgtcttgctacagcaattgccggagcatgggagaatggcgtctgtggaatcagaagcaccaccagaatggaaaacttgttatggaagcaaatagcgaatgaacttaattatatactctgggaaaacaacatcaagttaacagttgtggtaggtgatattataggagtacttgagcaaggtaaaaggacattgaccccacaaccgatggaacttaaatattcgtggaaaacctgggggaaagctaagatagtaacagcggagacccaaaactcaagtttcataattgatggtccaaatacacctgaatgcccatctgtttcaagagcatggaacgtgtgggaagtggaagactatggatttggtgtattcaccacaaatatttggctaaagctccgcgaagtatacacccaactgtgtgaccatagattaatgtcagcagctgtaaaggacgaaagggctgttcatgctgacatgggctattggatagagtcccagaaaaatggctcatggaaattagaaaaggcttcgttaatcgaagtgaaaacatgcacatggccgaaatctcatacactttggagtaatggcgttcttgaatcagatatgatcatacccaaaagtttagcgggtcctatcagccaacataaccacaggcctggatatcatacacaaacagcaggaccatggcacttgggaaaacttgagttggattttaattattgcgaaggaacaactgtagtaataacagaaaactgtggtacaagaggaccatcgctaaggacaaccacagtgagtgggaagttaattcatgagtggtgttgcagaagttgtacactgccaccgttgcggtatatgggcgaagatggctgttggtacggtatggagattagaccaattagcgaaaaagaagaaaatatggtaaagagcttggtctcagctggtagcggaaaagtggataactttacaatgggagtgttatgtttagcgatactttttgaagaagtcatgagaggcaagttcggcaagaaacatatgatagcgggggtattctttacctttgtgttacttctgtcaggccaaattacatggcgggatatggcgcatacgctaatcatgattggatcgaatgcgtctgacagaatggggatgggagttacgtacctagccctaatagcgacttttaaaatacaaccctttctggcactcggctttttcctaaggaaactaacttctagagaaaatttattattaggtgtgggtttagcaatggccacaaccctccaattacctgaggacatagaacagatggcgaacgggattgctcttggtctaatggcgttaaaacttataactcaattcgagacctatcagttatggactgctctgatatccttaacatgctcaaatactatatttactcttaccgtagcatggagaacagcgacattaatactagcaggagtgagcctactaccagtatgtcaatcaagctctatgagaaaaaccgactggttacctatggccgttgcagcaatgggagtaccacctttacctctctttatatttggacttaaagacacattaaaacgaaggtcctggccactaaatgagggagttatggcagtaggacttgtcagtattctagcctctagcctattacgaaatgatgttccgatggcaggaccgctagtcgctgggggcttactaattgcatgctacgtgattacaggtacctcggcagatttgacggtggagaaagctgcagatattacatgggaagaagaagctgaacaaacaggtgtgagtcataaccttatgataactgtagatgacgacgggacaatgagaatcaaagacgatgaaactgaaaatattcttacggttttacttaaaacggcgcttttgatagtcagtgggattttcccgtatagtatcccggcaactctgttagtatggcacacgtggcagaaacaaacgcaacgatccggagtgttgtgggatgttccatctccacctgaaactcaaaaagctgaattagaagaaggcgtttacagaataaagcaacagggtaacttctgggaaacccaagtaggagtaggggtgcaaaaagaaggtgtctttcacaccatgtggcatgtcacgagaggcgctgtccttacttataatggaaaaagactagagccaaactgggcaagcgttaagaaagacttaatatcgtacggaggcgggtggcgcctgagtgcacaatggcagaaaggtgaagaggtacaagttattgcagtagagcccggcaaaaaccccaaaaatttccaaacaatgcccgggacttttcaaaccaccacaggcgagattggggcaatcgctctggactttaagccagggacaagtgggagtccaatcataaatcgagagggaaaagttgttggcctttatggcaacggagtcgttaccaaaaatggagggtatgtaagcggcatagctcagactaatgcggagcccgacggaccaacacccgaactagaagaagaaatgttcaagaaacgaaatttaacaataatggacttacacccaggcagcggaaagacaagaaagtatttacccgcaatagtgcgggaagcaataaaaagaagacttagaacacttatactagctcccacgagggttgtagccgcggaaatggaagaagcgttgaaaggactcccaatccgataccaaacaactgccacgaaaagcgaacacacaggtagagaaatcgtcgatttaatgtgccacgcaacatttaccatgcgcttacttagccccgtgagagtgcctaattataacctcataattatggatgaggctcacttcaccgatcccgctagcatagcggcaagaggttatatttccacgagggtaggcatgggtgaagctgcggcaatatttatgacagcaacgccgcctggcacagctgacgcgtttccgcaaagtaacgcgcctatacaagatgaggagcgggacattcccgaaagaagttggaactctggcaatgagtggataacagatttcgctggtaaaacagtttggtttgtcccgtctattaaggccggtaatgacatagctaactgccttaggaaaaacggcaaaaaggtaatacaattatctagaaaaacttttgatacggagtatcagaaaactaaacttaacgattgggacttcgtcgtaacaacggacatatcggagatgggagcaaatttcaaagctgatcgagttatagacccacgtagatgtttaaaacccgttattctgacagacggtccggagagagtgatactagccggaccaatgccggtaaccgcagcgtcagctgcacaacgtagaggacgagtcggtagaaacccgcaaaaagaaaatgatcaatacatattcacaggccaaccccttaataatgatgaagaccatgcccactggaccgaagcaaaaatgctcttggacaatataaatacgcctgagggaataatacccgcattattcgaacccgaaagggagaaaagcgcagccattgatggggaatatagacttaagggcgaatctagaaaaacatttgtagaacttatgagacgtggagatcttacagtgtggctagcacataaggttgcatccgaaggaattaagtacacagaccgtaaatggtgctttgacggacagcgtaataatcaaatattagaagaaaatatggatgttgaaatatggactaaagaaggcgagaaaaagaaactaagaccacgttggttggacgcaaggacttatagtgacccactggcgctcaaagagtttaaagaatttgcagcaggaaggaaatcaattgcattagacctcgtcactgagattgggagggtgccttcacatcttgcccatcgcaccaggaatgcattagataatttagttatgttacacacaagtgaacacggcggcagagcatatagacatgcggttgaagaattgccggaaacaatggaaaccttgttattattaggactgatgatcttgttaacgggaggggctatgcttttccttatctcaggtaagggaattgggaaaacatctataggacttatttgtgtaatagcaagttcggggatgttatggatggcggaaataccattacaatggatagcatctgccattgtactagaatttttcatgatggtactactgataccagaacccgaaaagcagagaacaccacaggataatcaactggcttatgtagttataggaatattaactctagcagctatcattgcggcgaatgagatgggacttctagaaactacaaagcgtgatctcggaatgagtaaagaacccggtgtcgtgagtccaacttcctacttagatgttgatctacatcccgcgagtgcatggactctgtacgcagtagctacaactgttattacaccaatgctaaggcacacaatagagaactcaaccgcaaatgtcagccttgcggcgatcgccaatcaagcagtggtactgatgggactggacaaaggttggccaatttccaaaatggacttaggtgtacccttactcgctttaggctgctacagccaggtaaacccactaacgctgactgctgctgtgttactattaataactcattatgccattattggacccggtctacaagcaaaagctaccagagaggctcagaaaagaacagctgctggtataatgaaaaatcccacagtggatgggattatgactatagacttagacccggttatctacgactcaaaatttgaaaaacaactaggccaggtgatgctcttagtactatgtgcggttcaactgcttttgatgagaacatcatgggctctctgtgaagccctcactttggcaacaggacctatcacaactttatgggagggatctccaggaaaattttggaacactacaatagccgtatcaatggcaaatatctttagaggatcgtatctagccggtgcaggattagcttttagtattatgaaatcggttggaaccggaaagcgagggactggatcgcaaggcgaaaccctaggagaaaaatggaagaagaaactgaaccaattgagtagaaaagattttgacctctacaagaaatcaggtataaccgaagtggatcgcaccgaagctaaagaaggactaaaaagaggtgaaataacgcaccatgccgtttcaaggggtagtgccaaactacaatggtttgtggaacgtaatatggtgatccccgagggaagagtaatagatctgggctgcgggcgagggggctggagttactactgtgctggattaaagaaagttaccgaagtacgggggtacaccaaagggggaccaggacacgaagaacccgttcccatgtcgacctatgggtggaacattgtaaaactaatgtctggaaaggatgttttctatctacccccggaaaaatgcgatacactactttgcgacataggtgaaagctcaccttctccaacagtcgaagaatcccgaactatacgagtattaaaaatggttgaaccgtggctcaaaaataatcaattctgcataaaagtgcttaacccctacatgcccacggtaattgaacacttggaacggctccaaagaaaacatggaggcatgctagtcagaaaccctttatcccgaaattccactcatgagatgtattggatttctaatggaaccggaaacatagtcgcttcagtcaatatggtctcaagacttctacttaaccgtttcaccatgacgcataggcgcccaacaattgaaaaagacgtagacttaggtgctggaacgagacacgttaatgccgagccagagacccctaacatggacgtaattggagaacgaattaaaagaatcaaagaagaacataattccacatggcattatgacgacgaaaatccttacaagacgtgggcttatcacggatcttatgaagtaaaagcaaccggatcagcgtcgtctatgattaatggagtagtaaaactactaacaaaaccatgggatgttgtaccaatggtaacacagatggctatgaccgatacaacacctttcggtcaacaaagagtatttaaagaaaaagtagatacgagaacaccaagatccatgcctggcacacgaagagttatgggaataaccgcagaatggttatggcgtaccttaggtagaaataagaaaccaagactttgtacaagagaggaatttactaagaaagttagaaccaatgcagccatgggcgccgtctttacagaagagaaccaatgggactcagcaaaagcggccgtggaagatgaagatttttggaagctagtagatcgagaaagggaattacacaaacttggaaagtgcggcagttgtgtatataacatgatgggtaagcgagagaagaaactcggagagttcggtaaagcaaaaggttcgcgcgcaatttggtatatgtggttaggggccagatatcttgagtttgaagccttgggttttctgaatgaagaccactggttctctagagagaatagttatagtggtgtagaaggtgaaggtttacataaattaggctatatacttcgagatatcagtaaaattccaggaggggctatgtatgccgacgacacagctggttgggatacacgaataacagaagatgatttgcataatgaagagaaaattacacaacagatggatccagaacacaggcaactcgcgaatgcgatcttcaaactcacctaccaaaacaaagtggtaaaagtacagcggcctacgccaacaggcacagtaatggacataatatcccgaaaggatcaacgtgggtcaggacaagtcggcacttacggactcaatacatttactaatatggaggcgcaactaattagacaaatggaaggcgagggtgtgctatctaaagccgatctagagaacccccatcttcccgagaagaaaataacccaatggttagaaacgaaaggtgtagaaagattaaagcgaatggcaattagtggagatgactgcgtggtaaaaccaatcgatgatagattcgctaatgctctactcgccttgaacgacatgggaaaggtacgaaaagacattccgcaatggcaaccaagtaaaggttggcacgattggcaacaggtacctttctgcagccaccacttccacgaattgataatgaaagatgggagaaaactcgttgtaccgtgtcgaccacaagatgaactaataggcagagcacgaatatcacaaggtgcggggtggtctttaaaggagacggcgtgcttgggaaaggcgtatgcccaaatgtggtcccttatgtactttcacagaagagatctacgtctggcatctaatgcaatctgttcagcagtcccagtccactgggtaccaacgagtagaaccacatggtctatacatgctcatcaccaatggatgacaactgaggatatgttgacagtatggaacagagtctggatagaagacaatccttggatggaagacaagacgccagtgacaacatgggaaaacgtaccttacttgggaaaaagggaagaccagtggtgtggatcactcataggtctaacatctagggctacttgggctcaaaacataccaacagcaatccaacaggttcgttccttaatagggaacgaagagttcttagattatatgccatcgatgaagcgattccgaaaagaagaggaatcagaaggagcaatttggtaa

SEQ ID NO: 23200 - RNA, 9873 nt, synthetic construct
  misc_feature 1..9873: note = derived and/or modified CDS sequence (opt6) from DENV-3__HQ891025__SS-prME
  source 1..9873: mol_type = other RNA
accagcttatgtttaatgatgattttaccagccgccctagcttttcatttgacatcgagggacggggaaccacgtatgatcgtaggcaaaaatgaaagaggaaaaagccttttatttaaaacagcatctgggattaatatgtgtactctaattgctatggacttaggtgaaatgtgtgatgatactgtgacgtataaatgtccgcacatcactgaagtagaacctgaagacattgactgctggtgcaatttaacctcgacatgggtaacatatggaacatgcaatcaagcgggtgaacacagaagggataaacggagtgtggcactggcacctcacgtgggcatggggctcgacactagaactcaaacatggatgagcgctgaaggcgcatggagacaggttgaaaaagtcgaaacgtgggcccttagacatcctggatttacaatcctcgcactatttttggctcattatattggtacaagccttactcaaaaagtagtaatcttcatactgctaatgctagttactccatcaatgaccatgagatgcgtcggagtaggaaatcgagacttcgtggagggtctctcaggtgctacatgggtagatgtagttttagaacatggcggttgcgttacaacaatggctaaaaataaaccaactcttgacatcgagctacagaaaacagaggcaacacaactagcaacgttgaggaaactttgtattgaaggaaaaataacaaatataaccacggatagtcgatgtccaactcaaggcgaggcgacattaccagaggaacaagaccaaaactatgtatgtaaacacacttacgttgacaggggatggggaaatggatgtggcctattcggcaaaggatctcttgtcacttgtgcaaaattccagtgtttagaaccaattgagggaaaagttgttcagtacgagaatttgaaatatacagtaataattaccgtacacactggagatcaacaccaagtagggaatgagacacaaggggtaacagcagaaataacaccgcaagcgtccaccacggaagccattcttccagaatatggtacacttggactggagtgctcccccagaactggtctcgactttaatgaaatgattctcctaacgatgaaaaataaagcctggatggtacatcgtcagtggtttttcgacctgcccttaccgtggacttctggggccacaaccgaaacgccaacttggaatagaaaagagttattagttacattcaaaaatgcacacgctaagaaacaagaagttgttgtgttgggttcacaggaaggagctatgcacacagcattgaccggagccacagaaattcaaaattccgggggtaccagtatttttgccggccatctcaaatgccgcctaaaaatggacaaactagaactaaaaggcatgtcgtatgctatgtgcaccaacacttttgttctaaagaaagaggtatccgaaactcagcacggaacaatacttataaaagtagaatataaaggtgaagacgtgccttgtaaaattccgttcagtactgaggacggccagggtaaagcacataatggacgcttgattacagctaatccagtggtaaccaagaaagaggaacctgttaacatagaagcagaaccgccttttggcgaaagcaatatcgtaataggtatcggagataacgcattgaaaattaactggtacaagaaaggatcatctattggaaaaatgtttgaagctacagcaagaggggcacgtcgaatggctatcctgggagacacagcatgggattttggatcagtaggaggggtgctaaactcactcggaaaaatggttcatcaaatctttggtagcgcgtataccgcgttgttttctggagtatcctgggttatgaaaatagggataggggttctactaacctggataggattaaattcgaaaaacaccagcatgagcttcagctgcatcgctattggtataataactctctatcttggagctgttgtgcaagcagatatgggatgcgtcataaactggaaaggcaaagagctgaaatgtggaagcggaatctttgttacaaatgaagtccacacttggaccgaacaatataaattccaggcagattcccccaaaagacttgctaccgcaatcgcaggagcatgggaaaacggagtatgtggtataagatccaccactaggatggagaacctactgtggaaacaaatagccaatgaactaaattatatactctgggaaaacaacataaaattgacagtcgtagtaggagatattataggagtcctggagcaaggtaaaagaactttaacaccacagcctatggaacttaaatattcatggaaaacttggggaaaagccaaaatcgtaacagctgaaactcaaaattcctcatttataatagacggtccaaacacaccggaatgtccaagtgtatcgcgggcttggaacgtttgggaagtagaggattatggatttggagtatttactaccaatatatggctcaaactgcgtgaagtatacacacaactctgcgatcacagattaatgtcggccgccgtaaaggacgaaagggcagtacacgcagatatgggatactggattgaaagtcagaaaaatggaagttggaaattagaaaaggcatctcttattgaagttaagacatgtacgtggccgaaaagccatacgctctggtcaaatggtgtattggaatcagacatgatcattccgaaatcgttagctggcccaatctcacaacataatcatagacccgggtatcacacacagacagccgggccatggcatctaggtaaacttgagttagatttcaattattgtgaaggtacaacagtcgtaatcaccgaaaactgcggaacccggggtccatcacttagaaccaccacagtgtcaggaaagttaatacatgagtggtgttgccgctcttgcacattgcctcctctgagatatatgggggaggacggttgctggtacggaatggagataagacccatctcagaaaaggaggaaaatatggtaaaaagtttagtgagtgcagggagtggaaaagtagacaattttacgatgggagtcttgtgtcttgcaattttattcgaagaagttatgcgaggaaaatttggcaagaaacacatgatagcgggagtatttttcacctttgtactattgttaagtggacaaattacgtggagagatatggcgcacacgctaataatgatcggatcaaacgcctctgataggatgggaatgggcgtaacttatctagcgcttatcgctactttcaaaatacagccgttcttagcgttgggcttctttctgaggaaattaacatcaagagaaaacttattacttggagtgggcttggcgatggcaactaccctacaactacctgaagatatagaacaaatggcaaatgggatcgcattaggattaatggcattaaaattaataactcaatttgaaacataccaactctggaccgcattaatatcattaacttgtagtaacacaatttttactcttacagtcgcctggcgaacagccacattgattctagctggagtaagtttattgcctgtatgtcaatcctcctcaatgcgaaaaaccgattggctaccaatggcagtggccgccatgggcgtacctcctttgccgttattcatcttcggtttgaaggatacattaaagagacgcagttggcccctgaatgaaggcgttatggcagttggattagtcagtattctggcatcttcactattgagaaatgatgttcctatggcaggtcccctagtcgctgggggcttattaatcgcatgttacgtaattacaggcacatcggctgacctaacagttgagaaggcggcagacataacctgggaggaggaagcagagcaaaccggcgtaagtcacaatttgatgataaccgtggatgatgatggtaccatgcgtattaaagatgatgaaacggagaacatattaacagtgttattaaaaaccgccctcttaattgtttcaggcattttcccatacagcatacccgcaaccttgctagtctggcatacgtggcaaaaacaaacgcaaaggtcaggggtcctatgggacgttccaagtccgccagaaacccagaaggcagagcttgaggagggagtttaccgaataaaacagcaggggatcttcggcaaaacacaggttggagtaggagttcagaaagaaggagtattccatacaatgtggcatgtgacccgtggcgcagtattaacgtacaatggtaaaagattggaacccaattgggcctcagtgaagaaagatctaatctcttatgggggtggatggagattatcagcccaatggcagaaaggagaggaggttcaagtaattgcagttgaacctgggaaaaaccctaaaaatttccaaacaatgcctgggacctttcagaccactacaggtgaaatcggtgctatagcactggactttaaaccaggtacatctggttcaccaattataaacagagaaggtaaagtagtgggattatatgggaatggtgtagtaactaagaacgggggttacgtgtctggaattgcacaaacaaatgcagaaccggatggaccaactcccgaactcgaagaagaaatgtttaagaaacgtaatcttactattatggatctacatccagggtcaggcaagactagaaaatacttaccggctattgtcagagaagcaattaaaagacgtctacgtaccctcatactcgcaccaacaagggtggtagcagcagaaatggaagaagcattaaagggcttaccaataagataccaaacaacagcgactaaatcagaacataccggccgtgaaatagtggacttaatgtgccacgcaacatttactatgagattactttcacctgtaagagttcctaactacaacttaatcatcatggacgaggcgcactttaccgatcctgcttcgattgcagcacgagggtacatttctaccagggtggggatgggagaagcggctgccatatttatgacagctacacctcctggaacagcagacgcttttccacagtcgaatgctccaattcaagacgaggaaagggatataccagagagatcatggaactcaggcaacgaatggataaccgattttgcaggtaaaactgtttggttcgtaccctcaataaaggcaggtaacgacattgcaaattgtcttcggaaaaacggcaaaaaggtaatacaattatcacgtaaaaccttcgacactgaataccagaaaacaaaattaaatgactgggactttgtggtaactacagacataagtgaaatgggagcgaattttaaggcagatcgtgtcattgacccaagaagatgtctcaaaccagtaattttaacggacggaccggaaagagtgatcctagcagggcctatgcctgtgactgctgcaagtgctgcacaaagacgaggacgcgttggcagaaatccccaaaaagaaaatgatcaatatattttcacaggtcaaccgttaaataatgatgaagatcatgcgcactggacggaagctaaaatgctattagataatataaatacaccagaaggtataataccagcattatttgaaccagaacgggaaaaatcagcggcaatagacggcgagtataggctaaaaggagaaagtcgaaaaacgttcgttgagctaatgcgtcgaggagaccttccggtctggctagcccataaagtcgcaagcgaaggcataaagtacacagatcgaaagtggtgtttcgatgggcagagaaataaccagatcttagaagagaacatggatgtagagatatggacaaaggagggtgagaagaagaaactgcgaccacgatggttagacgccaggacgtactccgacccactagccttaaaagagttcaaagagtttgcagcaggtagaaaaagtatcgcccttgacttagtaaccgaaataggaagagtccccagtcatcttgctcatcgaacccgaaacgccttagataatctagtaatgttacatacgtccgaacatggcggtcgagcgtaccgtcacgcggtggaagaattacctgaaacaatggaaactcttctgttactaggtttaatgattctattaacaggaggtgctatgctattcttaatatccggtaaaggaataggaaaaacgtcgattggattaatatgtgttatagcttcttcaggaatgttatggatggcagaaatacccctccaatggatagcttcggctatagtacttgaatttttcatgatggtactcctcattcctgagcctgaaaagcagcggacaccacaggataatcagctagcgtatgtggttattggaatactgactttagcagctatcattgcagcgaatgaaatgggcttactagaaacgacaaaaagagacttaggaatgtcaaaagaacctggggtggtaagtccaacctcttatcttgatgtcgatttacatcctgcctctgcttggacactgtacgcagtggcaaccacagtcataactcccatgctaaggcatacaatcgagaacagcacggctaacgtttcattggcagcaatagcaaaccaagcagtggtcctgatgggtctcgataaaggatggccgattagcaagatggacctaggtgttccattgttagctcttggttgttactctcaagtcaacccattgacacttacggccgcggtactgcttttgatcacacactatgcaataataggaccaggattacaagcgaaagcgacgcgcgaagcccagaaacgcacagcggctggtattatgaaaaacccaacagtggacggcattatgactatagacctagatcctgtgatttacgactcaaaatttgaaaaacaattggggcaagtaatgttactggtactatgcgcagtacagctattacttatgcgaaccagttgggcgttatgtgaagctctaactttagctacaggacctattactacgctctgggagggatcaccaggaaaattctggaatacaactatagcagtaagtatggctaacatattcagaggtagctatttagccggagcagggcttgcattctccataatgaaatccgttggtacaggaaagaggggtactggatcacaaggggaaacgctaggtgaaaaatggaagaagaaactgaatcaattatcaagaaaagattttgatctttacaagaaatccggaattaccgaagtggacaggactgaggcaaaagagggcctgaaacggggtgagataacccaccatgcggtaagtaggggaagcgcaaaattacagtggtttgtagaaagaaatatggttataccagaaggtagagtcatagacctcgggtgtggaagaggtgggtggtcttattactgtgctgggctaaagaaagtcactgaagtcagaggttatactaaaggtggtccaggtcatgaagaaccagttcctatgagtacatatggttggaacattgttaaactcatgtcaggaaaagatgtcttttacttaccgcctgagaagtgtgatactctgttatgtgatatcggcgaatctagtccctcaccaacggtagaagagagtaggacaatacgagttctcaagatggtggaaccgtggctcaaaaataaccaattctgcataaaagtactaaacccttacatgccaactgtaatagaacatttagagaggctacaaaggaaacacggtggaatgttggtgcgcaacccgctctcaagaaattcaacacatgaaatgtattggatttctaatggaactggtaatatagtagctagtgtaaatatggtgtccagactcttgctaaatagatttacaatgacgcacagacgacctactatcgagaaggatgtagatttgggagcgggaactagacatgttaatgccgagcctgaaactccaaacatggatgtaataggcgagcgcattaagaggattaaagaggagcacaattcgacctggcattacgatgacgaaaatccgtataaaacatgggcataccacggaagctatgaggttaaagcgacaggctctgcatcttcaatgattaatggagtggtaaaactgctgacaaagccatgggatgtagtgcccatggtgacacaaatggccatgaccgacacaactccctttgggcaacaaagagtctttaaggaaaaggtagatactagaacgccaaggtctatgcccggaaccagaagagtgatgggtattactgctgaatggctttggagaacgcttggtcgaaataagaaacctcgtctatgtacacgtgaggaatttacaaagaaggtaaggactaatgcagcaatgggagcggtcttcaccgaggaaaatcagtgggattccgcaaaagctgcagttgaggatgaagacttttggaagctagtagacagagagagagaacttcacaagttgggtaagtgtggaagctgtgtatataacatgatgggaaaaagagagaagaaactcggagagtttgggaaagctaagggatcaagagctatttggtacatgtggctgggggcccgttacttggagttcgaagccctaggcttccttaatgaagatcactggttcagcagagaaaattcatacagtggagtagagggagaaggactacacaaactcggatatatattacgagatatttcaaaaataccaggaggagccatgtatgccgacgatacagcaggatgggatactcgcatcactgaagatgacttacacaatgaagagaagattactcaacaaatggacccagaacacagacaattggcaaatgccatcttcaaactaacatatcagaacaaggtagtaaaagtgcaaaggccaactccaactggaacagtgatggatataataagtcgaaaagaccaacgggggagcggtcaggttggaacttatggacttaatacatttacaaatatggaggctcaattaataaggcaaatggagggggaaggggtattatcaaaggctgacttagaaaatccacacctcccggagaagaaaattacgcaatggttagaaacaaaaggggtagagaggctaaaacgtatggctataagtggagacgattgtgttgttaaaccaattgatgacagatttgcgaacgcacttctagcgcttaatgatatgggcaaggtccgaaaggatatacctcagtggcaaccttcgaaaggttggcacgactggcaacaggttccattctgttcgcatcatttccatgaattgattatgaaagatggaagaaagttggtagttccatgccgtccacaggatgaattaataggaagggcaaggatatcacaaggagctggttggtcattaaaagaaaccgcatgcttggggaaggcctacgcacaaatgtggagcctgatgaactttcatcgtagagacctacgattggcctcaaatgcgatttgtagtgctgtgccagtccattgggtaccaacatcaagaacaacttggtcgattcatgctcatcatcaatggatgacaacagaagacatgcttacagtatggaaccgggtatggatagaggataatccctggatggaagataaaacgcctgtgactacctgggagaatgtcccgtatctcggaaaacgagaagatcaatggtgcggatctcttataggccttacaagcagagctacatgggcacagaacatacctacagcaatacagcaagtaagatctcttatcggtaatgaagaatttctcgattacatgcccagtatgaagagattcagaaaggaagaggaaagtgaaggggctatatggtaa

SEQ ID NO: 23201 - RNA, 9873 nt, synthetic construct
  misc_feature 1..9873: note = derived and/or modified CDS sequence (opt6) from DENV-3__HQ705617__SS-prME
  source 1..9873: mol_type = other RNA
acgagcctttgtctaatgatgattttaccagcggctttggcattccatttaacttcgagggacggagaaccccgaatgatcgtaggcaaaaatgaacgaggtaaatcgttactgttcaaaacagcaagcggtataaatatgtgtacattaattgctatggatttaggagaaatgtgtgacgatacagtaacatataaatgcccacatattacggaagttgagccagaagacattgattgttggtgcaatttaacgagcacatgggtcacatatggtacttgtaatcaagccggcgaacataggcgtgacaaaagatcagtagctttggcccctcatgttggaatgggcttggatacaagaacccaaacatggatgagcgcggaaggggcatggcggcaagttgaaaaagtagaaacttgggcactacgtcatcccggatttaccatattagctttgtttttggcacattacataggaacttctctcactcaaaaagtagttatttttatattactgatgctggtcacacccagtatgacgatgagatgcgtaggagtcggcaaccgagactttgtagaaggactcagtggagctacatgggtggacgtggtacttgaacatggaggatgtgtaaccacaatggccaaaaataaacctactcttgatattgagctccagaaaacagaggcaacccaactagcaacactaagaaaactttgcattgagggaaaaataacaaatattacaactgatagtagatgtccaacacaaggcgaggcaacattaccagaggaacaggatcaaaattatgtatgcaaacacacctacgtagaccgaggatggggaaatggctgtggcttatttggcaaaggcagccttgtcacctgtgcaaagtttcagtgtctggaacccatagaaggtaaagtcgtccaatacgaaaacctaaaatacaccgtaattataacagttcacacaggggaccaacaccaagtgggtaacgaaactcaaggggttacggcggagattaccccacaagcctcaacgacagaagcgatcttacctgagtatggcacattaggcctagagtgttctccaagaactggtctcgactttaatgaaatgattttactgacaatgaaaaataaagcatggatggtacatagacaatggttcttcgatttaccactgccatggacaagtggagccaccacagaaactccaacgtggaatcgcaaagaactattagtaacttttaaaaatgctcatgccaaaaagcaagaagtagtagtactaggctcacaggaaggagcaatgcatactgcattaacaggtgcgacagaaattcaaaactcagggggtacaagtatattcgcagggcacctgaaatgtcgattaaagatggacaaactagaactgaagggaatgtcatacgctatgtgcactaatacatttgtattaaagaaagaagtcagcgaaacacaacatggaactatactcattaaagttgaatataaaggcgaagacgttccctgtaaaataccattttcaacagaagacggtcaaggtaaagcacacaacggaagattaataactgctaacccagttgtaactaagaaagaagaacctgttaatatagaagcagagccaccattcggggagtccaacatagtgataggaataggcgataacgctttaaaaattaattggtataagaaaggaagtagcataggcaaaatgttcgaagctacggctaggggcgctagaagaatggccatactaggtgatactgcgtgggattttggttcggtcggaggggttctcaattctttaggaaaaatggtgcatcaaatattcggttcagcttatacagccttattctctggggtttcttgggtgatgaaaattggtataggagttctccttacctggataggtttaaactctaagaacacctcgatgagtttctcttgcattgcaataggaataataaccctttatttaggcgcggtagtccaagccgatatggggtgcgtgataaactggaagggaaaggaacttaaatgtggaagtggaatttttgtaaccaatgaggtccatacttggaccgagcaatacaaatttcaagccgattctccaaaaaggctagctactgcaatcgcgggcgcctgggaaaatggagtatgtggtatacgtagcacaacccggatggagaatttgttatggaaacagattgccaatgagcttaactatattctatgggaaaataatatcaaactaactgtagtagtcggggatatcatcggcgtattagaacaaggaaaaagaacattgactcctcaaccgatggaactaaaatatagctggaagacatggggaaaagctaaaatagtgacagcagaaacacaaaactccagctttataatagatggaccaaatacaccggaatgtccaagcgtcagtcgcgcatggaatgtgtgggaagtagaagactacggatttggtgtattcacaactaacatatggttgaaactaagagaagtatacacacaactgtgtgatcatcgattaatgagtgcagctgtaaaagatgaacgcgccgtccacgctgatatgggttattggatagaatcccaaaagaacggatcctggaagttggaaaaagcatccctgattgaagtcaaaacatgcacgtggccaaaatctcatactttatggagcaacggagtactagagtcagacatgataatacccaagtcactagcgggccccatttcacaacataaccacagacccggatatcatacacaaactgcaggtccgtggcatttaggtaaactcgaactagatttcaattattgtgaaggtaccacagtagtaattaccgaaaattgcggaaccagaggaccatcactgcgtactactaccgtatcggggaagttaattcacgaatggtgttgtagaagctgcaccttaccgcctctacgatatatgggcgaagatggatgttggtacggaatggaaatacgtccaatatcagaaaaggaagaaaatatggtgaagtcacttgtatctgcagggtcggggaaagtcgacaatttcaccatgggtgtattatgcctagccattctcttcgaagaagttatgaggggaaaatttgggaaaaagcatatgattgccggtgtattctttacatttgtactactattatctggacaaataacgtggcgagatatggcccataccttaattatgataggtagtaatgcatccgatcgcatgggcatgggagttacgtatctggcattaatcgcaacctttcgtattcagccgttcctcgcattaggtttcttcttaaggaaattaacttcacgggagaacttactgctaggggtcggattggccatggctacgacattacaacttccagaagatatcgaacagatggcaaatgggatagctctaggcctaatggcactgaaattaataacccaatttgagacatatcaattgtggacagcgttaatatctttaacctgttcaaatacaattttcacattgactgttgcttggagaactgcaacgctaatcttagcgggggtcagtcttctgccagtgtgtcagagtagtagtatgcgcaagactgattggttaccaatggccgtcgctgctatgggcgtaccacctctccctctctttatatttggattaaaagatacgcttaaacgacgaagctggccattaaatgaaggggttatggctgtgggattagtttcgatccttgcgtcctctctactacgtaatgacgtgcccatggcaggacccttggttgccggaggtctgctcatcgcttgctacgtgataactggaaccagcgcagaccttactgttgaaaaggcagccgatataacatgggaggaagaagcggaacagaccggagtaagtcataacctaatgataaccgttgatgatgatggcaccatgcgcatcaaagacgacgagacggaaaatatattaacagttttattgaaaacagcgttattaattgtgtcaggcatttttccttactcaattcccgcaactctactcgtgtggcacacttggcaaaaacagactcagagatcaggtgttttatgggatgtcccgagcccacccgaaacacaaaaagcagaactcgaagaaggagtatatcgaatcaagcaacaagggatttttggtaaaacgcaggtcggagtcggcgttcaaaaagagggagtcttccacactatgtggcatgttacaagaggggctgtccttacctataacggtaagaggctagaaccaaactgggcatcagtcaagaaagacctgatttcatacggaggcggatggcgtttatcggcacaatggcaaaaaggagaagaagttcaagtaatagcagtagaaccgggtaagaatccaaagaatttccagacaatgccggggacttttcagacgacaacaggagaaataggagcaatagcattagattttaaaccaggcacgtcagggagccctattataaacagagaaggcaaagtggttgggctttatgggaacggagtggttaccaaaaatggaggctatgtaagcggaatcgcacagacgaatgccgagcccgatgggccaactcccgaactggaagaggaaatgttcaaaaagagaaatctaactataatggacctgcatccaggctccggaaaaacaaggaaatatctgcccgcaattgttcgcgaagcaataaaacgacgcctacggacgttaatactcgctccaaccagggtagtagcagcagagatggaagaagctcttaaaggattgccgataagataccagacaacagctacaaaatcagagcacacaggtagagagatagtggatctaatgtgccatgccacgtttacgatgagattactttcacccgtaagagtccccaactacaacttaataattatggatgaagcccactttactgaccctgcatcaatagccgccagaggatatatatccactcgagtaggaatgggtgaagcagcagcaatttttatgacagcaacaccaccaggcactgctgatgcgttcccgcaatcaaacgcaccaatacaagacgaagagagggatatacctgaaagatcatggaatagcggcaatgaatggataacagattttgctggaaaaacggtctggttcgtcccatcaataaaagcaggcaatgatatagctaactgccttcgaaagaatgggaagaaagtcattcaacttagtagaaaaacattcgacactgaatatcagaaaacaaaactaaatgattgggactttgttgtaacaacagacatatcggagatgggggcaaacttcaaagcggacagagtaatcgatccaagacgatgtttaaaacctgtaatattaacagatgggccggaaagggtaatactggccgggcccatgcctgtcacagcggctagcgccgcccaaagacgtggaagagttggcagaaacccccaaaaagaaaacgaccagtatatttttacaggtcagcccttgaataatgatgaggaccacgcgcactggacagaggccaaaatgttgctggataatattaatacacccgagggtataataccagccctttttgaacctgaacgcgaaaagagcgctgctattgatggagaatataggctgaaaggcgaatcaagaaaaacattcgttgaattaatgagacgaggagatctacccgtgtggctcgcccacaaagtggcaagcgagggtataaaatacacggatagaaaatggtgttttgatggtcaacggaataatcaaatattagaagaaaacatggatgttgagatatggactaaagaaggagagaagaagaaattgaggccacgctggctagatgcaaggacatacagtgacccattggctttaaaagaatttaaagaatttgctgccggaagaaaatctatagcactagatttggttactgagatcggaagggtgccttcacatcttgctcacagaacacgtaacgcattagataatctggttatgcttcatacctcagaacatggcggacgagcgtatcgacatgcagttgaagaattaccggaaacaatggaaacgctccttttattgggtttgatgatattattgacgggaggcgccatgttatttttaatttccgggaaaggaatcggcaaaacaagcataggcctaatttgcgttatagcttctagcggaatgttgtggatggcagagatcccattacaatggattgcgtctgctatcgtactagaatttttcatgatggtccttcttataccagaaccagaaaagcagagaaccccacaagacaatcaacttgcatacgtagtaataggtattttaacccttgcagctataattgccgcgaacgaaatgggactactagaaaccactaaacgcgatcttggaatgagtaaagagccaggcgtagtgtccccgaccagctacctagatgtagacctacatccagcaagtgcctggacactatacgctgtcgcaacaaccgtcattacaccaatgctcagacatacaattgaaaactcaactgcaaacgtatcattggctgccatagcaaatcaagcagtcgtcctaatgggcttagacaaaggttggcccatcagcaagatggacttaggagtgccattgttagctctcggatgttattcacaagtcaatccgctgacattaactgctgcggtgctcctactgataactcattacgcgattattggtccaggtttacaggcaaaagcaacaagggaagctcagaaaaggacagcggcaggaattatgaaaaacccaaccgtagatggtataatgacaattgacctagacccagttatctatgattcaaaattcgaaaagcagttagggcaggtaatgctattagtactatgtgcagtacaattactgctcatgcgtacttcgtgggcattgtgtgaggctctaacgcttgcaacagggcccataacgactttgtgggagggctccccaggtaaattttggaacacgactatagctgtctcaatggctaatatcttcagagggtcctatctggcaggcgcgggattagcattttctataatgaagagtgtcggtacggggaaacgaggaacaggttcacagggcgaaacgcttggagaaaagtggaaaaagaaacttaatcaacttagccgtaaagactttgacctatacaagaaaagtggaataactgaagtagatcgcactgaggcgaaggaaggtttgaaaagaggcgaaataacccatcatgcagtaagtaggggatctgcaaaacttcagtggtttgtcgaacgcaatatggttataccagaaggccgggttattgacttaggttgcggtaggggaggatggtcttattattgcgcaggactaaagaaagtaacagaggtacgcggatacacaaaaggtggaccaggacatgaagaacccgtccctatgtccacatatgggtggaacatagtgaaactaatgagcggcaaagacgtcttttatctaccaccagaaaaatgtgatacattattgtgtgacatcggcgagtcttctccgtcacccaccgtagaggaatcgaggacaataagggttttaaaaatggttgaaccatggcttaaaaacaaccaattttgtatcaaagtacttaacccatacatgccgacggtaatagagcatctagaacgattgcaaagaaaacatggcggcatgctggtgcgaaacccgttaagtcgaaattcgacacatgaaatgtattggatatcgaatggtacaggtaacatagtcgcgagcgtaaatatggtgagtagactcttgcttaacagatttaccatgacccatcgacgtccaacgatagaaaaagatgttgacctgggagcaggaaccagacacgtgaatgcagaacccgagactcctaatatggacgtaataggggaacgtattaaaaggataaaagaggaacacaattcaacatggcattatgacgacgagaacccttacaagacatgggcatatcatggctcatatgaagtaaaagctactggttctgcgtctagtatgataaatggagttgtcaaattgttgacaaagccatgggacgtagtacccatggtcacacaaatggctatgacagacacaacacctttcggtcaacaaagagtatttaaagaaaaagtcgatactcgtaccccacgatcaatgcccggcacacggagagtaatgggtatcacagccgagtggctatggagaacattgggacggaacaaaaagccacgattatgtaccagggaagagtttacgaaaaaggttcgaacgaacgcagcaatgggtgctgtttttacagaagaaaatcaatgggactcggctaaagcagcagtagaagatgaagacttttggaaattagtggacagagaacgggaactccacaagctgggaaagtgtggatcgtgcgtgtataatatgatgggtaaaagggagaaaaagctaggagagtttggtaaagccaaagggtcacgagcgatttggtatatgtggctcggagcccgttatttagaatttgaggctttggggtttcttaacgaagatcactggttttcaagggaaaatagttactctggtgtggagggtgaagggcttcacaagttaggctatatcttgagagatatcagtaaaataccagggggagctatgtacgcggatgacacagcaggatgggatactagaattactgaagatgacctccataacgaagagaaaataacgcaacaaatggacccagaacataggcaactagcaaatgctatcttcaaattgacgtatcaaaacaaagtagtgaaagtacaacgacccacgcctacaggtaccgttatggatataataagtagaaaagatcagcgcggatcgggccaagtaggcacatatggattaaacactttcacaaacatggaagcacaattgatccggcagatggagggagaaggggtgctatcaaaagcagatttggaaaacccacaccttccagagaagaaaataactcaatggttagagacgaaaggcgtggaacgtctaaaaagaatggcaatatcaggtgacgattgcgtcgttaagcccattgacgatagatttgcgaatgccctattagctttaaatgatatgggcaaagtaagaaaggatatccctcaatggcaacctagtaaagggtggcatgactggcaacaagtcccattttgttctcaccatttccacgagctaattatgaaagacggaagaaaactcgtagtcccatgtcgacctcaggacgaattaataggacgggcacgcatatcacaaggcgccggatggagtctgaaggagactgcgtgcctgggtaaagcatacgcgcaaatgtggtcgctaatgtattttcatcgacgtgatctacgtttagcttctaatgcgatatgtagtgcagttcccgttcattgggtaccgacaagcaggacaacttggtcaattcatgcacatcaccaatggatgaccactgaagatatgctcacagtgtggaaccgtgtatggatcgaagataacccctggatggaggataaaacacccgttacaacttgggagaatgtaccgtatttaggaaaaagagaagatcaatggtgtggatcattgatcggcttaacctcccgggcgacgtgggcacagaatataccaacggctattcaacaagttagaagccttataggaaatgaagaatttctagattatatgcccagtatgaaaagattccggaaagaagaggaatccgaaggagcaatttggtag

SEQ ID NO: 23202 - RNA, 9873 nt, synthetic construct
  misc_feature 1..9873: note = derived and/or modified CDS sequence (opt6) from DENV-3__HQ705619__SS-prME
  source 1..9873: mol_type = other RNA
acttcattgtgtctcatgatgatattaccagctgcactagcgtttcatttaacttctcgggacggagaaccaagaatgatcgtcgggaaaaacgaaagaggaaaatcattgttatttaaaactgcatcgggaatcaatatgtgtactctcatagcaatggatcttggtgaaatgtgcgatgatactgtaacttacaaatgtcctcatatcaccgaagtcgaacctgaagatatcgactgttggtgtaatctaacgtccacctgggtgacatatggtacttgtaaccaagcaggagaacataggagagacaaacgatcggttgcattggcaccgcatgtaggtatggggcttgatacacgaacacaaacatggatgtcagcagaaggggcatggagacaagtagaaaaagtagaaacttgggcattaaggcatccaggatttacaatactcgctctctttcttgctcactacataggaacctccttgacgcaaaaagtcgttatatttatcctccttatgctagttactcccagtatgacaatgagatgtgttggtgtgggcaacagagatttcgttgaaggattaagcggtgcgacgtgggtagacgtagttcttgaacacggtggatgtgtaaccacaatggctaaaaataaacccacactagatatagaattacagaaaaccgaagcaactcaattggctacgttaaggaaactatgcatcgaagggaaaataaccaatattacgacagattcacgatgtcctactcaaggggaagccacattacctgaagaacaagaccaaaattatgtatgtaaacatacttacgtagatagaggttgggggaacgggtgcggtttgtttggcaaaggatccctagtcacatgcgcaaaatttcaatgtctagagcctatagaggggaaagtagtgcaatatgaaaatctcaaatacacagtcataataaccgtacacacaggagaccagcaccaggtagggaatgaaactcaaggagttacagcagaaatcacaccacaagcatccacgaccgaagctatattacccgaatatggaacactcgggttagagtgtagtccgagaaccggactagactttaatgagatgatactgttgactatgaaaaacaaagcctggatggtccatcgtcagtggttctttgatttacctctcccttggacatccggagcaaccaccgaaacgcttacatggaatcggaaagaactgttagtaacatttaaaaacgcacatgccaagaaacaagaagtagtagtgcttgggtcgcaagaaggtgcaatgcacactgcattaacgggcgctacggaaatacagaatagcgggggaacgtcaatatttgctggccaccttaaatgtagactaaaaatggataaattagaacttaaaggtatgtcatacgccatgtgtaccaatacattcgtattaaagaaagaagtaagtgaaacacagcatggaactattttaattaaagtagaatacaaaggcgaagatgttccttgcaaaataccgttttctacagaagacggacaaggaaaagcacacaatggacgcttaatcactgccaaccccgtagttacgaagaaggaggaacccgtaaacatagaagcagaacccccatttggagaatctaacatcgtgataggcataggagataacgcattaaagataaattggtacaagaaaggctcgagcattggaaaaatgttcgaagcaacagcaagaggtgctagaaggatggcgatactaggagacacagcttgggattttggtagcgtgggaggcgttctaaactctctaggtaaaatggtccaccagatctttgggagcgcttatacagcactcttctcgggagtctcatgggttatgaaaataggcataggtgttctgctaacgtggataggactaaattctaaaaacacatcaatgagcttctcgtgcattgctataggaataattacgttgtatttgggagctgtggtacaggcagatatggggtgcgtaattaactggaaaggtaaggagttgaagtgtggctctggtatctttgtaaccaacgaagtacatacttggacagaacagtataagtttcaagcagattcaccgaaaaggctagctacagccatagccggtgcttgggaaaatggcgtgtgtgggatccgtagtacaactcgtatggaaaacctactctggaaacaaattgctaatgaattgaactacatattatgggaaaacaacatcaaacttacagtcgttgttggcgacattatcggagtgttggaacaagggaaaagaacactcactccacaacctatggaactgaaatactcctggaagacatggggtaaggcaaaaatagtcactgctgaaacacaaaattcctctttcatcattgacgggccgaataccccagaatgcccaagtgtatcccgagcgtggaacgtttgggaagtagaagattatggatttggtgtcttcacaacaaacatatggttaaaattgagagaagtatatacgcaattgtgtgaccatcgcttgatgagtgctgccgttaaagacgaacgagctgtacatgccgatatggggtattggatagagagtcagaaaaatggtagttggaagctagaaaaggcgagtttaatagaggtaaaaacctgtacatggcctaaatcgcacacattatggtcaaatggagtactcgagtcagatatgattataccaaaaagtttggccggaccgatatctcagcataatcacagaccaggatatcatacacaaactgcagggccatggcacctaggtaaattagaactcgattttaattactgcgaaggaacgacagtagtcataacagaaaactgcggaacaagaggaccaagtttacgtacgactacggtttccgggaaactaatacacgaatggtgctgccgaagctgcacgctgcctccattgagatacatgggcgaagatggttgttggtatggaatggaaatcaggccaatttccgaaaaagaagaaaatatggtcaaatcgctagtaagcgcagggagcggtaaagtagataattttactatgggcgtcttatgtctcgcaatactcttcgaagaggtaatgagaggaaaatttggtaagaaacatatgatagcaggcgtattctttacttttgtgttactcctaagtggtcagataacctggcgagatatggctcatacgctaataatgattggatctaatgccagtgatagaatggggatgggagtgacgtatctagcccttatagccacgttcaagatacaaccttttctagcactaggattctttctacgaaaattaacaagcagagaaaatctgttgctaggagtcggtctagctatggcgacaacactacaacttccagaggatatagaacaaatggcaaatgggatagcactagggctaatggctttaaaattaattactcaatttgagacataccaactatggacggcattgattagtctaacctgctcgaataccatatttactcttacagtagcatggcgtacagccacattaatccttgctggtgtaagtctcttgcctgtgtgtcagagttcatccatgcgcaaaaccgactggttgcctatggcagtggcggccatgggagtaccgcctttgccattgtttatttttgggttgaaagatacactcaaacggagaagctggccactcaatgaaggtgtaatggcagtcgggctagttagtatcttagcgagcagtttattaagaaatgacgtacccatggcagggcccttagttgcagggggcctattaatagcatgttatgtcataacaggaacttcagctgatttgacagttgaaaaagctgccgacattacgtgggaagaggaagctgagcaaacgggtgttagccacaatttaatgattacagtagacgacgatggtactatgcgaataaaagacgacgaaactgaaaacattttaacagttctcctaaagacagcattattaatcgtatcaggtatcttcccatattcaatacccgcgacattattggtttggcatacctggcaaaagcaaacacaaagatcaggagtattatgggacgtaccgagtccacctgagactcagaaagcagaactagaagagggcgtttaccgcataaaacaacaaggaattttcggaaaaacacaagtcggtgtcggagttcaaaaagaaggtgtattccacacgatgtggcacgtaacaagaggagcagtcctaacgtataatggtaagagattggaaccgaattgggcgagtgtcaaaaaggatttaattagctacggcggaggctggcgattatctgcacaatggcagaaaggagaagaggtacaagtcatcgcagtcgaacctggcaaaaatcccaaaaattttcagactatgcctgggacatttcaaacgacaacaggtgaaataggtgctatagccttggatttcaagccaggtacatctggctcaccaataataaatagggaaggtaaagtcgttggattatacggaaatggagtcgtaacgaaaaatgggggatacgtatctggtattgcacagactaacgctgagccggatggtcctacacccgagttagaagaggaaatgttcaagaaacgaaatctaactatcatggatctccatcctggcagcgggaaaacccgtaaatatttaccagctatagtaagagaagccattaaacgtaggttgagaaccctaatacttgcgccaacgagagtagtagcagctgaaatggaagaggctttaaaaggtttaccaatacgatatcaaactaccgcaacgaaaagtgagcacacaggaagagaaatagtagacctgatgtgtcatgcaacgttcacgatgcgtttactgtcacccgtaagagtaccgaattacaatctaataataatggatgaggcacactttactgatcctgcaagcatcgccgcgcgagggtatatctcgactcgagttgggatgggtgaagctgctgcaatctttatgacagcaacgccacctggaacagcagatgcttttcctcaaagcaacgctcccattcaagacgaggaaagagatatacctgagagaagctggaactccggaaacgagtggataacagacttcgcaggtaaaaccgtatggtttgttcctagtataaaagcgggcaacgacatcgctaattgtctgcgtaagaacggaaagaaagttattcaattgagtagaaaaacatttgataccgaatatcagaaaactaaattgaatgattgggatttcgtggttaccacagacatctcagagatgggagctaacttcaaagcagacagagtgatagatccacgtcgatgcttaaaacccgtgatcttaacagatggaccagagagagttattttagctggaccaatgccagtcactgctgctagcgcagcacagaggagagggcgagttggtaggaatccacaaaaagaaaatgaccagtatatatttactggccagcccttaaataatgatgaggaccacgcccattggacagaggcgaaaatgttacttgacaatataaatacaccggaagggatcattccggcattatttgaaccagaacgagaaaagtccgccgctatagacggagaatatagattgaaaggagaaagtcgtaaaacatttgttgaactaatgaggagaggagatctaccagtatggttagcccataaagtcgcatcggaaggcataaaatatactgaccgaaaatggtgttttgatggccaaaggaataaccaaatcttggaagaaaatatggacgtggaaatttggactaaagaaggtgagaaaaagaaattacgacctaggtggcttgatgcgcgaacttactctgatcctttagccctaaaagagttcaaagagtttgcggccggacggaaaagcattgcactagatttagtaacggagataggacgagtaccgtcacatctagcccatagaacaagaaatgctctggataacctagtcatgttacacacctctgaacatggtgggagggcttatcggcatgctgttgaggagctcccagaaacaatggaaacgttattacttttaggtcttatgatactgctaacagggggagccatgctattcttaatttcaggcaaaggtattggaaaaacgtcaatagggttaatctgtgtgatagcatcatcgggtatgttatggatggcagaaatccctctacaatggatagcgagcgcgatagtattagagttctttatgatggtgctgctcatccccgaacctgaaaaacaaagaacaccacaagataaccaactagcttatgtcgttatcggaattttaacattagcagcgataatagcagcaaatgaaatgggattactagaaactacaaaaagagatctagggatgagcaaagagcctggtgttgttagcccaacgagttatttagacgtcgacttacatcccgcctccgcatggactctctacgcagtggcgacaacagtaattacaccaatgctgcgacatacgatagaaaatagcactgccaacgttagcttagcagcgatcgccaatcaagctgtagttttaatgggtctggataagggttggccaatatcaaagatggacctaggtgtacctctacttgcccttggatgttattcacaagtgaatcctcttacgctaacagctgccgtattactgctaatcacacattacgccataatcggcccaggtcttcaagctaaagcgaccagggaagctcaaaaacgaacagcagccggtatcatgaaaaacccaacagtagatgggataatgactatagacttggatcccgtgatttatgattcaaagtttgagaaacaactaggccaggtaatgctattggttttatgtgcagttcaacttttattaatgcgaactagctgggctctatgcgaagcgcttacgttggccactggaccgataacaaccttgtgggaagggtcacctgggaagttttggaacactaccatcgctgtgtctatggcaaatatattcagaggaagttatctcgcaggcgccggcttagcattcagtattatgaagagtgtaggcactggaaaaagaggaacaggttcgcagggtgagacactcggagagaaatggaaaaagaaattgaatcagctctctaggaaagattttgatctttataagaaaagcggaataacagaggtagacagaacggaagctaaggaagggctaaaacgtggtgaaattacccaccatgctgttagcagagggagcgctaaactacagtggttcgtagaaagaaacatggtaattccagagggtcgagtaatcgatttaggatgtggcagaggaggctggtcatattattgcgcaggactcaagaaagttacagaagttagaggctacacaaaagggggacctggacatgaagaacctgtcccaatgtccacttatggctggaacattgtgaaactaatgtctggaaaggatgtcttttacctacctccggaaaagtgtgatactttattatgtgacataggtgaatcgagcccttcgccaacggtcgaggagagtaggacaataagagttttgaaaatggtcgaaccttggctaaagaataatcaattttgtatcaaagtactaaatccgtatatgccaacggtaatcgaacacttagaacgactacaaagaaaacacggtggcatgttggtaagaaatccgctgagcagaaattcgacgcatgaaatgtactggatctccaatggaacaggaaacatagttgcatcagtcaatatggtttcacggctgctgctaaacaggtttaccatgacacatcgcaggccaaccatagaaaaagacgtggatctaggagcgggcactcgtcacgtcaatgcagaacccgaaacgccaaatatggatgtaattggagaaagaataaaaagaataaaagaggagcacaattcgacatggcattacgatgatgaaaacccatacaaaacttgggcatatcacgggagttacgaagtgaaagcaacgggaagtgcaagcagcatgatcaacggagtagttaaactattgacgaaaccctgggatgtagtgcccatggtaactcaaatggcaatgacagataccaccccatttggtcagcaaagagtatttaaggaaaaagtagacactagaacgcctcgttcgatgcccggaaccaggagagtaatggggataaccgcagaatggttatggcgaactttgggccgaaataagaaacctagactatgtacaagagaggaatttacaaagaaggttaggacaaacgcagcaatgggtgcggtttttacagaagaaaatcaatgggattcagctaaagctgccgtcgaggatgaggacttttggaagctagtcgaccgtgaaagagaattacataagttaggcaaatgtggctcatgtgtctataatatgatgggtaagagggagaagaaactaggcgaatttgggaaagcaaaaggatcaagagcgatctggtacatgtggttgggtgcacgatatctggaatttgaagcgctggggtttttaaatgaagatcattggttttcaagagaaaacagttactcgggtgttgaaggtgaaggtttgcataaactaggttatatcctaagagacatatcaaaaatacctggtggcgccatgtacgctgacgacacagctggctgggacacccgaataacggaagatgacttacacaatgaggagaagataacccaacagatggatccggagcaccgtcaactagcaaatgcaatttttaaattgacttatcagaacaaggtagttaaagtccagagaccaacaccgactggaaccgttatggacataatttcgcgtaaagatcaaagaggttctggacaggtaggaacctacggtttaaataccttcacgaacatggaggcccaactaattcgacagatggagggagaaggggtcttgagcaaggcggacttagaaaacccccatcttcctgagaagaaaattacacaatggttagaaactaaaggagtagaaaggctaaaaagaatggccattagcggtgatgattgcgtagtaaaacctatcgacgaccgctttgctaacgccttattagcattgaacgatatgggaaaagtacgtaaagacataccccaatggcaaccttccaaaggctggcatgattggcaacaggtacccttttgttcacaccactttcatgaactaattatgaaagacggaagaaagctagttgttccatgtcgtccgcaagacgaattaataggtcgagcacgcataagtcaaggcgcaggctggtctttgaaagaaactgcttgcttagggaaagcatatgcgcagatgtggtccttaatgtacttccacaggcgtgacctaagactagcgtcgaatgctatatgcagtgcagtacctgtacattgggttccgacatccaggacgacttggtcaattcacgcacaccatcaatggatgactacagaagacatgttaaccgtctggaatagagtctggatagaagataatccttggatggaggataaaacacctgtaacaacatgggagaatgtaccatacttaggtaagagagaggaccagtggtgcgggtcactaatcggtttaacaagtagggctacatgggcacagaacatacccacggcaatacaacaagtaagatcattgataggcaacgaagagtttcttgactatatgcccagcatgaaacgctttaggaaagaggaagaatccgaaggagctatatggtga

SEQ ID NO: 23203 - RNA, 9873 nt, synthetic construct
  misc_feature 1..9873: note = derived and/or modified CDS sequence (opt6) from DENV-3__HQ705620__SS-prME
  source 1..9873: mol_type = other RNA
acatctctatgtttaatgatgatccttcctgccgctttagcatttcatctgacgtcccgagacggagaacctaggatgatagttggtaaaaatgagagaggtaaatcattattgtttaaaactgcaagtggtataaacatgtgtacactaatagctatggatttaggagaaatgtgtgacgacaccgttacatacaaatgccctcatataacggaagtagaacccgaagatattgactgttggtgcaatctaacttctacatgggtaacatacgggacctgtaatcaagcgggcgagcataggagagacaaacgatcggtcgcactggcacctcatgtaggaatggggctggatacccgaacacaaacgtggatgagtgcagagggagcctggagacaagtcgaaaaagtagagacttgggctctacgacatcctggatttacaatacttgcattatttcttgcccattatatagggacatcattaactcagaaagttgttattttcatcctattaatgttagttacgccatccatgactatgagatgtgtaggagttggtaacagagatttcgtagaaggtctatccggagccacatgggtcgacgtggtattagaacatggaggatgtgttacaaccatggctaaaaataaaccgacactagatatagagctacagaaaactgaggccacgcaactagctaccttaagaaaattatgcattgaaggtaaaattacgaacataacaactgattctcgttgcccgacccaaggcgaggctaccctaccagaagaacaagaccaaaattatgtctgtaaacacacttacgtagacagaggatggggcaacggatgtggcctatttggcaaaggctctctagtaacatgcgcgaaatttcaatgcttagaaccgatagaaggaaaagtcgtacaacacgagaacctgaaatacaccgtcattattacagtacacactggggatcagcatcaagtcggaaacgagacacaaggtgtaaccgcggagataacaccgcaagcatctactaccgaagcaattcttccagagtatgggacgttaggacttgaatgttcgcctcgaacaggcctagattttaatgaaatgatactacttacaatgaaaaataaggcttggatggttcaccgtcaatggttctttgaccttccactaccatggacgtctggagccaccacagaaactccaacatggaatagaaaagaactgctcgtaacctttaaaaatgcacatgctaagaaacaagaagtagtagtcctcggtagtcaggaaggcgccatgcatacagccttaaccggagctactgagatacagaatagcggagggacttccatcttcgcgggacatttgaaatgtcgacttaaaatggataaattggagctgaaaggcatgtcttatgcgatgtgcacaaacacatttgtgttgaagaaagaggtgagtgagacccaacacggaacaatattaattaaagtagaatataaaggtgaagacgtaccatgtaaaataccgttctcgaccgaggatggccagggaaaagcacataatggaaggttaattaccgcaaaccctgtagtcaccaagaaagaggaaccagttaatatagaagcagaaccacccttcggggaaagtaatatcgtaatagggatcggtgataacgccttaaaaatcaattggtacaagaaaggaagcagcatagggaaaatgttcgaagctacagcgcgcggtgctagaagaatggcaattctaggcgatactgcctgggacttcggttctgttggtggcgttttaaactcattaggaaaaatggtacaccaaatatttggatcagcctacacagccctattcagcggggtatcctgggtgatgaaaatcgggataggtgtcttattaacgtgggttggtttaaactcgaaaaacacctcaatgtcattctcatgtatcgctataggcataataacactctatcttggtgcggttgttcaagcggatatgggctgtgtgataaattggaaagggaaagaacttaaatgtggctcaggtatattcgtaactaacgaggtccatacatggactgaacaatataaattccaagctgatagtccaaaaaggttggcaactgctattgcgggggcatgggaaaatggagtttgcggcattcgatctaccacacgcatggaaaacctactatggaaacaaatagctaatgagcttaattatatcctttgggaaaacaacataaaactaacagtcgttgtaggcgatatcataggtgtactggaacaagggaaaagaacattaacgccacaaccaatggaattaaaatactcatggaaaacctggggaaaagcgaaaattgtaaccgcagaaacacaaaattccagttttattatcgatgggcctaatacgccagagtgcccttcagttagtcgagcgtggaatgtttgggaagtggaggattatggctttggtgttttcacaaccaatatttggctcaaactacgcgaagtgtatacacaattatgtgatcatagattgatgtcagcagcggtaaaagatgaaagagctgtacatgccgacatggggtattggattgaaagtcagaaaaatggatcgtggaaacttgaaaaagcatcattaattgaagttaaaacctgtacatggccaaaaagccacactttgtggagtaacggggtattagaatcagatatgattattccaaaaagtctcgctggcccaatctctcaacacaatcatagacctggttaccatactcaaaccgccggtccatggcatctagggaaattggaacttgactttaactattgcgaaggaactacagtagtaataactgaaaattgtggtacgagaggaccctctctaagaacaacaacggtttcagggaaacttatacatgaatggtgttgcagatcctgcaccttaccacctttaaggtatatgggtgaagacggttgttggtatggaatggaaattagacccataagcgagaaagaagagaatatggtaaagtctttggtatccgcggggagtgggaaagtcgataactttacaatgggggttctttgcttggcgatattatttgaagaagttatgcggggaaaatttggcaagaaacatatgatagccggagtattctttacgtttgtgttactattatccggccaaataacctggagagatatggcacataccctcatcatgatcggttctaatgcaagcgatcgcatggggatgggcgtcacgtatttagcattaatagcaacatttaagatacaaccttttcttgcacttggattctttcttcggcgattaacatcaagggaaaatctcctacttggggtcggtctcgcaatggctaccacattacaacttcctgaggatatagagcaaatggccaatggtattgcactgggacttatggcgcttaaattaataactcaatttgaaacgtatcagttatggactgcacttatcagcttgacctgtagcaacactatatttactctaacagtagcctggcgaacagcaaccctcatactcgcaggagtatcactcctgcctgtctgtcaatcaagtagcatgaggaaaacggattggttacccatggcggtagccgcaatgggagtaccaccccttcccttgttcatttttagcctaaaagacactttaaaacgaagatcatggccactaaacgaaggagtgatggcagttggtctagtctctatactagcatcaagcctattacggaatgatgtacccatggcaggaccattagtagctggtggactattgattgcttgttatgtgataacggggaccagcgctgacttgacggtcgaaaaggccgctgatatcacctgggaagaagaagctgagcagacaggtgtttcacacaacttaatgataacagttgacgacgacggcacgatgcgtatcaaagatgatgagacagagaatatattgacagttctactgaagacggctctcctcatagtctccggtatatttccgtattctataccggcaacactattagtatggcatacatggcagaaacaaacacaaaggtctggagtcctctgggatgtgccaagcccacccgaaacgcagaaagccgaattggaagaaggtgtttataggattaaacaacaaggcatcttcggaaagacccaagtgggggtcggtgtacaaaaggaaggagtcttccataccatgtggcatgtaacgcgtggagctgttttaacttataatggtaaaagattggagcctaattgggccagtgtcaagaaagaccttataagttatggaggaggatggcgcctttcagcccagtggcaaaagggtgaggaagtgcaagtaatagctgtcgaaccgggcaaaaaccccaaaaactttcaaaccatgcctggaacttttcaaacaacgaccggagaaatcggagcaatagcactagattttaaaccgggaacatctggaagcccgatcataaaccgggaaggtaaagtggtaggattatacggcaatggggtggttactaaaaatggtggttacgtatcaggaattgctcagactaatgcagaaccagacggaccaacacctgagctagaagaagaaatgtttaagaaaagaaacttaacgattatggatcttcaccctggttcgggaaaaacaaggaaatacttaccagcaatagtcagagaagcaataaagcgcagactcagaaccctaatattggccccgacaagagtagtagcagccgaaatggaagaagcacttaagggcctgcccattaggtatcaaactacggcaacgaaatctgaacatacgggcagagaaatagttgatcttatgtgtcacgcaacttttactatgagactattgtctcctgttagagttccaaattataaccttatcataatggacgaggcacactttacagatccagcctctatcgcggctcggggttatatctcaacaagggttggaatgggagaagcagccgcaatattcatgactgcaacaccacccggcacagctgacgcattcccccaatcaaatgcaccaatacaagacgaagaacgtgatataccagagaggtcatggaacagcggtaatgaatggataacggattttgcgggtaaaactgtatggttcgtaccgtctataaaagctggaaatgacatagctaattgtttaaggaaaaatggcaagaaagtaattcagctatcgcggaagacctttgacactgaatatcagaaaacaaagttaaatgattgggattttgtagtgaccacggatatttctgagatgggagcgaattttaaagcagaccgtgttatagacccacggaggtgcctaaagccagtgatattaacagatgggccagaaagagttatactggctggcccaatgccagttacggctgcgtcagctgcgcaacgtagaggccgcgtgggacgcaatccacaaaaagagaatgaccaatatatattcactggtcaaccattaaacaatgatgaagaccatgctcactggacagaggcaaaaatgttactagataatattaacacccctgaagggataataccagcactctttgaacccgaacgagagaaaagcgccgcgatagacggggagtatcgacttaaaggtgaatcgagaaaaacttttgtcgagctaatgaggcgcggggatctcccagtttggctggcacacaaggttgcttccgaaggtataaagtataccgatagaaaatggtgcttcgatggccaaaggaacaatcaaatacttgaagaaaatatggatgttgagatctggacaaaagagggagagaagaagaaattgcgacctcgttggttagacgctagaacttattcagaccccctcgcactaaaagaatttaaagaatttgcggcagggagaaaaagtattgctctggacttagtaacggaaataggcagggtaccatctcacctcgcacacagaactagaaatgcattagacaacctagttatgcttcacactagcgaacatggtggtagagcatatcgacatgctgtggaagaattgccggagacaatggagaccttactattattgggcctgatgatacttttaacaggcggtgccatgttgttccttattagcggcaaaggtataggcaaaacaagcataggattaatctgcgtgatagcttcatcaggtatgttgtggatggcagaaatcccacttcaatggatagcctcagctatagttctggagttctttatgatggtcctcctcatacctgaacccgaaaaacagagaacaccacaagataatcaattagcatatgtcgtaatcggaatattgactttagcggcaataatagcagcaaacgaaatgggactattggaaaccacaaaacgtgatttgggtatgtcaaaagaacctggagtagtatctccaacatcatatctcgatgtagatctacaccctgccagtgcttggactttatatgctgtcgcaaccacggtaataacgcctatgctacgtcacacgattgaaaattcaaccgcaaatgtaagcctcgctgcaatcgctaatcaagctgtagtccttatgggacttgataaaggttggccaatttcgaaaatggacctaggggtcccgcttctcgcactaggatgttattctcaagttaatccactaacattgacagccgcagtactacttttaataacgcactatgcaatcattgggcctggcctccaagcaaaagctactagggaagcacagaaaagaacagccgccggaataatgaaaaacccgaccgtggacggcattatgacaatcgatctagatcctgtgatctacgattcaaaattcgaaaaacaactaggacaagttatgctgttagtactgtgcgctgttcaacttctactaatgcgtacaagttgggcattatgcgaagcgttaacgctcgcgacaggtcccatcacaactctgtgggaaggttcaccaggtaaattctggaacactactatagccgtttctatggccaacattttccggggtagttatctcgccggtgctggattagcattttctataatgaaatcagtaggtaccgggaaacgtggtacaggaagtcaaggcgagaccttaggagaaaaatggaaacgaaaattaaaccaattatctcgaaaggactttgacctttacaagaaatcaggtataaccgaagtagatagaacagaagcgaaagagggcttaaaaaggggcgaaatcacacaccatgctgtgtcaagaggaagcgcgaagttacaatggtttgtggaaagaaatatggtcatacccgaaggcagagtaatcgacttaggctgtggcagaggagggtggtcttattactgcgcaggactcaagaaagtaaccgaagtaaggggctatacgaagggaggaccaggccatgaagaacctgtacctatgtcgacatacgggtggaatattgttaagctaatgagcggaaaagatgttttctatctacctccagagaaatgcgatactttattatgcgacataggagaaagctccccttcgccaacagttgaagagtcacgtactatccgggttcttaaaatggtagaaccttggttgaaaaataaccaattctgcattaaggtactaaacccatatatgcctacggtaatagaacacctagaaaggcttcaaagaaaacatggagggatgctagtaaggaatccgcttagtagaaattccacacacgaaatgtactggatttcaaacggaacaggaaacatagtggcctctgttaacatggtaagtcgtttgctattaaataggttcacaatgacacacagaagaccaaccattgagaaagatgtagatttaggagcaggaacgagacatgtcaatgcagaaccagaaactcctaacatggacgtcataggcgagaggattaaacgcattaaagaagaacataattctacttggcattatgacgatgaaaatccatataaaacatgggcctatcatggttcttacgaggtcaaagcgaccggatcagcgagcagtatgataaatggtgtcgtcaaattgttaaccaaaccttgggacgtggtacccatggtgacacagatggcaatgaccgatacaactccctttggacaacaaagggtctttaaagaaaaagttgacactcgaacacctagaagcatgcccggaacacgtcgagttatgggcattaccgccgaatggttatggagaactttaggacgaaataagaaaccaagattatgtaccagagaagagttcactaagaaagtaaggacaaatgccgcaatgggggcagtatttactgaagaaaatcagtgggattcggccaaagcagcggtcgaggatgaagatttttggaagttagttgacagagaaagagaattgcataaattaggaaaatgtggttcatgcgtatacaacatgatgggaaaaagggagaagaaactaggtgagtttggaaaagcaaagggctcaagagccatctggtatatgtggttaggtgcgaggtatctagaatttgaggccttaggttttcttaatgaggaccactggttttcacgcgaaaattcgtactcaggagtagaaggggaaggacttcataagttagggtatatattacgtgatataagcaaaatcccgggaggagccatgtatgccgatgatactgcaggatgggacacacgtattaccgaagacgacttacataacgaggagaaaattacacagcaaatggatcctgagcatagacaacttgccaatgcaatatttaaactgacatatcagaataaagtcgtaaaggttcagcgaccgactccgaccgggacggttatggatataattagccgaaaagatcagcgtggatcgggtcaagttggaacgtacggactaaatacatttacaaatatggaagctcaattgattagacaaatggaaggagagggggtgttaagcaaagcagacttagaaaacccacatctacccgagaagaaaattactcaatggctagagactaagggggtagagcgactaaaacggatggccataagcggtgatgattgcgtggttaaaccaattgatgacagattcgcaaacgcacttctagcacttaatgatatgggtaaggtacgaaaggatattccccaatggcaaccatcaaaaggatggcatgattggcagcaagttccattttgtagccaccacttccacgaactaataatgaaagatggacgcaaattagtagtgccgtgcagaccacaagatgagctcatcgggagagcaagaatatcacaaggagctggttggagtcttaaggagactgcttgcctcgggaaagcatatgcccagatgtggtccttaatgtactttcacagaagggatttaagattggcaagcaatgccatttgcagtgcagttcctgtgcattgggttccaacctctcgaactacatggtctatccatgcacaccatcaatggatgacaactgaggatatgttaacagtatggaatagagtttggatagaggataacccatggatggaagataaaacacctgttaccacatgggaaaacgtaccatacttaggtaaacgagaagaccaatggtgcggatcactaataggtctgacctctcgggcaacatgggcccaaaatattccgacggcaattcagcaagtcagaagcctcataggaaacgaggagttcttagattacatgccttcaatgaagagattcaggaaagaagaggaatcagagggcgctatctggtaa

SEQ ID NO: 23204 - RNA, 9873 nt, synthetic construct
  misc_feature 1..9873: note = derived and/or modified CDS sequence (opt6) from DENV-3__HQ705621__SS-prME
  source 1..9873: mol_type = other RNA
acgagcttatgtttgatgatgatactcccagctgcgttggcttttcatttaacatctcgtgatggcgagccgcgaatgatagtaggcaagaatgagcgaggaaagtctcttctatttaaaactgccagcggaattaacatgtgtacactaattgcaatggacttaggggaaatgtgcgacgatactgttacttataagtgtccacatattacagaggttgagcccgaggatattgactgttggtgtaatttaaccagtacatgggtaacatatggaacatgtaatcaagctggagaacatcggcgcgataaacggagcgtagcattagctccacacgtaggtatgggattagacacacggacgcaaacatggatgtcagcagaaggcgcatggcgccaagtagaaaaagtagagacatgggcattacgacacccaggctttacaattttagcacttttcctagcacactatataggaacctcgctaacccaaaaggtcgtgattttcatattgctaatgttggtaaccccaagtatgacaatgcgatgcgtgggagtagggaaccgagattttgttgaagggctatctggcgcaacttgggtggacgttgtactagaacatggaggttgcgtcacgaccatggcgaaaaacaagccaacactcgacattgaactacaaaaaaccgaagccacacaactagcaaccctgagaaaattgtgtatcgaaggtaagattactaatattaccactgattctagatgtccaacacagggggaagcaaccctgccagaagagcaagatcagaactatgtgtgtaaacacacatacgtagacagaggttggggcaatggatgtggattgtttggaaaaggatcgttagttacatgcgccaaatttcagtgcttagaaccgatcgaaggtaaggtcgtacaacatgaaaacttaaagtacaccgtaattataacggtgcatactggcgatcaacatcaagttggaaatgaaacccagggggtaactgcagaaataacgcctcaagctagcacaacggaagcaatcttgccagagtacggcacgctaggactagaatgctctccacgcacaggccttgatttcaatgagatgatattattaactatgaagaacaaagcttggatggtacacaggcaatggttctttgatttaccattaccgtggacaagtggagcaacaacagagaccccaacctggaataggaaagaattactcgtcacgttcaaaaacgcacatgcgaaaaaacaagaagtcgtggttttaggatctcaagaaggcgcaatgcacactgctctaacgggggccaccgaaatacaaaatagcgggggcacatcaatatttgcagggcatctaaaatgccgcctgaaaatggacaaacttgaattaaaaggtatgtcatatgctatgtgtacaaatacatttgtattgaagaaggaagtgtctgaaacccagcacggtaccatactaattaaagtagagtacaaaggagaagacgtgccttgcaaaatcccattttctaccgaagatggacaaggaaaagcacataatggccggctgatcacggcaaatcctgtagtaacgaaaaaagaagagccagtaaacatcgaagcagaaccgccttttggggaaagcaatattgtcataggaattggcgataatgcactgaaaatcaactggtacaagaaaggtagctcaataggaaaaatgtttgaggctactgcaagaggcgccagaaggatggcaatactaggagatactgcatgggacttcggttcagtcggaggggttttaaacagtttaggaaaaatggttcaccagatcttcgggtcagcatacacagcacttttcagtggcgtaagttgggtaatgaaaataggaataggagtacttcttacgtggatcggactcaatagtaaaaacacaagcatgagtttctcatgtattgcaataggtataataacgttgtacctaggagccgtggttcaagcagacatggggtgcgttataaattggaaaggcaaagaactgaaatgtggaagcggcatatttgttacaaacgaagtacatacttggacggaacaatataaatttcaagcagatagtccgaaaaggctcgccacagcgatagcgggagcttgggaaaatggtgtatgtgggatacgatctaccacaaggatggaaaacctcctttggaaacaaattgctaatgaattaaattatatattatgggaaaacaacataaaactaacagtagtcgtaggagatattataggtgtacttgaacaaggtaaaagaacacttaccccacagcctatggaactaaaatacagctggaaaacttggggtaaagcaaagatagtcacagctgagacacaaaactcgagtttcattatagatggaccaaacacacccgagtgtcccagcgtttctagggcttggaatgtatgggaagtagaggattatggatttggcgtattcaccacaaacatctggcttaaactcagggaagtttacacgcaactttgcgatcatagacttatgagcgcagcagtaaaagatgaacgtgcagtacacgcagatatgggttactggatcgaaagtcaaaaaaacgggagttggaaactagaaaaagcctccttaattgaagtgaaaacatgcacttggccaaaatcacacacattatggtcaaatggagtcctagagagtgatatgattataccaaagagtctcgccggccctataagccaacacaatcataggccaggttaccacacccaaactgcgggtccttggcatttaggcaaattagaactagattttaactattgtgaaggtactaccgtagtcattacggagaattgcgggactagaggacctagcttaagaacaacaacagtttcgggaaagttaatacatgagtggtgttgtaggtcttgtacacttccacctcttaggtatatgggggaggacggctgttggtatggtatggagatacgccctatatcagaaaaggaagaaaatatggttaaaagtctagtaagtgctggaagcggcaaagtcgacaactttacaatgggggtattatgtctagcgattctcttcgaagaggttatgagagggaaatttggtaaaaaacatatgatagcaggtgtattcttcacattcgtactactgctcagcggccaaattacctggcgcgacatggcacatacgctaataatgataggaagcaatgcatcagaccgaatgggcatgggagtgacatacttggctctaattgccacatttaagatccagcctttcctagcacttgggttttttttaagaaaactaacatcgcgtgaaaatctgttattgggagtaggtttagcaatggcaaccaccttgcaactcccggaagacatagaacaaatggcaaatggaatcgctctaggtctcatggcacttaaactcataactcagttcgagatataccagttatggacagcattaataagtctcacatgctctaatactatatttacactaaccgttgcctggcgaaccgcgactcttatacttgcgggtgtatcattactacccatgtgtcaaagttcaagcatgcgtaaaacagattggttaccaatggcagtcgccgcaatgggagtaccgcccttacctctatttatatttagcctcaaagacacgcttaaaagaagaagttggcctctaaatgaaggagtaatggcagtgggactagtcagcattcttgcaagctcgttattgagaaacgatgtacctatggcaggaccgctagtagctgggggtctactaatagcctgttatgttatcaccggaacttccgcggatttaaccgtggaaaaagcagcagatattacatgggaagaagaagctgaacaaacaggagtttcccacaacctaatgataacggttgacgacgacggaacgatgcgtatcaaagatgacgagacagaaaatattttgactgtattgttaaagacagcattactgattgtttcaggaatatttccttattctatacctgcaacgcttttagtgtggcatacctggcaaaaacaaacccaaaggtccggagtattatgggatgttccaagtcctcctgagacacaaaaagcagagctagaagagggagtatatcgaatcaagcaacaagggatttttgggaagacacaagttggcgtgggagtacaaaaagaaggagtattccacactatgtggcatgtaacaagaggtgctgtccttacatataatggcaagaggctcgaaccaaactgggcatctgtaaaaaaagatttaatctcgtacggcggtggatggagactatccgcgcaatggcaaaaaggggaagaagtacaggtgattgcagtagagccagggaagaatcctaagaactttcaaactatgcctggaacattccaaaccaccaccggagaaattggtgctatagctctggatttcaaaccgggtactagcggcagcccaattataaacagagagggaaaagtagtgggattatatggtaatggtgtagtgaccaaaaatgggggatatgtctcaggtatcgctcaaaccaacgctgagccggatggtcctacacctgaactcgaagaagagatgttcaaaaagagaaacctaactataatggacctacatccaggctccggcaagacacgcaaatatctaccagcgatagtaagagaagccataaaacgaagattaagaacattaatactcgcccccacccgagtcgtagcggcggaaatggaggaagcactaaaaggattgcctatacgttatcagacaacagctacaaagtcagaacatacaggccgggaaattgtggacttaatgtgccatgctacattcacaatgagattactttcgcctgtcagagtacccaattataaccttataattatggatgaggcacatttcactgatcctgcatcaattgctgcaagagggtacatctcgacaagggtaggcatgggagaagctgccgcaatattcatgacagctacacccccgggaacagcagatgcttttccccaatcaaacgcgccaatccaagacgaagaaagagacattccagagagatcttggaactccggaaatgaatggataactgactttgctggtaaaaccgtatggtttgtaccctctataaaagctggaaacgacatagcaaattgtttacgaaaaaacggcaaaaaagtaatacaactaagtcgaaaaacatttgacacagagtatcaaaaaactaaactcaacgattgggatttcgttgtcacaacggatatatcagaaatgggagctaatttcaaagcggatcgcgttatagacccccgtcgttgcctcaaaccagtaatattgacagacggtccagaaagagtaattttggccggacctatgcctgtcacagccgcatcagctgcacagcgccgcggaagagtggggcgtaatccccagaaagaaaacgatcaatacatcttcacggggcaaccattaaacaacgatgaagaccacgcacactggacggaagcgaaaatgttactggataatattaatactccagaggggattataccagccctatttgagccagaaagagaaaaatctgccgctatagacggcgaataccgattaaagggagagagccgaaaaacattcgtagaattgatgagaagaggggatctaccagtctggttagcacataaagtagcctcagaaggtattaaatacaccgacagaaaatggtgttttgacggccagagaaataatcagatcttggaggaaaatatggatgtagaaatatggactaaagaaggagagaaaaaaaaattaaggcctagatggctagatgcaagaacgtatagtgatccactggcactgaaagagttcaaagaatttgctgctggcaggaaatccattgcattggatctagtaaccgaaataggaagggtaccaagtcatctagctcatagaacaagaaacgcactagataatcttgtaatgcttcatacgtcagaacatggaggcagagcctacaggcatgcagtagaggaattgcccgaaacaatggaaacactacttctattgggcttaatgatactactaactggcggtgctatgctttttttaatatcaggaaagggaataggaaaaacatcaatcggtttgatttgtgtaatcgcatcaagcgggatgctttggatggcggagataccattgcaatggatagctagcgcaattgttcttgaattcttcatgatggtgctattaattccggaacccgaaaagcagcgaacacctcaagataaccagttagcatatgttgtcatcggaatcctcacccttgcagctataattgctgcaaacgaaatgggattattagagactactaagcgcgatttgggaatgtcgaaagaaccaggagtagtttctccaacaagttacctagatgtagacctgcatccagcttcagcatggactttatatgcagtcgcaacaactgtaattactcccatgcttagacataccatagagaactctactgcaaatgtgtctctagcagcaatagcaaatcaagctgtagtcctaatgggtttagataagggatggccaatttcgaaaatggatctcggcgtaccactgctagcattaggatgctactcccaagtcaaccccctaacattgacggctgcggtgttattacttataacacattatgctattattggacccggtctacaagctaaagctactagggaggctcaaaagcgtaccgctgccggaataatgaaaaatccaacggtagacggcattatgacaattgacctggaccctgtgatttatgactcaaaatttgagaaacagttgggacaagtgatgctgctggttttatgcgtcgttcagctcctactcatgagaacatcttgggctttgtgtgaagcactcactctagcgaccgggcccataacgaccttgtgggaggggagcccaggaaaattttggaacactactatagcagtatccatggcaaatatattcagaggatcctatctagcaggggcgggtttagcgttctctataatgaagtccgttgggacagggaagagaggaacaggtagccaaggtgagacactgggtgaaaagtggaaaaaaaagttaaaccaactctcacggaaagatttcgatttatacaaaaaatcagggataactgaggtcgatagaacagaagccaaagaaggtctaaagcgcggagaaataactcaccacgcggtatctcgcggctccgcaaaactacaatggttcgtggaaagaaacatggtaatacctgaagggcgtgtcatcgatcttgggtgtggtagaggaggatggtcgtactactgtgcaggcctaaagaaagttacagaagttcgaggctataccaaaggaggcccaggacacgaagaacctgtgccgatgtctacttacggttggaacatagtaaaacttatgtccggtaaggatgtattttatctgccaccagaaaagtgcgatacgttattatgtgatataggtgaaagctcaccaagtcccacagtagaagaatcaagaacgatccgggtattaaaaatggtagaaccttggcttaaaaataaccagttttgtatcaaagtgctaaatccatatatgccaaccgtcatcgagcatttagaacggttacaaagaaaacacggtggtatgttggttaggaaccctctcagcagaaatagcacacatgagatgtactggatatcaaacggaactgggaatatagtagccagcgtaaatatggtatcccgtcttcttttaaatagattcacgatgacacacagaagacctactatagaaaaagatgtagatctgggggctggcacacgccatgttaatgctgagccagaaaccccaaatatggatgtaataggagaacgtattaagagaataaaagaggaacacaactcgacctggcaccacgacgatgaaaacccttacaaaacatgggcatatcacggatcatacgaggtgaaagcaactggcagtgcatcatccatgataaatggcgttgttaagctgctaactaaaccctgggatgttgtgccaatggtaacacagatggctatgacagatacaacaccctttggacaacaaagagttttcaaggaaaaggttgatactagaacgcctagatccatgccaggcacgcgtagagtaatgggtataaccgctgaatggttgtggagaactttaggtaggaacaaaaagccgcgcctatgcactagagaagagttcacgaaaaaagtccgcaccaatgccgctatgggtgctgtgttcaccgaagagaatcagtgggactctgctaaagctgctgtagaagacgaagacttttggaagttagtagatagagaacgtgagctccacaaattaggtaaatgcggttcctgcgtatataacatgatggggaaaagggaaaagaaactcggagaattcggaaaagccaaaggaagcagagccatctggtatatgtggcttggtgcacgctaccttgagttcgaagctctcggattcctgaatgaagatcactggtttagtagggagaatagttattctggggtagaaggagaaggattgcataaattaggttacatactcagagacatcagtaaaattccgggtggagcaatgtatgcagatgatacagctggatgggatacgcgtatcaccgaagacgacttgcacaatgaggaaaaaattacacaacaaatggaccctgaacatcgacagttggccaatgcaatatttaaactaacttatcaaaacaaagtagtgaaggtgcaacgaccaacacccactggcacagtaatggatattatcagcaggaaggaccaaaggggttcaggtcaagttggaacttatggcttgaataccttcacaaatatggaggcccagctaatccgccaaatggaaggagaaggggtactttcgaaagcagatttagagaatccacatctcccggaaaaaaagattacccaatggctggagaccaaaggtgtggagcgcttaaaacgtatggcaattagcggggatgattgtgtcgtaaaaccaatcgatgacagatttgcgaacgcgctactagcgttgaatgatatggggaaggttagaaaagacatccctcaatggcaaccttcgaaaggttggcatgactggcagcaagtcccgttttgctctcatcattttcacgaactaataatgaaagacgggcgaaaactagttgttccatgtcgaccccaagacgagctaattgggcgggcaaggataagtcaaggtgcaggatggtccttgaaagaaactgcatgcctaggaaaagcatatgcccaaatgtggagtttgatgtattttcacagaagagaccttcgcttagcttctaacgctatatgttctgcagtacctgtgcattgggtacctacatccagaactacatggagcatacatgcacatcaccagtggatgactacggaagacatgttaacagtttggaacagagtatggatagaagataacccatggatggaggataaaacgccggtcacaacctgggaaaatgtaccatatttagggaaacgagaagaccagtggtgcggttctctgatcggtctaacttctagggcaacatgggctcaaaatattccaactgccatacagcaagttaggagtttaataggtaatgaggaatttttagactatatgccgtcgatgaaacgcttccgtaaagaagaggagagtgaaggtgcaatatggtaa

SEQ ID NO: 23205 - RNA, 9873 nt, synthetic construct
  misc_feature 1..9873: note = derived and/or modified CDS sequence (opt6) from DENV-3__HQ671176__SS-prME
  source 1..9873: mol_type = other RNA
acatctttatgtttgatgatgatacttcccgcagctttggcatttcaccttacaagcagagatggtgaaccacgaatgatagttggtaaaaacgaaagaggaaaatctcttctctttaaaacggcttctggaattaacatgtgcacattgatagcaatggacttaggagaaatgtgtgacgacacagtaacgtacaaatgtcctcatattacagaagtggaaccagaagatatcgattgctggtgcaacctaacaagcacctgggtaacatatggaacttgcaatcaagccggtgaacacagaagagataaaaggtctgtggccctcgcacctcatgtgggtatgggattagacacaaggacacaaacatggatgtcggctgagggtgcgtggagacaggtggaaaaagtcgaaacgtgggccttgcgacaccccggattcacaatcttagcattatttctagctcattacataggcacgtcactgactcaaaaagtagtaatattcatattattaatgctagtaactccaagtatgaccatgagatgtgttggagtgggaaacagggattttgtagagggtctatctggagctacatgggttgatgtagtcttagaacatggagggtgcgtaactaccatggccaaaaataaacccacattagacatagaattacagaaaaccgaagccacccaactggcaacgcttagaaaactgtgtatagaaggtaaaattaccaatataacgacggactcacgatgcccaacacagggcgaggccactctcccagaagaacaagatcaaaactatgtctgtaaacacacatatgtcgatcggggttggggtaacgggtgcggactgttcggcaaaggttccttagttacttgtgcaaaattccagtgtctcgaaccaatagagggcaaagttgtgcagcacgaaaatctaaaatatacagtaatcataactgtgcacacaggtgaccagcaccaagttggcaatgaaacccaaggggtcacagcagaaataaccccgcaggcgtcaactaccgaggctatattgcccgagtacggaaccctcggcttagaatgctcgccaaggactggactcgactttaacgaaatgatactcctaaccatgaaaaataaagcatggatggttcacagacaatggttctttgacctacctctaccatggacttctggtgccacgacggagacacctacgtggaacagaaaagaactactggttacatttaaaaacgctcatgccaagaaacaagaagttgtagttctaggatcacaagaaggcgcgatgcacacggctctaactggcgcgaccgaaatacaaaattctgggggaacaagcatttttgctggccatttaaaatgtcggttaaaaatggataaattagaattaaaaggaatgagctatgctatgtgtacaaatacttttgtgttgaagaaagaagtatctgaaacacaacatggaaccatactaataaaagttgaatacaaaggagaagatgtaccgtgtaaaatacctttctcaaccgaagatggtcaaggaaaagcacacaatggtcgattgattactgcaaatcctgtagtcacgaagaaagaagaaccggtaaatatagaagctgaaccgccgtttggtgaaagtaacattgtaatcgggataggcgataatgccctaaaaattaattggtataagaaagggtcttctataggaaaaatgtttgaagcgactgccagaggagcccgaagaatggcaatattaggagatacagcgtgggattttggttccgttggcggagttttaaacagtttaggtaaaatggtacatcagatttttggctcggcatatacagcactcttttcgggcgtatcgtgggtaatgaaaattgggataggtgttctactgacatggataggcttaaacagtaaaaatacatcaatgagcttttcatgcatcgcaatcggcataataactctatacttaggcgccgttgtccaggccgatatgggatgcgtaataaactggaagggcaaggaactgaaatgcggttctggcatatttgttaccaacgaagtccatacatggaccgaacagtataaattccaagccgattctccaaaaaggttagcgacagctattgcgggtgcatgggaaaacggagtttgtggtatacgtagtactaccagaatggaaaatttattatggaaacaaatagcaaatgagttaaattatatactatgggaaaataacattaagctaacagtagtcgtaggagatatcattggagttctagagcaaggcaaaagaacattaactcctcaaccgatggagcttaaatactcttggaagacctgggggaaagccaagatagttacagcagaaacccaaaacagctcttttataatagacggcccgaacacgccggaatgtccaagcgtatcgagggcatggaatgtatgggaagtggaagattatggctttggagtattcacgacaaacatatggttaaaactaagagaagtatatacacaattatgtgaccaccggctaatgtcagcagcagttaaagatgaaagagccgtccatgcagatatgggctactggatcgaaagtcagaaaaatggaagttggaaactagaaaaagcaagtctcatagaagttaagacatgcacttggcctaaaagtcatacactctggagcaatggagtattagagtcagatatgattattcctaaatcactggcaggccctatctcacaacataatcatcgcccagggtatcatacccaaactgctgggccttggcacctaggaaaattagagcttgactttaattactgcgagggaactaccgtagtaatcactgaaaactgtgggacacgcggccctagcttaagaacgacaacagttagtggaaagttaattcacgaatggtgctgtcgaagttgtactttacccccacttcgttatatgggggaagacggttgttggtatggaatggaaatccgaccaataagtgaaaaggaagaaaacatggtcaagtcgctcgtatctgcggggtctggcaaagtagataactttaccatgggagttctatgtctggcaattttatttgaagaagtaatgcgaggaaaattcgggaagaaacacatgatagcaggagtcttcttcacattcgtattactcttaagcggacaaattacttggagagacatggcacatactttaattatgattggtagtaacgcatcagatagaatgggaatgggcgttacatacttagcattaatagcgacatttaaaattcaaccatttttagcgttaggattctttctcagaaaacttacaagtcgcgaaaacctcctgttaggtgttggtttggctatggcaacaacattacaattgccggaggacattgaacagatggcaaacgggatagcacttggtctaatggcattaaaactgattacacagtttgaaatctatcaactttggacggcactgatttcgttaacttgctctaacacaatttttacgctaactgtagcgtggagaacagctacacttattttggcgggagttagcttgttgccaatgtgtcagtcaagtagtatgcgaaaaacagactggctaccaatggcagtggctgctatgggtgttccaccactaccactatttatatttagcctaaaagacacccttaaaagacgttcatggccactgaatgaaggagtaatggcagttgggttggttagtatactagcttcgagcctacttagaaatgatgtgcccatggcaggaccattggtagcagggggcttgctcatagcatgttacgtaataacaggtacttcagcggacttgactgtagagaaagcggcagatatcacatgggaggaagaagcagaacaaacaggtgtaagtcacaatctgatgataactgtcgatgacgatggtactatgcgtattaaagatgatgagactgaaaacattctcaccgtgctactaaaaactgcactactgattgtttcaggtatatttccgtatagcataccggcaacacttttagtatggcacacttggcaaaaacaaacccaacggtccggagtactatgggacgtacctagtccaccagagacacaaaaagcagaattagaagaaggagtgtatagaatcaaacaacagggaattttcggaaaaactcaagtaggtgtaggggtgcagaaagaaggtgtatttcatactatgtggcacgttacacgaggcgcagtcttgacatataacggtaaaaggcttgaacccaattgggccagcgtcaagaaagacttaatatcttatggtggtggatggagacttagcgcacaatggcaaaaaggtgaagaggtacaagtgattgctgtagaaccaggtaaaaaccctaagaactttcaaactatgccaggaacgtttcaaacgactacaggcgagattggagcaatagcgttagattttaagcccggtacatccggatctccaattattaaccgtgaaggtaaagtagtagggctttacggaaacggcgtagtaaccaagaacggagggtatgtatcaggtatagcgcaaactaacgcagaaccagatggaccaactccagaacttgaagaagaaatgttcaagaaaagaaatctgactataatggatttacatccaggctcaggtaaaacccggaagtatcttcccgcaattgtcagggaggcaataaaaagaagattaagaacattgatacttgcgcctacaagagttgtagccgctgaaatggaggaggcactaaaaggtcttccaattcgctatcaaacaacagccactaaatcggaacatactggacgtgaaatagtagatcttatgtgtcacgccacctttacaatgagactcttgtcgccagtaagagttccaaactacaatttgattgtaatggatgaagcacattttaccgatccggcatcaatagccgctagggggtatataagtacgagggtgggaatgggagaagcagcagcaatttttatgacagcaacaccccctggcactgccgacgcctttccccaaagtaacgctccaatacaagacgaagaacgggacataccagaacgttcctggaatagcggaaatgaatggataacagattttgcaggaaaaactgtttggtttgtaccgtccataaaggcaggcaacgatatagcaaactgcctccgtaaaaacggcaagaaagttattcaattgagccgtaaaacgtttgacaccgagtatcagaaaaccaaactaaatgactgggacttcgtagttacaactgatatatcagaaatgggagcaaatttcaaggctgatagggtaatagaccctcgcagatgtttaaagccagtcattcttacagatggaccagaacgagtgatattagctggtccaatgccagttacggcagctagtgcagctcaaagacgtggcagagtgggacgtaacccacaaaaggaaaatgatcagtatatattcaccggtcaaccgttgaataatgatgaagatcatgcacactggacagaagcaaagatgttattggataatataaacacacccgagggaataataccagccttgttcgagccagaaagagaaaaatcagcagctatagatggtgagtaccgattgaaaggagaatcacgcaaaacatttgttgagttaatgagaaggggtgatctccccgtctggctagcgcataaggtagcctccgagggaataaaatacacagaccgaaaatggtgttttgacggccagagaaataatcaaatactagaagaaaacatggatgtagagatctggacaaaagagggagagaagaagaaattacgaccgagatggcttgacgcgaggacgtacagtgatccactggcactaaaagaatttaaggagttcgcggccggtcgcaaaagcatagctttggatttggttacagaaataggacgagtaccttcgcatctggcacatcgtacacgaaatgcactagataacttagtaatgttacacacctctgaacacggaggaagggcctaccgtcacgccgtcgaagagttacccgaaactatggaaacattattattgttaggtctgatgatactactaaccggaggagcgatgttatttcttatatccggaaaggggataggaaagacatcaatagggttaatatgtgtaattgcatctagtggcatgttatggatggcagaaatacctctacagtggatagcatcagcgatcgtacttgagttctttatgatggtcttattgattccagaaccggaaaagcaaagaacaccacaggataaccagttagcctacgttgtaataggaatcttaacacttgcggctataattgcagcaaatgaaatgggattgctagaaaccactaaaagggacctagggatgagcaaagaacctggcgtagtgtctcctacaagctacttagacgtcgatttgcatcccgcatcggcatggactctatacgcggttgcgacaacagttataacgccaatgctgaggcatactatagagaacagtactgcgaatgtcagcttagcagcaattgccaaccaagcagttgtactaatgggcttagataaagggtggcccatatctaaaatggacctgggagtaccccttttagcattaggatgttactcacaagttaacccgttaacacttacggcagcagtattgttgctaataacacactacgctattataggtcctggcttacaggcaaaagctacgcgtgaagctcagaaaaggacagccgcagggataatgaaaaatccaactgtggacggaataatgactatagacttagatcctgttatttacgacagcaagttcgaaaaacaactaggacaggttatgctattagtgttgtgtgctgtccaactcctattaatgcgaacgtcatgggcattatgcgaagcgttgaccttagcgacggggcctattaccacattgtgggaaggatcaccaggtaaattttggaatactacaatagctgtgtcaatggcaaatatattccggggatcgtatcttgcaggagcaggactagctttctccataatgaaatctgtaggaacaggaaaacgtggcacaggtagccagggagaaacattaggcgaaaagtggaagaagaaactcaatcaactatcacggaaagactttgatttgtataagaaaagcggtataactgaagtcgaccgcaccgaagccaaagaaggtctgaaacgcggcgaaataactcaccatgcagtgtcacgtgggtctgcaaaattacagtggtttgtagaaagaaatatggtcatcccggaagggagggtgatagacttgggctgcggaagaggcgggtggtcgtactattgtgccgggttgaaaaaggtaacggaggtacgaggctacacgaaaggtggaccaggacatgaggagccggtcccaatgtccacttatgggtggaatatcgttaaactaatgagcggtaaggacgtattttacttaccgcctgagaagtgtgatacactattatgcgatataggcgaaagcagccctagtcctaccgtagaagaatccaggacaatacgcgtgctgaaaatggttgaaccctggttaaagaataatcaattttgcataaaagtcctaaacccttatatgcccacagtcattgaacatctagaacgactccagaggaaacatggcggtatgctggtaaggaacccattgagccgaaatagtacacatgaaatgtattggatcagcaatggaacgggaaatatagtggcaagtgtcaatatggtatcaagactgttattgaatcgatttaccatgacccatcgacgaccaactatagaaaaagatgtagacctaggcgccggaacacggcatgtcaacgctgaacccgaaacaccaaacatggacgtaattggagaaagaataaaacgaataaaggaagaacataattcgacatggcattatgatgacgaaaatccctataaaacctgggcgtaccatggatcgtatgaagttaaggcgactggaagcgcatcgtccatgataaatggtgttgttaaactcttaactaaaccatgggacgtggtaccgatggtaacacagatggctatgaccgatacaacaccttttgggcagcagagagtatttaaagaaaaagtggacaccaggacaccccgctcgatgcctggtactagaagagtaatggggattacagcggaatggctttggcgaactttggggaggaacaaaaagcccagattatgtacacgcgaagagtttacgaaaaaggtgagaacgaatgcggctatgggtgccgtctttacagaagaaaaccaatgggatagtgctaaggcagctgtcgaggatgaagacttttggaaacttgtagaccgagaacgtgagttgcacaaactaggtaaatgcggttcctgtgtatacaatatgatgggtaaacgagagaagaaattaggggaatttgggaaagctaagggaagtagagcgatatggtatatgtggctaggagcacgatacttagagttcgaggccctaggattccttaatgaggaccattggtttagccgtgaaaatagttacagtggtgtggaaggtgaaggactacataaattaggttatattctaagggatatatcgaaaataccaggcggcgccatgtatgcagacgacactgccggctgggataccagaataacggaggacgatttacacaatgaagagaaaataacgcaacaaatggatccagagcatagacaactagctaacgcgatatttaaattaacataccaaaacaaagtcgtcaaagtacagagacccacgccaacaggtacggtaatggatataattagtagaaaagaccaacgcggcagtgggcaggtaggtacgtacggcctcaatacttttactaatatggaagctcaactaatccgtcaaatggaaggtgaaggtgtattaagcaaggcagatttagaaaaccctcatctccctgagaagaaaataactcagtggctagaaaccaaaggagtggagagattgaaaaggatggcaatatcaggtgacgactgcgtcgtaaagccaattgacgatcgattcgcaaacgctttactagccctgaatgatatgggtaaggtaagaaaggatatacctcaatggcaaccatcaaaaggctggcatgactggcaacaagttcccttctgctcgcaccattttcacgaactaatcatgaaagatggccgtaagctagttgtcccttgcagaccacaagacgaattgatcgggagagcaagaatttcgcagggagccgggtggtcgctcaaagaaacggcttgtctcgggaaagcatacgcacaaatgtggagtctaatgtactttcacagacgagatttacggctggcttctaacgccatttgctcagcagttccagtccactgggtccctacatcaagaacaacttggtctatccatgcccaccatcaatggatgacgactgaagatatgcttactgtatggaatagggtttggatagaggataatccttggatggaagataaaacaccagtaactacctgggaaaatgtcccttatctaggtaagcgagaagatcagtggtgtggttccttaattgggctaacatccagggccacgtgggcacaaaatatcccgactgcaatccaacaagtaaggagcctgataggaaatgaagaatttttggactacatgccaagtatgaaaagatttagaaaagaagaggaatccgaaggagcgatatggtaa

SEQ ID NO: 23206 - RNA, 9873 nt, synthetic construct
  misc_feature 1..9873: note = derived and/or modified CDS sequence (opt6) from DENV-3__HQ705609__SS-prME
  source 1..9873: mol_type = other RNA
acgagtttgtgcttaatgatgatattacccgcagcacttgcattccatctaacaagtcgggacggagaacctcgaatgatcgtagggaaaaatgaaagaggtaaaagcctactatttaaaaccgcaagcggaataaacatgtgcacccttatagcgatggacctaggcgagatgtgcgacgacacagttacttataaatgtccacacatcacggaagttgaaccggaagatatagattgttggtgcaatttaacatcaacgtgggtaacctatgggacttgcaaccaagctggagaacatcggagagataaacgcagtgttgcactcgcaccacacgtgggaatgggactagatacaagaacgcaaacctggatgagtgcggaaggcgcatggcgacaagttgaaaaagtagaaacttgggcattacgtcatccggggttcacaatacttgcgctatttcttgcgcattatattggaacttctctaactcaaaaagtggtaatcttcatcctactaatgctagtaacacccagtatgacaatgcgatgtgtaggggtgggaaatagagatttcgtcgaaggattgtctggtgcaacatgggtagatgtagtgctagaacacggcggctgcgtaaccaccatggccaaaaataaaccaaccctagatatagaactacagaaaaccgaagcgacgcaattggcgactctgaggaaattatgcatagaaggaaaaattactaacataactacggactctcgatgccctacacaaggagaagctactcttcccgaagaacaagatcaaaactatgtatgcaaacatacatatgtggatcgtggctggggtaatggatgtggactgttcgggaaaggaagcctcgtaacctgtgcgaaattccaatgcttggaaccaatagaaggaaaagtagtccaatacgaaaatctaaaatacaccgttataatcacagtacacacgggggaccaacatcaagtcgggaatgaaactcaaggggttactgctgaaattacacctcaggcttcgacaacagaagctattcttcctgagtatggcacactaggactcgaatgtagccccagaacgggtcttgattttaatgaaatgatcctattgacaatgaaaaataaagcctggatggtccatcggcaatggtttttcgatctgccgctgccgtggacatcaggtgcaactacggagacaccaacctggaatagaaaagaactattagtcacttttaaaaacgcacacgccaagaaacaagaagtagtggtattaggatcacaagagggtgcgatgcacacagcgttaacaggtgcaactgaaatacaaaactcgggagggacctcaatttttgcaggacatcttaaatgtagactcaaaatggataaattggaactaaaaggaatgagctatgcaatgtgcacaaacacttttgttctaaagaaagaagtaagtgaaacacaacatggtacaatattgataaaagtagaatataaaggagaagatgttccgtgcaaaatccccttctcaactgaagatggacaagggaaagcacacaatggacgtctgataacagcgaacccagttgttactaagaaagaggaaccggttaatatagaagctgaacctccttttggggaatcaaatatcgtcataggcatcggcgataatgctttaaaaataaactggtacaagaaaggctcatcgataggaaaaatgtttgaagccacagcacgtggcgctcgacgaatggctattcttggtgataccgcatgggactttgggtcggtaggaggagtattaaactcactaggtaaaatggtacatcaaatttttgggagcgcatatacagcccttttctcaggagtttcatgggttatgaaaatcgggattggagtacttttaacctggattggtctaaattccaaaaatacgtccatgtctttttcgtgcatagcaataggaataataaccctctatctgggagcagtagtacaggcagacatgggttgcgttgtaaattggaaaggtaaggaactaaagtgcggtagtggtatatttgtaaccaatgaagttcatacatggactgaacaatacaaattccaagctgattctcctaagcgattagcaacagccatagcaggagcttgggaaaacggagtttgtggaatccgatccacaaccagaatggaaaatttactgtggaaacaaatagctaacgaactcaattatatcctatgggaaaacaacataaaactcacggtagtagtcggagacattattggggttcttgaacaaggcaaaagaacattaacaccacaaccaaaagaacttaagtacagttggaaaacctggggaaaagcaaaaatagtcacagcagaaacacaaaatagctcatttatcatcgatggtccaaatactccagaatgtccatcagtgtccagagcatggaatgtatgggaagttgaagactatggattcggcgtcttcactacaaacatttggttaaagttaagagaagtatatactcagctatgcgaccatagactgatgagcgctgctgtgaaggatgaaagggcagtgcacgccgacatggggtattggattgaaagtcagaaaaatggtagttggaaattagaaaaagccagcttaatagaggttaagacctgcacatggcctaaatcacacacattatggtcaaacggggtattggaatcagacatgattataccaaaatctttagcaggaccaatatcacaacacaatcatagaccgggttatcatacacaaaccgcggggccttggcaccttggtaaattagaattagatttcaattattgcgaaggtacaacagttgtgattactgaaaactgtggaacaagaggtcccagtctaagaacaacgacagtgtcagggaaactaattcacgagtggtgttgtagaagttgtacattgccgcctctgagatatatgggcgaagacggttgttggtatgggatggaaatacgccccattagtgaaaaagaagagaatatggtcaaatcattagtttcagcaggatcgggaaaagttgataattttactatgggggtcctatgccttgctatactttttgaggaagtcatgaggggcaagttcggcaagaaacacatgatagctggagtattctttactttcgttcttttattgtctggtcaaataacttggcgagatatggcccatacactgataatgataggttcaaatgcgtctgaccgaatgggaatgggtgttacttatctagccctaatagctacatttaaaatacaacccttcctcgcacttggattctttttgagaaaactgacaagtagagaaaatttgttacttggagtgggtctagctatggcaactactttgcaactccctgaagatattgaacaaatggcaaatggcatagcattgggcctcatggccttaaaactgataacgcaatttgagacatatcaattgtggactgccctcatctccttaacctgttcaaataccatatttacattaaccgttgcatggcgaacagctacgctcatattagctggtgttagcttacttccagtctgccaaagtagttcaatgagaaaaacggactggttacctatggctgtagctgctatgggtgttcctccgttaccactatttattttcagtttaaaagatacattaaaaaggaggtcttggcccttgaatgaaggagtaatggccgtaggcttggtgtctattcttgcaagttccttattaaggaacgatgtgccaatggcgggtcccctagtagcaggaggactgttgattgcctgttacgttataacggggaccagtgctgacttaactgtagaaaaagcagcggatataacatgggaagaggaagctgaacaaacaggcgtctcacacaatttaatgattaccgtggacgatgatgggactatgcggataaaagatgacgaaactgaaaacatactaactgtactccttaaaacggcactacttatcgtaagtgggatatttccgtattccataccagcaacactattggtatggcatacatggcaaaaacaaacgcaaagatccggggtcttatgggacgtcccatcaccacccgaaacacaaaaagctgaacttgaagaaggcgtttatagaattaaacagcagggcatattcgggaagacgcaagtaggagtaggagttcaaaaagagggagtatttcataccatgtggcacgtaacaagaggtgcagtattaacttacaatggaaaacggctagaacctaattgggcgtcagtcaagaaagatctcataagctacggcggaggatggagacttagcgcccaatggcagaagggtgaagaagtccaagtaattgcagtagaacccggtaaaaatccgaaaaattttcagacgatgcctggcacatttcaaactaccacaggcgaaataggagccatagcacttgactttaaaccgggcacctccgggtctcctataataaacagagagggaaaggtagtaggtctttacggtaatggggtcgtaactaaaaatggtgggtacgtaagtggaatcgctcaaaccaatgcagaacccgatggacccacgcccgagttagaggaagaaatgttcaagaaacggaacctcacgattatggacttacaccccggcagcggaaagacaagaaagtacttaccggcgattgtgagagaagctataaaaaggagattaagaacactaattctagctcccacacgggtcgttgcagcagaaatggaagaagctcttaaagggctaccaattagatatcagactactgcaaccaaaagtgaacacaccgggcgtgaaatagtcgatttaatgtgccatgcgacgtttaccatgcgattattatcgccagtccgagtaccgaattacaacttaattataatggatgaggcacattttacggatcctgcctcaattgccgcacgagggtatatcagtacacgtgttggaatgggcgaggcagcggccatatttatgactgccactcctccaggtaccgctgatgccttcccccaaagcaatgccccaatacaggatgaggaacgagatatcccggaacgaagttggaactctggtaatgaatggatcacagactttgcgggtaaaaccgtttggttcgtgcctagcattaaggcaggaaatgacatcgctaattgtttacgtaaaaacggcaagaaagtaatccaattatcacgaaaaactttcgataccgaatatcagaaaactaaattgaacgactgggactttgtcgttacgacagatatctcagaaatgggagcaaactttaaagctgaccgagttattgatccaagacgctgcctgaagccagtcatactgaccgacggacccgaaagggtaatccttgcaggtccaatgcctgttactgctgccagtgcggcgcaacgaagagggcgtgtcggccgcaacccacaaaaagagaacgatcagtatatcttcacaggtcagcctctcaacaatgacgaagatcatgcccattggactgaagctaaaatgctattagataatattaacacacctgaaggtataattccggcgttatttgagccagaaagggaaaaatcagcggccatagacggagagtaccgcctaaaaggagaaagtagaaagacctttgtcgaacttatgcgaagaggtgatctaccagtatggctcgcacacaaagtcgcatcagagggaattaaatacacggacagaaagtggtgtttcgacggtcaaagaaataaccaaattctagaggaaaacatggatgtagagatctggactaaagaaggcgaaaagaagaaattaagaccccgatggctagacgctagaacttacagtgacccactagctctgaaagaatttaaagagttcgcggcaggaaggaaatctattgcactagatttagtgacagagattggccgagtaccatcccacctagcacaccgtacaagaaatgccctagataacctagttatgcttcatacgagtgaacatggaggcagagcatataggcacgccgtggaggaattgcccgaaacgatggaaactttattactgttaggactaatgatattacttaccgggggtgcaatgttatttcttatatcgggaaaagggatagggaagacatcgataggactaatctgtgtgattgccagttcaggcatgctatggatggccgaaataccattacaatggatcgcctctgcaatagtactggagttctttatgatggttctacttataccggaaccagagaaacagagaacgccccaagataaccaactggcatacgtggttataggcattttaacactggcagcaatcatagctgcaaacgagatgggtctactggaaacaactaagagagatctgggtatgagtaaagagccgggagtagtaagccctacttcatacctcgatgtggatcttcatcctgcatcagcatggactttgtatgctgtcgcgaccactgtgattactcctatgttgagacacactatagaaaattcgacagcgaatgtttctctcgccgcaatagcaaaccaagctgtcgttctgatggggctcgataaagggtggccaatcagtaagatggaccttggtgtaccactcttagcactaggctgctactcccaagtaaatcccttgacactcacggcagctgttctacttttgataactcattacgcaatcattgggccgggactgcaagctaaagccacaagagaggctcagaagagaacggctgcaggcattatgaaaaaccctacagttgacggaataatgaccatagacctggaccccgttatatatgactctaagtttgaaaaacaactaggtcaagtaatgctactcgtactgtgtgctgtacagttattgctaatgcgtacaagttgggccttgtgtgaagccctgacattagctacaggacctatcactacattatgggaaggtagtccaggcaaattttggaacaccacaattgcggtatcaatggcaaatatctttagaggttcttatttggcaggggcggggctagcttttagtatcatgaagtccgttggaactggtaaaagaggaaccggatctcaaggagagacacttggtgaaaaatggaaaaagaaactgaaccaactatcaagaaaggactttgatttgtataaaaagtctggtataactgaagtggaccgcactgaggcaaaagagggtttaaaaagaggtgaaatcacacatcatgcagttagtagaggcagtgcaaaattacaatggtttgttgagagaaatatggtcataccagaaggacgagtaattgatttaggctgtggaaggggtggttggtcgtattattgtgctggcctcaagaaagttaccgaggtaaggggatatactaaaggtggtcctgggcatgaagaaccagtaccgatgagcacatatggatggaatatagtaaaacttatgtcgggtaaggacgtattctacttgccccctgaaaaatgtgatacactgctttgtgatatcggagaaagcagtccgagcccaatagtcgaagaatcaagaacaataagagttcttaagatggtagaaccgtggctcaaaaataaccaattctgcattaaagttttgaacccttacatgccgactgtaatagaacatttagaaaggctgcaacgtaagcatggaggaatgttggtacgtaatccgctgagtcgcaattcaactcatgagatgtattggatttcaaacggaactgggaatattgtggcatctgtgaacatggtttcacgattactcttgaatagattcaccatgacacatcgacgcccaacaatagagaaagacgtcgatctaggagcaggaactcgtcacgtgaatgcagagcctgaaacaccgaacatggatgttataggagaacgtataaaacgtataaaagaagaacacaactcaacatggcattatgacgacgaaaatccatacaagacatgggcctatcatggatcatatgaagtcaaagccacaggaagcgcatctagtatgattaatggtgtggttaagttattaacgaaaccctgggacgtagtccccatggttacacagatggctatgactgacacaactccgtttggacagcaacgagtatttagagaaaaggtagatacacgcactcctagatcgatgcccggaacacggcgggtcatgggtataacagcagagtggctatggaggacgttggggagaaataagaaacctagactgtgtacgagagaggaatttaccaagaaagttcgtactaatgccgccatgggtgcggtatttactgaggagaaccagtgggatagcgcgaaagcggctgttgaagatgaagatttctggaaattggtagatagagaacgtgaattacacaaacttggtaaatgtggctcatgtgtttataacatgatggggaaaagagagaagaaactaggagagttcggaaaagcaaaggggagcagagcgatatggtacatgtggctaggcgcaaggtacctagaatttgaggcactaggatttctcaatgaagaccattggttttcgagagaaaacagttattcaggtgttgagggagaaggcttgcataaattaggttacatcctgagggatattagtaaaataccaggtggggcgatgtatgcggacgacacagctggctgggatactcgaataactgaggacgatttacacaatgaagaaaagataacacaacaaatggacccagagcaccgtcaactcgcaaacgccatatttaaactgacgtatcaaaataaagtagtcaaagttcaaagaccgactccaacaggaacagtaatggatatcatatctcggaaagatcaaagaggcagcggccaagtgggcacttatgggttaaatacctttacaaacatggaggcacaattaattcgacaaatggagggcgagggcgtacttagtaaggccgacctggaaaatccacatctacctgagaagaaaataacgcaatggttggaaaccaaaggtgtcgaacgtctgaaacggatggccatttcaggagacgattgtgtagtaaaaccaatagacgatcggttcgctaacgcactactagctttgaacgacatgggtaaagtcaggaaggacataccccagtggcaaccaagtaaaggatggcatgattggcaacaagtgcctttctgttcacaccactttcatgagctgattatgaaagatggacgaaagctagttgttccatgtcgacctcaagatgaattgataggccgagccaggatttcacagggagcgggatggagtttgaaagaaacagcgtgcctaggaaaggcatatgcccagatgtggtctctaatgtattttcatagaagggacttaagactagcttcgaacgcaatctgttcagccgtacctgtccattgggtcccgaccagcaggactacctggtcgattcatgcccatcaccaatggatgactactgaggacatgctaactgtttggaatcgagtctggattgaagataatccatggatggaggacaaaacaccagtcacgacgtgggaaaatgtcccgtacttagggaaacgtgaagatcagtggtgtggaagtcttataggattaacatcaagagcaacttgggcacaaaatataccaacagcaatccaacaagtaagaagtctaataggcaatgaagaatttttggattatatgccgtcaatgaaacgcttccgaaaagaggaagagagcgaaggagctatttggtaa

SEQ ID NO: 23207 - RNA, 9873 nt, synthetic construct
  misc_feature 1..9873: note = derived and/or modified CDS sequence (opt6) from DENV-3__HQ705610__SS-prME
  source 1..9873: mol_type = other RNA
acaagtctatgccttatgatgattctacctgctgctctagcatttcaccttactagcagagacggagaaccacggatgattgtaggcaaaaatgaaaggggcaaaagcctgttgtttaaaactgcatcgggcattaacatgtgtacattaatcgcaatggacttaggagaaatgtgtgatgacaccgtgacatacaaatgtcctcatataacagaagtagaaccagaagatatagactgctggtgtaatctaacaagtacttgggtaacgtacggaacctgtaatcaagcaggagaacacagaagagataaaaggagtgtagcattagctccacacgtaggaatgggcttagacactaggacacaaacgtggatgtctgcagaaggagcatggagacaagtcgaaaaagtagaaacctgggctctccgccacccaggttttactatattagccctattcctagcccattacatcggtacctcactaactcaaaaagtagttatctttatattgctaatgcttgtaactccaagtatgaccatgaggtgcgtaggtgtaggtaatagagattttgtggaagggctaagtggtgctacatgggtcgatgttgtactagaacatggaggatgtgttacaacaatggccaaaaataaaccaacactagacatagaactgcagaaaacggaagcgacccaacttgcgactctccgtaaattatgtatagaaggaaaaataacaaatataacaactgatagccgatgccctactcaaggagaggctacacttcctgaggaacaagatcaaaattatgtatgcaaacatacttatgtagaccgaggatgggggaatggctgtggactctttggaaaaggatctttagtgacatgtgcgaaattccaatgccttgaaccaatcgaagggaaagttgtgcaatatgagaatcttaaatacaccgtgattataacggttcataccggtgatcaacatcaagtaggaaacgaaacccaaggagttaccgccgagattacaccacaggcttctacgacagaagcaatactccctgaatacgggaccttagggctagagtgcagtcctcgtacaggcttagatttcaacgaaatgattcttttaaccatgaaaaacaaagcatggatggtccatagacaatggttctttgacctgcccttaccatggacctccggagcaacaactgaaacacctacctggaaccgaaaagaacttttggtgacatttaaaaacgcacacgccaagaaacaagaagtagtcgtgttgggatcgcaggagggtgcaatgcatacagcactcacaggagccaccgaaatacaaaattctggtggaacttcgatatttgctggacacttgaaatgcaggttgaaaatggataaactcgaactaaaaggaatgtcttatgccatgtgcactaatacatttgtactcaagaaagaagtatcagaaactcagcacggaacaatattgattaaagtggaatacaaaggtgaggatgtgccttgtaaaattccattctcgactgaagatggacaaggtaaggcacataatggacgactgataacagccaaccccgtggtaactaagaaggaagaaccagtaaacatagaggcggaacccccatttggggagtctaacatagtcattggtattggtgataatgcactaaaaatcaactggtataagaaaggaagcagcattggaaagatgtttgaagctacggcacgtggtgcacgtcgaatggcaatactcggggatacagcatgggattttggcagtgtaggaggtgttctcaacagtttagggaaaatggttcaccaaatattcggatctgcatatactgcattattttctggagtctcttgggttatgaagatcggtataggagtgttactaacgtggattggattaaatagtaaaaacactagcatgtcgtttagctgcatagcaatcggaataataacactttatcttggggcagttgtccaagcagacatgggttgtgtaataaactggaagggtaaagagttaaaatgtgggtcaggaatttttgtaacaaatgaagtgcatacatggacagagcagtataaatttcaagcggactcgccaaaaagactcgctactgccatagctggggcatgggagaatggagtatgtgggatcagaagcaccactagaatggagaatttgttgtggaagcaaattgcaaatgaacttaattacatcctatgggaaaacaatatcaaattgaccgtagtagtaggagacataataggagttctggaacagggaaaaagaacactaacacctcaaccgatggagcttaaatattcgtggaagacgtgggggaaagcgaaaatagttacagctgagacgcaaaattcatcttttataattgacggtccaaatactccggaatgtcctagcgtgtcacgagcatggaatgtatgggaagtagaggattacggatttggagtatttacaactaatatatggttaaaattacgtgaagtatacacacaactctgtgatcatcgactaatgtctgcagccgtcaaggatgagagagctgtgcatgcggatatgggatactggatagagtcgcagaaaaatggtagttggaaattagagaaggcttctttaatcgaagttaaaacttgcacctggccgaagtcacatacgatctggtcaaatggtgtgctagaaagcgatatgataattcccaaaagtcttgcaggtccaataagtcaacacaatcatagacccggatatcatacacaaaccgccgggccttggcacttaggtaaactcgagctagatttcaattattgcgaaggtactactgtagtaataacagagaactgcggcactagaggtccatcattgcgaactaccacagtatcaggaaaactgattcacgagtggtgttgccgaagttgtacactaccccctctgagatacatgggagaagacggttgctggtatgggatggaaatccgcccaatatcagagaaggaagagaatatggtcaaaagcctagtatcagcgggcagcggcaaggtagataattttactatgggtgtgctatgtcttgcaatactatttgaagaagtaatgcgaggaaaattcggcaagaaacatatgatagcaggagtcttcctaacattcgttctgcttctatcggggcaaataacgtggaaagacatggcgcacacattgataatgattggctctaacgcttctgaccgtatgggtatgggagtaacttatttagctctcatagcaacattcaaaatccaaccttttctagctctcggattcttcttgcgaaagctgacaagtagagaaaatttattattaggagttgggttagcaatggccacgactttacaattacctgaagatatagaacaaatggccaatggtatcgcattgggcctcatggcattaaaattgataacacaatttgaaacgtatcaattatggaccgccctcatatccctaacctgctcaaatacaataagtactctaacagttgcttggcgaaccgcaactttaattttagcaggagtttccctactacccgtctgccaatcaagtagtatgcggaagaccgattggctccctatggcggtagctgcgatgggcgtcccacccctgcctttgtttatatttagcttgaaagatacactcaaaagacggagttggccgctaaacgaaggagtaatggccgtaggattagtatctattctcgcctcatctttactccgcaacgatgtgccgatggctggtcctttggttgcaggcggattattgatagcatgctatgtaatcacgggaacatcggctgatttaacagttgaaaaggccgccgacatcacctgggaggaagaagcagaacaaacgggagtcagtcataatcttatgattacggtagatgacgacgggacaatgcgaataaaagatgatgaaacagaaaatatacttacagtactcttaaagacagcattgctgatagtgagtggtatctttccctatagcatacctgccactctcctagtctggcatacatggcagaaacaaacacaaagatccggtgtattgtgggacgtcccctcacctcccgaaacgcaaaaggcagaacttgaggaaggcgtctacagaataaaacaacaagggatatttggaaaaacacaggtgggagtcggagttcaaaaagaaggagtcttccataccatgtggcatgtcacaaggggtgcagtgttaacatacaatggtaaacggttagagcccaactgggcctctgtcaagaaagacctgatctcctatggaggaggctggaggctgagcgcccagtggcaaaagggggaagaagttcaggtaatagcagttgaacctggtaaaaaccccaaaaatttccagacaatgccaggaacctttcaaacaactacaggagaaattggcgcgatagctctagattttaaacctggcacatcaggatcgcctataattaatcgagagggcaaagtcgtaggattatacggaaatggagtagtgacaaagaatggcggatatgtttccgggattgcccaaacaaatgctgaaccagatgggcccacgccagagttagaagaagaaatgtttaagaaaagaaacctaaccataatggacttgcatcccggatctggaaagacaagaaagtatctgcctgcgatagtccgagaagccattaaaagacgccttcgaactcttatattagctccaacgagagtagtagcagcagaaatggaggaggctttgaaagggttacccattaggtatcaaacgacggcaacaaaaagcgaacatacgggcagagaaatagtagatttaatgtgccacgcaacttttactatgcgacttttatcaccagtcagggtgcctaactataacttaataattatggatgaagcccatttcacagatccagccagtatcgcagccagaggttatattagtacaagggtaggtatgggagaagctgcggctatctttatgactgctacaccaccgggcacagcagacgcatttccccagtcaaacgctccaatccaagatgaagaaagagacatacctgaacgctcgtggaatagcggtaatgagtggatcaccgacttcgctggaaaaaccgtctggtttgtcccgtcgataaaggctggcaacgatatagccaattgcctgcgaaagaatggcaaaaaggtaatacaattgagtagaaaaacttttgatacagaataccagaaaactaaactaaacgattgggactttgtagtcacaactgatatatcggaaatgggagcaaactttaaagctgatagagtcatcgatccgcgacgatgcttaaaaccagtaattctcactgacggtcctgaaagggtaatcttagcaggcccaatgccagttacagcggctagtgcagcgcaaagaagagggagggtgggccgtaacccacaaaaagagaatgatcaatacatatttactgggcaacctctgaacaatgatgaggatcacgcacattggactgaagccaagatgcttttagacaatataaacacgcccgaaggaataatccctgccctttttgagccagaacgtgaaaaatccgcggcgattgacggtgagtatagattaaaaggagagtcccgaaagacgtttgttgaactaatgcgacgaggcgatctaccagtatggttagcacacaaagtagcgtcggaaggcattaagtatactgatagaaaatggtgttttgacgggcaacgaaataaccaaattctggaagaaaatatggacgtagaaatatggacgaaggaaggagagaagaagaaattgcgaccaaggtggctcgacgctagaacatactcggacccattagctttaaaagaatttaaagaatttgccgcgggtcggaagtcaatcgcactcgatctagtaaccgaaattggacgagtacccagtcaccttgcccatagaactagaaatgcgctggacaatttagttatgctacatacatcagaacacggaggcagagcgtaccgacacgctgtggaagaattgcccgaaactatggaaacactattactactagggttaatgattttactcacaggcggagcaatgctattcctaataagcggtaaaggtatagggaaaacaagtatcgggttaatatgtgtcatagcatcgagtggaatgttgtggatggccgaaataccgctacaatggattgcgtccgctatagtcttggagttctttatgatggtccttttaatacctgaaccggaaaaacagaggaccccacaagacaaccaattggcgtatgtagtaattggaatactgactttagcagccattatagctgcaaacgaaatgggacttcttgaaacaacgaagagagatttaggtatgagcaaggagcctggagtagtgtctcccacaagttatctggatgtagacttacacccagcatctgcctggacgctatacgcagtagctactacagtaataacgccaatgctcagacatacgatcgaaaacagtacagcgaacgtatcactagccgctatcgctaatcaagctgttgtactgatgggactcgataagggttggcctataagtaagatggacttaggagtcccccttcttgccctaggatgttactcgcaagtgaatccattgacacttactgctgcagttctcttattaataacacattacgcaatcataggcccagggctacaagctaaagcaacgagagaagcacagaaaagaacggcagcaggaataatgaagaaccccaccgtagacggtataatgactatcgatttagatccagtaatctatgactccaagtttgagaagcaactcggtcaagtaatgttattagtgttgtgtgttgtccaattacttcttatgagaacgtcttgggctctatgtgaggcattaacattagctacaggcccaatcaccacactatgggaaggctctcctgggaaattctggaacacgacgattgcagtgtcgatggccaacatcttccgaggatcatatttagcgggtgcaggattggccttcagcattatgaaatcagtcggcacgggcaaaagaggcacaggttcacaaggagaaacgttaggagaaaaatggaagaagaaattaaaccaactatcacgaaaagatttcgatctctataagaaaagcggaattaccgaagtcgaccgaacagaagctaaagagggcttaaagcggggcgaaatcacgcatcatgcagtttctcgtggatctgctaaactacaatggtttgtagaacgtaatatggttatcccggaaggacgtgtaatagatctaggatgcggcagaggaggatggtcctactattgtgccggtctaaagaaagtgacggaggttcgggggtacacaaaaggtggacctggacacgaagaacctgtacctatgtcaacatacggatggaatatagtaaaattaatgagtggtaaagacgtattttatctgcctccagaaaaatgtgatactttactctgtgatattggagagtcgagtccaagtccaaccgttgaagaatccagaacaatacgggtattaaaaatggttgagccttggttaaagaacaaccagttttgtattaaagtgttaaatccgtacatgccaacagtgatagaacacttagaaaggctacagcgtaaacatggagggatgttagttagaaatccattatcacgaaattccacccatgagatgtactggatatccaacggcacgggtaatatcgtagctagtgtaaacatggtcagtcgattactactcaatagatttacaatgacacatcgaagaccaacaattgaaaaagacgtagatctgggtgcaggaactcggcacgttaacgccgaacctgagacacccaatatggacgtaattggtgaaagaatcaaacgaataaaagaagaacacaattcaacgtggcattatgacgatgaaaacccatacaaaacctgggcttatcacggctcttacgaagtcaaagcaactggatcggcgagctctatgataaacggagtcgtcaaattgctaacaaagccatgggacgtagtaccaatggtgactcaaatggctatgactgatactactccgtttggacaacaacgtgtgttcaaagaaaaggttgatactagaaccccaagatcgatgccgggaacccgacgagttatggggataaccgccgagtggttatggcgaacactcgggcgcaataagaaaccacggctttgtacacgagaagagtttactaagaaagttagaacaaacgcagcaatgggtgcggttttcacggaagagaaccagtgggattcggcaaaagctgcggtagaagacgaagatttttggaaattggttgatagagaacgcgaacttcataaattaggcaaatgtgggtcctgcgtatataatatgatgggcaaacgggagaagaaattaggagaatttggcaaagcaaaaggctctagggcaatttggtatatgtggttgggtgcacgctatttagaatttgaagcactcggttttctaaacgaggaccattggttttcaagagaaaactcttacagtggagtagaaggagaaggtttacacaagctaggatacatattaagggacatatccaagattccgggaggggctatgtatgcagacgacactgctggatgggacacgcgaataacagaagacgatctgcataacgaagagaaaataacacaacagatggatcctgaacataggcaactagcaaatgcaatatttaaacttacataccaaaataaagttgtgaaagtacaaagacctacaccgacagggacagtaatggacattatttcccggaaagatcaaagaggtagtggacaagtaggaacatacggactgaatacatttaccaatatggaagcacaattgatccgccaaatggagggagagggagtgctatcgaaagccgacctagagaatccccatctaccagagaagaaaattactcaatggcttgaaacaaaaggggttgaaagactcaaacgaatggctatttcgggagatgattgcgtggtaaaacccatagatgacagatttgcgaatgcactgctcgctctaaatgatatgggaaaggtgcgaaaagatataccccaatggcagccatctaagggttggcatgactggcaacaagtaccattttgctctcatcattttcacgagttaataatgaaagatggccgtaaactggtagtaccttgtcgcccgcaggatgaattgattgggagggcccgaatcagccaaggcgcaggatggtcgctgaaagaaactgcctgtcttggaaaagcatacgcgcaaatgtggtcactaatgtattttcaccgaagggacttgaggttagcctcaaatgcaatatgttcggcagtgcctgtacattgggttccaacaagtaggaccacatggagcattcacgcgcatcaccagtggatgactacagaagatatgttaacagtctggaatcgggtttggatcgaagataatccctggatggaagataaaacaccagtaactacgtgggaaaacgtaccatacttgggaaagcgagaagatcaatggtgtggatcattaatagggctgacgtcacgagccacgtgggctcaaaatattcccacagctatacagcaagtaagatctctaattggtaacgaagagttcctagactacatgccaagtatgaaacgattcaggaaagaggaagaatctgagggcgcaatctggtaa

SEQ ID NO: 23208 - RNA, 9873 nt, synthetic construct
  misc_feature 1..9873: note = derived and/or modified CDS sequence (opt6) from DENV-3__HQ705611__SS-prME
  source 1..9873: mol_type = other RNA
acatcattatgtctaatgatgattctacctgcagcactggcatttcatttaacaagtagagatggtgaaccaagaatgatcgttggcaaaaatgaaaggggtaaatccctactctttaaaacagcaagtggtattaatatgtgtactttaatagcaatggacttaggagaaatgtgtgacgacacagttacctacaaatgtccgcatattacagaagtagaaccagaagacatcgattgttggtgtaacctaacaagtacatgggttacttatgggacatgtaaccaagccggagaacatcgaagggacaaacgtagtgttgcgcttgctccgcacgtaggaatggggttagacacaagaacccaaacttggatgtctgccgaaggagcgtggcgtcaagtagaaaaagtggaaacatgggccttacgtcatccagggtttactattctcgcactattcttagcccattatataggtacttctctcacacaaaaagtagtaatatttatcctattaatgctagttaccccgagcatgacaatgcggtgtgttggggtaggaaaccgagattttgtagaaggcctctcaggagccacttgggtagatgtagtattagaacacggcggatgtgttaccacaatggccaaaaataaaccaacattagatatcgaactccagaaaactgaagctacacaattagctacgctcagaaaattatgtatagaaggtaaaattacaaacatcacaactgatagtaggtgtcctacccaaggtgaagctacactacctgaagaacaagatcaaaattacgtctgcaaacacacctatgtagacaggggttggggaaatggttgtggactttttggtaaaggtagtctagtaacatgtgcaaaatttcaatgtttagaaccgatcgaaggtaaagtagtacaatatgaaaacctcaaatatactgtaattatcaccgtacacacaggagaccaacaccaagttggcaacgaaacccaaggagtaacggcagaaataacgccacaagcatccacaacagaggccatcttaccagaatatggaactctaggcctagaatgctcacctaggactggacttgattttaatgagatgatacttctaaccatgaaaaataaagcatggatggtccataggcaatggttctttgatttaccgttaccatggacaagcggtgctaccactgagacaccaacatggaatagaaaagagctacttgtaacattcaaaaacgcacatgcaaagaaacaagaagtagtagtgctaggcagtcaagaaggagctatgcatacagctcttaccggagctacagaaatccaaaactctggtggaacttctatatttgctggacatttaaaatgtaggttaaaaatggacaaactggaactgaaaggaatgtcttatgcaatgtgtacgaatactttcgtactaaagaaagaagtaagtgaaactcaacacggaacaatactgatcaaagtagagtacaaaggagaagacgtgccttgcaaaatcccatttagtacggaggatgggcaaggtaaagcacataacgggagacttataacggctaatccagtagttaccaagaaagaggagccagtaaacatagaggcagaaccaccgttcggcgagtccaatatagttataggcatcggagataatgcactaaaaataaattggtataagaaaggaagtagcataggcaaaatgttcgaagcaactgcgagaggagctcggagaatggccatactaggtgatacggcgtgggatttcggatcggtcgggggagtgttaaatagcctcggaaaaatggtgcatcaaatctttggttcagcctacacggctctattctctggtgtttcatgggtaatgaagatcggaattggagtattgctaacatggataggcctaaatagcaaaaatacaagtatgagtttttcttgcattgctatcggcattatcacgctatacttaggagcagtagtccaagctgatatgggatgcgtaattaactggaaaggcaaagaactgaaatgtggaagcggaatattcgtgacgaatgaggtccatacctggaccgagcaatataagtttcaagccgatagccctaaaaggcttgccacagcaatagcaggcgcttgggaaaacggtgtgtgcggaattagaagtactactagaatggaaaacctattatggaaacagatagcaaacgaactaaattacatcttatgggagaacaacataaaactaactgtcgtagtaggtgatatcatcggtgtgctagaacagggtaaacgaacattgacaccacaacctatggaattgaaatactcatggaagacgtggggtaaggccaagatagtcacggctgaaacacaaaattctagtttcataattgacggtccaaatacgccagaatgcccaagtgtttccagagcttggaatgtttgggaagtagaggattatgggtttggggtttttacaactaacatatggttaaaattgagggaagtctacacacagctatgtgatcacagactcatgtcagctgcagtaaaggacgaaagagcagtacatgcggatatgggatactggattgaatctcagaaaaatgggtcttggaaactcgaaaaagctagcctaatagaagtgaaaacttgtacatggcctaaatcacacaccctatggtcgaacggggtgcttgaatccgatatgatcattccaaaatccttagctggacctatttcccagcataatcatcggcccggctatcacacacagactgcaggcccttggcatctaggcaagttagagttagattttaattactgtgaaggcacaactgtagttataacggaaaattgtgggactaggggaccgagcctccgaacgacgaccgtatcaggaaaattgatacacgaatggtgctgtagatcgtgcactcttcccccactccggtatatgggggaagacggatgttggtatgggatggaaataaggcccatatctgaaaaggaagaaaacatggtaaaatcgctagtgagtgcaggctcaggcaaggttgataactttaccatgggggtgttatgcttagccatcttattcgaggaagtaatgcgtggcaagtttgggaagaaacatatgattgcaggagtcttctttacgttcgtgttattactaagtggacagataacttggagggatatggctcatacactaataatgatcggatcaaatgctagcgataggatgggaatgggtgtaacataccttgctttaattgcgactttcaaaatacagccgtttctagccctaggatttttcttaagaaaattaacatcgagagagaacttgttattaggtgtaggtttagccatggcgactaccctacaattaccagaagacattgagcaaatggcaaatggaattgcattgggccttatggcattaaaactaataacgcaattcgaaacataccaactctggacagcgcttatcagcttaacatgctcgaatactatcttcaccttaacagtagcatggagaaccgcaaccctcatactcgctggtgtctcgttgttacccgtctgtcagtcctccagtatgagaaaaactgattggctaccaatggctgtggctgcaatgggagtgccaccattgccactctttatatttggactaaaagacacgctgaaaagacgtagttggccactcaatgaaggagtaatggcggtaggcttggtaagcattctggcgtcatctttattaaggaatgacgtccccatggctggacctttggttgcaggaggactcctaattgcatgttacgtcatcacaggcacatcagctgatttaaccgtggaaaaagcagcagacataacatgggaagaagaagccgagcagacaggcgtgtcccataacctaatgatcacggtagacgatgatggaacgatgcgtataaaagacgatgagactgaaaatatactaacagtattattaaaaacagctctgcttatagtgagtggaatctttccatatagtatacctgcgacactcctggtgtggcatacttggcaaaaacaaacccaaagaagcggagtactttgggatgttccaagtccaccggaaacacagaaggcagaattagaggaaggggtttacaggattaaacagcagggaatatttggtaaaacacaagtaggcgtcggagtacaaaaagagggagtttttcacactatgtggcatgtgacacgaggagcagttctgacatacaatggaaagagattggagccaaattgggcaagcgtcaagaaagacttaatatcatacggaggaggatggagactatctgcacagtggcaaaaaggagaagaagtacaagttatagctgttgaaccaggaaagaatcccaaaaatttccaaaccatgccgggcacttttcagacaacgacaggagaaataggagctatagcgttagactttaagcccggcacatcaggttcaccaataatcaatagagagggcaaagttgtcggactctacggtaacggggtagtaaccaagaatggtggatacgtttctggtattgcacagacaaatgcagaaccggacggaccgaccccagagctagaagaggaaatgttcaaaaagagaaatcttacaatcatggacctgcaccccggcagtggaaaaacgcgaaaatatcttcctgctatagttagggaggcgatcaaaagaagactaagaacgctcatactagcacccacacgagtagttgctgcagagatggaagaagctctaaagggtttaccaatcaggtaccaaacaacagcaacaaaatcagaacacaccggtcgagagattgtagatttgatgtgccacgcaacatttacaatgagattattaagtcctgtcagagtgccaaactataacttaataatcatggacgaagcacacttcacagaccctgcaagtatagctgccaggggttatatatcaactagagtaggaatgggagaggcagcggcaatattcatgaccgctacaccgccaggaaccgcagatgcctttcctcaaagcaacgccccaatacaagacgaagaaagagacatacctgagagaagctggaactctgggaatgaatggattactgatttcgcaggaaaaaccgtatggtttgtacctagcataaaagccggtaatgatatcgcaaactgcttacggaaaaatggaaagaaggtcatccagttatcgcgtaaaacattcgacaccgaatatcagaaaacgaagttgaatgactgggattttgttgtcacgacagatatatcagagatgggtgcaaattttaaagcagatcgagtgattgacccaagaagatgtctcaaaccggttattttaactgatggacctgaaagggtaatattagcaggcccaatgcccgtcacggcagcaagcgcggctcagagacgaggtcgtgtgggtagaaatcctcaaaaggagaatgaccagtatatattcaccgggcaaccactaaacaatgatgaggatcatgctcattggaccgaagcgaaaatgttattagataatattaacacacccgaaggaataatcccggcattgttcgagccggaaagagagaaaagtgccgctattgatggcgaatacagactaaagggagaaagtcgtaaaacctttgttgaactaatgcgaagaggggatcttcccgtatggctcgcacacaaagtggcgtcagagggcattaaatacacggacagaaaatggtgcttcgacggtcagagaaataatcaaatattagaagaaaatatggacgtagaaatttggaccaaagagggagagaagaagaaactccgacctcgttggctggatgcgagaacctacagcgatcctctagcactaaaagagtttaaagagtttgctgcggggaggaaatctattgcactggacctcgttacagaaattggacgagtcccttcccacttagcgcacagaactaggaacgcactagacaacctagtgatgttacacacgagtgagcatggaggtagagcttacagacatgccgtagaggaactccccgaaacgatggaaacgctattactactaggtctcatgattctacttaccggaggcgcgatgctattccttatcagtggtaaaggtatcggaaaaacatcaatagggttaatatgtgtcatagcttcaagcggcatgctatggatggcagaaataccgttacaatggatagcatcagctatcgttctagagttctttatgatggttttacttatccccgaacccgaaaagcaacgaacaccacaagataatcaattagcatacgttgtaatcggcatactaactttagcagcgatcattgcagccaacgaaatgggattgctagagacgacgaaaagagacttaggaatgagtaaagaaccaggcgtagtaagtcctacttcatacctcgatgtagacctccacccagcctctgcatggaccctttatgcggtagctaccacagttatcacacccatgctaagacacacaatagaaaattctaccgcaaacgtttcattggccgcgattgctaaccaagcagtcgttctaatgggtttagataaaggttggcctatatcaaagatggatcttggagttcccttacttgcattaggttgttatagtcaagtcaacccgttaactcttactgcagcggtattattattaattacccattatgctataataggccccggactccaggcaaaagctacacgagaagctcaaaagcgaacagcagccggaataatgaaaaacccaacggtcgacggaataatgacaattgatttagatcctgttatttatgattcaaaattcgagaaacaactcgggcaggttatgctcttagtattatgtgccgtacaacttttattaatgagaacatcttgggcgctatgcgaagcactcacactggcaacaggtccaattaccaccctttgggaaggttctcctggcaaattctggaataccactatagcagtgtctatggcaaatatatttaggggtagctatttggctggagccggcctagcctttagtataatgaaaagcgtggggacaggaaaaaggggaacgggctcacagggagaaacactgggagaaaagtggaagaagaaattaaatcaattaagtcgcaaagattttgatctatacaagaaatccggaataacagaagtagatagaactgaagcaaaagagggattgaagaggggagaaataacacatcacgccgttagccgcggctccgcgaaactccagtggtttgtagaaagaaacatggtaatacccgaaggccgagtaatagaccttgggtgcggtcgcggagggtggtcttattactgcgcaggcctgaagaaagtgactgaggtacgaggatatacaaagggcggaccgggtcatgaagaaccggtaccaatgtccacctacgggtggaatattgtaaagctaatgagcgggaaagatgttttctatcttccgccggaaaaatgcgacacactattatgtgacattggcgaaagctctccatctccaacagtcgaagaatcgagaacaattcgtgtattaaaaatggtggaaccttggctaaagaacaatcaattttgcattaaagtactaaatccatatatgcccactgttatagaacatttagaacgacttcaaaggaagcacggagggatgctagtgcgcaaccccttaagtcgaaacagtactcatgaaatgtactggataagtaatggtacaggaaacatagtagcatcagtcaatatggtttccaggttactcctcaaccgcttcacaatgacgcataggcgacccacaatagaaaaagacgtggacctcggggctggaaccaggcatgttaacgctgaaccagagacaccgaatatggatgtgataggagaaagaatcaagaaaataaaggaagaacataatagcacctggcactatgatgacgagaatccttacaaaacgtgggcctaccatgggtcatatgaagtcaaagcaaccggatctgccagcagcatgatcaatggcgtagtaaaacttctaacaaaaccctgggatgttgtacccatggtaactcagatggcaatgactgacacaacgccatttggacaacagagagtttttaaggaaaaggtcgataccaggactcctcgatcaatgccgggcactagaagggttatgggaattacagccgaatggttatggcgcacactaggtagaaataagaaacctaggttatgtacaagggaagaatttaccaagaaagtacggaccaatgctgcaatgggggcagtatttacagaagaaaatcagtgggatagcgctaaagccgctgtagaagatgaggacttttggaaattagtcgaccgcgaaagagaattacacaagttagggaaatgtggctcttgtgtatacaatatgatgggaaaacgggagaagaaattaggtgaatttggtaaagctaaaggtagtagggcaatatggtatatgtggttaggcgctagataccttgaatttgaggctttgggattcctaaacgaggaccattggttctcacgagaaaattcctattccggagtagaaggtgaagggcttcataaattaggttatatacttagggatatatctaaaatcccaggaggggcaatgtacgctgacgacactgccggttgggatacgcgaataaccgaagacgatttacataacgaagagaaaataacacagcaaatggatccagaacatagacaactcgcgaatgcgatattcaagctgacatatcaaaataaagtagtaaaggttcaacgacctacacccacaggaaccgttatggacataatatcccgaaaagaccaacgaggttccggacaagtaggaacctacggcctgaataccttcactaatatggaggcacaattgatccgtcaaatggagggagaaggagttttaagtaaagcagatttagaaaatcctcatctaccagagaagaaaataacgcaatggctagaaacaaaaggggttgaaagattgaaacggatggcaatctccggtgacgattgcgttgtaaaacccatcgatgataggtttgctaacgctttactagcgctaaatgatatgggaaaagtaaggaaagatataccccagtggcaaccgagcaaaggatggcatgattggcaacaggtaccattttgtagccatcattttcacgagctaataatgaaggacggacgcaagctagtggtaccatgtaggccacaggacgaattaatcggtagagcccgaattagccagggtgcaggatggtcacttaaagagacagcatgtttaggaaaagcctacgctcagatgtggagccttatgtattttcatagaagagacctccggttagcaagcaatgctatatgctccgctgttcccgtacactgggtacccacatctcgaacaacatggagcatccacgcacaccatcagtggatgacgactgaagatatgttgacagtctggaatagggtatggatagaagataatccgtggatggaggacaaaaccccagtcactacatgggagaatgtaccatatctggggaagcgagaagatcagtggtgtgggagtctcattggactgacaagccgggctacatgggcccagaatatacctactgcaatacagcaagtgaggtccttaattggaaacgaagaatttctagactatatgccaagcatgaagagatttaggaaagaagaagagtctgaaggagctatatggtga

SEQ ID NO: 23209 - RNA, 9873 nt, synthetic construct
  misc_feature 1..9873: note = derived and/or modified CDS sequence (opt6) from DENV-3__HQ705612__SS-prME
  source 1..9873: mol_type = other RNA
acaagtctatgtttaatgatgatcttgcctgctgcattagcgtttcacctaacatcaagagatggagaaccacgaatgatcgttggtaaaaatgagaggggaaaaagtctactattcaaaactgcaagcggtataaacatgtgtactttaattgcgatggacttaggagaaatgtgtgatgacacggtgacatacaaatgcccacacataacagaggtggaaccagaagatatagattgctggtgcaatttgacatctacatgggtgacctatgggacctgcaaccaggcaggggagcacagacgcgataaacgatcagttgcattagcaccgcatgttggaatgggattagatacaagaacacaaacgtggatgagtgccgagggtgcttggcgtcaagtagaaaaagttgagacctgggctttaagacatccaggatttactatattagctctgtttttagcgcactatatcgggaccagcttaactcaaaaagtagtaattttcatacttctaatgttggtaacccccagtatgaccatgagatgtgtgggcgtgggcaacagagattttgtggaaggattatcaggtgcaacatgggtagatgtagttttagaacatggtggttgcgtaactacaatggccaaaaataaaccaaccttagatatagagttacagaaaacagaagcgactcaactagctactcttcgaaaactatgcattgaggggaaaataaccaacataaccaccgatagtagatgccccactcaaggagaagcaactttgcccgaggaacaagaccaaaactacgtttgcaaacatacatacgtggatagaggatgggggaacgggtgtggcctgttcggtaaaggaagtctagttacgtgcgcgaaatttcaatgtttagaaccgatagaaggaaaggtagtgcaatacgagaacctcaaatacactgttattatcactgtacatacgggtgaccaacaccaagttggaaatgaaacacaaggagttacagcagagattacgccccaagctagtacgacagaagcaatacttccagaatatggtactttaggactagaatgtagcccgcgaactggactggatttcaacgaaatgatattactaaccatgaaaaataaagcgtggatggttcatcgacaatggttctttgaccttcctctaccctggacttctggtgcaactacggaaacaccgacttggaatagaaaagagttattggtgacttttaaaaatgctcatgcgaagaaacaagaagtcgtagtattaggatcacaggaaggagctatgcacactgccttaacaggggctaccgaaatacaaaacagtggcggaacatcaatattcgcagggcatctcaaatgccgacttaagatggataaattagaactcaaaggaatgagctacgctatgtgcacgaacacgttcgtgctaaagaaagaagtttccgagacccagcacggaaccattttaataaaagtagagtataaaggggaagatgtaccatgcaaaattccttttagcacagaggacggccaaggaaaggcacataatggtcgcctaataaccgcaaatccggtagtgaccaagaaagaagaaccagtcaacatagaagctgaacctccatttggggaatcaaacattgtgattggaatcggagataatgccttaaagataaattggtacaaaaagggatctagtataggaaagatgtttgaagccactgcacgaggagcacgtagaatggcaatattaggagatacagcttgggatttcggatccgtaggaggggtattaaactcacttggtaagatggtccatcaaatttttggaagcgcctataccgcgttattcagcggggtttcatgggtaatgaaaataggtattggtgtactactaacctggataggtctgaacagtaaaaacacatctatgtcgttctcctgcatagcgatcgggattataacgttatatctaggagccgtcgttcaagcagacatgggatgcgtaataaactggaaaggaaaagaactcaaatgcggctctggaatttttgttaccaatgaagttcacacttggacagaacaatataaattccaagctgattcgccaaagcgcctagcgacggcaatcgccggtgcctgggaaaatggggtttgtggtatcaggtcaactacaagaatggaaaacttattgtggaagcaaattgctaacgaacttaattacatattatgggagaataatatcaaacttaccgttgtagtgggtgacattataggagtgctcgaacagggcaaacgaacgctaacgccacaacccatggaattgaaatactcctggaaaacctggggtaaagcgaaaatagtaacagcagaaacccaaaattcgagttttatcattgatggaccaaacacgcccgaatgcccgtcagtatcaagagcttggaatgtatgggaagtagaggattatggattcggggtatttaccacaaatatttggctaaaactcagagaagtatacactcaactatgtgatcataggcttatgtctgcagctgtcaaggatgagagagcagtacatgcagatatgggttactggatagaatctcagaaaaatgggtcgtggaaactagagaaagccagtctaatagaagtcaaaacatgtacatggccaaaaagccatacgctctggtctaatggggtcttagagagcgatatgataatacctaaatcattggctggaccaattagtcaacataaccaccgcccgggctatcacacacaaaccgcaggaccatggcacctcggaaaacttgaattagattttaactactgcgaaggtacaacagtggtaataacggaaaattgcggaacaagaggacctagtttacgaacaacgactgtttcaggcaaattgatacacgaatggtgttgtagatcctgcacattgccaccactaaggtatatgggagaggacggatgttggtatggaatggagattagaccaattagtgaaaaagaagaaaatatggtgaaatctttagtatctgcaggctcaggtaaagtagataattttaccatgggagttctatgcctcgcaatccttttcgaggaagttatgagaggaaaattcggcaagaaacacatgatagccggggtcttctttacattcgtactgcttttaagtggacagattacctggagggacatggcccacaccctgatcatgataggatctaatgcatcagatagaatgggaatgggagtaacgtacttagcgctaattgcgacctttaaaatacagccattcctcgctttaggctttttccttagaaagttaaccagtcgagaaaatctattgctcggggtggggttagccatggcgactactctccagttaccagaagatatagaacaaatggccaacggaatagctcttggattaatggctcttaagctgataacccaatttgaaacataccaattatggactgctcttattagcctcacgtgcagtaacacaatttttacgcttacagtagcgtggaggactgctacccttatcttggcaggcgtaagtctgttaccagtttgccaatcaagctctatgagaaaaacagactggcttcccatggccgtagcagcgatgggggtaccgccattaccattgtttatattcggactaaaagatactctaaaaaggcgatcttggcccctcaatgagggcgttatggcggtagggttagtttccatactggcgtcatcattgttaaggaacgatgtaccaatggcaggacccctagtagctggtggtcttcttatagcctgttatgtcataactggtaccagtgcggacttaacagtagaaaaagcagcagacacaacatgggaagaagaagcagagcaaactggtgtatcacacaatctaatgatcacggtggatgacgacggaacaatgcgtataaaggatgacgaaacggagaatattctcacggttttactaaagacagcacttttgatcgtaagtggcatatttccatacagtatacccgcgacactcctagtttggcatacttggcaaaagcaaacacaaagatctggggtcctgtgggatgttccgtcaccacctgagactcagaaggctgaattagaggaaggtgtttacaggataaaacaacagggaatattcggtaaaacacaagtgggagttggagtacaaaaggaaggtgtctttcatacaatgtggcatgttaccagaggagcagtgctaactcataatggtaaacgacttgaaccaaactgggcgtctgtaaagaaagatttaatttcatatggaggaggatggaggttaagtgcgcagtggcaaaaaggagaagaagtccaagttattgctgtcgaaccaggtaaaaatcccaaaaattttcaaacaatgccagggacatttcaaaccaccacgggtgaaatcggcgccatagcactcgattttaaacccggaacgtctggtagtcctataataaatagagagggcaaagtcgtaggtctgtatggtaatggagttgttaccaaaaatggagggtatgtcagcggtatagcacaaactaacgctgaaccagatggtccaacaccagaactggaagaagaaatgtttaaaaagcgaaaccttacgataatggatctacatcctggatcaggaaaaacgcgtaaatacttaccggcgatagttcgagaagctataaaacggcgactaagaaccttaatactggcacctacgagggtagtagcagccgaaatggaagaagctctaaaaggactaccaatacgataccaaacgactgcaactaaatcagaacatactggaagggaaatagtggatctcatgtgccacgctacattcacaatgagacttctgtcacctgtcagagtgccaaattataaccttattataatggacgaagcacatttcacagatccagcttcgattgcggccagaggttatataagcacccgggtaggaatgggtgaagcagctgcaatctttatgacagcaactcctccgggtacggcagacgcttttccccaaagtaacgcaccaatacaggacgaagaacgagatataccggaacgatcttggaatagtgggaacgaatggataacagatttcgcaggtaaaactgtttggttcgtaccaagtattaaagcaggaaacgacatagcaaactgcctacgtaaaaacggtaaaaaggttatacaattgagcagaaaaaccttcgacacagaataccagaaaacgaagttaaacgactgggattttgtcgtgactacggatatttcagaaatgggggcaaactttaaagcggaccgagtgatagatccaagaaggtgtcttaagccggttattctcacagacggtccagaacgagtaatattggcagggccaatgccagtaactgccgcatcagcagctcaacgacgtggacgagtgggacgcaacccacaaaaagaaaatgatcaatacatttttaccggccaaccactgaacaatgatgaagatcatgcccactggactgaagcaaaaatgttactggataatataaatactcccgaaggaataattcccgcgctatttgaacctgaaagagaaaaatcggccgctatagacggcgaatatagactgaagggagagagtcgcaaaaccttcgtggagttaatgaggcgaggtgatcttcctgtatggctagcgcacaaagtagctagtgaaggcataaaatatacagaccgtaagtggtgtttcgatggacaaagaaacaatcagattttagaagaaaatatggacgttgagatttggacaaaggaaggcgagaagaagaaacttcggccaagatggctagacgcccgtacttacagcgacccgctcgccttaaaagaatttaaggaatttgccgcaggacgaaaaagtatagcattggacttagtgacagaaataggtagggtaccgagtcatttggctcacaggacaaggaatgcccttgataacttggttatgttgcacacgagtgaacatggtgggagagcttatagacacgcagttgaagaactcccagaaacgatggaaactctacttctattagggttaatgatattgctaactgggggagcaatgctatttctaatatctggcaaaggaatcggcaaaacgagtataggcctaatttgcgtcatcgcatcatcaggcatgttatggatggcagagatacccctacaatggatagcaagtgcaattgtactagagttctttatgatggtattattaatcccagaaccagaaaagcaacgaactccacaggataatcaattagcgtacgtcgttattggtatcttaacccttgctgccataatagcggcgaacgaaatgggattactggaaacgacgaaaagagacttaggtatgtcgaaagaaccaggtgtggtctcccctacaagctatcttgacgttgatttgcacccagcatccgcttggacactgtacgcagtcgccacaacggtaattaccccaatgcttcgtcataccattgaaaattcgacagctaatgtatcactggctgctatcgctaaccaagctgttgtattgatggggttggacaagggttggccaatctctaaaatggatttaggagtaccacttctcgcactagggtgttattctcaggtcaatccattaacactaacagcagcagtcttactattaattacacattatgcaatcatcggaccaggcctacaggcaaaggcaacacgagaagcccaaaaacggacagccgcaggtatcatgaaaaacccaactgttgacggaattatgactatagacctagatccagtcatttatgatagtaaattcgaaaaacaactgggacaagttatgttattagtgttatgcgcagtacaacttctccttatgagaacatcctgggcattatgtgaagcacttacattagccactgggccaattacgacactatgggaaggatcgcctggcaaattctggaacacaacaatagctgtatctatggctaatattttccgaggttcttatttagcaggcgctggactcgcatttagcataatgaaatcagtaggtacaggaaaacgaggaacgggttcacaaggtgaaacattaggagaaaagtggaaaaagaaactaaatcagttgagtagaaaagattttgatctttacaagaaatcaggtattactgaagtagatagaacggaagcaaaagaaggactgaaacgaggagaaattacgcaccatgctgtctctaggggttctgccaaactgcaatggtttgtagaaagaaatatggtcattcctgagggacgagttatagatctaggatgtggtagaggaggctggagctattactgcgcaggacttaagaaagttacagaagtaagaggttatactaaaggaggacccggacatgaagaaccagttccaatgtcaacatatggttggaacatagtcaaactaatgtcaggcaaagatgtattttatttgcccccagaaaagtgcgacactctgctgtgtgacataggagagtctagtccgtcaccgacagtcgaagaatcaaggactataagagttctgaaaatggtggagccatggctcaagaataaccagttttgtattaaagtattaaacccatatatgcctacagtcattgaacatttggaacgacttcagagaaaacacggaggcatgctagtacgtaacccattgtcccgaaattcgacgcacgagatgtattggattagtaatggcacagggaacattgtagcatctgtcaatatggtttcaagacttctcctaaataggttcactatgacacatagacgaccaacaatcgagaaagacgtcgatttgggagcaggcacacgacatgtaaatgcggagcccgaaacgccaaatatggatgtgattggagaaagaattaagagaattaaagaggagcataattcaacatggcattacgatgacgagaatccgtacaaaacgtgggcgtaccatggaagttacgaggtgaaagccacaggaagtgcatcgagtatgattaacggggttgtcaaactattaacaaaaccatgggacgttgtaccaatggttacgcaaatggcaatgactgataccacaccatttggtcagcaacgggtatttaaagaaaaggtagacacaagaaccccacgcagcatgccaggaacccgtagggtaatggggatcacagccgaatggctttggagaactctaggacgaaataagaaaccacggttatgtacaagagaagaatttaccaagaaagtcagaacaaacgccgcaatgggtgcagtgttcacggaggaaaaccaatgggattctgctaaggcagcagtcgaagacgaggatttttggaaattagtcgaccgtgaacgagaactacacaagttaggtaagtgtggttcctgcgtttataatatgatgggaaaacgagagaagaaacttggggaatttggaaaagctaaaggctcaagagcaatctggtatatgtggcttggcgcgagatatttagaatttgaagcgctaggattcttaaacgaggaccactggttcagcagagaaaattcgtattcgggggtagaaggtgagggactacataaacttggctacattctaagagatatttctaaaatacccggcggcgccatgtatgccgatgataccgcgggatgggatacaagaataactgaagatgatctgcacaacgaagagaaaattacacagcaaatggacccggaacataggcaattggcgaatgcaattttcaaactaacctaccaaaataaggttgtgaaagtgcaaagacctactccaactggaacagtcatggatattatttcacgaaaagatcaaagaggctcaggacaagtaggaacttatggcttaaatacgttcacaaacatggaagctcaactcatcaggcagatggagggcgagggagttctatcaaaagccgacttagaaaacccacacttaccagagaagaaaattacccaatggctagagacaaagggagtagagagattaaagaggatggcgataagtggcgatgattgtgtagtgaaacccatagacgacagatttgccaacgccctattagctcttaacgatatggggaaagttcgaaaagacattccacaatggcagcccagtaaaggatggcacgattggcaacaggtaccattttgttcccaccatttccatgagttgatcatgaaagatggaagaaaacttgtggttccatgtagaccacaagacgagttaataggtagagcgagaatctcccaaggagcagggtggagtttaaaggaaactgcgtgccttggtaaagcgtatgcacaaatgtggtccctaatgtattttcatcgcagagatctaaggctagcaagtaatgccatatgctcagcagtacccgttcactgggtccccacttctcgtacaacatggagtatacatgctcatcatcagtggatgacgacggaagacatgcttaccgtttggaatcgtgtttggatcgaagacaacccttggatggaagacaagacgcctgtaacaacctgggaaaacgtaccatacttaggtaagcgggaagatcaatggtgtggatcattaatagggttaactagcagagccacgtgggctcaaaatattcccacggcaattcagcaagtacgatcattaataggaaatgaagaatttctagactatatgccttctatgaagcgatttcgaaaagaggaagaaagcgaaggggctatatggtag

SEQ ID NO: 23210 - RNA, 9873 nt, synthetic construct
  misc_feature 1..9873: note = derived and/or modified CDS sequence (opt6) from DENV-3__HQ705613__SS-prME
  source 1..9873: mol_type = other RNA
accagcctatgccttatgatgatactacccgcagcactagcatttcatcttacttcgagagatggagaaccacgaatgattgtcgggaaaaatgaacggggcaaatcgcttttgttcaaaaccgcatctgggattaacatgtgcaccttaattgcaatggatttaggagaaatgtgtgacgataccgtaacttacaaatgtccgcatatcaccgaagtggaacccgaagacatagactgttggtgtaatttaacttcaacttgggtcacatatggaacctgtaaccaagcgggtgaacatagacgcgacaaaaggtcagttgcactggctccccacgtaggtatgggtttggatacccgaacacaaacctggatgagtgcagaaggtgcatggagacaggtagaaaaagtagaaacgtgggccctacgacatccaggtttcaccatattggcactctttttagcacattatataggcacaagcctaactcaaaaagtagtcatctttattctattgatgttggttactccctcgatgactatgagatgcgtcggtgttggtaaccgtgattttgttgaaggactatctggtgcaacctgggttgatgttgttctggaacacggaggatgcgtcacaacaatggctaaaaataaaccaacactggacatcgaattacagaaaactgaagcgactcaactagccacattgcgaaaattatgcattgagggcaaaataacaaacattacaaccgactcgagatgtccgacgcagggtgaagcaaccctaccggaagaacaggaccaaaactacgtgtgtaaacatacatatgtagatcgtggttggggcaacggttgcggcctttttggaaaaggtagccttgtaacatgtgccaaattccaatgtctagaacctattgaaggcaaagtagtccagtacgagaacctgaaatacacagtaataataaccgtacatactggagaccagcaccaagtagggaatgaaacgcaaggggtaacagcagaaattacaccacaagcatccacaactgaagcaattttacccgagtacggcacactcggactggaatgtagcccccgaacaggattagatttcaacgaaatgatattactaaccatgaaaaacaaggcttggatggtccatagacagtggtttttcgatttaccactaccgtggacatcgggagctaccactgaaacccctacctggaatagaaaagaattattagtgacttttaaaaacgcacacgctaagaaacaagaggtagtcgtattagggtcccaagaaggagcaatgcatactgccctaaccggagcaacagaaattcaaaatagtgggggaacaagcatattcgccggacacctaaaatgtcgcttgaaaatggacaaactagaacttaaaggtatgtcttatgctatgtgtacaaacactttcgtgcttaagaaagaagttagcgaaacacaacacggtacgatcttaattaaagtagaatacaaaggagaggacgtaccgtgtaaaattcccttttcaacagaagacggacagggaaaagcccacaatggcagactgatcacggccaatcccgtcgtaacaaagaaagaagaaccagtgaacatcgaggccgagccaccatttggtgaaagcaacattgtcattggaataggtgacaatgccttaaaaatcaactggtataagaaaggttcgtcgataggtaaaatgttcgaagcaaccgcaagaggggccagacgtatggcaattttgggtgacacagcctgggatttcgggtccgtcggaggagtattaaacagtctaggcaaaatggttcatcagatatttgggagcgcgtacacagccttatttagcggagtctcatgggttatgaaaataggaataggagttttactcacatggataggtctcaattccaaaaacactagcatgagttttagttgcatagcaattggtattataaccctatatttaggtgcggtagtacaagcagacatgggctgtgttatcaactggaaagggaaagaactcaaatgcggcagtggaatctttgttacgaatgaagttcacacttggacagagcaatataaatttcaagctgacagtccaaaacgacttgcgacagcaattgcaggagcatgggaaaacggggtctgtggtatacgttctacgacacgtatggaaaacttgctatggaaacaaattgccaatgaacttaattacattttatgggagaacaatattaaactaacagtggtagttggagatattataggtgtattagaacaaggtaaaagaacattgactccacaacccatggaacttaaatactcatggaaaacatgggggaaagctaaaattgtaaccgccgagacacaaaatagtagtttcataatcgatggacctaataccccagaatgtccgagtgtatctagagcatggaatgtttgggaagtcgaagattatggatttggggtatttacaaccaacatatggttaaaacttagagaagtatatacacaactttgcgatcacagacttatgtcagcagcggttaaagatgaacgtgcagtccatgcagatatgggatattggattgaatcacagaaaaatggcagctggaaacttgagaaagcgtccctcatagaagtaaagacatgtacttggccaaaaagtcacaccttatggtcaaacggtgttctcgaaagtgatatgatcatacccaaaagtttagcaggtccaattagccaacataatcatagaccaggatatcatacccaaaccgctggtccttggcatcttggaaagctagagttagactttaattattgcgaaggtacgaccgttgtaattacggagaattgtgggacacggggaccatcgttaaggactacgaccgtatctggaaaacttatacacgaatggtgttgcagaagctgcacgctaccccctttacggtatatgggagaagacggttgctggtacggaatggaaattcgcccaatctcggaaaaggaggaaaacatggtgaaaagtctcgtctcagcgggcagtggaaaggttgataactttacaatgggagtgctgtgtctcgctatactttttgaagaagttatgagaggaaaatttggcaagaaacacatgattgcaggagttttctttacttttgtgctcctattatcggggcaaataacatggcgagatatggcacatacactaataatgataggatctaatgcatccgacagaatgggcatgggcgtaacatatcttgcattaatcgcaaccttcaaaatacagccattcttagcactaggtttctttctaagaaaattaacatctagagaaaacctcttactaggcgtggggttagctatggcgacgacacttcagttaccggaagacattgagcaaatggcaaatggcattgctcttggattaatggccttaaaactaataacgcaattcgagacataccagctctggaccgcacttatatccctcacatgtagcaacactatatttacgctaaccgtagcatggagaaccgctacacttatcttagccggagtcagtcttcttcctgtatgtcaaagtagctcgatgagaaagacagactggctccctatggcagtagctgcaatgggcgtgccaccgttacctctattcatatttggactcaaagacaccctaaagaggagatcatggcccctaaatgaaggagttatggcagtgggtctcgtaagcattttagcatcatcgttactaagaaacgacgtccctatggctggtcctctagttgccggtggactgcttatagcatgttacgtgattaccggaacatctgcagacttgacagtcgaaaaagctgccgacattacttgggaagaagaagcggaacaaacgggtgtctcccataatctaatgataaccgtagacgatgacggtacgatgcggataaaagacgatgagacagaaaacattttaacagtacttttgaaaacggctctcttgattgtctcaggcatatttccatatagtattccagccacattattagtttggcatacatggcaaaaacaaacccaaagatccggtgtcctttgggatgtaccaagtccacctgaaactcaaaaggctgagcttgaagaaggtgtatatagaattaaacaacaaggaatatttggcaaaacccaagttggtgtgggggtacaaaaggaaggagtttttcatacaatgtggcatgttacaagaggcgcagtgctcacgtataacgggaaaagactagaacctaactgggcatcagttaaaaaggacctaatttcgtacgggggaggttggagactttctgcacaatggcagaagggagaggaagtccaggtaatagcagtagaacctggaaagaaccctaaaaattatcaaacaatgccaggcactttccaaactacaactggtgaaataggagcaatagctctagactttaaacctgggacaagtggatccccaataataaatcgcgaagggaaagtcgtcggattatacggaaacggcgtcgttacaaagaacggcggctacgtatcaggcattgcccaaactaacgcagaaccagacgggccaactccggaattagaagaagaaatgttcaagaaacgtaacttaaccattatggacctgcatccgggcagtggaaaaacgagaaagtatctaccagcaatagttagagaggcaattaagcgacgattacgtactcttatattagctccaacacgagttgtagcagcagaaatggaagaagccctgaaagggctccctattcgttaccaaacgacagccacaaaatctgagcatactggtcgcgaaattgtagatctaatgtgtcacgctacctttacaacgcgcctgttgtcacctgtgcgggtcccaaattacaatctgattattatggacgaagcacacttcaccgacccggccagtattgcggcgaggggatatatttcgacgagggttggaatgggcgaggcagctgccattttcatgactgcaactcctccaggtactgcagatgcgtttccacaatcgaacgcacctattcaggatgaagaacgagatattcccgagagatcatggaatagcgggaatgaatggatcacagattttgcaggaaaaacagtttggtttgttccatccataaaagccggaaacgatatagcaaattgtttacgtaaaaacgggaagaaagtcatacaactatctagaaaaacatttgatacggaatatcagaaaaccaaactaaatgactgggacttcgttgttaccaccgatatatccgaaatgggtgctaattttaaagcggaccgagtcatcgatccaaggcgatgtctaaaaccagttattctaacagatggtccagaacgagtaattttggctggaccaatgcctgttacagcagcttcagccgcacaaagaagaggtagagtaggacgcaacccccaaaaggaaaacgatcaatatatcttcacagggcaacccctaaataatgatgaagatcatgcccactggactgaagcgaaaatgttacttgataatataaacacaccagaaggtatcataccagctttatttgaacctgagagggagaaaagtgcagctatagacggagaatacaggttaaaaggagagagtcgtaagacttttgtagaattaatgaggagaggtgacctacctgtctggctcgctcacaaagtagcttcagaagggattaaatatacagataggaagtggtgtttcgatggacagcgcaataaccagatactagaagaaaatatggatgtggaaatatggacaaaagaaggcgagaagaagaaactacgccctagatggctggatgcgcgaacatattctgacccattagcactaaaagagttcaaagagtttgccgctggcaggaagtcgatcgcactggacctagtaacagagataggacgcgtacctagtcatctcgctcacagaacaagaaacgccttagacaatttggttatgctgcacactagcgaacatggaggcagggcctatagacacgccgtcgaagaactaccagaaactatggagacactactacttctaggtttaatgattttgcttactggtggagcgatgctattccttatatcgggaaaaggaataggcaaaacatctataggcctgatatgtgttatcgcatctagtggaatgctatggatggcagaaataccactacaatggattgcttcagctatagtattagagttcttcatgatggtgttactgataccagagccggaaaaacaaagaacaccccaagacaatcagttggcatacgtagttataggaatcttaacattagccgcaataattgctgcaaacgaaatgggactcctagaaactactaaaagggatttaggtatgtccaaagaaccaggagttgtcagtccaacaagttacttagatgttgacttgcacccagcgtctgcctggacattatacgcggtagccacgacagtaattacgccaatgttgcgtcatacaatagaaaattcaacagctaacgttagtctggctgcaatagctaatcaagcagtagtattaatgggattagataaggggtggcctataagcaaaatggaccttggggtacccctattggcgctgggttgctattctcaagtaaatcccttgacattgactgcagcagtactattattgatcacgcactacgcaataataggtcccggcttacaagccaaagccaccagagaagcacaaaagagaacagcggcagggataatgaagaaccctacagttgacgggataatgacaattgacctagatccagtgatatatgacagtaaattcgaaaaacaacttggccaagttatgctgctagtgctttgcgcagttcaattgcttttgatgagaacctcgtgggcactatgcgaagcgttaacgctagctactggtccaattactactctatgggaaggttccccggggaaattctggaacacaacaattgccgtatctatggccaatatattcagggggtcatatttagccggcgctggacttgcattctcaatcatgaaaagtgttggtacaggtaaaagaggtaccggtagtcaaggtgaaacgctaggagaaaaatggaagaagaaactaaatcaactctctagaaaagattttgatctatataagaaatctggaattactgaagtggatcgcacagaagctaaggaaggactaaaaagaggcgagatcacccaccacgccgtaagcagaggttccgcaaaactgcaatggttcgtagaaagaaatatggttataccagaaggccgagtgatagatcttggctgtggtcgaggtggatggtcctattactgtgcgggtttaaagaaagtaacagaggtacgagggtacacaaaaggaggacccggtcatgaagaaccagtgccaatgagtacctatgggtggaacattgtcaaactcatgagtggtaaagacgtcttttatttgccccctgaaaaatgtgatacattactttgtgatataggggaatcatcgccatctcctactgttgaagaatcacgaactattcgagtattaaaaatggttgaaccgtggctcaagaataatcaattttgtataaaagtccttaatccttacatgccaaccgttatagaacatttagagcgtcttcagagaaaacatggtggcatgctcgtaaggaacccattatcgagaaactctacacacgaaatgtactggatttcaaatggaactgggaatatagtagcatcagtcaatatggtatccagactattactaaatcgatttacaatgacacatcgcaggccaactatagaaaaagacgtagatttgggagctggtacacgacatgttaatgctgaaccagagacaccaaatatggacgtaatcggtgaaagaatcaagagaatcaaagaggaacataactcgacatggcactacgatgatgaaaacccttataaaacttgggcttatcacggaagttatgaggtaaaagctacaggttcggcttctagtatgatcaatggagtagttaaattacttacaaaaccctgggacgtcgtaccaatggtcacccagatggccatgacggacacaacgccctttggccaacagagagtgtttaaggaaaaagtagacacccgaacacctagaagtatgcccggcacgagaagggtcatgggaataacggccgaatggttgtggaggactttgggccgaaataagaaaccacgcctttgtaccagagaagagttcactaagaaagttagaaccaatgcggcaatgggagcagtgttcacagaggaaaatcaatgggatagtgctaaagcagctgttgaggacgaagacttttggaagctcgtcgatcgtgaacgcgaactgcacaaacttggtaaatgtggaagttgcgtatataatatgatgggaaaaagagagaagaaattaggggagttcgggaaggctaagggctcaagggccatatggtatatgtggttaggtgctcgatatttagagttcgaagcattaggatttttaaatgaagaccattggttttcaagagaaaattcgtattcaggtgttgaaggcgaaggacttcacaaattaggctatatactacgcgatatttcaaaaattccaggaggcgcgatgtatgcagatgacacagcaggatgggatacgagaattaccgaagatgacttgcacaatgaagagaaaatcacccaacaaatggatccggaacataggcagcttgcaaatgcaattttcaaactaacttaccaaaacaaagttgtaaaagtacagcgtcctacccccacaggcactgttatggacataatatcacgaaaagaccaacgaggaagcggacaagtgggaacctacggattaaatacttttaccaatatggaagcccaattaatccgacaaatggaaggtgagggagtgctaagtaaagcagatctagagaaccctcacctaccggagaagaaaattactcaatggttggagacaaaaggtgtggaacgtcttaaaaggatggctatctcaggtgacgattgtgtagtaaaaccaatcgacgataggtttgcaaacgcactgctggctctaaacgatatgggaaaagtacgaaaagatataccacaatggcagccatcaaaaggctggcacgattggcaacaagttcccttctgttcccatcatttccacgagcttattatgaaggacggaagaaaactcgtagtaccttgcagaccacaagatgaattgattggtcgagccagaatctcacaaggagccggttggagcctaaaagaaacagcatgtctaggcaaagcgtatgcgcaaatgtggtcactcatgtattttcacagacgcgacctacgattagcatctaacgcgatatgttctgctgtccctgttcattgggtccctacctctaggactacatggtcgatacatgcccatcatcaatggatgacaacagaggacatgctaacggtatggaacagagtatggattgaagataatccatggatggaggataagacgcctgtaacaacttgggagaacgtgccatacctaggaaaacgagaagaccagtggtgtggatcattgataggattaacttccagagctacatgggcacaaaatatacctactgctattcaacaagtaaggtcattgataggaaacgaggagtttctagattatatgccatccatgaagaggtttagaaaggaagaggaatctgaaggagctatatggtaa

SEQ ID NO: 23211 - RNA, 9873 nt, synthetic construct
  misc_feature 1..9873: note = derived and/or modified CDS sequence (opt6) from DENV-3__HQ705615__SS-prME
  source 1..9873: mol_type = other RNA
acaagtttatgtttaatgatgatattaccggctgctcttgcttttcatcttacgtctagagatggtgaacctaggatgatagtagggaaaaatgaacgcggaaaaagtttattatttaaaaccgcttcaggaattaatatgtgcacgcttatagctatggacttaggagaaatgtgcgacgatactgttacgtacaaatgcccccatataacggaagtggaaccagaagacatagactgctggtgcaacttaacttcaacatgggttacatatggaacatgcaatcaagcaggagaacaccgaagagataaacgttctgtagctctagcaccacacgtgggaatgggattagacacccgcacacaaacatggatgtcagctgaaggagcttggcgccaagtagaaaaagtagaaacgtgggctttaaggcaccctggatttaccatccttgcactctttctggctcactatattgggacttctttgactcaaaaagtggttatttttatattacttatgttagttactccttcaatgactatgcgatgtgtcggagtaggtaacagggattttgtagaaggattaagtggagcaacttgggtagacgtagttttagaacatgggggttgtgtcactacgatggccaaaaataaacctactttagatatagaattgcagaaaactgaagcaacacaacttgcaacattaagaaaattatgtatagaaggaaaaattactaatataacaaccgacagtaggtgcccgacacaaggggaagcgactttacctgaggaacaagaccaaaattacgtttgtaaacacacgtacgtcgatcgaggatggggtaatggctgcggattattcggtaaagggtcgttagttacttgcgccaaatttcaatgtttagaaccaattgaaggcaaagtagtacaatatgagaatttaaaatacaccgtaattattacagtacacactggcgaccagcatcaagtaggaaacgaaacacagggtgtaacagctgagatcaccccacaagcatctacgacagaagcaatacttccagaatacggaacactaggactcgaatgttcaccgagaacaggattagactttaacgaaatgatattacttacgatgaaaaacaaagcctggatggtacacagacaatggttcttcgatctaccccttccgtggacgtccggagcaacgactgaaacccctacttggaatagaaaagaactcctagtcacgtttaaaaatgcacatgctaagaaacaagaagtcgttgttctaggatcacaagaaggagctatgcacactgctttaaccggagctacggagatacaaaatagtggaggtacttccatattcgccggacatttgaaatgtagattaaaaatggataaattggagttgaaaggtatgtcatatgccatgtgtaccaacacattcgtactaaagaaagaagtgagcgaaacccaacacggaactattctcataaaagttgaatacaaaggagaagatgtcccatgcaaaattccattctccactgaggatggtcaaggtaaagcacataatggaagactaattacggccaatcctgtggttactaagaaagaagaacctgtgaacattgaagcggagccaccctttggagaaagtaatatagtaataggaataggagacaacgcccttaaaattaactggtacaaaaagggctcgtcgataggcaaaatgttcgaagcaaccgcccgtggtgcccgaagaatggcgatattgggagatactgcatgggatttcggaagcgttggaggagttctaaattcgctcggtaaaatggtacatcaaatttttggatcagcatacacagctcttttctcgggagtatcatgggtaatgaagattggaattggagtattactgacatggatcggactaaattcaaagaacacatctatgtcgttctcttgtattgctatagggatcataactctatacctgggagccgtagttcaagcggatatgggatgtgtgatcaattggaaagggaaagaattaaaatgtggttcgggaatcttcgttactaatgaagtacatacatggaccgaacaatacaaatttcaggctgactcacctaaaagattagctaccgcaatcgcaggagcctgggaaaatggcgtttgcggaatccggagcactacaaggatggagaatttgttatggaaacagattgcgaatgaactcaattacatattatgggaaaataatataaaacttactgttgttgtaggagatataataggggtgctggaacaaggtaaaaggacactaaccccacaaccaatggaattgaaatatagctggaaaacatggggcaaggctaaaatagtaacagcagaaacgcaaaacagctcctttatcatagacggaccaaacacaccggaatgcccttctgtatctagggcatggaacgtatgggaggtagaagactatggatttggggtttttacaacaaatatttggttgaaattaagagaggtatatactcaactatgtgaccaccgcctgatgtcagccgcagtaaaggacgaaagagcagtacatgccgacatgggatactggattgaatcccagaaaaatggtagttggaaactagagaaagcaagtttaatagaggtaaagacgtgtacatggccaaagagccacaccctttggtcaaacggagtgctcgaatcggatatgataatcccgaaatcattggccggacctatcagccaacacaatcacagaccaggttatcatactcaaactgccggcccatggcacttagggaaacttgaactagattttaattactgcgaagggaccacagtggtcataactgaaaattgtggaactagaggacccagcttacgtacaacgactgttagtggcaagttaatccacgaatggtgttgtcggtcttgcactcttccacctttacgttatatgggagaagacggctgttggtacggcatggaaatcagacctatcagcgaaaaagaggagaacatggtaaaaagcctggtgtccgcgggaagtggtaaagttgataattttacaatgggcgttctatgtctagcgatcctttttgaagaagttatgagaggaaaattcggcaagaaacatatgatagctggggtcttctttacattcgtattattgctgagtggtcaaataacttggcgagatatggcacacaccctaatcatgatcggttcaaatgcttcggaccgaatgggaatgggagtcacttatctggctctaatagcaacattcaaaatccagccatttctagctttaggattctttctaagaaaactaacttctagagaaaacctactcttaggtgtgggattggctatggctacaaccttacaactccctgaagatatagaacagatggccaatggtatagccttaggcttgatggctttaaaattaattacacagtttgaaacctatcaactgtggacggctttaatatccctaacttgttcaaatacgatattcacactcacggttgcttggcgcacagcgacgctaatattagccggtgtatcgctcctgccggtatgccaatcatcaagtatgcgaaagaccgattggctacctatggcagttgcggctatgggcgtgccaccattgccattatttatattcagtctgaaggacacattaaaaaggaggtcgtggccactgaacgagggtgtgatggcggttggtttggtgtcgatactggcgagctcgcttttacgaaatgatgttccaatggctggacctttagttgccggcgggcttctaatagcgtgttatgtaataacggggacgtcggccgacctaacagtcgaaaaagctgcagatataacctgggaggaggaagcggaacaaacaggcgtatcccataatttaatgatagctgtcgatgatgatggaacaatgaggataaaagatgatgaaactgagaatattttaactgtactacttaaaacagcactcctgatagtttccggcatatttccatattcaattcctgcaactcttttagtatggcacacatggcaaaagcaaacccaaagatctggagtgctatgggatgtgccatcgccaccggaaacacaaaaggcggaactcgaagaaggagtctatcgaataaaacagcaaggtatatttggaaagacccaagtaggcgtaggagtccagaaagaaggtgtatttcatacaatgtggcatgtaacccgaggggcagtactaacgtataacggtaagaggctagaacctaattgggcatcagtcaagaaagatctcattagctacgggggtggttggagattatctgcacaatggcaaaagggtgaggaggtgcaagtgatagctgtagaaccaggcaaaaaccccaaaaattttcaaaccatgcccggaacatttcagacaactacaggagaaattggtgcgatcgcattagatttcaaacctggaacaagtggtagtccaataattaatcgagagggtaaagtagtggggctatacggaaatggagtagttacgaaaaatggcggttatgtttccggtatagcacagaccaacgctgaacccgacggtccaactcccgaactcgaggaggaaatgtttaaaaagcgtaacctaacaattatggatctccatcccggatcaggtaaaactcgaaagtatctaccagctatcgtgagggaagccattaaacgtagactaagaacattaatattagctcctacgagggttgtcgccgctgaaatggaagaagcgttgaagggactaccaatcagatatcaaactactgccacgaaaagcgaacacaccgggagagagatagtggacctgatgtgtcatgcaacatttactatgcgtctactttcgcccgtcagagtacccaactataacctcattataatggatgaagcacactttacagatccagcatcaatagccgcacgcggatacatttccactcgagtcggaatgggagaggctgcagcaattttcatgaccgcaactccgcctgggacagccgacgcctttccacagagtaacgcaccaatacaggatgaggaaagagacattccagaaagaagttggaactctggtaacgagtggataaccgacttcgcaggaaaaaccgtctggtttgtccccagtataaaagcaggaaacgatattgcgaattgtcttaggaaaaatggcaagaaagttattcaactgagccggaaaacttttgatacagaataccagaaaactaaattgaatgattgggatttcgtagtaacaactgacatctcagagatgggagcgaactttaaagccgatagagtaatagatcccagaagatgtcttaaacccgtaatcctaactgatggacccgaaagagtcatactcgccgggcccatgccagttacagccgccagtgcagcgcagagaaggggaagagttggtagaaatccacaaaaagaaaacgaccaatatatttttacgggtcagccactaaacaatgatgaagatcatgcacactggacagaagctaagatgttattggataacataaataccccggaaggtatcatacctgcactttttgaaccggaaagggagaaaagcgcagcaatagacggtgaatataggttaaaaggcgaaagtagaaagacgtttgtagaattaatgcgtcgaggcgatctcccggtctggctagcgcataaggttgcaagtgaaggtataaaatacacagatcgaaaatggtgttttgacggtcaacgaaataatcagatattagaggaaaatatggatgtagaaatatggaccaaggagggtgagaagaagaaacttcgaccaagatggttggacgcgagaacctatagcgatccattagcactaaaagaatttaaagaatttgcagcaggaagaaagagcattgcactagacctagttactgaaatcgggagagtaccttcgcacctagcccatcgtactcgaaatgcattggacaacctagtaatgttacatacatctgaacatggcggaagggcctatcggcatgccgtagaagagttaccagaaactatggaaacactactgttacttggattaatgatcctactaaccggtggagctatgttattcctaatttccggaaagggcatcggtaaaacctcaataggtttaatttgtgtgatcacttcaagtggcatgttatggatggcagaaatacctctgcagtggatagcgtccgccattgttcttgagttctttatgatggtattgctaataccagaacctgaaaagcagcgtacaccccaggacaatcaattagcatatgtggtaataggaatactaacgctagccgcaattatcgcggcgaatgaaatgggtctcctagaaaccaccaaaagggatttaggtatgagcaaagaaccgggtgtagtgagcccaacgtcatatttggatgtagacctgcacccagcaagtgcgtggacactatatgcagtagcaacaactgttatcaccccgatgcttcggcatactatagaaaactcaacagcaaacgtaagcctagcggcaatagcgaatcaagcggtcgtacttatgggactagataaaggatggcctataagtaagatggacttgggagtccctttattagcattaggatgttatagccaggtaaatcctctgactttaacggcagctgtccttctcttaattactcattatgcgatcataggacccggacttcaagctaaagccacaagagaagctcaaaaacgaaccgccgccggaattatgaaaaatccaaccgtcgacgggattatgacaattgatttagatccagtgatttatgactccaaatttgaaaagcaattaggacaagttatgttattagttttatgtgcagtacaactccttctcatgcgtacttcatgggcgctatgcgaggctttaacccttgcaacaggacctattacaactttgtgggaagggtcaccaggcaagttttggaatactacaatagccgtaagtatggcaaacatatttagaggatcgtacttggcgggcgcaggattagcgtttagtatcatgaagagtgtaggaaccggcaaaagaggaacagggagtcaaggagaaaccttgggtgagaaatggaagaagaaactaaatcaattgtcaagaaaagattttgacttatataagaaatccgggataactgaggtagacagaacagaagcaaaagaaggccttaaaagaggtgagatcacgcaccacgcggtatcgcggggttctgctaaacttcagtggtttgtggaaaggaacatggttatacctgaaggtagagttattgatctaggctgtggtagaggcggatggagttaccattgcgcgggtctcaagaaagtaactgaggttcggggctacaccaaaggaggacccggacatgaagaaccagttcctatgagtacttatgggtggaatattgttaagttaatgtcgggcaaggatgtattctatctcccaccagagaagtgcgatacacttttatgtgacattggagagtcatctcccagcccaacagtcgaagagtctcgtacaattcgagtattaaaaatggtagaaccatggttaaagaataatcaattttgcataaaggtacttaacccatatatgcccacggtgatagaacatttagagagactgcagagaaaacacggcggcatgctagtcaggaaccctctttcacgcaattctacacacgaaatgtactggatctcgaacgggaccggtaacattgtcgcatcagtaaatatggtcagcagactccttctcaatagatttaccatgacgcatagacgaccaacaatcgaaaaagacgtagacttaggagctggaactcgccacgttaacgcagagcctgaaactcctaacatggatgttataggtgaacggatcaaacgtattaaagaggaacacaattcaacttggcattacgatgatgaaaacccatacaaaacatgggcctaccacggcagttatgaagtaaaggcaaccggcagtgcttcgagcatgataaatggcgttgtaaaactgcttactaaaccatgggatgttgtacccatggttactcaaatggcaatgactgatactaccccattcggacaacagagagtttttaaagaaaaagtcgatacacgaacacctagatcaatgcctggtactcggcgagttatgggtataacagcagaatggctctggagaacacttggcaggaataagaaaccccgcctgtgcacaagggaagaatttaccaagaaagtgcgaaccaacgcggcaatgggagcagtgttcaccgaagaaaatcaatgggatagcgcaaaagcggctgtagaggacgaagatttctggaaacttgtagacagggagcgagaattacataaactcggaaaatgcggatcatgtgtgtacaacatgatgggtaagcgtgagaagaaactaggtgaatttggaaaagcaaagggaagcagggcgatatggtacatgtggttaggagcccgttatctagagttcgaagctcttggatttctaaatgaagatcattggttctcacgagaaaacagctattcaggtgtagagggagaaggtcttcataaattaggttatatactaagagacatatcaaaaattccgggcggcgcaatgtacgctgacgatacagcgggatgggacacaagaataactgaagacgaccttcacaatgaagagaaaataacccaacaaatggacccggagcaccgccaactggcaaatgcaattttcaaattgacatatcagaacaaagtagttaaggttcaaaggccaacgccgactggaacggtaatggatataatctcaagaaaagatcagagaggtagcggacaagtcggaacctatggactaaatacttttactaacatggaagctcagcttatccgtcaaatggaaggagagggtgtactttctaaagccgatttagaaaacccacatcttccagagaagaaaataactcagtggctagaaacaaagggagtcgaacgcttaaaacgtatggctataagtggtgacgactgtgtagtaaaacccattgatgatcgatttgcaaatgcattgctcgcgctaaacgacatgggaaaggtgcgaaaagacataccacaatggcaaccaagtaaaggctggcacgattggcagcaagtccctttctgttcgcatcattttcacgaattaattatgaaagatggccggaaattagtcgtaccctgcaggcctcaggatgaacttatcggtagagctaggatcagccagggagctgggtggagtctcaaagaaactgcatgtctaggaaaggcttatgctcaaatgtggtcactcatgtactttcaccgaagagatcttagattggcaagtaatgcgatatgttcagcagtacccgtacactgggttcccactagccgtacaacttggtccatccatgcgcatcatcaatggatgacgactgacgatatgttaacagtgtggaacagagtttggatagaagacaatccatggatggaagacaaaacacccgtgacgacatgggaaaacgtaccatatctaggaaagagagaggaccaatggtgcggttcacttattgggttaacgtccagagctacttgggcacaaaacatccctacagcaatacaacaagtaagatccttaattggaaacgaggagttcttagattatatgccctcgatgaaacgatttaggaaagaagaagaatccgagggagcaatatggtag

SEQ ID NO: 23212 - RNA, 9873 nt, synthetic construct
  misc_feature 1..9873: note = derived and/or modified CDS sequence (opt6) from DENV-3__JF920398__SS-prME
  source 1..9873: mol_type = other RNA
acatctctatgtctaatgatgatcttaccagcagctttagcattccatctgacctccagagacggagaaccacgcatgatagtagggaaaaatgaacgtggaaaatcgttactattcaaaactgcttctggaataaatatgtgtacactaattgcgatggacctgggggaaatgtgcgacgataccgtaacgtataaatgcccgcatataaccgaagtagaacctgaagacatcgactgttggtgcaatctgacatcaacttgggtaacctatggaacttgtaatcaagctggagaacaccgtagagacaaaagaagcgtggcattagcaccgcacgtgggaatgggtcttgatactagaacgcaaacttggatgtctgcagaaggggcgtggcgacaagtagaaaaagtagaaacttgggctttgcggcatccgggttttaccatactggctctattcctggcccactatattggaacaagtctcacccaaaaagtagttatatttattttactcatgctagttactccatcaatgactatgcgatgcgttggagtaggaaatagagattttgtcgaaggactaagtggagcaacatgggttgatgtagtattggaacacggaggttgtgtaactaccatggcgaaaaataaaccgactttagacattgaattacagaaaactgaagcgacacagttagcgacgttgagaaaactctgcatagaaggaaaaatcacgaacattactaccgactcaagatgtccgacacaaggggaagcaactctacctgaagaacaagaccaaaactacgtatgcaaacacacttatgtagatagaggatggggaaacggctgtggtctgttcggtaaaggttcattagtgacatgcgctaaattccagtgcttagaacctatcgaaggaaaagttgtacagtatgaaaatttaaaatatacagttatcataacagtacatactggtgaccaacaccaagttggaaatgaaacccaaggagtaacggcggaaataaccccacaagcatcaactacagaagctatattgccagaatacggaactctaggactggaatgtagcccgagaacaggactagatttcaatgaaatgatacttctaactatgaaaaataaagcatggatggttcatagacagtggttctttgatttacctctgccatggacatccggtgctactactgagacgccaacgtggaatcgtaaagaattgttagtaacttttaaaaacgctcatgcaaagaaacaagaagtggtagtattaggatcacaagaaggtgccatgcatactgctttaactggggccacagagatacaaaactcaggtggaacatcaatttttgctggacacctcaaatgccgactaaaaatggataaactagaactaaaagggatgtcctacgcaatgtgtacgaatacgttcgtactaaagaaagaagtctctgagacacaacatgggacgatactaataaaagttgaatataaaggagaggatgtaccatgtaaaatccccttctccaccgaagatggacaaggaaaagcacataacggtagattaataacggcaaaccctgtagtaacgaagaaagaagaaccagtaaatattgaagcggagccgccatttggtgagtccaacattgtaatagggatcggggacaatgcattaaaaataaactggtacaagaaaggcagctccataggaaaaatgttcgaagcaactgccagaggtgcgaggcgtatggcaattttaggcgatactgcgtgggacttcggtagcgtcggcggggtactgaatagcctaggcaaaatggttcaccaaatattcggttcggcatatacagctctattctcgggtgtaagctgggtaatgaaaattggtataggagttttactaacctggattggcttaaattctaaaaatacatccatgtccttcagctgcattgcaataggaataattaccctatacttgggcgccgtagtgcaagctgatatggggtgtgttataaattggaaagggaaagaactgaaatgtggaagtgggatatttgtaacgaacgaagtccacacttggaccgagcaatataaattccaagcagatagtccaaaaagacttgcaaccgcaattgctggagcttgggaaaacggggtatgcggcatacgttccactaccaggatggagaatctgttatggaaacaaatcgccaatgaattgaactacatcctttgggaaaataacatcaaactgacagtagtagttggagatattattggcgtgctagaacaaggaaaaagaactctcacaccacagccaatggagctaaaatacagctggaaaacctgggggaaagccaaaatcgtaacggccgagacacaaaactcttctttcatcatagatggtcccaacacgcccgagtgtccgagtgtttcgcgtgcttggaatgtatgggaagtcgaggattatggcttcggtgtattcacaacaaatatatggttaaaattacgagaagtatacacacaattgtgcgaccaccgtctaatgtcagcagctgttaaagacgaaagagcagttcatgctgatatgggctattggatcgagtcccagaaaaatggctcatggaaactcgaaaaagcatcacttatcgaagtcaagacgtgtacatggcccaaaagtcacacaatatggagtaacggtgtattagaaagtgacatgataatccctaagtcactcgcaggaccaatctcacagcacaaccatagaccaggttatcacacacagactgctggcccatggcacctgggcaaattagaattggacttcaattactgtgagggcactacagtggtcatcactgaaaattgcggtacccgaggtccatcattaagaactaccacagtcagtggaaaactcattcatgaatggtgctgtagaagttgtactttaccaccgcttcgatatatgggagaggatggatgttggtacggtatggaaatacgtcctatatcagagaaagaggaaaatatggtaaaaagtctggtatctgctggatcaggtaaggtagataattttaccatgggcgttctatgcctcgcaatactgtttgaagaagtcatgcgaggcaaatttggcaagaaacatatgatagcaggagtctttttgaccttcgtattgttactaagtggacagataacatggcgcgatatggcacatacactgattatgatcggatcgaatgcgtcagaccgtatggggatgggagtcacttatttggcattaattgcaacattcaaaatacaaccctttcttgccctaggattcttcctacgaaaactgacgagcagagagaacttactgttaggtgttggcttagcaatggctacaactttacaactgcctgaggacatcgaacaaatggcgaatggtatcgcgttagggcttatggcgttaaaattaataacgcaatttgaaacatatcaactttggacagctttgattagcctgacttgctccaatacaatattcacactaacagtagcatggaggaccgcaactttaattcttgcaggagtgagcctattacctgtctgtcaaagttcaagcatgagaaaaaccgactggctaccgatggcagtagcggcaatgggagttcctccgcttccactttttatcttctcgctcaaggacaccctcaaaagacgatcgtggcccttaaatgaaggagtgatggccgtgggcttagtaagtattttagcttctagcttactgcggaatgatgtaccgatggcgggtcccctagtagccggtggactacttattgcgtgttatgtgatcacgggaacttcagcagatttaaccgtagagaaggcagccgatataacgtgggaagaagaagcagaacaaacaggagtatcccacaacctaatgataacagtggatgacgacgggacaatgagaattaaagacgacgagactgaaaacatactaactgttctacttaagacagcactacttatcgtaagcggtatattcccttacagcattcccgcaacattgctagtttggcacacttggcaaaaacaaacgcagcgttcaggtgttctatgggatgttccgtctccgcctgaaacccaaaaagccgaactagaagagggagtgtacagaataaaacaacagggaatattcgggaaaacccaagtgggagtaggcgtacaaaaagaaggcgtttttcatacaatgtggcacgtgacaagaggtgctgttttaacctataacggaaaacgcctagagcccaattgggcatctgtaaagaaagatttaatttcatacgggggtggatggagactgagcgctcagtggcagaaaggggaagaagtacaagtgattgcagttgagccaggtaaaaaccccaaaaattttcaaacgatgcccggaaccttccaaacgacaacaggagaaataggtgccatcgccctagattttaaaccgggtacatcagggtccccaataataaatagagaaggtaaggtagttggtttatacggtaacggcgttgtgacgaaaaatggtggatatgtgagcggaatcgcccaaaccaacgcagagccagacggacctacgccagaattggaggaagagatgtttaagaaacggaatttaacaataatggatctacacccagggagcggcaagacaaggaaatatttacctgcaatagtacgcgaagctataaaacgtaggctacgaaccttaatattggctcctacacgggtggttgcggcggaaatggaagaggcattgaaaggacttcctatacgataccagacaacagcgacaaagagcgaacacactggtcgcgaaattgttgacttgatgtgtcatgcgacttttactatgcgacttctctcgccagtacgagtaccaaattataatttaattataatggatgaagctcatttcacagatccagcaagcatagcagcaagaggatatatatctaccagagttggtatgggcgaagcagcagcaatctttatgaccgccacgccgcctgggacggctgatgcttttccacagagtaacgcaccaatacaggatgaagaaagagatattcctgagcgcagctggaactccggaaatgagtggataacagatttcgcgggaaaaaccgtatggtttgttccatcgattaaagccgggaatgacattgccaactgtctgaggaaaaatggaaagaaagtaatacaactaagcagaaaaacattcgacacagaatatcagaaaaccaaactaaatgattgggacttcgttgtgacaacggacatatccgaaatgggagccaatttcaaggctgacagagtaattgatcctcgcagatgccttaaaccagtaattctgacagatggtccggaacgagttatacttgctgggccgatgccggtaacggctgcgagcgctgctcaacgtcgtggcagagtaggcagaaatcctcagaaagaaaacgaccaatatattttcactggacagccactaaataatgacgaagatcacgcacattggacagaggccaaaatgttattggataatataaatacacctgaaggtataattccggctctatttgaacccgagagggaaaaatccgctgctatagacggagaatacaggttaaagggtgaatcgcgtaaaacttttgtggaattaatgcgaagaggcgaccttccagtgtggttagcacataaggttgcgagtgaaggaattaaatatacagatcgaaaatggtgtttcgatggtcaaagaaacaatcaaatcttagaagagaatatggatgttgagatctggactaaagaaggtgagaagaagaaattgagaccgcgttggctagacgcgcgaacctattcggaccctttggcactcaaagaatttaaggagttcgcggccggccgtaaatcaatcgcgctagatttagtaaccgaaatagggcgcgtccctagccatcttgcacatcgtactcgaaacgcgctggacaacctagttatgctgcacaccagcgaacacgggggaagggcttacagacatgctgtggaagaactgcctgagactatggaaactctcctattgctaggcctcatgatattattaacaggaggggcaatgctattcttaatcagcgggaaaggaatcggaaaaacttctataggactaatttgcgtaatcgcatcttcaggtatgttatggatggcagagatacctttacaatggatcgcatcagctattgttttagagtttttcatgatggttttactaatcccagaaccagaaaaacaaaggaccccgcaggataaccaactagcatacgttgtaatcggaatattaacattggcggctattatcgcggcaaatgaaatgggtctacttgagacaacaaaaagggatttgggcatgagtaaggaaccaggtgttgtaagcccaacaagctatttagatgtggatctgcatcctgcatcagcgtggactttatacgctgtagcaactaccgtaatcaccccaatgttaagacatacaattgaaaattcaaccgcgaacgtaagtctagccgcaatagccaaccaagcggttgtactcatgggattagataaagggtggccaatttctaaaatggatttaggagtccctttgttggctttaggctgttacagtcaagtcaacccattaacattaactgcagctgttttgttattaatcacacactacgcaataattggaccaggcctacaagcgaaagccacccgtgaggcccaaaaacgtacagcagctggcattatgaaaaaccctactgtagacggcattatgaccatcgatctagatccagtaatttatgatagcaaatttgaaaagcaattaggtcaagttatgcttctcgttctctgtgcagtgcaactcttactaatgaggacttcatgggctctatgtgaggctttaactctagcaacaggtccaataacaacattatgggaaggatcgccaggcaagttctggaatactactattgcggtatccatggcgaatatttttagaggttcatatttagccggtgctggcttagcattctctataatgaaaagtgtaggcacagggaaaagggggactggatcacaaggtgaaactctcggagagaaatggaagaagaaactaaaccaattgagcagaaaagactttgatttgtataagaaatccggtataactgaggtagataggacagaagcaaaagaagggctaaagcgaggtgagataacccaccatgcggtttctcgaggttctgcaaaattacaatggttcgttgaaaggaacatggtcataccagaaggaagggtaatagatcttggttgtggtcgaggcggatggagctattactgtgccgggctcaagaaagtaactgaagttagaggatacacaaaaggtgggccgggacatgaggaacctgttccaatgtccacttacggttggaatatagtgaagttgatgagtgggaaggacgtgttctatcttccgccagagaaatgtgatacactactttgcgatattggcgaatcaagcccttcacccaccgttgaagaaagtaggactataagagtcctcaagatggttgaaccatggctcaaaaataatcaattttgcatcaaagtgctaaacccttatatgccaacagtgatcgaacatttagaaaggctacaacgtaaacatggaggaatgcttgtaaggaacccattatcgcgaaactctacccacgagatgtattggatatcaaacggtacaggaaatattgtagcatcagtcaacatggtaagtagactgttacttaacagatttaccatgacccatcgaagacccacgatagaaaaagatgtagacttgggcgcagggacaagacatgtaaatgctgaaccagagacaccgaacatggacgtgattggcgaacgtattaagagaatcaaggaagaacacaatagcacctggcactatgatgacgaaaatccttataaaacatgggcctaccatggtagctacgaggtgaaagcaacaggcagtgcatccagtatgattaatggagtagtaaaactactgacaaaaccttgggatgtagtgccaatggtaacacaaatggccatgacagatactacgccattcggtcaacagagggtatttaaagaaaaagtcgacacacgtaccccaagaagtatgccggggaccagacgggtaatgggcatcacagccgaatggttgtggagaacccttggccgaaataagaaaccaaggctatgtacaagggaagagttcactaagaaagtacgcacaaacgcagcaatgggtgcagttttcacagaagaaaaccaatgggactccgcaaaagccgcagttgaagatgaagatttttggaaacttgtggatcgagaacgagaattacacaaattaggaaaatgtggctcttgtgtatataatatgatgggtaaaagggagaagaaacttggcgagtttggcaaagcaaaagggtcacgtgccatatggtatatgtggttaggcgcgcgatacctagagttcgaagccttaggatttctcaacgaagatcattggttctctagagaaaattcttacagtggtgtagaaggagaaggtttacacaaattgggttatatattaagagatataagtaaaatccctggaggagccatgtacgcagatgacaccgcaggatgggatacgagaattactgaagatgatcttcataatgaggagaaaatcactcaacaaatggacccggaacatcgccaactggctaatgcaatctttaaactcacatatcaaaacaaggtggttaaagtacaacgtcccacaccaacaggaacagtcatggacataatttcaagaaaagaccaaagaggaagcggtcaagtggggacatatggattaaatacctttacaaatatggaggctcagctaattcgtcaaatggaaggcgaaggagttctctcaaaagcggacctagagaacccacacttaccggagaagaaaataacacagtggctagaaacgaagggtgttgagagattgaaacggatggcaatatcaggggatgattgtgtggtcaagcctattgacgatagattcgctaacgcgttacttgctttaaacgacatgggtaaagtgcgtaaagatatccctcagtggcagccatctaaaggctggcacgattggcagcaggtccccttctgctcccatcattttcatgagctgataatgaaagatggtagaaaattagtcgttccatgcagaccccaggatgaactgattggcagagctagaatttcacaaggagcaggatggagcctcaaagaaacggcatgcctcggtaaggcttacgctcaaatgtggagtcttatgtatttccacagacgagacctacgtttagcctcaaatgcaatatgctcggctgtacctgtacattgggtgccaacatcgaggacaacatggtcgattcacgcacaccaccaatggatgacaactgaagatatgttgaccgtctggaatagagtatggatagaggacaacccatggatggaagacaaaacccctgttactacgtgggaaaatgtaccctatctaggaaaaagagaagatcaatggtgtggttccttaataggtctaactagcagagctacctgggcgcaaaacatcccaactgctatccagcaagtacggtcgctcataggtaacgaggagttccttgactacatgccttcaatgaagagatttcgaaaggaggaagagtcagaaggagcgatatggtag

SEQ ID NO: 23213 - RNA, 9873 nt, synthetic construct
  misc_feature 1..9873: note = derived and/or modified CDS sequence (opt6) from DENV-3__JF920402__SS-prME
  source 1..9873: mol_type = other RNA
acgtctctatgcctaatgatgattctaccagcggcattagcatttcatttaacaagtcgggatggtgaaccacgtatgatagtcggcaaaaatgaaaggggaaaatcattattattcaaaactgcttcaggaatcaacatgtgcactttaatagctatggatcttggtgaaatgtgtgatgacaccgtcacatacaaatgcccacacattacagaagttgaaccggaagatatagattgttggtgtaacctaacttcaacttgggtcacctacgggacatgtaaccaagcaggagaacaccgcagagacaaacggtcagttgcattggcgccgcatgtaggaatgggtctagacacgagaacacagacctggatgtcagctgaaggtgcatggaggcaagtggaaaaagttgagacatgggcattacgtcaccctggtttcacaatcttagcattatttctagcccactatatcggcacatcgctaacacaaaaagtggtaatctttattctattaatgctcgtaacaccgtcaatgacaatgcgttgtgtaggagttggaaatagggactttgtggaaggtctaagtggagcaacctgggtagacgttgtattagaacacggcggttgcgttacaactatggctaaaaataaaccaacattggacattgagctgcagaaaaccgaagcaacacaactagctactctaagaaaactctgtatagaaggaaaaataacaaatattacgacggattcaagatgccctacccaaggagaagcaacactgccagaagaacaagatcaaaactatgtttgtaaacacacctacgtagatagaggatggggaaacgggtgtggcttatttggaaaaggttccctagtaacctgcgcgaaatttcagtgcttagaaccgatagaaggcaaagtagtacaacacgaaaacctaaaatatacagtgatcataaccgttcacacaggagaccagcatcaagttggaaacgagactcaaggtgttacagctgagataacacctcaggcaagtacaacagaggcaatcttaccagaatacggtacattaggattggagtgttcacctaggactggactagactttaatgaaatgatattactaaccatgaaaaataaggcttggatggtgcatcgtcaatggttctttgatcttcctctcccgtggacatcaggagcaactacagaaacaccgacttggaaccgcaaagagttgttggttacattcaaaaatgcgcacgcgaagaaacaggaagtcgtagtattaggatcgcaagagggcgccatgcatacagcgctaacaggggctacggagatacaaaatagtggtggaacctcaatatttgcaggacaccttaaatgccgacttaaaatggacaaactcgaattaaaaggaatgtcttacgcgatgtgtacgaacacattcgtactaaagaaagaagttagcgaaacgcagcacggaacgatcctcattaaagtagaatataaaggagaagacgtaccgtgtaaaatacccttctctaccgaggatgggcaggggaaagcccacaacggtcggttaataaccgccaacccagtagtcactaagaaagaagaacctgtaaatattgaagccgaacctcctttcggtgaatcaaatattgtaataggtatcggagataacgcgttaaaaatcaattggtataagaaaggaagctcgatcgggaaaatgtttgaggcgacagccagaggggcacgaagaatggcaatacttggtgatacagcatgggattttggtagcgtaggaggagttctaaatagtttgggtaaaatggtacatcaaatatttggcagcgcctacacagccttgttcagtggggtatcatgggtaatgaaaattgggattggggttctactgacgtggataggcctaaattccaaaaacacatcaatgagttttagttgtatcgctataggcataattaccttatatttgggagctgtagtccaggcagacatggggtgcgtcataaattggaaaggtaaagaactcaaatgtggtagtggaattttcgtaacgaatgaggtacatacgtggactgaacaatacaaatttcaagcagattcaccaaaaagattagcgactgcgatagctggcgcttgggagaacggggtatgcggtatacgctctacaacaagaatggaaaatttactttggaaacaaatagccaacgaattgaattatattttatgggagaacaacataaaactaactgttgttgtaggtgatataataggtgttcttgaacagggtaaacggacactcactccccagccaatggaattaaaatattcatggaaaacctgggggaaagcaaaaattgtaactgccgagacacaaaacagctctttcattattgatggaccgaatacgcccgaatgtccatctgtgagccgcgcttggaacgtttgggaagtggaggactatgggtttggtgtctttaccacaaacatatggttaaaacttcgtgaagtttacacccaactgtgtgaccatcgtcttatgtcggcagccgtaaaagatgagagagccgtacacgctgatatgggatactggatcgaaagccagaaaaatggtagttggaaattagagaaagcctctttaatcgaagttaaaacttgcacatggccaaaatcacatactctttggtcgaacggagttttggaatctgacatgataattccaaaaagtctagctggaccaataagtcaacacaatcatcgccccggttaccatacgcaaactgctgggccgtggcatcttggcaaacttgaacttgattttaattattgcgagggaacgacagtagtaataacagaaaattgtggagcgagaggacctagcctaagaactactacggttagtggtaaactaatacatgaatggtgttgccgctcttgcactcttccgccattgcgatatatgggggaagatggatgctggtacgggatggagattagacctatatcagagaaagaagaaaatatggttaaaagtctagtctcagctggatctggaaaggtagacaattttactatgggagttttatgtctagcgatcctatttgaggaagtgatgagagggaaatttggcaagaaacacatgatagcgggcgtgttctttacgtttgtattgctgcttagtggtcaaataacatggcgagatatggcacatactttgataatgataggcagtaatgcatcagacagaatgggaatgggagtaacatatctcgcactaatagcaactttcaagatccaaccatttctagcgctcgggttctttcttaggaaattaacaagtcgtgaaaacttattgctgggagtgggtttagccatggctacaacacttcaactaccggaggacatcgagcaaatggcaaatggaattgcattgggcttaatggctttaaaattaataactcaatttgaaatttaccaactgtggaccgcactgattagtcttacgtgttcaaataccatattcacgctgactgtagcatggagaactgcaaccttgatacttgccggtgtgagtcttctccctatgtgccagagtagttcaatgaggaaaacggattggctccctatggcagtagctgcaatgggagtcccgccattacctctgttcatattttcactgaaagatacactaaaacgaagaagttggcccttaaacgaaggagtcatggcggtcggacttgtcagtatactggcatcaagcctactaagaaacgatgtaccaatggctggacctctggttgcagggggactactaatagcttgttacgtaattacaggaacttcagcagatttaacagtagagaaagcggcagacattacatgggaagaagaagcagaacaaacgggtgttagccataatctaatgatcacagtagacgacgatggcacaatgcggattaaggacgatgaaactgaaaatatattaacagtattgctaaaaaccgctttacttattgtctctggtatattcccctatagcattccagctaccttacttgtttggcatacttggcaaaaacaaacccagagatcgggtgtactgtgggatgtaccctcaccacctgaaacacaaaaagccgaacttgaagaaggagtataccgcattaaacaacaaggtatatttggaaaaacgcaggtaggcgtaggagttcaaaaagaaggcgtattccacacaatgtggcatgtgactagaggggcagtgctaacttataacggaaaaagactagaacccaactgggcaagtgtaaagaaggatttaataagttacggagggggctggcgattgagtgctcagtggcaaaaaggtgaagaagtccaggttattgcagttgagcctggcaaaaatcctaaaaattttcaaacaatgcctgggaccttccagactactacgggcgaaattggggcaatagctctcgacttcaaaccgggtacaagtggatcaccaataataaatcgcgaaggcaaagtagtgggtctatatgggaatggagtagtcactaaaaatggtggctatgtaagcggtatagctcaaacaaacgcagaaccggacggacctacccctgagttggaagaagaaatgttcaaaaagagaaaccttaccatcatggatctgcatcctggaagtggcaagactagaaaatacctgccggctatcgtacgagaagccataaaaagaagattgcgtactctaatactagctcctaccagagtcgttgctgcggagatggaagaggccttaaaaggtctcccaatcaggtaccaaactactgcaactaaatcagagcatactggaagagaaattgttgatcttatgtgccatgcaactttcacaatgagattactatcacccgtacgcgtccctaattataacttgatcataatggatgaagcacattttactgatcctgcgtcaatagcagccagaggatacatctcaactagggtaggaatgggcgaggccgctgcaatcttcatgacagcaactccaccgggaacggctgatgcgttcccgcaatctaatgcacctatccaagacgaggagcgcgatattcccgaaaggagctggaactccggcaacgaatggataacagatttcgcgggcaaaacagtatggtttgttcctagtataaaagcaggaaatgacatagcaaactgcctacgtaaaaacggtaagaaagtgatacagttaagcagaaaaacatttgacacggaataccagaaaactaaattaaacgactgggatttcgtagtaactactgacatttcagaaatgggagcaaatttcaaagcagacagagtgatagacccccgaagatgtcttaaaccggttatactgacagacggcccggaaagagttatattagctgggccaatgcccgttactgctgcaagtgcggcacaaagaagagggcgagttggaagaaatccacaaaaagaaaacgatcagtacatctttactggacagccgcttaataacgacgaggaccatgcacactggactgaagctaaaatgctcttagacaacataaacactccggaaggtattatccctgcactgtttgagcccgaacgagaaaaatctgcagcaatcgacggagaataccgattgaaaggagaatcaagaaaaacctttgtggagttaatgcgaagaggggacttaccggtatggttagcccataaagttgctagtgaaggcattaaatataccgaccgtaaatggtgttttgacggtcaaagaaacaatcaaatacttgaggaaaatatggatgtagaaatctggacgaaagagggggagaagaagaaactgcgtcctagatggctcgatgctcgaacatattctgacccacttgcattgaaagaatttaaagagtttgcggccgggagaaaatcgattgcccttgacctagtaaccgagattggtagggtaccgtcacatttagcacataggactagaaatgctttagacaatctggtcatgttacacacgagtgaacatggcggaagggcatacagacacgcagtcgaagaactaccagaaacgatggagacattactactactaggcctaatgattttattaacaggcggcgcaatgctttttcttataagcggcaaaggaataggaaaaacttcaataggcttaatatgcgttatcgcctcttcagggatgctttggatggctgaaatacctctccagtggatagcaagtgcaatagttctagagttctttatgatggttttattaatcccagaacccgaaaaacaacgaaccccgcaagataatcagcttgcttacgtggttatagggattttaacgctagctgcaatcatagcggcaaatgaaatgggactgctagaaactacgaaacgagatttagggatgtccaaagaaccaggggtagtgtcccctacaagttatctagatgtagatcttcatccggcttcggcttggacgttatacgccgtcgcgactactgtaatcacaccaatgctgcggcacaccattgaaaattcaacagcaaacgtttcattagcggctattgcgaatcaggcggtggtacttatggggttagataaaggttggcccataagtaaaatggacctaggagttcctttattagctctagggtgttacagtcaagtaaatcctctgacactcactgcagccgttttacttctaattacacactatgcgataattggtccaggtttacaagcaaaagcgacaagagaagcacaaaaacggactgcagcaggtatcatgaagaatccaactgtagacggaattatgaccatcgatctagatcccgtcatatatgactcaaaatttgaaaaacagcttggacaagttatgctacttgtgttgtgcgttgtacagctactcctaatgcggacaagctgggcactttgtgaagctcttacactcgcaacaggacctatcacaactctttgggaagggagccctggaaaattctggaacaccacaatcgctgtcagtatggcaaatatttttagaggatcttacttggcaggcgcaggacttgcgttttcaataatgaagtctgttggaacgggtaaacgcggtacgggaagtcaaggagaaacacttggagagaagtggaagaagaaattaaatcaacttagccgtaaagattttgacctttataagaaaagtggtattactgaagtcgatagaacagaggccaaagagggattaaaaagaggagaaataacacatcatgcggtatctagaggatcagcgaaattacagtggtttgttgagcgcaatatggtgattcccgaaggaagggttatagacctaggatgcggccgcggtgggtggtcgtactattgtgcagggttaaagaaagtaaccgaagtgcgcggttatactaaaggtggacctggacacgaagaaccagtaccaatgtcaacatacgggtggaacatcgtaaaattaatgtcagggaaagatgtcttttaccttccgccagaaaaatgcgacaccctgttgtgcgatattggcgaaagcagcccatccccaaccgtagaggaaagtagaacaatccgagtattgaaaatggttgaaccatggctaaagaacaaccaattttgtatcaaagttttaaatccatacatgcctactgtaatagaacacttagaacgacttcaaagaaaacatggaggaatgctagtgaggaacccattgtcaaggaactctactcatgaaatgtattggatctccaacgggacaggcaacatagtagcctcagtaaatatggtttctagattactactcaatagattcacaatgactcatcggagaccgacaatagaaaaagacgtcgatcttggtgcaggaactagacatgttaatgctgagcctgaaactcccaacatggatgtaataggagaaagaataaaaagaattaaagaagaacataactcaacatggcactatgatgacgaaaatccttataaaacatgggcatatcatggtagttatgaagtaaaagctaccggttccgcttctagtatgattaatggcgtggtcaaattattgactaaaccctgggatgttgttccaatggtaacacaaatggccatgacagatacaacgccgtttggacaacagagagtttttaaagaaaaagtagacacaaggacgccccggtcaatgccagggactagaagagttatgggaataactgccgaatggctatggagaaccttaggacggaataagaaaccacgcttatgcacgagagaggagtttactaaaaaggtaaggactaacgcagctatgggagcggtttttactgaagaaaaccagtgggacagtgctaaggcagctgtagaagacgaggacttttggaagttagttgaccgagaaagagagctacataagttagggaaatgtggatcttgtgtgtataatatgatggggaagcgagagaagaaattgggtgaatttggcaaagctaaaggttcaagagcgatatggtacatgtggttaggggcgcgatatttagaatttgaagccctaggcttcttaaacgaggaccactggtttagtagagaaaacagctatagtggtgttgaaggagaagggttgcacaagctaggatacatattaagagacatatcaaaaataccaggaggagcaatgtatgcagatgacacggccgggtgggataccagaattacagaagacgacttgcataatgaagagaaaatcacacagcaaatggacccagaacacagacaactggcaaatgctatatttaagttgacttatcaaaacaaagtcgtgaaagttcaacggccaacccccaccggcacagtaatggatattatttcgaggaaagatcaaaggggatcaggacaagtagggacttatggattaaatactttcacgaatatggaagcgcaattaataaggcagatggaaggagagggagtattatctaaagcggacttagaaaaccctcatctgccagaaaagaaaatcacgcaatggcttgaaacaaaaggggtagaaaggttaaagaggatggcaatcagtggggatgattgtgtggtaaaacctattgacgaccgatttgcaaatgctcttttagccttaaatgatatgggcaaggtacgaaaagacataccacaatggcagccaagtaaagggtggcatgattggcaacaagttcccttctgttcacaccattttcacgagttgataatgaaagacgggaggaagctagtcgtcccatgtcgcccgcaggacgaactaattggccgggcacgaatctcgcaaggagcaggatggtcattaaaagaaacagcatgccttggtaaggcgtacgctcagatgtggagcctgatgtatttccaccgccgggatctacgactagcatcaaatgccatttgtagtgccgtcccagttcattgggtcccaaccagccgaacgacatggagcatacatgctcaccaccagtggatgaccactgaagatatgctcacagtatggaatcgagtatggatagaagacaatccatggatggaggataaaacacccgtcaccacttgggaaaatgtcccttatttaggtaaacgagaggaccaatggtgcggttctttgatagggctcacttcaagagcgacctgggcacagaatatccctacagcaatccaacaggtgcgaagtctaatcgggaatgaagagttcctagattacatgccttctatgaaacggttccgaaaagaagaggagagtgaaggagcaatatggtga

SEQ ID NO: 23214 - RNA, 9873 nt, synthetic construct
  misc_feature 1..9873: note = derived and/or modified CDS sequence (opt6) from DENV-3__JF937652__SS-prME
  source 1..9873: mol_type = other RNA
acatccttatgtctaatgatgatactaccagcggcactagcgttccatttgacatcaagagacggagaacctaggatgattgtgggtaaaaatgaacgaggaaaatcattattattcaaaacagcaagcggaattaatatgtgtacactaatagctatggatttaggagaaatgtgcgacaacactgtcacatataaatgcccgcacattacggaagtcgaacctgaagatatagattgctggtgtaatttaacaagtacttgggtaacatatggaacttgtaatcaagcgggggaacatagaagagataagcggtccgtagctcttgctccgcatgtaggcatggggttggatacaagaacacaaacctggatgtcggcagaaggggcatggaggcaagttgaaaaagttgaaacatgggcactgcgacaccctggatttacaatcctagcactttttctcgcccattatataggaacttcattgactcaaaaagttgtaatattcattctgctaatgttggtcaccccctctatgacaatgagatgcgtaggagttggtaacagggacttcgtggaaggacttagcggtgcaacttgggtagatgttgtattagaacatggtggctgcgtcacgaccatggctaaaaacaaacccaccctagacatagaactacagaaaacggaagccactcaacttgcaactctaagaaaattatgcattgaaggaaaaattacaaatataacgacagatagtcgatgtccgacgcagggtgaagcgactctacccgaagaacaagatcaaaactatgtttgtaaacatacttatgtagatagaggatggggcaacggctgcgggctgtttggaaaaggtagcttagttacttgtgccaaatttcagtgccttgaaccaatagaaggaaaagtagttcagtatgaaaatttgaaatacaccgttatcattactgttcacactggagaccaacatcaagttggaaatgaaacccagggagttaccgcggaaattacgccacaagcatccacaacagaagccgtgctgccagaatatggtacattaggactggaatgctcacctagaacagggttagactttaatgaaatgatcctgcttacgatgaaaaacaaggcttggatggtacaccggcaatggttctttgacttgcctttgccgtggacatcaggtgcaacaacggaaacacccacatggaatcgaaaagaactgcttgttacatttaaaaacgcacatgccaagaaacaggaagtagtagtcttaggttcgcaagaaggcgctatgcacacagcgctgactggagctactgaaatacaaaattcaggtggaacgagtatctttgccgggcacctaaaatgccgcttgaaaatggataaactcgaactcaaagggatgtcttacgccatgtgcacaaacacatttgtattgaagaaagaagtcagtgaaactcagcacggaactattttaatcaaagtcgaatacaaaggcgaagacgtgccttgcaaaatccccttctcgacagaagacggacaaggaaaagcacacaacggcagattaatcacggcaaatccagtggtaactaagaaagaagaattagttaatatagaagccgaaccacctttcggggaatctaacatcgtcattggaataggagacaacgctctgaaaataaattggtacaagaaaggatcttctatcggaaaaatgttcgaagcgactgctcgaggcgcgagaagaatggcgatactgggtgacacagcctgggattttggaagtgttggaggtgtacttaatagcttaggaaaaatggttcatcaaatcttcggctccgcttacaccgcactgttcagcggagtttcatgggttatgaaaataggtataggtgtgctcttaacctggattggcttaaattctaaaaatacatcaatgtcattttcctgtatagctattggaatcataactctctatctaggagcagtcgtacaagccgacatgggctgcgttatcaactggaaagggaaagaacttaaatgcggatctggtattttcgtcactaacgaagtccatacttggacggaacagtataaatttcaagcggattcacctaaaagacttgccacagcaatcgcaggagcatgggaaaacggagtttgcggcattcgcagcactacccgtatggaaaatttactttggaagcaaatagctaatgaactaaattatatcttgtgggaaaacaacataaagttgactgtggtagtgggcgacataataggggttttagaacagggcaagcgcactctcactccgcaacctatggagcttaaatattcctggaagacttggggtaaagccaaaatagtgacagcggaaacccaaaactctagcttcattattgacggaccaaacacacctgaatgcccttcagtaagtagggcttggaatgtctgggaagttgaagactatggttttggtgtttttactacaaacatttggttaaagctaagagaggtctatacacaactttgcgaccataggttaatgagtgcggcagtgaaagacgagcgtgctgtacatgccgacatgggctactggatcgaaagccaaaagaacggtagttggaagctagaaaaagcaagtctaatagaggtaaagacatgtacatggccaaaaagccacactctttggtcgaatggcgtattggaatccgacatgataataccaaaatcattagcgggaccgatttcacaacataattatagaccaggatatcatacacaaacagctggcccttggcatctgggtaaactagaattagatttcaactattgcgagggtacaacagtagtgatcacagagaactgcggaacccgaggtccttcactaagaactacgacagtctctggaaagctgattcatgaatggtgctgtcggtcctgcacgctgccaccattaagatatatgggggaggatggatgctggtatggaatggagattagaccgatttctgagaaagaagagaatatggtaaaatccctagtatcagctggttccggtaaagtagataactttacaatgggagtattgtgtctggccattctgtttgaggaggttatgcgtggaaaattaggcaagaaacatatgatagctggagtgttctttactttcgttttgttactatcgggccagattacctggagggatatggcacataccctaattatgataggttcaaatgctagcgacagaatgggtatgggagtcacctatctagcactcatagccacgttcaaaatacaaccatttctagctctgggtttctttctgaggaaactaacatctagagaaaacttacttctgggagtaggcttagcaatggcaaccacacttcagcttcccgaggatatagaacaaatggcgaatggcattgccctgggactcatggccttaaaacttataacgcaattcgaaacctaccaactatggactgcacttatatctttaacatgttctaacacgattttcaccttaactgtcgcgtggagaactgcaacacttattctcgcaggagtaagtctgctaccagtatgtcaaagtagtagcatgagaaagactgactggctaccaatggcagtcgcagccatgggtgtaccgccattacccttgtttattttcggtctaaaagacactctaaaacgaagaagctggcctttaaatgagggcgtcatggcagttggattagtatcaatactggctagcagccttcttcgaaatgatgtaccgatggccggccctttggttgccggaggactacttatagcatgctacgtaataactggaacttcagcagatctaaccgtggaaaaggccgctgatatcacatgggaagaagaagcagagcaaaccggagtatcgcacaacctaatgataaccgttgacgacgatggaaccatgcgaattaaagatgacgaaacggaaaacattttgacagttttactgaaaactgccctccttatcgttagcggaatttttccttactcaataccggccaccttacttgtttggcatacttggcaaaaacaaacacaacgttcaggtgttctatgggatgtgccttcaccgcctgaaacacaaaaggccgaattagaagagggcgtttaccgaatcaaacaacaggggatatttgggaaaacgcaagtcggagtaggagtgcagaaagagggagtcttccatacaatgtggcacgtaaccagaggagctgtactcacttacaacggtaaacgccttgaaccaaattgggcgagtgtaaagaaggatttaatatcgtatggaggtggctggcgtctcagcgcccaatggcagaaaggagaggaagtgcaagtgatagccgttgaaccaggtaaaaatcccaaaaactttcagacaatgcccggtacatttcaaacaacaactggtgaaataggagcaattgctttagattttaaaccaggtacttccggatccccaattatcaatcgcgaaggcaaagtggttggtctatacggaaacggagtcgtaaccaaaaacggaggctatgtatcaggtattgcacaaacaaacgccgaaccggacggtccaacccctgagttagaggaagaaatgtttaagaaacgaaatcttaccatcatggatttacatcctggaagcgggaaaacacgaaaatatcttccggctattgtaagggaggcaattaaaaggcgcttgcgaactctgatactagcaccgacaagggtcgtagccgcagaaatggaagaggctttaaaaggactccctataagataccagactacagccacaaagagtgaacatacaggccgtgaaatcgttgacctcatgtgtcacgcgaccttcaccatgcgtttacttagccccgtaagagtaccaaactacaaccttatcattatggacgaagctcattttacggacccagcttcaattgccgctcgtgggtacatttcaacacgagtgggtatgggggaagcggcagcaatatttatgaccgccaccccaccaggaaccgcagatgcatttccacaatctaacgctccaatccaggatgaagaaaaggatattcccgaacgatcgtggaatagtggcaatgaatggataacagatttcgctggaaaaactgtttggtttgtaccctccataaaagcaggtaatgatatagcaaactgtttgaggaaaaatgggaagaaagtgatacaattgtcgaggaaaacttttgatacagaataccagaaaacgaagctaaacgattgggacttcgtagtaacaacagatatatcagaaatgggggcaaattttaaggcggatcgagtaatagaccctcgccggtgtttaaaaccagtaatattgactgacggtccagaaagagttattcttgccggtccgatgccagttacagcggcctctgctgcgcagagaagaggaagagtaggtcgtaaccctcagaaagaaaatgatcagtacatttttactgggcaaccattaaataatgatgaagatcatgcccattggactgaggccaaaatgctcttggataatataaatacgccagaaggaataattcctgcactcttcgaaccagaaagagagaaatccgctgcgattgacggagaataccgtttaaagggtgagtcaagaaagacctttgttgagctaatgagacgtggggatttaccggtgtggctagcacacaaagttgcttcagaaggaattaaatatacagataggaaatggtgttttgacggccagcgaaataaccaaatcttggaagagaacatggacgtagagatctggactaaagaaggagaaaagaagaagctaagacctcgatggttggatgcaagaacttatagcgacccgttagcactaaaagaatttaaagagttcgccgcaggtcgaaaatccatagcgctagatctagttacagaaatcggcagggtgccatcacatctggcacatagaacaagaaatgcattagataatctcgtgatgctacacacatcagagcacggtggcagagcttatagacatgcagtcgaagaattacctgagacaatggaaactctgttattattaggactaatgatcttactcactggaggagctatgttatttcttataagtggaaaaggtattggcaaaacatccataggtttaatttgtgtgattgcaagctcaggaatgctgtggatggctgaaatacctttacaatggattgccagtgccatagtacttgaatttttcatgatggttttacttataccagagccagaaaaacaaagaacgccacaagacaaccagttagcctatgtcgtcatagggatattaacactggctgctataatcgccgctaacgaaatggggctactagagactacaaaaagggatttaggcatgtcaaaagaaccgggcgtagtaagtccaacctcatacttagatgtagatttgcacccagctagtgcatggacactctatgcagttgcaacaaccgtaataacccctatgctacggcatactattgaaaactccaccgccaatgtaagtctagctgcgatcgctaatcaagccgttgtgcttatgggactagacaaaggatggccgatatcaaaaatggacctaggagttccccttctcgcactcggctgttacagtcaagtgaacccccttactttaaccgcggccgttttgctactcattacacattatgcaataatcggacctggattacaagcgaaagccactcgagaagcacaaaaacggactgcagcgggaatcatgaagaatccaacggtagacggtatcatgacaattgatttagatccggtaatttacgattctaaattcgagaaacaattaggacaagtcatgttattggttttgtgcgcagtccaactgttattaatgaggacctcttgggctttatgcgaagcacttacactagcaacaggaccgataacaactttatgggaaggcagccctggaaaattctggaacacgactatagccgtatctatggcaaacatatttaggggtagttatttggccggagccggactagcattcagtataatgaagtctgttggaacaggaaagagaggaacggggtcacaaggggaaacattaggggaaaagtggaagaaaaagctaaatcaactaagccgcaaagacttcgacctatataagaaatccggaataacggaagtagataggacggaggccaaggaaggtctaaaaaggggtgaaatcacacaccatgctgtaagtagaggctctgctaagttacagtggtttgtcgaaagaaatatggtcattccggaaggaagagtaatagacttgggatgcgggcgaggcgggtggtcatattactgtgcaggtcttaagaaagtaacagaagtgcgaggttatacaaagggcggaccaggacatgaagaaccagttccaatgtctacctacggttggaatatcgtaaaattaatgtcaggaaaagatgtattttatttaccgcccgaaaaatgtgatacacttttatgtgacattggagaatcaagtccgtcccctaccgtagaggaaagtagaactataagggttttgaaaatggttgaaccatggttgaaaaacaaccaattttgcataaaggtcctaaatccttatatgccgacagttatcgaacacttggagaggctgcagcggaaacatggcggtatgttggtaagaaacccattatctcgaaattctacccatgagatgtattggataagtaacggaactggaaacattgtcgcatcagtgaacatggtaagcagactattattaaaccgatttaccatgacgcatcgtagaccaacgatcgaaaaagacgtggatttaggagccggtacacgacatgtcaatgcagaaccagaaacacctaatatggatgtaattggtgaacgaattaaacgcataaaagaggaacacaacagtacgtggcattatgacgacgagaatccgtataaaacctgggcatatcatggttcgtacgaggtcaaagcaacaggttcagcttcaagtatgataaatggtgtggtcaaattattaactaaaccatgggatgtggtgccgatggtcacacagatggctatgaccgataccacgcccttcggtcaacaaagagtctttaaagagaaagtagatacacgtacgcctagaagtatgcctggcaccaggagggttatgggaataacagccgaatggttatggagaactctagggagaaacaagaaaccaagattatgtaccagagaagagttcaccaagaaagtaagaaccaatgctgctatgggtgcagttttcacggaagaaaatcagtgggattccgcaaaggcggcggtagaagatgaagatttttggaagttggtagatcgagaaagagaactgcacaagctaggcaagtgtggatcttgtgtatataatatgatggggaaaagagagaagaaactaggggagttcggtaaagctaaaggtagcagagccatctggtatatgtggttaggagcacggtacctagagttcgaagccttaggattcttgaacgaagaccattggttcagtagagaaaattcttatagtggagtagaaggcgaaggtctacataagctaggatatatcctacgagatatatcaaaaatcccgggaggagcaatgtatgcagatgatacagccggatgggatactagaataactgaagacgacctccataatgaagaaaagataacacaacaaatggatccagagcaccgacagctagcaaatgcaatatttaaacttacatatcagaataaagtcgttaaggttcaacggccaactcctaccggtacagtaatggatattatctctagaaaggaccagcgtggatcagggcaggttggaacatatggtcttaatacatttacaaatatgggagcacaattaataagacagatggaaggtgaaggggttttatcaaaagccgatctggaaaatccgcatttaccagagaagaaaataacccaatggttagagaccaaaggggtggagcgattaaaacgaatggcaatttcaggtgatgactgtgtcgttaaacccatagatgatagatttgctaacgctttactcgccctaaatgatatgggaaaagtgagaaaagacatcccccagtggcagccaagcaaaggatggcatgactggcaacaagtccccttttgctcccaccatttccatgaattgataatgaaagatggtagaaaactcgtggttccttgtagacctcaagatgagctgattggtcgagccaggattagtcaaggtgccggctggtcacttaaagaaactgcctgtcttggtaaggcatatgctcaaatgtggtcacttatgtatttccatagacgggaccttaggcttgcctcgaacgcaatttgtagcgccgtaccagttcactgggtgccaacaagtaggaccacatggagtatacacgcgcatcaccaatggatgactacggaagatatgttaaccgtttggaatagagtatggatagaagataacccctggatggaagataaaacgccagtcactacatgggaaaatgtgccataccttggcaaacgcgaggaccaatggtgcgggagcttaataggtttaacatcacgtgcaacttgggcccaaaacataccaacggctattcagcaagttagaagtttgatcggtaacgaagagttcttagattatatgccgtcaatgaagagatttagaaaagaagaagagagtgaaggagctatttggtaa

SEQ ID NO: 23215 - RNA, 9873 nt, synthetic construct
  misc_feature 1..9873: note = derived and/or modified CDS sequence (opt6) from DENV-3__JF920404__SS-prME
  source 1..9873: mol_type = other RNA
acatctttatgcctgatgatgatacttcctgcggctctagcatttcaccttacatctagagatggtgaaccaaggatgatagttggaaaaaatgagagaggaaaatcattactctttaaaacagcatccggtataaatatgtgtacattaattgcaatggaccttggagaaatgtgtgacgatactgttacgtacaagtgcccgcatatcaccgaagtagagcctgaggacattgattgttggtgtaacctaacctccacatgggtaacatatggaacgtgtaaccaagcaggtgaacataggcgtgacaagagatcagtggcactggctcctcacgtcggcatgggcttagatacaaggacacaaacctggatgagtgctgaaggagcgtggcgacaagtggaaaaggttgagacttgggcgctgcgccatccgggatttactattctcgccctctttctggcacattacattggtactagtttaactcaaaaagttgtgatttttattctacttatgttagtgacaccatccatgactatgaggtgtgtaggtgtagggaatagagattttgtagaaggactttccggagcaacatgggtggacgtagtactagaacacggtggctgcgttactaccatggcgaaaaacaaaccaacccttgacatagaattacaaaaaacagaagcgacccagctcgcaactttacgaaaactatgcatagaaggaaagattactaacattacgacagacagtcgatgtccaacacaaggtgaagcaacccttccggaagaacaagaccagaactacgtttgtaaacacacatatgtggatcgtgggtggggcaatggctgcggtctttttggaaaaggaagcttagtcacatgtgccaaatttcaatgtcttgagcctattgaaggtaaggtcgtacagtacgaaaacttgaagtatacagtcataattaccgtgcataccggggatcagcaccaggtaggaaacgaaactcaaggtgttacggcagaaataactccacaagcgagtacaacagaggctattctaccagaatatggaactctagggttagaatgttcacctcgcacaggacttgactttaatgaaatgatacttttaacaatgaaaaacaaagcatggatggtccataggcaatggtttttcgacctaccattaccatggacgagcggagctactactgaaacccccacctggaataggaaagaattattggtcacttttaagaatgcacatgctaagaaacaggaggttgtcgttctcggttcacaagaaggtgccatgcataccgcattaacaggcgcaacagaaatacaaaattccggaggcacttctattttcgccggtcacctaaaatgtcgattaaaaatggataaattggaactgaaaggtatgtcgtatgcgatgtgcaccaacgctttcgtattgaagaaagaagtgagcgaaacacaacatggaacaatactaatcaaggtggaatacaaaggtgaagatgtaccatgcaaaattccgttttccacggaagatgggcaaggcaaggcacataatgggaggctaattacagctaatcccgtagtcactaaaaaggaagagccagtaaacatagaagcagagccaccctttggcgaaagcaatatagtaatcggaataggggataacgcattaaagattaattggtataaaaaagggagttcgattgggaagatgttcgaagcgacagcaagaggtgcccgacgaatggctatattgggggatacagcatgggattttggtagcgtcggaggcgtactaaatagcttaggaaaaatggtgcatcaaatctttggttcggcctacactgccttatttagtggagtaagctgggtgatgaaaataggaataggagtccttttgacatggattggactgaactcgaaaaatacgtcgatgagcttttcctgcattgctatcggtataataacattatacctgggagcagtagtgcaagccgatatgggatgcgttattaactggaagggcaaggaattgaaatgtggctccggcatatttgtaacaaatgaagttcatacttggacagagcagtataaattccaagccgactctccgaaacgattagcaacggccatagcaggggcttgggaaaacggagtttgtggtattagatcgactacaagaatggaaaacttactctggaaacaaatcgcaaatgagcttaattatatattatgggaaaacaatattaaattaaccgtagtagtaggagacataatcggtgtacttgagcagggaaagagaacattaaccccacaaccaatggagttaaaatactcgtggaaaacatgggggaaagctaaaattgtaacagcagaaactcaaaacagcagctttataattgacggccccaatacgccagagtgtccatcagttagcagagcatggaacgtatgggaagttgaggattacggattcggagtatttacaaccaatatatggttaaagttaagagaagtatatacgcaattatgtgaccatagattaatgagcgcagcagtgaaagatgagagagctgtccatgcagatatgggatattggattgaatcccaaaaaaacgggtcgtggaagcttgaaaaagcttctctaattgaagtaaaaacttgtacttggccaaaatcacatacattatggtcaaatggcgtattagaaagcgacatgataatacctaaatcccttgctggacccatttcccaacataatcaccgccccggataccacacgcaaacagcaggcccatggcacctgggtaagttagaattagactttaattactgcgaaggaacaactgttgttataacagagaactgcggtacccggggaccaagtctaaggacgactactgtcagtggaaaattaattcacgaatggtgctgcagaagctgcacactacctccactccgttatatgggtgaagatggttgctggtatggaatggaaatcagaccgatcagtgaaaaggaggaaaatatggtcaaatcactcgtctcagcgggatcaggcaaggtagacaatttcaccatgggagtactttgtttagctatccttttcgaagaagtcatgagaggtaaatttggaaagaaacatatgattgcaggtgtattttttactttcgtcttacttctaagcgggcaaataacgtggcgcgacatggcccatacattgataatgattggatcgaacgcttctgaccggatgggtatgggtgtaacctacttagcgctaatagcaacgtttaaaatacaacctttcctagcattaggtttttttctgcgtaagttaacgagtagagaaaacttacttcttggcgttggtctagccatggccactacattgcaattgcctgaagatatagaacaaatggcgaatggtatagcattaggattaatggcgttaaaattaataacacagtttgagacataccaactttggacagctctaatttccctaacttgcagtaatacaatattcacattaacggtagcctggcgtacagcaacactaattcttgcaggggtcagtttactgccagtctgtcagtcgtcctcaatgagaaaaaccgactggttgcccatggcagtagcagcaatgggagttccacctctgccactgtttatattcgggttaaaagacaccttgaaaagaagaagctggccgttaaatgaaggagtcatggccgtaggactagtctccattcttgcgtcatcactattgcgtaatgatgtgccgatggccggaccgctggtcgccggaggacttctaattgcatgttatgtaattacaggtacatccgcagatttaacagtcgagaaagcagcagacatcacatgggaggagggagctgaacaaacaggtgtttcacataaccttatgataacagttgacgatgatggtacaatgcggatcaaagatgacgaaacggaaaatattctaacagtactcctgaagacagccctgctaatcgtaagtggaattttcccttactcaattcctgccactctattagtgtggcacacttggcagaaacaaacgcaaaggagtggagtactctgggacgtgccgagccctccggaaacacaaaaagcagaactcgaagagggtgtttatcggataaagcagcaagggatcttcggcaaaacacaagtaggcgttggtgtccaaaaagagggagtctttcacacgatgtggcacgtcactagaggtgccgtgttaacatacaatggtaaaagattagagcctaattgggcatctgtcaaaaaagatttaatttcatacggtggaggatggcgattgtcagcccagtggcaaaaaggagaggaagtgcaagtaatagctgttgaacccggaaaaaacccaaaaaattttcaaacaatgccgggaactttccaaacaaccacaggagaaataggagctattgccctggattttaagcccggtacgagcgggtcacccatcataaatcgggaagggaaagttgtcggattgtacggcaatggagtcgtaacaaaaaatgggggttatgtaagtggaattgcacagacaaatgcagaaccagatggacctacaccagaattggaagaagagatgttcaaaaaaagaaacttaactatcatggatcttcatccgggttcaggaaaaacaagaaaatatctaccagcaatagttagagaagctataaaaagacgactaagaactctcatcttggcgcctacccgagttgttgctgcggaaatggaggaagcactaaagggtcttccgatacgatatcagacaacggccaccaaaagcgaacatactggtcgtgaaatagtagatctaatgtgtcatgctacctttacgatgaggctgcttagccccgttagggtccccaattacaatctgattataatggatgaagcgcacttcactgatccagcttcaatcgctgctcgaggatatatctcgacgcgggtaggaatgggtgaagcagcagcaatatttatgacggctactccaccggggactgctgacgctttcccccaatcgaatgcgccaatacaagatgaagaaagagacattcctgagcgttcatggaattccggtaatgaatggattactgactttgctggcaaaactgtctggttcgtcccgtcaataaaagccggtaacgatatagcaaactgtttgcgaaagaatggaaaaaaagtcatacaattaagtagaaaaacgtttgatactgagtatcagaagaccaaattaaacgattgggatttcgttgtaaccacagacatctcggagatgggagcaaatttcaaagcagatagagttattgatcctagacgatgcctaaaacccgtcatcctaacagacggcccggaaagagtcattctggcaggtccaatgcccgtgacagcagcctcagcagcacaaaggcgaggtagagtaggccgaaatccacagaaagagaatgatcaatacatattcacaggtcaacccttaaataatgatgaagaccacgcacattggacagaagcaaagatgttactcgataacataaacacacctgagggtataattcccgccttattcgaaccagaaagggagaaatcggcggcaatcgacggagaatatcgactcaaaggtgaatcccggaaaacattcgttgagttaatgagaaggggcgacttacctgtttggctagcacacaaagtggcaagtgaaggcatcaagtatacagaccgcaaatggtgttttgacggacaaagaaataaccagatattagaagaaaacatggatgttgaaatttggacaaaggaaggagagaaaaaaaaacttaggccgagatggttagatgctagaacctacagtgaccctttagcgctaaaagaatttaaagagttcgcagctggtagaaaatcaattgcattagacttggtcacagaaatcggtagagtccccagtcaccttgcacataggacaaggaatgcactagacaatcttgtcatgttacacacatcggagcacgggggtcgtgcatacagacatgctgtagaagaattgccagaaacaatggaaacgttattattgttggggttaatgattctccttaccggaggcgcaatgttgtttcttataagtggtaaaggaataggaaaaaccagtataggactaatatgtgtaatcgctagcagtggtatgctatggatggccgaaattccgttgcaatggatagcaagtgcaatagttctcgaattcttcatgatggtactcttaataccagaaccagaaaaacagcggaccccacaggataatcagctcgcctacgtcgttattggaattcttacgttagctgcgatcatagccgctaacgagatgggtttattagaaactaccaaaagggatcttggaatgtccaaagaaccaggggtggtaagcccaacttcttacctagatgttgacctccatccagcatcggcatggacactctatgctgtggcgactacagtaattactcccatgttaagacatacgatcgaaaactccaccgcgaatgtttccttggcggcaatagccaatcaggcagtagtcttgatggggttagataaagggtggcctataagtaaaatggatttgggtgttccgttactcgctttaggatgttatagccaagttaaccctttaacgttaactgccgctgtacttttattaatcacgcactatgctatcattgggccaggtttacaagcaaaagcaactcgtgaggctcagaaaagaaccgcggcaggcatcatgaagaatccaacagtggacggaattatgacaattgacctagatccagtaatttatgattcgaaatttgagaaacaactaggacaagtaatgttgctagtactatgcgccgttcaactactacttatgcgtacaagttgggcattatgtgaggctttaactctggcaaccgggcccattactacattatgggaagggagtccaggaaaattctggaatactacaattgctgtatccatggcgaacattttcaggggctcatatctagcaggtgcaggtctagcgttcagtatcatgaaatccgtcggaacgggaaagagaggaacaggatctcagggcgagactctaggcgaaaagtggaagaagaaactcaatcaattgagtagaaaagattttgatctatataagaaaagtggtataacagaagtagatcggaccgaggcgaaggaaggtttaaaacggggtgaaattacacatcatgcagtctctagaggctcagcaaaactccaatggtttgttgaacgaaatatggtaattccggaaggcagggttatagaccttggatgcggaagagggggctggtcctactattgcgccggtctcaagaaagtcactgaagttagaggatacaccaaaggaggtccaggacatgaagaaccagtaccaatgtcaacatatggatggaacatcgtcaagttgatgagtggtaaagacgttttttatttacctccggaaaaatgcgatactcttttatgtgacataggtgagtcctcgccgagtccgactgttgaagaaagtagaacaattagggtattaaaaatggttgaaccttggttaaaaaataatcaattttgcatcaaagttttaaatccatacatgccaactgtaatagagcatttagaaagactccaaagaaaacatgggggaatgttggtacgcaacccactatcaaggaactctacacatgaaatgtattggatttcaaacggtacaggcaacatagtcgcatcggtaaacatggtcagcaggttattactaaaccgcttcaccatgacccataggaggccaacaattgaaaaagacgtagatttgggggcggggacaagacatgtaaacgcggaacctgagacccctaacatggacgtaataggagagagaataaaacgaatcaaagaagaacataactcaacgtggcattatgatgatgaaaatccatataaaacgtgggcataccatgggagttatgaagtcaaagctaccggatctgctagtagcatgattaatggagtagtaaaattgcttactaaaccctgggatgtagttccaatggttacacaaatggcaatgacagacactaccccctttggtcagcaaagggtatttaaagaaaaagttgacacaagaaccccacgatcaatgccaggcacgagaagagttatgggaataacggctgaatggttgtggcgaacactcggaagaaataaaaaaccgagattgtgtactcgagaagaatttacaaaaaaagtacgaacaaatgcggccatgggagctgtctttactgaggaaaaccaatgggatagtgctaaagcggccgtggaagatgaggatttttggaaacttgtggaccgagaaagagaactacataaactaggcaaatgcggatcctgtgtgtacaacatgatgggtaaaagagagaaaaaattaggagagttcggtaaagcgaaagggtctcgcgcgatatggtatatgtggttaggagcacgatacctcgagttcgaagccttaggatttctgaatgaggaccattggttctcacgagaaaattcgtattctggggtcgaaggagaaggtttacacaaactcgggtatattttacgggatatttccaagattcccggtggtgcaatgtacgccgacgatacagcaggatgggatacaagaataacagaagatgatcttcataacgaagaaaagataacacagcagatggatcccgaacaccggcaattagccaacgcaatatttaaattaacttatcagaataaggtcgtaaaggtgcaaagaccaacccccacaggaacagttatggacataatatccaggaaagaccaacgaggttcgggccaagtagggacctacgggttgaatacatttacaaatatggaagcacagttaataagacaaatggaaggcgaaggagttctttccaaagccgacctagagaatcctcacttaccggaaaaaaagataacacaatggttggaaactaaaggagtagaacggttaaaacggatggctattagtggagatgactgtgtagttaagccgattgacgacaggttcgcaaatgcattactagcgctaaatgatatgggtaaagtaaggaaagatatcccacaatggcaaccctcaaaaggttggcatgattggcagcaggtccctttttgcagccatcacttccacgaactcataatgaaggacggaagaaagttagtagttccatgtagaccacaagacgagctaattggtagagctcggatatcccaaggagcaggctggtctttaaaagaaacggcttgcctaggaaaggcatatgcccagatgtggtcgcttatgtattttcacagaagagatctcagattagctagcaatgcaatttgtagcgctgtcccagttcattgggtacctacgtctcgaacgacctggtcaattcacgcacaccatcaatggatgacaacagaagacatgttaaccgtttggaatcgagtctggattgaagataatccatggatggaagataaaacacccgtaacgacgtgggaaaatgttccctatttaggtaaaagagaagaccaatggtgcggatcgctaataggtctcacttcaagagcaacgtgggcgcaaaacattccgacagcaattcagcaagtacgttctcttatcggaaatgaggaattcttggactatatgccgagtatgaaaagattccgaaaagaagaggagagtgaaggggcaatatggtaa

SEQ ID NO: 23216 - RNA, 9873 nt, synthetic construct
  misc_feature 1..9873: note = derived and/or modified CDS sequence (opt6) from DENV-3__JF937641__SS-prME
  source 1..9873: mol_type = other RNA
acttcactttgtctcatgatgatcttgcctgcagcattggcgtttcatttgacgagtagagatggtgaaccaagaatgatagtagggaaaaatgaaagggggaaaagtttgctgtttaaaacagcgagtggcattaacatgtgtactcttattgccatggacttaggtgaaatgtgtgatgatacagttacttataaatgtccacacattacagaagtggaaccagaagacatcgactgctggtgcaatctgacatcaacctgggtgacatatggtacatgtaaccaagctggagaacaccgtagagataaaagaagtgttgcacttgctccacatgttggaatgggactagatactaggacccaaacctggatgagtgcagaaggggcttggcgacaagtcgaaaaagtcgaaacctgggcgttaagacacccaggatttacaatacttgcgttattcttagctcattatataggaacatcccttactcaaaaagtcgttatatttattttacttatgctcgtaacccctagtatgactatgcgctgcgtaggtgtagggaaccgagattttgtggaaggtttatctggtgccacgtgggtagatgtagtactggaacacggaggatgtgtgacgacaatggctaaaaataaaccaacattggacatagaattacagaaaacagaagcaactcaactggcaaccttacgaaaactctgcatagaaggtaaaatcaccaacatcacgacagattctaggtgtccaacccaaggcgaagccacattacccgaagaacaagatcaaaattatgtgtgtaaacacacatatgtggatcgtgggtggggcaatggatgtggcctattcgggaaaggatcacttgtcacttgcgctaaattccagtgtttagaaccgatagaagggaaagttgtgcaatatgaaaacttaaaatatacagtaattataacagtccacacaggagatcaacaccaagtaggtaacgaaacacagggtgtgacagcagaaataacgcctcaagcgtcaacaacagaagcaatcttacctgaatacggtactctcggtctggaatgctcaccaagaacaggtttagattttaacgaaatgatactgttaactatgaaaaacaaagcatggatggtacacagacagtggttcttcgatctcccgctgccatggacgtcgggcgccacaacagagacaccgacatggaatagaaaagagctattggtaacatttaaaaatgcccacgcaaagaaacaggaagtggtggtactaggctctcaagaaggtgccatgcatacggcgttaaccggtgcgacggaaatacaaaatagcggaggcaccagtatcttcgcaggacacctaaaatgcagactaaaaatggataaattagaactgaaaggtatgtcatacgcgatgtgcacaaatgctttcgtattaaagaaagaggttagtgaaacacagcatggcacaatactaatcaaagtagaatataaaggggaagacgtaccatgcaaaataccattctctacagaagatggacaaggaaaagcccataacggtcgtttaataacagcaaaccctgtagtaacgaagaaagaggaacctgtgaacatagaagctgagccgccctttggtgagtcaaacatcgtgattgggataggagataatgcattaaaaattaattggtacaagaaaggtagttctataggtaaaatgtttgaagcaacagcacgcggagcacgacgtatggccatattaggagatacagcatgggattttggaagtgtaggaggagttctcaattcgttagggaaaatggtccatcaaattttcggatcagcatatacagcattgtttagtggagtgagctgggtaatgaaaataggtattggggtattattaacttggattggattaaacagcaaaaataccagtatgagttttagttgtatagccattggcattataactctttatctaggtgccgtggttcaggcggatatgggatgcgtaatcaattggaaaggaaaggaattaaagtgtggaagtggaatcttcgtgacaaatgaggtgcatacctggacggaacaatataaatttcaagctgacagccccaaacgcttagctacagctattgcaggagcatgggaaaacggagtatgtggaatacgcagtacaacacgtatggagaacttgctctggaaacagatagccaatgaattaaactacattctgtgggaaaataacatcaaattgacagtggtagttggagatatcataggtgtgttagagcaaggtaaaaggacccttacaccacaacctatggaattgaaatacagctggaagacatggggtaaggctaagatagtaacggcagagacgcaaaacagctcttttataattgatggtccaaatacacccgaatgcccctccgtctcacgagcatggaatgtatgggaagtagaggattatggttttggtgttttcactacaaatatttggcttaaacttagggaagtgtacacccaactatgtgaccatcggttaatgtcggctgctgtcaaggacgaaagggcagtacatgcagatatgggctactggatcgaatctcagaagaacgggtcatggaaattggaaaaggcatccctgatagaagtgaagacttgtacttggcccaaatctcatacactgtggtccaatggtgtattggagtctgacatgataatacctaaaagcctagcaggacctattagccaacataatcatcgaccaggataccatacccaaactgcgggaccgtggcacttggggaaactagaattagactttaattattgcgaaggaacgactgtggtaataacagaaaattgcgggacaagaggaccttctctacgaactacaactgttagtgggaagttaatacacgaatggtgctgtagatcttgcactctaccacccttaagatatatgggcgaagatggatgctggtacggaatggaaattaggccaattagtgaaaaagaagaaaacatggttaaaagtttagtgagcgcgggaagcggtaaagttgacaatttcaccatgggagttctctgtctagctattcttttcgaagaggttatgagaggcaaatttgggaagaaacatatgatagctggggtgttctttacttttgttttacttcttagtgggcaaattacttggagggacatggcgcacacactgataatgattgggtcaaacgcgtcagatcggatgggaatgggagtgacatatttagctttgattgcgacattcaaaatacaaccctttttggccctagggttcttcctcagaaaactaacatcgcgcgaaaacttactcttaggagttggtcttgctatggcaactacactacaattaccagaagatatcgaacaaatggcgaatggaattgcgctcggcttaatggcactaaaacttataacacaattcgaaacataccaactttggaccgcgttaataagccttacatgctccaacacaatcttcacattaacggtagcgtggcggacagccacattaattctcgctggggtttcactattacctgtatgtcagtcctcaagtatgcgaaaaacagactggcttccgatggccgtcgcagcaatgggtgtaccgccattgcctctgtttatttttgggcttaaagatactttgaaaagaagaagctggccactaaacgagggtgtaatggctgtaggactggtgtcgatactggcatcaagtttattaagaaacgatgtaccgatggcaggacctttagtagcagggggactgctaatagcttgttacgtcatcacaggtacatctgcagatttgacggttgaaaaagccgcagacattacttgggaagaagaagcagagcaaacaggggtttcgcataatcttatgatcacagttgatgatgatggaacaatgagaatcaaagatgacgaaactgaaaatatattaacagtcctactaaaaaccgccctcttgatcgtgtctggcatttttccctacagtataccagcgaccttactcgtatggcatacgtggcagaaacagactcaacgaagtggggtgctgtgggatgtccccagtccaccggagacacaaaaagcagaactagaagaaggcgtgtacaggataaaacagcaagggatattcggcaaaacgcaagttggagtaggcgttcaaaaagaaggtgtatttcacaccatgtggcatgtcacgagaggcgccgtattaacttacaatggaaaacgactagaaccgaattgggcgagcgtcaagaaagatttaatcagttacggcggagggtggagactatcggctcaatggcaaaagggagaagaagtacaagtcatagcagtcgaacctggtaagaatcctaaaaacttccaaaccatgccaggaacattccaaactacaacgggtgagattggagcaatagcactggatttcaagcccggaacatcagggagtccaataattaaccgcgagggaaaagtagtgggcctatatggtaatggcgtagtgactaagaatggagggtacgtatccgggatagcacaaacaaatgcagaacccgatggacccaccccagagctggaagaagaaatgtttaagaaacgcaatttaacgattatggatctacatccaggatctgggaagacacgaaagtatttaccagccatcgttagggaagcaataaaacggcgcttgagaactctgatcctagcacccaccagggtagtggcggcggaaatggaagaagcactcaaaggattaccgataagatatcagacaactgcaaccaaaagtgaacatactggaagagagatagtagacttaatgtgccatgccacattcaccatgaggttactatcacccgtaagagttcctaattataacctaatcataatggacgaagcacactttactgatccagcctctattgcagcaaggggttacatcagcactcgagttggaatgggagaagcagctgcaatcttcatgacagccacgcccccggggactgcagatgcttttccacaatcaaatgctcctattcaagatgaggaacgcgatataccagagagaagttggaacagtggaaacgaatggattactgatttcgcaggcaaaaccgtatggttcgttccttcgattaaggcgggaaacgacatcgctaactgtttaaggaaaaatggcaagaaagtaatacaactgtcgagaaagacatttgatacagaataccagaaaaccaagctgaacgactgggacttcgtagtgaccacagacatctcggaaatgggcgcgaattttaaagcagatagagtaatagatccacgccggtgcttaaaaccggttatactcactgacggtccggagagagtaatattagccggtccaatgcctgtgacagctgcctctgccgcacaaaggagaggacgcgtgggtagaaaccctcaaaaagagaatgaccaatacatatttacaggtcaacctttaaataatgatgaggaccatgcccattggacggaggcaaagatgctgttagataatataaacaccccggaaggaattattccggccttatttgaacctgaaagagaaaaatcagcagcaatcgacggagaatacagattaaaaggagaatctagaaaaacattcgttgagctcatgcgtagaggagaccttccagtctggttggcacacaaagttgcatccgaggggataaagtacactgatcggaaatggtgctttgacggtcagcgaaataatcaaattttggaagaaaatatggacgtagaaatctggacgaaggagggtgagaagaagaaattaaggccacgatggctcgacgcacgaacatattcagaccctttagcgctcaaagagttcaaggagttcgcagcgggtcgcaaaagtattgctcttgacttagtcacagaaattggaagagtaccatcacatctcgcacaccgtacacgaaacgcactggataatttagtaatgctccatacgtcagagcacggaggacgagcatatagacacgcagttgaagaactgcccgaaacaatggaaacgttactattattaggcctaatgatattgctcactggtggagctatgctatttttaatatcaggaaaaggaattggtaaaacgtccatcggattaatatgcgtaatcgcaagcagcggtatgctctggatggctgaaataccactccaatggattgcatcagccatagtactagagttcttcatgatggtactacttatacccgagccagagaaacaaagaactccgcaggacaaccaattagcctatgtcgtaataggcatattaacacttgctgcaataatagcagcgaacgaaatgggtctcctagaaacaactaagcgagatcttgggatgtcaaaggaacctggagtagtatcaccaaccagctatttagacgttgatctgcatccagcatcagcatggacgctgtatgcggtagcaacaacagtaatcacaccaatgttacgacacactatagagaacagtacggcaaacgtgagtttggctgctatagcaaatcaggctgttgtccttatgggtcttgataaaggatggcccatatctaaaatggatctaggagttccgctgttagccctagggtgttacagccaagtaaacccactaacattaaccgcagcggtactcttacttattacgcattacgcgataatcggacctggactccaggccaaagcaacacgagaagctcagaaacgaactgcagcaggaatcatgaaaaatccaacagtagacgggattatgactatcgacttggatcctgtgatttatgatagtaaatttgagaaacagttaggacaagtgatgttgcttgtgttatgcgcagtccagctattgcttatgcgaacatcctgggcattgtgcgaagcactaaccttagctacagggccaattacaactctttgggaaggcagtcctggcaaattctggaacactacgatagctgtatcaatggcaaatatctttcgaggatcatatttagcaggcgcaggtctggctttctctattatgaaatctgtaggaacaggaaaacgcggcactggctcacaaggagaaactttaggggaaaaatggaagaagaaattaaatcaactatctagaaaggactttgatttatacaagaaatcaggtataactgaagttgacagaactgaagctaaggaaggattgaaaagaggagaaatcactcatcacgccgtttctagaggatcggcgaaattgcaatggttcgtagaacgcaatatggttataccagaagggagagttatcgatttgggatgtggtagaggagggtggagctattattgtgcaggattgaaaaaggtaacagaagtacggggatacaccaaaggcgggccaggtcatgaggaaccggtcccaatgagcacatacggctggaacattgtaaaactcatgagcggtaaagacgttttctacctaccacccgaaaaatgcgacaccttgttatgcgatataggcgagtcctccccgtcgccaacagtcgaagaaagcagaacaattagagttttaaaaatggtagaaccctggctaaagaataaccaattttgtattaaggtactcaatccatatatgcccacggtaatagaacatcttgagcggctccaaaggaagcatggaggtatgttagtccggaacccactttcgagaaatagtacacatgaaatgtactggatatccaatgggactggaaacatagttgcatctgtcaacatggttagccgattactattgaatagatttacaatgacacataggcgtcccacaatagaaaaagacgttgatttgggcgccggcactcgacacgtgaacgccgagcccgaaactccaaatatggacgttattggagaaaggattaagcgaattaaagaagaacataactcaacctggcactacgatgacgagaatccatacaagacgtgggcatatcatggttcttacgaagtaaaggcgacaggctcagcctcttctatgataaacggagtcgtaaaacttttaactaaaccatgggatgtggttcccatggtgacacaaatggcaatgacagacacgacaccgttcggacaacaaagagtcttcaaggaaaaagttgacactagaacgcctagatctatgccgggaacgaggagagttatgggaataacggcagaatggttatggagaactttagggaggaacaaaaagccacggttgtgtacaagagaagaatttacaaagaaggtaagaacaaatgctgctatgggagccgtattcactgaagaaaaccaatgggattcagctaaagccgcagtagaagatgaagacttttggaaattagtcgacagagaaagagaacttcacaaactaggaaagtgcgggagctgcgtatacaacatgatgggaaagagagaaaagaaattaggcgagttcggcaaagcaaaaggcagtagagctatatggtacatgtggcttggcgctcggtatttagaatttgaggctttagggttcctgaacgaagatcattggttttcccgggagaatagctactcaggagtagaaggtgaaggtttacacaaactaggctatatactacgagatataagcaaaatcccaggaggagctatgtatgcagatgatacagcaggctgggacacaagaatcacagaagacgacctccataatgaggagaaaataactcaacaaatggatcctgagcatagacaattggctaatgcaatctttaaactgacctatcagaacaaagtggtaaaggttcaacgaccaacacccacaggaacggtgatggatataatctctcgaaaagaccaacgtggaagtggacaagtaggcacgtacggactcaatacctttaccaatatggaagctcaattaatcagacaaatggagggtgaaggggtactctctaaagcagacttggagaaccctcatttacctgagaagaaaatcacacagtggttagaaacaaaaggagtagaaaggctaaagcgaatggccatctccggtgatgattgcgtagtgaagccaatagacgatcgattcgcaaatgcacttttagccctaaacgatatgggaaaggtgagaaaagacattccacaatggcagccctctaaaggatggcacgattggcaacaagttccattttgtagccaccatttccacgagctaataatgaaagatggtagaaagttagttgtaccttgtagacctcaagatgagctcatagggcgtgccaggatttcacaaggggcgggctggtcactaaaggaaacagcttgtctgggcaaagcatacgcacaaatgtggagtctaatgtactttcataggagggacttaaggttggccagcaacgcaatttgctcagcagtacctgtccactgggtaccgacatcacgaacaacctggtcaatccacgcgcatcatcaatggatgacgaccgaagatatgctcactgtttggaatcgggtctggatagaagataatccttggatggaagacaaaaccccagtaacaacatgggaaaacgtaccatatcttggaaaaagggaggatcaatggtgcggcagccttataggactgacttcgcgagctacgtgggcacagaatatcccaacagcaatacaacaggtgcgttccttgattggtaacgaagaatttttagattatatgccatctatgaagcgttttagaaaagaggaggaatcagaaggagcaatctggtaa

SEQ ID NO: 23217 - RNA, 9873 nt, synthetic construct
  misc_feature 1..9873: note = derived and/or modified CDS sequence (opt6) from DENV-3__JF920396__SS-prME
  source 1..9873: mol_type = other RNA
accagtttgtgtttgatgatgatcctaccagctgcattagcatttcatcttacttctagggacggtgagcccagaatgattgtcgggaaaaatgaacgtggtaaaagccttttgttcaaaactgcatctggtataaatatgtgtactctaatagcaatggatttaggggaaatgtgcgacgatactgtgacgtataaatgcccccacatcacagaagtggaaccggaagacatcgactgctggtgtaacttaacttcaacgtgggtaacatatggtacatgtaaccaagccggtgaacatagacgcgataaacgatcagtggctcttgctccacatgtggggatgggtctagacacgcgaacacagacttggatgtcagctgaaggtgcatggcgtcaagttgaaaaagttgaaacttgggcattacgtcatccggggtttacaattctcgccctattcctagcgcattacataggaacaagtcttactcaaaaagtcgtaatatttatcctactgatgcttgtcacaccttcaatgaccatgcgctgcgtcggagtaggaaatagggatttcgttgaaggactctcaggagctacctgggtagatgtcgtattagagcacggcggatgcgttacaacaatggccaaaaataaaccaacattggatattgagttgcagaaaacagaggctacccaacttgctaccttaagaaaattgtgtatagaaggcaaaataacgaatataacaaccgacagtcgctgccctactcaaggagaagcaacgttaccggaggaacaagaccagaattacgtctgtaaacacacatatgtagaccgaggctgggggaacgggtgtggattatttggaaaaggctctttagttacgtgtgcgaaatttcaatgtctagaaccaatagaaggaaaagtagtacaatatgaaaatctaaaatacactgttattattactgtacatacgggagatcaacatcaagtgggtaacgaaacccaaggagtaactgctgagataacaccacaggcatccacgaccgaagcgattttaccagagtatggaacgcttggtctcgaatgcagtccccgtaccggattagattttaacgagatgatattactcacaatgaaaaataaagcatggatggtccatagacaatggttctttgatctacccctgccatggacatcaggagcaacaacggaaacaccgacgtggaaccgaaaagaactgcttgtgacattcaaaaacgcacacgcgaagaaacaagaagtggttgtattaggatcccaagaaggcgcaatgcacacagcactgactggcgcgacagaaattcaaaattctggtggaaccagcatatttgcaggacatctgaaatgccgactgaaaatggacaaactagaacttaaagggatgtcctatgcaatgtgcaccaatacattcgtgttgaagaaagaagtttcggagacccaacacggtacaatccttatcaaagtagaatacaaaggcgaagacgtaccatgtaaaataccattctccacagaggatggtcagggaaaagcacataacggtaggttaataaccgccaaccccgttgtcactaagaaagaagaaccggtaaatatcgaagcggaaccacccttcggagagagcaatattgtgattggaattggggataacgcactcaaaataaactggtataagaaagggtcaagcataggcaaaatgtttgaagccacagcacgaggtgcacggaggatggcgattcttggcgataccgcttgggactttggttccgttgggggtgttctgaacagtctgggaaaaatggttcaccaaattttcggttccgcgtacacagcattattttcaggtgtatcatgggtgatgaaaatagggataggagcattacttacatggatcgggctaaattcgaaaaacacttcaatgtcattttcctgtattgccataggtataataactttgtacctaggggcagtagtacaagcggatatgggatgcgtagtgaattggaaaggaaaagaactaaaatgtggaagtgggatctttgttacaaatgaggtgcacacctggacggaacaatacaaatttcaagcagactcacctaaacgtttagcaacagcaattgctggtgcgtgggaaaatggagtctgtggaattagatcgacgactagaatggaaaatctattatggaaacaaattgctaacgaattgaattacatactatgggaaaacaacatcaaattaactgtagtcgttggtgatataatcggtgtgcttgaacaaggaaaaagaacccttacaccccaaccgatggaattaaaatatagctggaaaacttggggcaaagcaaagatagtaactgcggaaacacagaacagctcatttataattgatgggcccaatacccctgaatgtcccagtgtgtcacgagcctggaatgtttgggaagtcgaagattatggttttggcgtatttacaacgaacatctggttgaagttgagggaagtgtatacacaactttgtgaccacaggctcatgtctgcagcggtaaaggacgaaagggccgtgcatgcagacatgggctattggattgagagtcaaaagaatgggtcgtggaaactggaaaaagctagccttatagaagtaaagacgtgtacgtggcctaaatcacacactctttggagcaacggcgtactggaatcagacatgataatcccaaaaagtctagcaggaccaatatctcaacacaatcacaggccaggttatcacacccagacagccggtccctggcatctgggaaaacttgagctcgactttaattattgcgaaggaactacagtagttatcacagagaattgcggtacaagaggtccatcattacggacaacgaccgtgagtgggaagttaatacatgaatggtgctgcaggtcatgtaccttaccaccattaagatatatgggagaggacggttgttggtatggaatggagattcgtccgatatcggaaaaagaagaaaacatggtcaaatccttagtgtcagccggctccggaaaagtggataacttcactatgggcgtactttgtctagcaattctattcgaagaggtgatgagaggaaaattcggaaagaaacacatgattgcaggggtcttcttcacattcgtactgttattatctggccagataacctggagggatatggcacatacattaataatgataggatcgaacgcgagtgacagaatgggtatgggagtaacatatctagcgttaatcgcaacatttaaaatacaacccttccttgctctgggattctttttaagaaaattgacaagtcgagaaaacttactattaggtgttgggttagcaatggccacaacattgcaactacctgaagatattgaacaaatggcaaatgggattgccctggggttgatggcattaaaactaattactcaattcgaaacctatcaattgtggacagcccttatttcgttaacgtgtagtaatacgatatttacattgacagtggcatggagaacagcaacccttatcctcgccggggttagcttgcttccagtatgccaatcatcttcaatgaggaagacagactggttgcctatggctgttgctgcgatgggcgttccaccacttcccctatttatctttagccttaaagatacgctgaaacgacgttcatggcccctgaatgaaggtgttatggccgtaggtctagtgagcattttagctagttcactgttgcgcaatgatgttccaatggctggtcctttggtggcgggagggttgctgatcgcatgctatgttataacaggaacgtcggcagatttaactgtagaaaaggcagcggacataacgtgggaagaagaagctgagcaaacaggtgtttcacacaacctaatgattacagttgacgacgatggaactatgaggattaaagacgatgaaacagaaaacatcttaacagtacttctcaaaactgcattgctgatagtgagtggaatctttccatatagtatacctgctacactcctagtatggcacacatggcaaaaacaaactcagcgatctggagttctctgggatgtgcctagtccgccggaaacacaaaaggcggaactagaagaaggggtatacagaatcaagcaacaaggaatttttggaaaaacacaagtaggagttggagtgcaaaaagagggcgtgtttcatacaatgtggcacgttacgcgaggtgctgtactaacttacaatggtaaaagactcgaaccaaattgggcaagcgtgaagaaagacctcatcagctatggcggaggatggagattgagtgcgcaatggcagaaaggtgaagaggttcaagtaatagcagtggaaccaggcaaaaatcccaaaaattttcaaacaatgccaggaaccttccagacaacaacaggagaaatcggggcaattgcacttgattttaaacctggaacaagcggaagcccaattataaacagggaaggaaaagtagttggattatatggaaatggtgttgtaactaaaaatggtggttacgtctctggaatagcccaaactaatgctgaaccagatggaccaactcctgaactcgaagaagaaatgttcaagaaaaggaaccttaccattatggatttacatccaggaagtggaaaaacgagaaaatatttaccagcaattgtacgggaagccataaaacgtagacttcggaccttaattcttgcaccaacaagagtagtcgcagcagaaatggaagaggcattgaaagggttacccattaggtaccagacaacagcaactaagagtgaacacacaggaagagaaatagttgacctaatgtgccatgctacatttactatgagattattatctcctgttcgtgtacctaattataacttaattattatggacgaagcacactttacagaccctgcaagtatagcagctcgcggatacataagtacgagagttggaatgggagaggctgctgccatcttcatgacggcaacgccgccgggaacagctgatgcatttccgcaatccaatgctcctattcaagatgaagaaagagatatacctgaaagatcgtggaactccggtaacgaatggataaccgacttcgctggtaaaacagtatggtttgtaccgagcattaaagctggtaatgacatagcgaattgtctaaggaaaaacggcaagaaagttattcaattgtcgcgtaaaacttttgacactgaatatcagaaaaccaaactaaatgattgggactttgtcgtcactacagacatcagtgaaatgggcgcaaacttcaaagcagaccgagttatcgacccacggagatgcctcaaaccagtcatcctgacagacgggccagaaagggtaatcttagccggtccgatgccagtaacagcagcatcggctgctcagagacgtggcagagtcggacgcaacccccaaaaagagaatgaccaatatattttcactgggcaaccattaaacaatgacgaggatcatgcgcattggacagaagctaaaatgcttctagataatattaatactccagaaggaatcatacctgcactatttgagccagagagagagaaaagtgcagcgatcgatggcgaatacaggctaaaaggtgaatcgagaaagacatttgtggaattaatgcgaagaggagatttacctgtttggttggcccataaagtagcatcagaaggaatcaaatataccgatcgcaaatggtgttttgatggacagcgcaacaatcagatacttgaagaaaacatggacgttgaaatttggacaaaagaaggtgagaagaagaaactcaggcccagatggctagatgcgcgaacttattcagacccgttagcattaaaggaatttaaagagtttgctgcaggaaggaagtctatagcccttgacctggtcacagaaataggtagagtacctagtcatttggcacatcgaacacggaacgctcttgataacctagtgatgttacatacttctgagcacggtggaagggcctatcgtcacgcagtagaagaacttcctgaaactatggaaactctactcttacttggattaatgattttattaacaggaggtgcaatgctattcctaatttcgggaaaaggaatcggaaaaacatccataggattaatatgcgttattgcatcctcaggtatgctatggatggcagaaattccgttgcaatggatagcctccgcaattgtattggaatttttcatgatggttttattgatccctgagcctgagaaacaaaggactccgcaagacaatcaactggcatacgtagttattggaatcctaactctagcagcaataatagcagctaatgaaatgggtcttttggaaacaactaaaagagatttagggatgagtaaagaaccaggtgtagtcagcccgacttcttatctagacgttgatttgcacccagcctctgcttggacactgtatgctgtagcaacgacagttatcactccaatgctaaggcacacaatagaaaattcaacagcaaatgttagcctagcagcaatcgcaaaccaagccgtagttttaatgggtttggataaaggatggccaatatcgaaaatggatttgggtgtacccctattagcattagggtgctattcccaagtgaaccctttaactctgacagcggctgtcctcttactaatcacacactacgccatcattgggccaggactacaagccaaagcaacaagagaggctcaaaagcgcaccgctgcaggtatcatgaagaatccaaccgtggatggcataatgacaatagatttggatccagtaatctatgacagtaaatttgaaaaacagttggggcaagtaatgctattagttctatgcgctgttcaattgttactaatgcgaacgagttgggccctatgtgaggctttgacgcttgctactggaccaatcactactctatgggaaggatctccgggaaaattctggaatacaacaattgctgttagtatggcaaacatattcagaggttcttatctagcaggagcaggcttagcgttctcaataatgaagagtgttggaactggtaaaaggggaacaggcagtcaaggagaaaccctaggtgaaaaatggaagaagaaattaaatcaattatctcgaaaagacttcgatctctacaagaagtctggcatcactgaggttgaccggactgaagccaaggaaggactaaaaagaggagaaatcacccaccatgcagtttctagaggttcggcaaagttacaatggtttgttgaacgcaacatggtaataccagagggccgagtaatcgatctaggttgcggcaggggaggctggagctattattgtgcaggcctcaagaaagtaacagaagtaagaggatatacaaaaggaggaccaggacatgaggaaccagtgcctatgtctacttacggatggaacatagtgaagctgatgagcggaaaggacgtattctacttgccaccggagaagtgtgacactttattgtgcgacattggagaatcaagtccgagtccaactgtcgaagagtcaaggacaatcagagtgttgaagatggtagaaccttggttgaaaaacaaccagttctgcataaaagtgctaaatccttacatgcccacagtaatagaacacctagaaagattacagcgaaaacacggcggtatgcttgtcagaaatcctctgtcaagaaatagtactcatgaaatgtactggatcagtaacggtaccggaaacatagtagcaagtgtcaacatggtctcaaggttactactaaacagattcacgatgactcacagacgtcccacaatcgagaaggatgtagacctaggggctggtacaagacatgttaatgccgaacccgaaacacccaatatggatgtgataggtgaaaggataaaacgtataaaagaggaacacaattctacatggcattacgatgatgagaacccatataaaacgtgggcatatcacggctcgtacgaagtaaaagcgacaggctctgcgtcaagcatgattaacggtgtcgtaaaattgctcacaaagccatgggatgtcgtacccatggtaacacaaatggctatgacagatacaacaccattcggacaacaaagggtattcaaagaaaaagtcgacacgagaacgccgcgatccatgccggggacacgtagagtaatgggaattactgcagaatggttatggaggaccttaggtcgaaacaagaagcctcgactttgtactcgagaggagtttactaagaaagtacggacaaacgcagcaatgggagccgtgtttactgaagaaaaccaatgggatagcgcaaaggcggctgtggaagatgaagacttctggaagctagtggatcgggaaagagaattacacaaactaggtaaatgtggcagctgtgtatataatatgatgggaaaaagggagaagaaactaggagaatttggaaaagccaaaggcagtagggctatatggtacatgtggcttggggcaagatacttagaatttgaagcactcggatttctcaatgaggatcactggtttagcagggaaaatagttactcaggtgtagagggagaaggtttacataaactggggtatatcctaagagatattagcaaaattcctggaggtgctatgtatgcggatgataccgccggttgggacacgcgaataactgaagacgacttacacaacgaagaaaagatcactcagcaaatggaccctgagcatcgacagctggctaatgcaatatttaaactaacataccaaaataaagttgtaaaagtacaaagacccacacctactggtactgtaatggacatcatttctagaaaagatcaaagagggagtggacaagttggcacatatggactcaacactttcacaaacatggaagcacaacttataagacaaatggagggcgagggagtactcagtaaagccgatctagaaaatcctcacttgcctgagaaaaagataactcagtggctcgagacgaaaggcgtcgaaagacttaaacgcatggcgatcagcggagatgattgtgttgtcaaaccaatagatgataggtttgctaatgctctactagctttaaatgacatggggaaagtgcgtaaagacatcccgcagtggcaaccaagtaaaggatggcacgattggcaacaagtacccttttgcagtcatcactttcatgagttaatcatgaaagacggcagaaaacttgtagtaccctgtcgaccacaggatgaactgataggtcgagctaggatttcacaaggagcaggttggagtcttaaggaaacagcgtgcctagggaaggcctacgctcaaatgtggtccctaatgtatttccataggagagatctacgattagcatcgaacgccatatgttctgcagtcccagtgcattgggttccgacttcacgtacaacatggagtattcatgcgcatcatcaatggatgacgacagaggatatgttgacggtctggaatcgagtctggattgaggataatccttggatggaggataaaacgcctgtcactacatgggaaaacgtaccctatttagggaaaagagaagatcaatggtgtggaagtttgatcgggttgacgtcaagagcgacttgggctcaaaatatcccgacagctatacaacaggtccgatcattgataggaaatgaggagttcttagattacatgccctcgatgaaaagattcaggaaagaagaagaatctgaaggggcaatatggtaa

SEQ ID NO: 23218 - RNA, 9873 nt, synthetic construct
  misc_feature 1..9873: note = derived and/or modified CDS sequence (opt6) from DENV-3__JF920406__SS-prME
  source 1..9873: mol_type = other RNA
acaagcctctgtctcatgatgattttgcctgccgctctagccttccatttgacctcgcgggatggcgaaccaagaatgatcgtcggtaaaaacgaaagaggtaagtctctattgtttaaaactgcatccggaattaatatgtgcacattaatagccatggacctgggcgagatgtgtgatgatactgttacatataagtgccctcatataactgaagtcgaacctgaagacattgattgctggtgtaatttgactagtacatgggtaacttacggaacttgcaatcaagcgggagaacacagacgagataaaagatcagtagccttagcaccacacgtgggaatgggtcttgataccagaacccaaacatggatgtcagcagaaggagcctggagacaagtagagaaggtcgagacgtgggcacttcgtcatcctggattcactatattggcattatttttggctcattatatcggcactagcttaacacaaaaagttgtcatttttatcctcctaatgttagtaacaccttctatgaccatgaggtgtgttggagtcggaaatagggatttcgttgagggactttctggagctacatgggtggatgtcgtacttgaacacggggggtgtgtaacaacgatggcaaaaaataagccgaccctggacatcgaattacaaaagaccgaggcgacacaattagctacactccgaaagctttgcatagaaggaaagatcactaacatcacaactgactcccggtgtcctacacaaggcgaagcgacactacctgaagaacaagatcagaactatgtttgtaaacatacatatgttgatcgcggatggggcaacgggtgcggactattcgggaaagggtcattagttacatgtgcaaagtttcaatgtctagaaccaatagagggaaaagtagttcaatacgagaatctaaaatataccgtaataattactgttcacacaggagaccaacaccaagttgggaatgaaacgcaaggagtgacagcagagattacaccacaagcatcaaccaccgaagcaatccttccagaatatggaacacttggcctcgaatgctcgccacgcaccggactcgatttcaatgagatgatcttacttacaatgaagaataaagcatggatggtgcatcgacaatggttttttgatttacccctaccttggacaagtggagccactacagaaacacctacctggaatcgaaaagaactattagtaacatttaaaaacgctcatgcaaagaagcaagaagtagtagttctcggtagtcaagagggtgctatgcatacggccctaactggggccaccgaaatacaaaattctggtggaacttcaatatttgcaggacacctaaagtgtcgactgaaaatggacaaactcgagttaaaaggcatgtcatacgctatgtgcacaaacgcttttgttctgaaaaaagaagtatctgaaactcaacatgggacaatactaataaaagttgaatataagggagaagatgtgccatgcaaaataccattttcgacggaagatgggcagggtaaggcacataacgggcgtctcataacagccaaccctgttgtgactaaaaaagaagaaccagttaatatagaagcggaaccaccctttggagaaagcaacattgtgattgggattggcgacaatgctctcaaaataaattggtacaaaaaaggaagctcaatcggaaaaatgtttgaagcaactgcacgaggagctagacgcatggcaatcctaggagatacagcgtgggactttggatctgtgggaggggtcttaaactcacttggaaaaatggtccatcaaatcttcggatctgcctacaccgcgctgttttcgggagtatcttgggtcatgaagataggaataggtgtactattaacatggataggattgaatagtaagaatacctcaatgtcgttttcatgtattgcaataggaattataacgttgtatttaggggcagttgtgcaagcggatatggggtgtgtaataaattggaaaggaaaagaactcaaatgtggaagcggtatctttgtgaccaacgaagtacatacgtggaccgaacagtataagttccaagccgatagtccaaaaagattagcgactgcaatcgcaggtgcatgggagaatggggtttgcggtatcaggagtacgactcggatggagaatttattgtggaaacagattgccaacgaattgaattatatactatgggaaaataatataaagttaactgtagttgtgggtgacatcattggagtactggagcaaggtaagcgtactttaacaccccagccaatggaattaaaatactcatggaaaacttggggaaaagccaaaatagtgacagcagaaactcaaaactcttcttttattatcgatggacctaacacacccgaatgtccctccgtctcgagggcgtggaacgtgtgggaggttgaggattatggattcggagttttcaccactaatatatggcttaagctaagggaagtttacactcaattatgtgatcacagactaatgagcgcagcggtgaaagacgaacgagctgtccatgctgatatgggttactggattgagtcccagaaaaatggaagttggaaattggagaaggcaagcctaatagaggtcaagacgtgtacgtggccgaaaagtcacacactatggagcaatggagtattagaaagcgatatgattataccgaagtccttagctggcccgatttcacaacataaccataggcctggataccatacacagacggcaggcccatggcatttagggaagctagaactagatttcaattactgtgaaggaaccacagtagttataacggaaaattgtggaacacgaggaccttcattaagaactactacagtttctggtaaattaatccatgagtggtgttgtcgaagctgcacattgccacctctacgttatatgggagaagacggctgctggtacggtatggaaattcgacccatatccgagaaagaagaaaatatggtaaaaagtttggtatccgccggcagcggaaaagtcgacaatttcaccatgggcgtactatgtttagcaatactatttgaagaagtaatgagaggaaaatttggaaaaaaacatatgatagccggagtattctttacatttgtattgctcctatctggacagataacttggcgtgacatggcgcatacactgataatgatcgggagtaacgcttccgatcgaatgggtatgggtgtgacatatttggcattaatagcaacgtttgaaattcaaccgttcctagcactcggtttcttcctaagaaaactgacgtcgcgtgaaaacttattactaggcgttggacttgcaatggcaaccaccctacaactcccagaagacattgagcaaatggctaatggaatcgcgttaggactgatggcattaaaactgataacccagtttgaaacataccaactttggactgcactaatctccctaacttgcagcaacaccattttcacattaacagttgcttggcgaacagcaaccctaatactggccggagtaagcttattgccagtatgtcaaagtagctcaatgcgaaagacagactggctacctatggctgtggcagcaatgggagtcccaccgctacctcttttcattttcgggctaaaggatacccttaagagaaggtcttggcctttaaacgaaggtgtaatggctgtcggtctagtgagcattctcgcttcaagccttctacgaaacgatgtaccaatggccggaccactcgttgccggagggttattaatcgcgtgttacgtaataaccggtacctcagcagatctgacagtagagaaggcagccgacataacgtgggaagaagaagcagaacaaactggggtgagccataatcttatgataactgtagatgatgacgggacaatgagaataaaggacgatgagacagaaaatattctgacagttctactaaaaaccgcgcttttaatagtttcgggtattttcccgtactcaattcctgccaccttattggtgtggcacacgtggcaaaagcaaacccaaagatcgggagttctatgggatgttccaagccccccagaaactcagaaagcagaactagaagaaggtgtatatagaatcaaacaacagggaatttttggtaaaacacaagttggtgttggcgttcaaaaagaaggtgtattccatacaatgtggcatgtaacgagaggcgcagttctaacctataacgggaaacggcttgagcctaattgggcgagtgtgaaaaaagatttaatttcgtacggtggtggctggcgcctaagtgcccagtggcaaaaaggagaagaagtccaagtaatagctgtagaaccagggaaaaatcccaaaaatttccaaacgatgcctggtacatttcagacgactacaggagagataggtgcaatagctttagatttcaaacctggaacttcgggaagtcctattataaaccgggaaggaaaagttgttggtctctatggcaatggagtggtcactaaaaacggaggttatgtttcaggcattgcccagacaaatgcagaaccagacggacctacacctgaattagaggaagaaatgtttaagaaacgcaacttaactatcatggaccttcacccgggatctggtaagacaagaaagtatctccctgcaatagtgagagaagcaatcaagaggagactaaggacactaattttggccccgacgcgagttgtagctgcagaaatggaagaggccttaaaaggtctcccaataagatatcaaaccacggcaacaaaatctgaacataccggacgggaaatagttgatttgatgtgtcatgccacgtttacaatgcgccttctatctcctgtccgagtgcctaattataaccttataatcatggacgaggcacatttcacagatccagcttcaatagccgcccgcggatatataagtactcgtgtaggaatgggtgaagctgcggcaatcttcatgacggcaacaccacccggaactgctgatgcttttccacagagtaatgctccgatccaggacgaagagagagacatccctgaacggagttggaacagtgggaatgagtggataaccgactttgcaggaaagacggtttggtttgtgccaagcataaaggctgggaatgatatagcgaattgtctacgaaaaaacgggaagaaagttattcaattgagtcgaaaaacgttcgatactgaatatcaaaaaacaaaactgaatgactgggactttgtagttactacagacataagtgagatgggagcgaattttaaagcagacagggttattgatcctcgaaggtgccttaaacccgtgatactaacagatggaccagagagagtaatactggcgggtccaatgcctgttactgcggcaagtgctgcacaaagacgaggcagagtaggccgaaatccacaaaaagagaatgaccaatatatcttcacaggccaacctttgaacaatgacgaggatcatgctcactggacagaagccaaaatgctcttagataatatcaacactccggaaggtattatcccagctctatttgagcctgagcgagaaaagagcgcggccattgacggagaatataggttgaagggtgaatctcgtaaaacatttgtcgaattaatgagacgtggagatctacctgtctggttagcgcacaaagttgcttccgaaggtataaagtacactgaccgcaaatggtgttttgacggtcagagaaataaccaaatacttgaggaaaatatggatgtcgaaatctggacaaaagaaggggaaaaaaaaaagctaagaccgcgttggcttgatgcgagaacctactctgatccactcgctttaaaagaattcaaagaattcgcagctggaagaaaatcaattgcattggacctggttacagaaataggccgtgtcccctcacatttagctcatcgtactcggaacgcattagacaaccttgttatgcttcacactagtgaacatggcggaagggcctacagacatgcggtagaagaattaccagaaacgatggaaacattattattactaggattgatgatattactcacaggtggggcaatgttattcttaataagcggaaagggtatagggaaaacatctataggacttatatgtgtcatagcaagtagtgggatgttatggatggccgaaattccactacaatggattgccagcgcgattgtgttagaattttttatgatggtattattaattcccgaacctgagaagcaaagaacgccacaagataatcaattggcctatgtagtcataggtatattaacactagcagctattattgcagcgaacgagatgggtctattggagaccaccaaaagagacttaggaatgagcaaggaaccgggtgtagtatcaccaactagttacttggatgtggatctccatccagcaagcgcatggaccttgtatgcggttgcaacgacagtgataacaccaatgttaaggcacactatagaaaactcaaccgcgaatgtgagcctagcagccatagcaaaccaggcagtcgtcttaatgggactagacaaaggatggcccataagcaaaatggacctgggtgtaccgctgctcgccctcgggtgctattctcaagtgaatccactcacccttacggcggcagtccttttattaataactcattatgccataattggccccggattacaagctaaagcgacacgggaggcacagaaacgtacagccgcggggatcatgaagaacccaacggtcgatgggatcatgactatagatctagatccagtgatttatgatagtaagttcgagaagcagctgggacaagtaatgttgctcgtgctgtgtgcggtacagctactcctgatgcgaacatcatgggctctctgtgaagcattaactctagcaaccgggccaataactacattatgggaaggaagccctggtaagttctggaatactacaattgccgtatcaatggcgaacatatttagaggttcttacctggctggagctggtttagcgttcagtataatgaaaagcgtcggaaccggaaaaagaggaacaggatcacaaggtgaaacactaggagaaaaatggaaaaagaaactaaatcagctgtccagaaaggatttcgacctctataaaaagagtggaataactgaggtagatcgaactgaggccaaagaaggtttaaaaagaggcgaaataacacatcatgcagtatcacgtgggagtgcaaagcttcagtggtttgtcgaaagaaatatggtcataccggaaggaagagtcattgatctaggatgtgggagaggtgggtggtcatattactgcgcaggactaaagaaggtaacagaggttagaggttacacaaaagggggtccaggtcacgaagaaccagtccctatgtcaacatacggatggaatatagtaaaacttatgagcggcaaagatgtattttacttgcctccggagaaatgtgatactctactttgtgatatcggagaaagttcacctagtccaacggtagaagagagcagaacgatccgagttttaaagatggtagagccatggcttaaaaacaatcagttttgtataaaagtgcttaacccatatatgcccactgtgattgagcacctcgaaagactacaaaggaaacacggtggtatgctggttaggaatccattgagcaggaactccacacacgagatgtattggataagcaacgggacaggaaatatagtagcctctgtaaatatggtgtcccgcttgttgttgaatcgtttcacaatgacccatagaagaccaacaatagaaaaggacgttgacctgggagcgggaacaagacatgtgaatgctgaacctgaaacaccgaacatggatgtaataggtgaaagaataaaacgaataaaggaagagcacaatagcacatggcactatgacgatgaaaatccttataaaacgtgggcttatcatggatcttatgaagttaaagcgacaggcagtgcatcgtcaatgatcaatggtgtcgttaagctactcactaaaccttgggacgtggtgcccatggttacacaaatggcaatgacggacacaacaccatttggccaacagagagtgtttaaagaaaaagtagacacacggacacctcgaagtatgcccggcacacgaagggttatgggaatcaccgctgaatggttgtggcgaactttaggtagaaataagaaaccccgattatgtacccgcgaagaattcactaaaaaagttagaacaaatgcggcaatgggagctgtatttactgaggaaaatcaatgggattccgctaaagctgcagtagaagacgaagatttttggaaattagtcgacagagaacgagaactccacaaattaggaaagtgcggtagctgcgtgtacaatatgatgggaaaaagggaaaagaaattgggcgaatttgggaaagcaaaaggatcaagggcaatctggtacatgtggcttggggctagatatcttgaattcgaagcattgggatttcttaacgaagaccattggtttagtcgcgaaaattcctattctggggtggaaggcgaaggactacataaattaggctacatattaagggacatttccaaaataccgggaggagcaatgtacgctgatgacactgcaggttgggacacgaggattacagaagatgacttacataacgaagaaaaaatcacacaacaaatggacccagaacacaggcaacttgcgaatgcaatctttaaactaacttaccaaaataaggtagtaaaagttcaaaggccgacgccaactggaacagtgatggatataatatcaaggaaagatcagcggggcagcggacaagtcggaacttacggccttaatacattcacaaatatggaagcacaattgataagacaaatggaaggtgaaggagtgttatcaaaggcggacctcgagaatccacaccttccagaaaaaaaaataacacaatggttggaaactaaaggggtagaacgtctaaaacgaatggccattagtggtgacgattgcgtcgtaaagccgatagatgatagattcgctaatgcgctattagctctcaatgacatgggaaaagtccgaaaggatattccacagtggcaaccaagtaaaggatggcatgattggcaacaagttcccttttgcagccatcatttccatgaacttatcatgaaggacggtcggaagttagtagtaccctgtcgaccccaagacgagcttataggaagagcaagaataagccagggagcaggatggtcccttaaggaaactgcttgtctgggtaaagcctacgctcaaatgtggtctctaatgtatttccatagacgagatctgcgattagcttctaatgccatctgttccgcagttcccgtccactgggttccaacaagtagaacgacttggtcaattcacgctcatcatcaatggatgactactgaagacatgctcacagtatggaatcgagtatggatagaagataatccttggatggaagacaagacgccagtaacaacgtgggaaaatgttccatatcttggtaaacgagaagatcaatggtgcggttctcttataggtcttacatcaagggcaacctgggcacaaaacattccaacagccatccagcaagtgcgtagcttaatagggaatgaagagtttctagactacatgccttcaatgaaaagatttagaaaagaagaggaatctgagggcgccatatggtaa

SEQ ID NO: 23219 - RNA, 9873 nt, synthetic construct
  misc_feature 1..9873: note = derived and/or modified CDS sequence (opt6) from DENV-3__JF920409__SS-prME
  source 1..9873: mol_type = other RNA
acctcgttgtgtcttatgatgatcctacctgctgcattggctttccacttgacgtcacgagatggagaaccccgcatgatagtaggcaaaaatgaacgggggaaatcgttattgtttaaaactgcaagcggtattaatatgtgcacgcttatagccatggatttaggtgaaatgtgtgatgatactgtcacatacaaatgtccgcacataaccgaagttgaaccagaagatattgattgttggtgtaatctaacgagtacatgggtgacttatggtacatgtaatcaagcaggagagcatagacgagataaaaggtcagtagcactcgctccgcatgtcgggatggggttagatacgagaactcaaacttggatgagtgcagagggagcttggcgacaagtcgaaaaagtcgaaacctgggctctacgacatcccggctttacaattttagccttgtttctagcacactatatagggacaagtttagcacaaaaagtcgttatatttattttgctaatgttggttacacccagcatgacaatgcgatgtgtcggggttgggaatcgagattttgtcgagggactttcgggagccacttgggtagatgtagtactagagcacggaggatgtgtcacgactatggctaaaaataaaccgacattagacatagagttacagaaaacagaagctacacaattagcaactctgcgcaaattatgcatcgaagggaaaatcacgaatattacaaccgactcaagatgccccacacaaggcgaagcaactttaccagaagaacaagaccaaaactatgtgtgtaaacacacgtatgtcgatcggggttgggggaacggatgcggccttttcggtaaaggatccctagttacatgtgcgaaatttcagtgcctagagcctatagaaggaaaagtagtacagtatgaaaacttaaaatacactgttatcattacggttcatactggtgaccaacaccaagtcgggaatgagactcagggtgtaactgcagaaataacaccccaagcaagtacaacagaagcaatccttcccgagtacggaacactcggactagaatgcagtcctaggacagggctggactttaacgagatgatattgttaacaatgaaaaacaaagcatggatggttcatagacaatggtttttcgatttaccgttgccatggacaagtggtgcaacgactgagactcctacatggaacagaaaagagcttctagtcacttttaaaaacgcccatgctaagaaacaggaagttgtggtacttgggtcacaagaaggtgctatgcacacggcattaacaggggctacggagatacagaacagcggaggaacaagtatatttgctggccacttaaaatgccgcctcaaaatggacaaacttgagcttaagggtatgagttatgccatgtgcactaatacgtttgtacttaagaaagaagttagcgagacacagcatggaacaatactaatcaaagtagaatataagggcgaagacgtaccatgcaaaattcctttcagcaccgaagacggacaaggcaaggcacacaatggtaggcttataacggcaaaccctgtagtgactaagaaagaagaaccagtgaacatcgaagcggaaccgccattcggagaatcaaacatagtaattggaatcggagataatgctttgaagataaactggtataagaaaggatctagcataggaaagatgttcgaagccaccgcaagaggagcacggagaatggcaatacttggtgatacagcatgggattttgggagtgtgggcggagtgttaaatagtttaggaaaaatggttcatcagatatttgggtctgcatatacggcattattctcaggggttagttgggtgatgaaaataggaataggagtcctattaacgtggataggacttaatagcaagaacactagcatgtcattttcatgtattgcgatcggtataatcacgttgtacttaggggcggttgtacaggctgacatggggtgtgtaataaactggaaaggtaaagaattgaaatgcggtagtggaatatttgtcacaaatgaggtccatacctggacagaacaatataaatttcaagctgattctccaaaaagattagctacggctatagcgggagcatgggagaatggggtatgtggcataaggagcacaactcgcatggagaatctgttatggaaacaaatagctaacgaactaaattatatcttatgggaaaataacattaaattaactgtagttgtaggagatattataggtgtactagaacaaggaaaaagaactttaactccacaaccgatggaactaaaatacagttggaaaacatggggtaaagcaaaaattgtcacagccgaaacacaaaattccagtttcatcatagatggacccaacacaccagagtgtccaagtgtcagcagagcctggaacgtgtgggaagtagaagattatggattcggtgtttttactactaatatatggttaaaattaagggaggtatacacccaactctgcgatcaccgtctaatgtccgccgcggtcaaggacgagcgagccgtgcacgcagacatggggtactggattgaaagtcagaaaaatggctcctggaaactagaaaaagcaagtttaattgaagtaaaaacttgcacatggccaaaaagtcataccttatggtctaatggtgttctagagagcgatatgattatccccaaatctcttgcaggtcccatctcccaacataatcatagacctgggtaccatacgcaaacagcaggcccgtggcatttaggtaaactcgagcttgacttcaattactgtgaaggaacgaccgtagtaattaccgagaactgtgggacaagaggaccaagtctgcggacaaccacagtatccggtaaattgatacacgaatggtgctgtcgtagctgtacactaccccctttgcgatatatgggtgaggatggatgctggtatggaatggaaatccggccaatttccgaaaaagaggaaaacatggtaaaaagtttggttagcgcagggtctgggaaggtcgataattttactatgggtgtcctatgccttgccatacttttcgaagaagtcatgagaggaaagtttgggaaaaagcatatgatagcaggagcgtttttcatgttcgtattactattaagcgggcaaatcacatggcgagacatggcgcacactttaataatgatcgggtccaatgcaagcgaccgtatgggaatgggagtcacgtacttagcgctaatagccacttttaagatccaaccctttctcgcgttggggttctttttaagaaagctaacttctagagaaaatctattattaggcgtagggttagcgatggccactaccttacaacttcccgaagacatcgagcaaatggccaacggaatagccctaggcttaatggcactaaaactaattacgcaatttgagacatatcaattatggactgcactcattagcctaacctgtagtaatacaatctttacactaacggtagcatggcgaactgcaaccttaatattagcaggcgtgagtctattgccagtatgccaatcctcgagcatgcgcaagactgactggctgcctatggccgttgcggccatgggagtgcctccacttcccctcttcattttctcattaaaagacacactcaaaagaagatcatggccgttaaacgaaggcgtaatggctgtaggacttgtgagtatattagccagctctttactaagaaatgacgtgccaatggctggtccgcttgtagcgggcggacttctaatcgcttgttatgtaattacagggacatctgcagacttaacagtagaaaaagctgcggatatcacttgggaagaggaggcagaacagacaggggtaagccataacttaatgattacagtagatgatgatggcacaatgcgaatcaaggacgatgaaagcgagaatatcttgaccgtacttttaaagacagcattgctaattgtaagtggtatttttccatactccatacccgctactctgctagtatggcacacctggcagaagcaaacacaaagatcgggcgtgttgtgggatgttccgtccccgcctgaaacacaaaaggcggaattagaagagggagtctatcgtataaaacaacagggaatatttgggaaaacccaagttggggttggagttcaaaaagagggcgtgttccatacgatgtggcatgttacaaggggagcagttcttacttataatgggaaacgtctagaacctaattgggcaagtgtcaagaaagatttgataagctatggcggtggatggagactatctgcacagtggcaaaagggggaagaagtacaggtaatagcagtagagcctggtaagaatcccaaaaattttcaaacgatgccaggcactttccaaactacaacaggggaaataggcgcaatagcattggactttaaaccaggaacgtccggaagtcccatcataaatcgcgaaggcaaagtagtcgggctttatggcaacggggtagtcactaagaatggaggatacgtgtcgggaatagcgcaaacaaatgcagaaccggatggaccaacaccagaattagaagaggaaatgttcaaaaagagaaacctgacgatcatggatttacatccaggttcgggaaaaactagaaaatacctcccggcgatagttcgcgaggcgataaagaggaggttgcgaacactaattctcgctccaactagggtcgtcgcggcggaaatggaagaagcacttaaaggcctaccgataagatatcaaactactgcaacaaaatcggaacatacaggtagagaaatcgtggacctaatgtgtcatgcaacattcactatgagattattaagccccgttagggtccctaattacaacttaataataatggatgaggctcacttcacagatcctgcgtcaattgcagctcggggatatatttcaacaagagttgggatgggcgaggcagcggcaatcttcatgaccgctacaccaccaggaacagcagacgcatttccacagagcaatgcgccgattcaagacgaggagcgcgatattccagagagatcatggaactctggaaacgagtggataacggatttcgccgggaagacagtttggtttgttccaagtattaaagctggtaatgatatagctaattgcttacgcaaaaatggaaagaaagtaatacaactgtcacgtaagacattcgacactgagtatcaaaagacaaaactaaacgactgggattttgtagtgactaccgacatctctgaaatgggagccaattttaaggctgacagagtaatagatcctcggagatgcttgaaaccggttatcttaaccgatggccctgaaagagtaatactcgctggtccaatgcctgtgacagcggcaagtgccgcgcagagaagaggccgtgtaggtcgcaacccgcagaaggaaaatgaccagtacatattcacggggcaaccacttaacaatgacgaggaccatgcacactggacagaagcaaagatgttattggataacattaacacaccggaaggaattattccagctctctttgaacccgaaagagagaagtcagcggcaatcgatggtgaatatagattaaagggcgaaagtaggaagacctttgttgaactaatgagacgaggggatttacctgtttggcttgcccataaagttgcaagtgaaggaataaagtatacagacagaaaatggtgctttgatggacaacgtaataatcagatcttggaagaaaacatggacgttgaaatctggactaaagaaggcgagaaaaagaagttacgaccgagatggctggatgcaagaacatatagtgatcccttagccctaaaagagtttaaagaatttgccgccggccgcaagagcatcgccttagatcttgtcactgaaataggtcgagtaccatcccatctggcacacaggacaagaaatgctcttgataatcttgttatgctacatacaagtgagcatggaggtagagcttatcgccacgcagtagaagaacttcccgaaacaatggaaacacttcttctacttggtctaatgatccttttaacaggtggagccatgctgttcctaataagtggcaaaggaataggtaaaacaagtattggccttatctgtgttattgcatcatcaggtatgttatggatggcggaaatcccattgcagtggatagcgagcgcaatagttcttgagttcttcatgatggtactcctaataccagaacctgaaaaacagagaacaccccaggataaccaactggcttatgtagtcatcggaatattaacactggcagctatcattgccgcaaatgaaatggggctactcgaaactacaaaacgtgacctcgggatgtcgaaagaacctggagttgtatctccaacttcttacttagatgtggatcttcatcccgcttcagcttggacgttatacgcggttgccacaactgtcataacaccaatgttaagacatactatagaaaacagtacagcaaatgtgtcattagccgctattgctaaccaagccgtcgttttgatgggtctagacaaaggatggcctatttcaaaaatggacctaggtgtacctctgttagccctgggatgttatagtcaagtaaatcctttaacactcactgcagcagttttattattgatcacccattacgcaattatcggaccaggattacaagctaaagctacaagagaggctcagaaaagaacagctgcgggcattatgaaaaatccaaccgtagatggtataatgacaatagatctggatccggtaatctacgattcaaaattcgagaaacagctgggtcaagtgatgctattagttttatgcgctgtgcaacttttacttatgaggaccagctgggccttgtgtgaagcattaactttagccactggacctataacaaccttgtgggaaggaagtcctggcaaattctggaatactactattgccgtctcaatggcaaacatttttaggggttcctatttggccggtgcagggttagccttcagtataatgaagtcggtcgggacaggaaaacgcgggacaggtagtcagggagaaactttaggtgaaaaatggaagaagaaattgaatcaattgtcaagaaaggatttcgatctatacaagaaaagtgggataacggaagtagatagaaccgaagctaaagaaggcttgaaaagaggtgagattacgcatcatgcagtttccagaggatcagccaagttacagtggttcgttgaaagaaacatggtcataccagaaggaagggttatagacctaggatgtggtagagggggatggtcatactattgcgctggactcaagaaagtgacagaggtaaggggatatactaaaggaggcccaggtcatgaagaaccagtgcctatgagcacatatggatggaatatcgtgaaattgatgagtgggaaagacgtattctatcttccaccagagaagtgcgacaccctgctctgcgacattggagagtcaagcccctctccaacagtagaagaatcaagaacaattagggtcttaaaaatggttgagccttggctcaaaaataatcaattttgtataaaagttctaaacccatacatgcctacagtaatagaacatttagaaagattacaacggaaacatgggggaatgttagttagaaaccccttatcacgaaactctacccatgaaatgtattggattagcaatggaactggaaatatagttgcgtctgtaaatatggtatcaagattgttactcaaccgctttacaatgacgcatagacgtccaactatagaaaaggatgtcgacctaggcgctggaactagacacgtaaatgcggagccggagacaccaaatatggatgttatcggtgaacgaattaaaagaataaaagaagaacataatagcacatggcattatgatgacgaaaatccttataaaacgtgggcttaccatggaagttatgaagttaaagcaacagggtcagcatcgtccatgataaatggtgtcgttaaactgctaaccaagccttgggatgttgtgccaatggttactcaaatggcaatgacagatacaaccccattcggtcaacagcgcgtatttaaagagaaagtagatactcgaaccccacgatctatgcctggaacgcgtagagtcatgggaatcactgcagaatggctttggcgcacacttggtagaaacaagaaaccacgactatgtacaagagaagagttcactaagaaagtacggactaacgctgcaatgggtgcagttttcaccgaagagaaccaatgggactctgctaaagctgctgtagaagatgaagacttctggaagctagttgatagagaaagggaactccataaattagggaaatgtggcagctgtgtatataacatgatgggcaagcgagagaagaaactgggtgaatttggtaaagccaaaggatcaagggcaatatggtatatgtggctaggggcccgatatttagagtttgaggcactcggcttcttaaacgaagaccattggttttcaagagaaaacagttacagcggagttgaaggagaaggtctacataaattaggttatatactacgagatatttctaaaataccaggtggggcaatgtatgcagatgacactgcaggatgggatactcgcataacggaagatgatctacacaatgaagagaaaataactcaacaaatggatccggagcaccgacaattagcgaacgcaatatttaaattaacctatcaaaataaggtagttaaagtacagagaccaacacctacagggactgtaatggacataatatcccgaaaagaccagcgcggtagcggccaggttggcacatacggtttgaacacatttacaaatatggaggcccaacttatacgtcaaatggaaggtgaaggagtgttaagtaaggcagatcttgaaaatcctcatttgccagagaaaaagatcactcagtggttggaaacaaaaggagtagaaagactaaagagaatggcgatctcaggtgatgattgtgtcgtgaaacctatcgatgacagatttgcaaatgcactcttagcattaaacgacatgggtaaagtacgtaaggacataccacagtggcaaccttccaaaggatggcatgattggcaacaagttccgttctgttcgcatcattttcatgaattaattatgaaagatggtagaaagttagtggtcccttgtaggccgcaagacgaattaataggcagagcacgaatcagccaaggagcaggctggtcattaaaggaaacagcttgtctaggtaaagcgtatgcgcaaatgtggagccttatgtactttcatcgcagggatctaaggctcgcaagtaacgcgatatgttcagcagtcccagtccattgggtaccaacgtcgagaaccacttggagcattcacgctcatcaccaatggatgactaccgaggatatgctgacagtgtggaacagagtctggatcgaagacaatccatggatggaggataaaacccccgtcacaacatgggagaacgttccttatttaggtaaaagagaagatcaatggtgtgggtcactaataggcctgacttcaagggcaacatgggctcaaaatatacctactgcaattcaacaagtaagaagtttaatcggaaacgaagagttccttgactatatgccatcgatgaaacgatttaggaaagaggaagaaagtgaaggagctatatggtaa

SEQ ID NO: 23220 - RNA, 9873 nt, synthetic construct
  misc_feature 1..9873: note = derived and/or modified CDS sequence (opt6) from DENV-3__JF920408__SS-prME
  source 1..9873: mol_type = other RNA
acatccctgtgcctaatgatgatattaccagctgctttggcattccatttaactagccgagacggagaaccaagaatgatcgttggcaaaaatgaaagaggaaaatcattattgttcaaaacagcaagtggaatcaatatgtgcactctaatagctatggacctaggtgaaatgtgcgacgacactgttacttataaatgccctcacatcacggaagtggaaccggaagatatcgactgttggtgtaatttaacttcaacttgggttacatacggtacctgcaatcaagctggagaacatcgacgtgataaaagaagtgtagcgcttgctccacacgtaggaatgggacttgacactagaacccagacatggatgagcgcagaaggtgcttggcggcaagttgaaaaagtagaaacttgggcactacgccacccaggatttacaatactagccttattcttagcacattatattggtacatcgttaacgcaaaaagttgtaatatttatattgttaatgcttgtcaccccatcgatgactatgaggtgtgtaggagtgggtaatcgggactttgtggaaggactaagcggtgcaacttgggtcgatgtagtactagaacatggaggctgtgtgaccacaatggccaaaaataaaccaactttggatatagaactacagaaaaccgaagctacacaattagcaaccctccgaaaattatgtatagagggcaaaataacaaatataaccaccgactcaaggtgtcccacacaaggtgaggcaacactaccagaagaacaagatcaaaactacgtctgtaaacacacatatgtcgaccgaggatggggaaatggatgcggcctctttggtaaagggagcttagttacatgtgcaaaatttcaatgccttgaaccaattgaagggaaagtagttcaatacgagaacctaaaatatactgtcataatcacagtacacaccggggaccaacatcaggttggaaatggcacacagggagtcacagccgagataaccccgcaggcttcaactacggaggcaattttgccagagtacggaacattaggactggaatgttcaccccgaaccgggttagattttaatgaaatgatattattaacaatgaaaaataaggcttggatggtgcataggcaatggtttttcgatctgccgctaccatggacttctggtgcaacgaccgaaacgccgacctggaacaggaaagaactacttgtaacattcaaaaatgcccatgcaaagaaacaagaagtggtagtattgggatcacaggaaggagcaatgcacacagctttgacaggagctacggaaatccaaaattccggtgggaccggtatttttgctggacatctaaaatgcagattgaaaatggataaactagaactaaaaggaatgtcatacgctatgtgcaccaatacatttgttctcaagaaagaagtgagtgagactcagcatggcactatactcattaaagtggaatataaaggcgaagatgtgccctgcaaaattcccttcagtaccgaagatggacaaggtaaagctcataatggacgattaatcacagcaaacccagtcgtaactaagaaagaggaacctgtaaatattgaagctgaaccaccattcggagaaagtaacatagtcataggcattggggacaatgcattaaaaataaattggtataagaaagggagctcaataggaaaaatgtttgaggcgacagcacgaggggctaggagaatggcaatccttggggataccgcatgggacttcggcagtgttggaggggttttgaacagtctagggaaaatggtccatcaaatatttggctcagcgtatactgctctattcagcggagtaagttgggtaatgaaaattggaattggtgttctattaacttggattggtttaaacagcaaaaacacatctatgtcgttctcatgtatagcaatcggtattatcacgctatacctaggtgcagtagttcaagccgatatgggatgcgttatcaactggaaaggtaaagaattaaaatgcggtagcgggattttcgtaaccaatgaggttcatacatggacggaacagtataaattccaagcagatagtccgaaacggctcgctacagctattgctggggcatgggaaaatggcgtctgtgggattcgatccactacaagaatggaaaatttgctttggaaacaaattgcaaacgaactaaattatattttgtgggaaaataacataaaacttactgttgttgtaggggacataattggtgttcttgagcaaggaaaaagaacgttaactcctcaacccatggaattgaaatactcttggaaaacgtgggggaaagccaaaattgtaacggcagaaacccaaaactcaagtttcataatagatggccctaatacgccggaatgtccatctgtctcaagagcatggaatgtatgggaagtagaggactatggctttggtgtgttcaccactaacatatggctcaaactaagagaagtatatactcaattatgtgatcatcgcctgatgagtgcagcggttaaagatgaaagagcagtacatgcagacatgggatattggatcgaatctcagaaaaatggatcttggaaattggaaaaagcatcattaattgaggtaaaaacatgcacatggcccaaatcacacaccctttggagtaatggagttctggaaagtgacatgataatcccaaaaagtctagctggtccaatttcgcaacataaccacagaccaggatatcatacccagacagctggtccatggcatttaggcaaactagaattagactttaactattgcgaggggacaacagtagtaattacagaaaattgcggtacacgaggtcctagtcttcggacaaccactgtctcaggaaaattaatacatgaatggtgttgcagatcatgcaccttaccaccacttcggtacatgggggaagatggctgttggtacggtatggagattcgaccgatatcagaaaaagaagagaatatggtgaaatcattagtaagcgcgggatccggaaaagtagataatttcactatgggagtcctctgcctcgcgatcttattcgaggaagttatgagaggaaaatttggtaagaaacatatgatcgctggtgtattctttacatttgtgctcctcctcagtggacaaataacatggcgtgatatggcgcacacattgataatgataggttcaaatgcaagcgaccgaatgggtatgggcgtaacctacttagctctcatagccaccttcaaaatccaaccgttcctagcgctgggcttcttcttaagaaaactcacttcccgcgaaaaccttcttttaggggtaggactagcaatggcaaccacactacaattgcccgaagatattgaacagatggcaaatggaatagctctcggtctgatggccttaaaattaatcacccagtttgaaacataccaactttggacagcactaatttccttaacatgtagtaataccatttttacattaacagtcgcttggcgcaccgcaactttaatactagctggagtctctttattgccagtctgtcaaagcagttcgatgcgcaaaacagattggctgccaatggcggtggcagccatgggcgtcccgcccctaccgctgtttatctttgggctaaaagatacattgaaaagaaggtcgtggccattgaacgagggagttatggccgtaggtctagttagtatattagcttcaagcctactaaggaacgatgtacccatggctggtccactcgttgcgggcggtctactcatagcatgttacgtaataacaggtacatccgcagatttgacagtagaaaaagctgcagacatcacctgggaagaagaagctgagcaaacaggggtatcacacaaccttatgataacagttgatgacgatggaaccatgcgaattaaagacgatgaaactgaaaacatcttgaccgtccttcttaaaacagctttattgatagtaagtggcatttttccatattccattccggcaactctcttagtatggcatacatggcagaaacaaacgcagcgttccggggttctttgggatgtcccatcaccgccggagacccagaaagctgagttagaggagggagtgtaccgtatcaaacaacaaggtatatttggtaaaacacaagttggagttggagtacaaaaagaaggcgtcttccatacgatgtggcatgttacacgaggagcagttctaacatacaatggcaaacgactagaacctaattgggcgagcgttaagaaggatttaatatcatacggaggtggatggcgcttgtcggcacaatggcaaaagggcgaggaagtacaagttatagcagtggagcctggcaaaaacccgaaaaactttcagacgatgcctggaacatttcaaactacaacgggtgagataggtgcaatcgccttagatttcaaaccaggaacaagtgggagcccaattattaatcgggaaggcaaagtagtcggattgtacggcaatggtgtagtaaccaaaaacgggggttacgtatctggaatagcacagacgaatgctgaaccagatggacctacccctgaactagaagaggaaatgtttaagaaaagaaacttaactattatggatcttcatccaggctcaggcaaaacaagaaaatatttaccagcaattgtacgagaagctataaaacggcgattacgtaccctaatactcgcgccgactagagtcgtagccgcagaaatggaggaggcattgaagggattacctatccgatatcaaactactgctacaaagagtgagcacactggtagagaaatagtcgacctaatgtgtcatgcaacttttacaatgcgcttacttagtcctgtaagggtaccaaactataacttaattataatggacgaagcccattttaccgatcctgccagtatagcggctaggggctatataagtaccagggttgggatgggagaagcggcagcgatatttatgactgcaacaccccctggaactgcagatgcttttccgcagtccaatgccccgattcaagacgaagaaagagatataccagagagatcatggaactcgggaaacgaatggataactgactttgcgggtaaaacggtctggttcgtaccaagtatcaaagctggtaatgatatagcgaactgtctacgtaaaaacggcaagaaagtcatacaattatctaggaaaacttttgacacggagtaccagaaaactaaacttaacgactgggatttcgttgttacgacggatatatcagagatgggggcaaactttaaagctgatagagtaatagatccacgtagatgtctcaaaccagttattttaactgatggtcccgaaagggtcatattagctggtcctatgcctgtaactgccgcttcagctgctcaacgacgtggtagggttggaagaaacccccaaaaagaaaacgatcaatacatattcacaggacagccattaaataatgatgaagaccacgcgcattggacagaagccaagatgctactcgacaacataaacaccccagagggaattatacccgccttatttgaacctgagcgtgaaaaatccgcggctatcgatggcgaatatagactaaaaggtgaatcaaggaaaacgtttgttgaattaatgaggcgaggggatctaccggtttggttagctcataaagttgctagcgaaggaatcaagtatacagacaggaaatggtgcttcgatggacaaagaaacaatcaaatactagaagaaaatatggatgttgagatatggactaaagaaggagagaagaagaaattgagacctcgatggctagatgcaaggacgtatagcgatccgctggcattgaaagagtttaaagaatttgctgccggacggaaatcgatcgctttagatttggtaacagagatcggtagagtcccatcccacttggcccatagaacaaggaatgcattggataacctggtaatgttacatacctcagaacacggcggcagagcttacagacatgctgttgaagaacttcctgaaactatggaaacattacttcttttaggtttaatgatattgctcacaggaggagccatgttatttctaatctcaggcaaaggaatcggtaaaacgtcaataggccttatatgcgtaatagcctcgtctggcatgctatggatggcagagataccactacaatggatagcgagtgcaattgtactagagttctttatgatggtattgttaattccagaaccagaaaaacagcgcactccacaagataatcaattagcgtatgtagtcattgggattctaacactcgctgcgattatcgccgcgaacgaaatgggattattggaaactactaaacgggacttggggatgtctaaggaacccggagtcgtctcgccaacctcatacctggatgttgatctacatccggcatcggcatggactctatacgcagtagcaaccaccgtaataacacctatgctacgtcatacgatagaaaactcaacagccaatgtaagtttggctgcaatagccaaccaagcggttgtattaatggggctggataagggatggcctatctccaagatggacctaggagtaccgttactagcacttggatgctactctcaagtcaatcctctgacacttactgcggctgtacttcttctaataactcactacgcaatcataggcccaggtctacaagctaaagctaccagagaagcacagaaaagaacggctgctggaataatgaaaaacccaacagtagacggtataatgactatcgatttagatccagtcatatatgatagcaaattcgaaaaacagttggggcaggttatgcttttggtattatgcgcagttcagttactacttatgagaacaagctgggcactatgcgaagcactaaccctagcaacaggcccaataacaacgctatgggaaggctcacctggtaaattctggaacactacaattgcagtctctatggcgaacatatttagaggttcataccttgctggagctgggcttgcattctccattatgaagtcagtcggtaccggaaaaagaggaactggatcacaaggtgagactctcggagagaagtggaagaagaaattaaaccaactatcgaggaaagatttcgacctatataagaaaagtggtataacagaggttgatcgaacagaggcaaaagaaggactgaaacgaggtgagatcacgcatcatgcagtttcaagggggtccgcaaaactacagtggttcgttgaacggaacatggttatacctgagggtcgtgtaatagatctagggtgtggtagaggagggtggtcgtattattgtgcagggctaaagaaagtaacagaggtccgaggttacacaaaaggagggccaggacatgaagaacccgtacctatgtctacatacggctggaatatagtgaaactaatgtcaggcaaagacgtattctacttacccccagaaaaatgcgacaccctattatgtgacattggtgaatcaagtccgtcgccgacagtcgaggaatctaggacaataagagtacttaaaatggttgaaccatggctaaagaataaccagttctgtatcaaagttttaaatccatatatgcccacagtcatagaacatttggaaagattgcaaaggaaacatgggggcatgctagtaagaaacccattatctcgtaacagtactcatgaaatgtactggatttcaaatggcactgggaatatagttgcatctgtaaacatggtatcacgtcttctcctgaacagattcactatgactcatcgacgccctacgatagagaaagacgtagatctaggtgccggtacacgacatgtcaatgctgaaccagaaacaccaaacatggaagtaataggcgaacgaatcaagagaattaaagaggagcacaatagcacttggcactatgacgatgaaaacccatataaaacatgggcctaccacggttcatacgaagtaaaagcaacgggttctgcaagtagcatgatcaacggcgttgtaaaactcttgacaaaaccttgggacgtagtcccaatggtaactcagatggccatgacagatactaccccatttggtcaacagagagtcttcaaagagaaagttgacactagaaccccaaggagtatgcccggaacgagacgcgtaatgggaataacagccgagtggttatggcgcacactgggtagaaacaagaaacctagactatgcacccgggaagaatttacgaagaaagtacgaacaaatgcagccatgggagctgtattcactgaggagaatcagtgggattccgctaaagcagccgtagaagacgaagacttttggaaacttgtggacagagaaagagaactgcataaattaggtaaatgtggttcctgtgtatataacatgatggggaagcgtgagaagaaacttggagagttcggtaaagcgaaaggctccagagcaatatggtacatgtggttaggagccagatatttagaatttgaagcattaggattcctaaacgaagaccattggtttagcagagaaaattcatatagcggagttgaaggggaaggtttacataaattgggttatatattgagagatatctctaaaattccgggaggcgccatgtacgcagatgatactgctggttgggacacgaggataacagaagatgacctccataacgaagagaaaattacccaacaaatggatccagagcatcgacagcttgccgacgctatatttaagttaacataccagaataaggttgtaaaagttcagcggcccacaccaacaggaactgtaatggacatcatatcaagaaaagaccaacggggatcaggacaggttggtacatatgggctaaatactttcacaaacatggaagctcaactaattagacagatggaaggagaaggagtactaagtaaagctgatctggaaaatccccacctaccggaaaagaaaatcacacaatggctagaaactaagggagtggaaaggttgaaacgtatggcaatatcaggcgatgactgcgtcgtcaaacctatagacgatcgctttgcaaatgcacttctagcacttaacgatatggggaaggtacgaaaagacattcctcagtggcaaccgagtaagggttggcatgattggcagcaagtgcctttttgttctcaccacttccatgagctgattatgaaagatggaagaaagttagtggtcccgtgcagaccgcaggatgaactcatcgggagagcgcgtatttcacagggagccggatggtcattaaaagagacagcatgtttaggcaaagcatacgcacaaatgtggtcccttatgtattttcaccgaagagaccttagacttgcaagtaatgctatttgtagcgcagtaccagtgcactgggtgcccacaagtaggaccacgtggtcgattcatgctcaccatcaatggatgacaacagaagatatgttaacagtgtggaacagagtatggattgaagataatccttggatggaagacaaaacgccagtaactacttgggaaaacgtaccttatcttgggaaaagagaagaccagtggtgcggaagtctaatcggactaacgtcccgtgcaacttgggctcaaaatatcccaactgcaatacaacaagtccgatccttaataggcaatgaagagttcttagactatatgccatcaatgaaacggtttcgaaaagaagaagagtcagaaggagctatatggtag

SEQ ID NO: 23221 - RNA, 9873 nt, synthetic construct
  misc_feature 1..9873: note = derived and/or modified CDS sequence (opt6) from DENV-3__JF920397__SS-prME
  source 1..9873: mol_type = other RNA
acttcactgtgtcttatgatgatccttccagctgcactagcatttcacttgacatcgagagacggtgaacctagaatgatagtcggcaaaaatgaacgaggaaaatcattgttgttcaaaacggcatccggaatcaacatgtgtacactaattgcaatggacctgggagaaatgtgtgacgacactgtcacatataaatgtccacacattacagaagttgaaccggaagacatagactgttggtgtaatctaacgtctacctgggtcacgtacggtacttgtaatcaagctggagaacaccgcagagataaaagatcagtcgctttagcgccacatgtcggaatggggttagatacaagaacacaaacatggatgtccgcggaaggagcgtggagacaagtagaaaaagtagaaacttgggctctacggcatcctggatttacaatactagcgctatttttggctcactacattggaacgtcattaacacaaaaagtagtcatctttattctcttaatgctagtcactccatccatgactatgcgctgcgttggagtaggtaatagagatttcgtcgaagggttaagtggagctacttgggttgatgtggtcctcgaacatggagggtgtgttaccacaatggcgaaaaataaacctactctggatatagaactacagaaaaccgaagcaacacaactggctacactaagaaaactatgcatagaaggaaaaatcacgaacataacaacagatagtagatgccccactcaaggagaagccacattgccagaagaacaagatcaaaactatgtatgtaaacacacctatgtggatcgaggatggggtaacgggtgtgggctgtttggaaaaggaagtcttgtaacatgcgcaaaattccaatgtctagaaccgattgaaggaaaagttgttcaacacgaaaatctaaaatatacggtaatcatcactgtacatacaggggatcaacaccaagtgggcaatgaaacacagggggtaacggcagaaataacacctcaagcgtcgactacagaagcaatcctaccagagtatgggacattgggattagaatgcagtccaagaacaggcctagacttcaacgaaatgatcttattaacaatgaaaaataaagcgtggatggtacatcgacagtggttcttcgacttacccctaccatggacctctggagctacaactgaaacacccacatggaatcgcaaagatctattggtaacatttaaaaatgcacatgctaagaaacaagaagtagtcgttcttggtagtcaagaaggggccatgcacacagcattaacaggggctacagagatacaaaatagtggcgggacatctatcttcgcaggtcatctgaaatgtagattaaaaatggacaaactagaactgaaaggaatgagctatgcaatgtgcactaatacattcgtcctcaagaaagaagttagcgaaacacagcatggcacaattttaatcaaagtagagtataaaggcgaagatgttccttgtaaaataccgttttcgactgaggacggtcaggggaaagcccataatggccgattaataacagccaacccagtagtgactaagaaagaagaaccagtgaatattgaggcagaaccaccattcggcgagtcaaacatagtcataggtattggagacaacgccctaaaaattaattggtataagaaaggatcatctatcggaaaaatgttcgaagctacggcaagaggggcgcgaagaatggcgatattaggcgataccgcttgggacttcggctcagtcgggggagtgttgaacagcttagggaaaatggtgcatcagatatttggaagtgcatacactgcattgttctctggagtaagttgggtaatgaaaataggaataggagtattattaacctggattggcctcaactcgaaaaatacttctatgtcgttcagctgcatagcaattggaataattacactatacctcggagccgtcgtacaggcagatatgggctgtgtcattaactggaaaggaaaagaacttaaatgtgggagcgggatttttgttactaatgaggtgcatacatggacagaacaatacaaattccaggcggatagtccgaaaagattagcgactgcaatagccggcgcctgggaaaatggcgtttgcggtatcagatcaactacgcgcatggaaaatctactttggaaacaaatagctaatgaactaaattatatcctatgggaaaataatataaaacttacggttgtagtgggagatatcatcggagtacttgaacaaggtaaacgaactctaacaccgcaaccaatggagttaaaatatagctggaaaacatggggaaaagctaaaattgtcacagcagaaacgcaaaatagtagttttataatagatggtcctaacacgccggagtgtccttcagtaagccgtgcttggaatgtgtgggaagttgaggattatggctttggtgtatttacaactaatatatggctaaaattgagagaggtttacacgcagctttgcgatcatcgactgatgtctgcagcggttaaagatgaacgcgctgtgcatgcagatatgggctactggatcgaatcacaaaagaatggaagttggaaactagaaaaagccagcttaatagaggtaaaaacctgtacctggccgaaaagtcatactttatggagtaatggtgtgttagagtcggatatgataatcccgaaaagcctggcaggaccaatttcacagcataaccatagacctggctaccatacacaaacagcaggcccgtggcacctaggaaagctagaattagatttcaattactgcgagggcaccacagttgttattacggagaactgcggaacacgaggaccttcattaagaactactactgtaagtggaaaactaatacacgaatggtgctgtagatcttgtacgttaccaccactcagatatatgggcgaagacggatgctggtatggaatggaaatacggcccatatcggagaaagaggaaaatatggtaaagtctttggtaagcgcgggaagtggaaaagttgataactttaccatgggcgtgctgtgtctagctatccttttcgaagaagtgatgaggggtaaatttggcaagaaacatatgatagcaggcgtatttttcacatttgtactactattgtctgggcaaattacgtggagagatatggcgcatacactgataatgattggctcgaacgccagtgatcgtatggggatgggagtaacctacctggcactaatagcaacctttaagatacagccctttcttgcattaggattcttcctacgaaaattaacttcacgggagaatcttctactcggagtaggacttgccatggcgacaacgttgcaactaccagaagatatcgaacaaatggctaatggcattgcacttggcttaatggcattaaagctcattacacaattcgagatctatcaactttggacagcattaatttcattaacgtgcagcaatacaatatttactctaaccgttgcatggagaaccgccacattgatccttgctggagtatcattactacccatgtgtcaatcaagttccatgcgaaagaccgactggttacccatggcagttgcagcaatgggagttccccctttaccactgtttatattttccttaaaagatacgttaaaaaggagaagttggccactaaacgaaggagtgatggcagtgggccttgtaagtatattggcaagtagtttactaagaaatgatgtaccgatggcgggaccgctggtggctggaggtttactgattgcttgttacgtaataactggcaccagtgctgatttaacggtagaaaaagccgcagacataacttgggaagaagaagcagaacaaacaggagtatcacataacctcatgattacagtagacgacgatgggaccatgcgcattaaagacgacgaaacagagaacattctaacggttctgctgaaaacagctttgttaattgttagtggaatattcccttactcaattcccgcaacactactcgtttggcatacttggcagaagcaaacacaaagatcaggtgtcctatgggatgtccctagtcctcccgaaacccagaaagctgagttagaggagggagtctaccggatcaaacaacagggtatcttcggaaagacgcaagtaggcgtcggtgttcaaaaggagggtgtgtttcacacaatgtggcatgtaacaagaggtgcagtcctgacatacaatggaaaacgccttgaacccaactgggcctcagttaagaaagatctcatttcatacggtgggggatggaggctaagtacccaatggcagaaaggagaagaagtacaagtcattgcagtagaaccgggcaaaaaccctaaaaacttccaaacaatgccggggacgttccaaacaaccactggagaaattggtgctatagcactagacttcaaaccaggaacaagcggatctcctataataaaccgtgaaggcaaggtagttggtctatatggaaatggagttgtaactaaaaatggaggatatgtgtcaggaatagcccagacgaatgccgaaccagatggaccaacaccggaacttgaagaggaaatgtttaagaaaagaaacttaacaataatggatttgcacccaggatctggaaagacaagaaaatatctaccagcaatagtaagagaagcgatcaaaagacgacttcgtacgcttatattggctccgacgagagttgtagctgcagaaatggaagaagcgcttaaaggactgcctatccgatatcaaacgacagcaacaaaatcggaacatacaggtagagaaatagtagacttaatgtgtcacgcaacattcacaatgcgcctgttaagcccagttagagtacctaactataatttaattataatggacgaggcacactttactgatcccgcttcaatagcagcgaggggctatatttctacgagagtaggcatgggagaagctgcagcaatttttatgactgcaaccccgccaggaacggctgatgcatttccacagagcaatgctcctatacaagacgaagaaagagacatcccggagagaagctggaatagtgggaatgagtggatcactgattttgctggtaaaacagtatggtttgtcccctcaattaaagcgggaaatgacatagccaactgcctaaggaaaaacggtaagaaagttattcagctaagcaggaagacattcgatactgaatatcaaaagactaaattaaacgactgggactttgtagtaaccacggatataagcgaaatgggcgccaacttcaaagcagatagagttatcgatccccgtagatgcttaaaacccgttattctgactgatggcccagagagagtcatacttgccggtcctatgccagtgactgcggcatcagctgcacaaagaagaggtagagtaggccgcaatccccaaaaggaaaacgatcaatatatttttaccggccaacctttaaataatgatgaagatcatgcgcactggactgaagctaaaatgttactggataatattaacacaccggaaggaataattccagctctatttgaacccgaacgagaaaagtctgcagcaatagatggggaatacagattgaaaggagaaagtcgtaaaacattcgttgaattaatgagaaggggagacttacccgtgtggctggctcataaagtcgcaagcgaaggaatcaagtacactgaccgaaagtggtgttttgacggacaaagaaataatcaaatactagaagaaaacatggatgtcgagatttggacaaaggaaggagagaagaagaaactaagaccgagatggttagatgctaggacctacagcgatccattagctcttaaagagttcaaagagttcgctgcgggtagaaaatctatcgcactagatttagtaacagaaatcggaagggtcccttcgcatttagctcacagaacgagaaatgcattggataaccttgtgatgctacacacatcagaacacggtggcagagcctatcgccatgcagtagaagaattacccgaaacaatggaaacattattactgttaggactaatgatactccttacaggaggtgcaatgctattccttataagcggaaaaggaataggaaaaaccagtatagggctcatatgcgtgattgcttcgagtggtatgttatggatggctgaaatccctttgcagtggatagcctcagccattgtattggagttctttatgatggtactactcatcccggagccagaaaagcagagaacgccccaagacaaccaactggcatatgttgtcatcggaattttaacccttgccgcaattattgctgcgaatgaaatggggttgttggagacaacaaagagggatttgggaatgtcaaaagaacccggagtagtttcgcctacaagttatttagacgtcgacttacatcctgcgtcagcatggacactctatgcggtggctactactgttataacaccgatgttacgacacacaatagaaaactcaacagcaaatgttagccttgccgcaatagccaatcaggccgtagtactcatgggactggacaaaggttggccgatttcaaagatggacttaggagttccattactagcactagggtgttacagccaagtaaatccgctgacacttaccgctgctgttttgctgcttataactcactacgctataatagggcccggtttacaagcgaaagcgacaagggaagcacagaaaagaacagcagccgggattatgaaaaatccaactgtagacggaatcatgacaattgatttggaccccgtcatatatgatagtaaatttgaaaaacagcttggtcaagttatgttgctggtattatgcgtagtacaattactcttaatgagaacttcatgggcgttatgtgaagcactaacactagccacaggtccaataacgaccttgtgggaaggaagtcccggaaaattttggaataccacaatagctgtaagcatggctaatattttcagaggtagttacttagcaggagctggtttggcgttttctataatgaaaagtgtaggtacagggaagcgaggaacgggcagtcagggtgaaacactcggggagaaatggaagaagaaactaaatcagttgagtaggaaggattttgacctttacaagaaatctggtataaccgaggttgaccgaacggaggctaaagagggactcaaacgtggcgaaataacacaccatgccgtgtcaagaggttccgccaaacttcagtggtttgttgaaagaaatatggttatacctgaggggcgagtaatagatttaggatgtggccggggaggctggagttactattgcgcgggattaaagaaagtaacggaagtacgtggttatacgaaaggaggacccggtcacgaagaacctgtccctatgtcaacgtatgggtggaatatagtgaaactaatgtcgggaaaagacgtattttacttgcccccagaaaaatgcgacaccctactttgtgacattggagaaagtagtccgagtccaacggtcgaagaatctagaaccataagagtcttaaaaatggtagaaccatggctcaaaaacaatcaattctgcattaaggttctgaacccatatatgccaaccgttatagagcacttggaaaggctgcaacgtaaacatggagggatgctagtgagaaatccattaagccgtaattcaacccatgaaatgtattggatatctaacggcacgggaaatatcgttgcaagcgttaatatggtatcaagacttctattaaaccgatttacgatgacacatcgaaggcctactatagagaaagatgttgacttaggagcaggcacccgacatgtaaacgcggagccagaaacgccgaacatggatgtcattggggaaagaattaaaagaataaaggaagaacacaactcgacatggcactacgatgatgaaaatccctataagacgtgggcttatcatggcagttacgaagttaaagccacgggatcggcgagtagtatgattaatggagtcgtaaagctgttaacaaaaccgtgggacgttgtaccaatggttacccagatggctatgacggacaccactccttttggacaacaaagggtatttaaagaaaaagtggatacgcgcacacctagaagtatgcccggaacacgtagagtgatgggtataaccgccgaatggttatggaggacacttgggcggaataagaaacctcgactatgtactagggaagagttcaccaagaaagtgcgcacaaatgcagccatgggagccgtctttaccgaagaaaaccagtgggattctgcaaaggctgcagtagaagatgaggatttttggaaattggtcgaccgcgaacgagaactacataagctgggaaaatgtggaagctgcgtatacaatatgatggggaaaagagagaagaaacttggagaatttggtaaggcgaaaggatctcgcgcaatatggtatatgtggttgggggccagatacctagagttcgaagctcttggattcctaaatgaagaccactggttctcaagagagaactcgtatagtggggtagaaggagaaggcctacacaaattaggctacatcttacgagacatcagcaaaatacccggaggagctatgtatgctgatgatacggcgggttgggatacccggatcactgaagatgatcttcacaacgaagaaaagataacacaacagatggacccagaacatcggcaattagcaaacgcaatattcaaacttacataccaaaacaaggtagtaaaggtacaacgcccgacaccaaccggaacggtcatggatataatttcgcgaaaagaccaacgcggatccgggcaggtaggaacatatgggctaaatacattcaccaacatggaggcacagcttataagacaaatggaaggtgaaggggtacttagtaaggcagatcttgaaaacccacatctgccggaaaagaaaattacacaatggctagaaaccaaaggtgtagaacggctaaaacgaatggcaataagcggcgacgactgtgtagtaaagcctatcgatgacagatttgccaacgcgttattagcgttaaacgatatgggtaaagtccgtaaggacattccccaatggcagccatccaaaggttggcacgactggcagcaagttcctttttgctcacatcacttccacgaattaataatgaaagacgggcgcaagctagttgtaccctgccgccctcaagacgaactaattggcagagcgcgaatatcacaaggagcaggatggtctctcaaggaaacagcatgtcttggtaaggcatatgctcaaatgtggagcctcatgtattttcacagacgagatttgcgattagcatcgaatgcgatatgcagcgcagttcctgtccattgggtaccgacctctcggactacttggagcatacacgctcatcaccagtggatgacaaccgaggatatgctgactgtgtggaacagggtgtggattgaagataacccttggatggaagataaaaccccggttacaacatgggagaatgtaccatatctaggaaagcgggaggaccaatggtgtggctctcttataggccttacttctagagccacctgggcacaaaatattcccacagcaattcaacaagtacggagtctaataggaaacgaggagttcctagactatatgccaagcatgaagaggtttagaaaagaagaagaaagcgaaggcgctatttggtag

SEQ ID NO: 23222 - RNA, 9873 nt, synthetic construct
  misc_feature 1..9873: note = derived and/or modified CDS sequence (opt6) from DENV-3__JN093513__SS-prME
  source 1..9873: mol_type = other RNA
acatctctatgtttgatgatgatattacccgcagcgctagcttttcatttaacctcaagagacggtgaaccaagaatgatagtaggcaaaaatgaacgcggaaaaagtctactatttaaaacagcatccggaataaacatgtgtaccttaattgcaatggacctgggagaaatgtgtgacgacactgtaacctataaatgcccacacattaccgaggtagagccagaagatatagattgttggtgtaatctcacctcgacatgggtaacatacggtacttgtaatcaagctggagagcatagaagagataaacgcagtgtagctctggccccacatgtgggtatgggattagacaccagaacccaaacatggatgagtgctgaaggagcatggagacaagtagagaaagtggaaacatgggcgctaaggcacccgggatttacgattcttgctttatttttagctcattacataggaacctcacttacacaaaaagtagtaatctttattttactaatgcttgttactccatcaatgacaatgcgctgcgtaggagttggaaatcgagacttcgtagaaggtttgtcgggagcaacgtgggtagatgttgtacttgaacatggcggatgtgttacgacaatggctaaaaataaacccactttagatatagaactacagaaaacagaggctacgcaattggcgacattgcgaaaactatgcatagaaggtaaaatcacaaatataacgacagattccagatgtcccacacaaggcgaagcaacattgccagaggaacaagatcaaaattatgtttgtaaacatacttacgtagacagagggtggggcaacggttgtggattattcgggaaaggatccttagtaacttgtgctaaatttcaatgccttgaacccatagagggtaaagtagttcaacatgaaaatttaaaatatactgttataataacagtgcatacaggagatcaacaccaagtcggcaatgagacacaaggtgtaaccgccgaaatcacgcctcaagccagtactaccgaggcaattctacctgagtatggaacgcttgggctagaatgttctccacgaacaggtctagacttcaatgaaatgatcttactaactatgaaaaataaagcatggatggtacacagacaatggttctttgatttaccactgccctggacatccggagccacgaccgaaacaccaacatggaataggaaagaactattagtcacctttaaaaatgcacatgcgaagaaacaagaagtggttgttttaggcagccaagaaggtgcaatgcatactgcattgaccggggcaactgagatccagaatagcgggggtactagcatctttgcagggcacttgaaatgtcggctgaaaatggacaagttagaactaaaaggcatgtcttatgctatgtgtactaatacatttgtattaaagaaagaggtatcagaaactcaacatggaactattttgattaaagtagagtataaaggtgaggatgtcccatgcaagattcctttcagcacagaagatggtcaaggcaaagcacacaacggaaggttaataacggccaatccagtggtaacaaagaaagaagaacccgtcaatattgaagctgagcctcccttcggtgaatccaatatagttatcggaattggggacaacgccctaaaaatcaattggtataagaaaggatcttcaattggcaaaatgtttgaagcaactgcacgtggagcaagacgcatggcaatcttaggagacaccgcgtgggatttcggatcggtcggaggagtattaaattctcttggaaaaatggtccatcaaatctttggaagcgcatacacagctttatttagcggagtctcgtgggtaatgaaaatcggtattggagtactacttacctggatcggtctaaacagtaaaaacacatcgatgagtttttcgtgcattgccattggaatcataacattatatcttggtgcggttgtacaagcggatatgggctgtgtcataaattggaaaggcaaagaactcaaatgcggatctggcatattcgtaactaatgaggttcatacctggacagaacagtacaagtttcaggcagattctccaaaaagattagctacggcgatagcaggcgcctgggaaaatggggtatgtggtatacgttcaacgacccggatggagaatctactctggaaacaaatagctaatgaactaaactacatactatgggaaaataatattaaactaactgtagtagtcggggacataataggggtactagaacaaggaaaacgaacattgacgccacaaccaatggagcttaaatactcatggaagacatggggaaaagctaaaattgttacagccgaaacccaaaattcgtcatttataatcgatggaccaaatacacccgaatgtccatcggtgtcacgagcttggaatgtctgggaggtcgaagattacggatttggagtctttactaccaatatttggcttaaactaagagaagtatacacacaactgtgtgaccacagactaatgtcggctgcggtaaaggacgagagagcagtacatgcagatatgggttactggattgaatcacagaaaaatggctcatggaagttggaaaaggccagtttaatcgaggttaagacttgtacatggcctaagtcgcatactctctggagtaatggagtccttgaaagcgatatgatcatcccaaagtcactggctggtccaataagccaacataaccatcgtcccggttatcacacgcaaacagcaggaccatggcatttgggcaaactagaactagatttcaattactgtgaaggaaccacggttgtgataactgaaaattgtggaacacgaggaccatctctcagaacaacgacagtaagtggaaaattaatccatgaatggtgctgtaggagctgcactctccctccgttaaggtacatgggtgaagacgggtgttggtatggaatggaaattcgacccatcagtgaaaaggaagaaaatatggtgaaaagtttggtgagcgcaggcagcggaaaagtagacaactttacaatgggcgtactatgtttagcaattctatttgaagaagtaatgcgaggaaaatttggcaagaaacacatgatagcaggggtgttctttacatttgtattactattaagtggtcaaatcacatggcgcgatatggctcatacactcatcatgataggtagcaacacatccgaccgaatgggaatgggcgtaacatatttggcattgattgcaacctttaaaatacaacccttcctggctttaggattctttttaaggaagttaacttcacgagaaaatctattgctaggggtgggcttagcgatggctacaacgttgcaactaccggaagatatagaacaaatggcaaacggtatagcattaggtttaatggcacttaaactaataacacagttcgaaatataccaactttggactgcccttatatcgttaacctgttcgaatacaatttttactctcactgtagcatggagaacagcgacactcatcttagcgggcgtcagtttactacctgtctgtcagagttcatcaatgagaaaaaccgattggttgcctatggcagtcgcggctatgggggtacctccgctacccttattcatattcgggctcaaagacacattgaaaaggagatcctggcccttgaatgaaggagttatggcagttggcctagtaagcatattggcatcatccctgctgagaaacgacgtgccaatggcaggtcctctagtcgctggtggactgctaattgcatgttatgtgattacggggacctctgcagatttaactgtggaaaaagcggcggatattacctgggaggaggaagcggaacaaactggagtttctcataatttgatgataaccgtggacgacgatggtacaatgaggattaaggatgatgaaaccgaaaacattcttacagtgctgctgaagacggcacttttgattgttagtggcatattcccatattctatccccgccacactcctggtatggcacacctggcagaaacaaacacaaaggagtggagttttgtgggatgtgccaagcccacccgaaacgcaaaaagccgaattagaagaaggagtctatcgaataaagcaacagggtatatttgggaaaactcaagttggcgtcggagtacaaaaggaaggcgtcttccatactatgtggcacgtaaccagaggagctgttctaacatacaatggaaagagacttgaaccaaattgggcgtctgtcaagaaagatttgatctcatatggtggtgggtggagactctctgcacagtggcaaaaaggcgaagaggtgcaagtgatcgcagtggagcccggaaagaaccccaaaaattttcaaacgatgcctggcacctttcagaccacgacaggagagattggggccattgcgctagacttcaaacctggcacgagtggatcaccaataataaatagggagggcaaagtggtaggactatatggaaatggcgtagttaccaaaaacggagggtacgtatcgggtatagctcaaacaaatgcagaaccagacggccccacaccagaactagaagaagagatgttcaagaaacgtaacttgacaattatggatttgcacccagggagcggtaaaacgaggaaatacttacccgctatagtgagagaagccatcaaaaggagactccggacactaatattagctcctacacgtgtcgtggccgctgaaatggaggaagctctaaagggcctaccgatacgttatcaaacaactgcaaccaaatccgagcacacaggtagagagatagtagatcttatgtgccatgcgacattcacaatgcgtttactgtcacccgtgagagttccaaactacaatttaataattatggacgaggcacattttacggatcccgctagcatcgcagcacgtggttatatctcaacacgtgtaggcatgggggaggcggcagctatctttatgacagcaacacctcctggaacagctgatgcatttccccaatctaatgcaccaatccaggacgaagagagagatatccccgagcgttcgtggaactccgggaacgagtggattaccgattttgcaggtaaaacagtttggtttgtaccttccatcaaagctggtaatgacattgccaattgcttaaggaaaaatggcaagaaagtcattcaactgtcaagaaagacttttgataccgagtatcagaaaactaaactaaacgattgggatttcgtagtcactaccgatatatcagagatgggagctaattttaaagcagatcgagtaatagatccacgtagatgtctaaaaccggtaattttaaccgatggacccgagagggtcatattagcaggaccaatgcccgttacagcagcttcagcagcgcaaagacggggacgagtaggacgaaatccccagaaagagaatgatcaatatatcttcaccggacagcctttaaacaatgatgaagatcacgctcattggactgaagccaagatgttgttggataatataaatacaccggagggtataataccagccctatttgagcccgaacgagaaaaatcagcagctatagacggtgagtatcggctcaaaggagaatcacgcaaaacattcgtagaactcatgaggagaggtgatctacccgtctggctggctcataaagtagcatctgagggaattaaatacactgacagaaaatggtgttttgatggccaaagaaataatcaaatcctagaggagaacatggatgttgaaatatggacgaaagaaggggaaaagaagaaattacgaccgcgttggttagatgctcggacctattctgaccctttggccttaaaggaatttaaagagttcgccgccggaagaaaatcgattgcgttggaccttgtaacagagataggaagagttccttcacatttagcccatcgaacccggaatgcactcgataatttagtaatgcttcatacatcagaacatggagggagagcgtatagacacgcggtagaagagttaccagaaacaatggaaacactattattactcgggcttatgattctcttaaccggtggagccatgttatttttaattagcggaaaaggtattggaaaaacgagtatcggattaatatgcgtaattgctagtagcggaatgctatggatggccgaaataccactacaatggatagcatcagcgattgtattagagttctttatgatggtgttgctaatccctgagccggaaaaacaacgaacaccccaagacaaccaactagcttatgttgttataggcatactaacactagcggcaataatagctgcaaacgagatggggcttttggaaactacgaaacgtgatttggggatgtccaaagaaccaggggttgttagtccaacatcctatctggatgtcgatttacaccctgctagcgcatggactttatatgcggtagccacgacagtgataacaccgatgctaagacacaccatagaaaattcaactgcgaatgttagtttagccgcaattgcaaatcaggcagtagtattaatgggcctggacaaggggtggcctatctctaaaatggatctaggtgttccactactcgccctgggttgttatagccaagtaaatccacttacactaacagcggcggttcttctactaataacgcattatgctataatcggtccgggattacaagcaaaagcaacacgggaagctcagaaacgaaccgctgcgggtatcatgaaaaatcccacagtagatggaattatgacaattgatctagacccagttatttacgactccaaattcgagaagcaactcgggcaagtcatgttgttggtgctttgcgcagtccaattattattgatgaggacatcttgggcgttatgcgaagcactcactttagctacggggccgatcacaaccctatgggaaggatctccggggaaattctggaatacgaccatagccgtatctatggcaaatatctttaggggtagctacctagcaggcgcagggctcgcatttagcattatgaaatctgtggggaccggaaaaaggggtacgggatcacagggcgaaactctaggagaaaagtggaaaaagaaacttaatcaactttcgagaaaagactttgatttgtacaagaaatcaggaattacggaagttgaccggactgaagcgaaggaagggctgaaaagaggagagataacgcatcatgctgtgagccgtggaagtgcgaagttacagtggttcgttgaaagaaatatggttataccggaggggagagtaattgatttggggtgcggcaggggcggctggtcatattattgcgctggacttaagaaagtaacagaagtcagaggatatactaagggaggaccagggcacgaagaacctgttccaatgagcacctacgggtggaatattgtaaaacttatgtccggaaaggatgtgttctaccttccgccagagaagtgtgatacactactgtgtgatataggagaatcctcgcctagccctactgtggaagaatcaagaacgataagagttttaaaaatggtagagccatggctcaaaaataaccaattctgcataaaagttctaaatccttatatgcctacagtaatcgaacatctcgaaagactacaaagaaaacatggtggcatgttagtgaggaacccactaagcagaaacagtacgcacgaaatgtactggatttcaaatggaacaggaaatattgttgcatcagtaaatatggtatcaaggctattattaaacaggttcacgatgacgcataggcgacctaccatagaaaaagatgttgacctcggcgctggaacaagacatgttaacgctgaaccggaaacaccaaacatggatgttataggcgaaagaataaaaaggatcaaagaggaacataattcgacctggcactatgatgacgaaaacccatataaaacttgggcatatcatggttcatatgaagttaaagctacaggcagcgcaagttcaatgataaatggtgtcgtgaagttattaactaaaccttgggatgtcgttccgatggtaacccagatggcgatgaccgatacaacgccatttggacaacaaagagtatttaaagaaaaggttgacactcgcacaccgcgctcgatgcccggaacaagacgagtaatgggaatcacagcagagtggctatggcgaacacttggaagaaacaaaaagcctcggctatgtacgcgggaagagtttaccaagaaagtcagaacaaacgccgcaatgggggctgtatttacagaagaaaatcaatgggacagtgcgaaagccgcagtcgaagatgaagatttttggaaattagtcgatagagaaagagaactacacaaattgggaaaatgtggatcctgcgtatataacatgatggggaaacgggaaaagaaactaggtgaatttggaaaggccaaaggtagtcgagctatatggtacatgtggcttggagcaaggtacttggagtttgaagccctaggttttcttaatgaagatcattggttctcaagagaaaacagttacagtggagttgaaggtgaagggttacacaaattaggatatatcttaagagatatttcaaaaatccccggaggtgcaatgtacgcagatgacacagcgggctgggacacaagaattaccgaggatgatttacataatgaagagaaaatcacacaacaaatggaccctgaacatcgtcaactagcaaacgccatttttaagctaacttatcaaaacaaggtcgtgaaagttcaacgacctactccgactggaaccgtgatggatataataagtagaaaagatcaacgtggatcgggccaagtgggaacttacggtttaaatacttttactaatatggaggctcagctgataagacaaatggagggagaaggagtattatctaaagcagatctggagaatcctcatttaccagagaagaaaatcacccaatggttggaaacaaaaggcgttgaacgcttaaagagaatggcaatttcaggcgacgattgcgtagttaaacctattgatgacagatttgcaaatgctctcttggctttaaatgacatgggcaaagtgagaaaagacatacctcaatggcagcccagcaaaggatggcacgattggcagcaagttcctttttgtagtcatcactttcacgaactaatcatgaaggatggcagaaagctagtagtcccttgcaggccacaagacgaattaattggcagagctagaatctcacagggagccggatggtctctaaaagaaaccgcctgtctcggtaaagcctatgctcaaatgtggtcactaatgtacttccatagaagagatttacggttagcgtcaaacgcaatatgttcggcagtaccagtccactgggtacccacgtcgcgcaccacatggagtatacatgctcaccaccaatggatgacaacggaagatatgctaacagtatggaatcgtgtgtggatagaagataatccgtggatggaggataaaacacccgttacaacatgggaaaatgtaccttacctaggaaagagggaagaccaatggtgtggatctcttattgggcttacgagcagggcaacgtgggcacaaaacattccaacggcaatacagcaagttagatctttgataggaaatgaggaatttttagactacatgccttccatgaaaaggttccgaaaagaggaagaaagcgaaggagcaatatggtga

SEQ ID NO: 23223 - RNA, 9873 nt, synthetic construct
  misc_feature 1..9873: note = derived and/or modified CDS sequence (opt6) from DENV-3__JF937624__SS-prME
  source 1..9873: mol_type = other RNA
acgagtttgtgcttgatgatgatattaccggcagcacttgcttttcacctcacttcgagagatggtgaaccaagaatgatcgttggcaaaaacgaacgcggaaaatccctactatttaaaacagcgagcggaatcaatatgtgtacactcatagcaatggacttgggagaaatgtgtgacgatacggttacttacaaatgtcctcacattacagaagtcgagccggaagacattgactgttggtgcaatctaacttcaacgtgggttacttacggaacctgcaatcaagccggtgaacatcgtcgagacaaacgctctgtggctttagcaccgcacgttgggatggggttagatactagaacgcagacttggatgtctgcagagggggcatggcgccaagtcgagaaagtggaaacatgggctttaagacacccaggatttactatccttgcattatttctggcacactacattggaacatcactaactcagaaagtagtgatttttatattattaatgttggttacgcctagtatgacgatgagatgcgttggcgtaggtaatcgggactttgttgaaggactctcgggtgcaacctgggtggatgtagttcttgagcacggaggctgtgtcactactatggctaaaaataaacctacgctagatatagaactacagaaaaccgaagcaacacagctggcaaccttaagaaaactctgtattgaaggaaaaattacaaacattacgacggattcaagatgccctacacagggagaagcaacactcccggaagaacaagaccagaattacgtctgtaaacatacatatgtagataggggatggggcaacggctgtggcctctttgggaaaggatcattagtaacttgtgcaaaatttcaatgtctagaaccaatagaaggaaaagtggtccaatacgaaaacctcaaatatactgtaataataacagttcatacaggcgatcaacatcaagtaggcaatgaaacgcaaggcgttacagcggaaataacgccacaagcatcaaccactgaggctatattacccgaatatggtacattaggtttagaatgcagtccaagaaccggattggattttaacgaaatgattttgctaactatgaaaaataaagcatggatggttcacaggcagtggttctttgatttgcctctaccatggacaagtggcgctacaaccgaaactccgacatggaacagaaaagaactacttgtgacttttaaaaacgcccatgccaagaaacaggaagtggtagtccttggaagccaagagggcgctatgcatacggcacttacaggagcaacagagattcaaaacagcggtggtacttcaatttttgcaggccatttgaaatgtaggctgaaaatggataaacttgaattaaaagggatgagttatgctatgtgtaccaatacgttcgttttaaagaaagaagtttcagaaactcaacacggaacaatactaattaaagtcgagtataaaggtgaggatgtaccttgtaaaattccatttagtactgaggatggtcaaggtaaagcacacaatggcagattgattacagcaaatccggtggtaactaagaaagaagaacctgttaatatagaagcagagccaccttttggtgaatcaaatatagtaatcggaataggcgataacgcacttaaaataaattggtataagaaaggttcatccataggcaaaatgtttgaagctacagctagaggggcgcgcaggatggcaatcttaggagacactgcatgggactttggttcagtaggtggggtattaaattccctgggaaaaatggtacatcaaatattcggtagtgcgtacacagcgttattttcgggtgtatcctgggtgatgaaaataggaatcggagtattactcacctggataggactaaatagcaaaaacacaagtatgagcttctcatgcatagcgataggcataataactttatatctaggcgcagtggttcaagccgatatgggttgcgtcattaattggaaaggaaaagaattaaaatgcgggagcggtatattcgttacgaacgaggtccacacttggactgaacaatacaaatttcaagcggattccccaaaaagactagccacggctatagccggagcttgggaaaatggtgtttgcggtattcgaagtactacacgaatggagaacctcttatggaaacaaatcgctaacgaattaaattatatcttatgggaaaataacataaaattgaccgttgtggttggagatattataggagttctagaacaggggaaacgaaccctcacgccacaaccaatggaactgaaatatagttggaaaacatggggcaaagcaaaaatagtgacagccgaaacccaaaacagttcttttattattgacggaccgaatacgcccgaatgtccgtcggtaagcagagcgtggaacgtatgggaagtagaggattatggatttggtgtattcactactaatatttggctaaaattacgagaagtttatacacaattatgtgaccatcgtttaatgtctgctgcggtaaaagacgaacgggcagtacatgcggatatgggatattggatagaaagccagaaaaacggttcatggaaactcgaaaaagcatcactaatagaagtaaaaacgtgtacatggcccaaatcgcacacattatggtcgaacggagttttggaatcagatatgataatacccaagagcttggcggggcctatttcacaacacaaccatagacctggctaccatacccaaacagccggaccttggcacttaggaaaacttgaattggactttaactattgcgagggaacgacagtggttatcacggaaaattgtggtactaggggaccgtctctacgtacaacaacagtgagcgggaaattaatacacgaatggtgctgcagatcgtgcactttaccacctcttagatacatgggagaagatggatgttggtatggcatggaaattcggcctatcagcgaaaaagaggagaatatggtgaaatctttagtctctgcaggtagcggaaaagtcgataattttacaatgggtgtactttgcttagctattctatttgaagaagtcatgaggggtaaattcggcaagaaacatatgattgctggagtgtttttcacgttcgtactcttactgtccggtcagataacatggagggacatggcccacaccctaattatgatcggatcaaatgcatctgaccgaatgggcatgggggtaacgtatcttgcactaattgcaacattcaaaatacagccgttcctggccttaggattctttttgagaaaactaacatcacgggagaacctcctactgggtgtaggactcgcgatggctacgacgttacaactaccagaagacatagaacagatggcaaacggaattgcactcggcctcatggcgcttaaactgataacccaattcgagacataccaactatggacagctttaatatctctgacttgttcgaacacgatctttaccttgactgtggcttggagaacagcaaccctcattttagcgggtgtaagtttattaccagtttgtcaaagtagttcaatgcgtaaaactgattggttacccatggcagttgccgccatgggcgtaccaccattgcccttatttatctttggattaaaagatacattaaaaagaagaagttggcctttaaacgaaggagtgatggcagtaggactcgtctcgatcttagcgtcgagcctcttacgaaacgatgtacccatggctggacctttagtcgccggtggattattaatagcatgttatgtgatcactggaacttccgcagacctcacagttgagaaagcagccgatataacgtgggaagaagaggcggaacagactggagtgagccacaatctaatgataactgtcgacgatgacggaactatgagaatcaaagatgacgaaacagaaaatatattaactgtattacttaagacggcgttgctaattgtatcggggatattcccgtactctattccggcaactttattagtttggcatacatggcaaaagcaaactcagaggtcaggagtactgtgggatgtcccttcaccaccggaaacccaaaaggcagaactagaagagggggtataccggataaaacaacaaggaatattcggcaaaactcaagtaggagttggcgttcaaaaagaaggcgtctttcatacaatgtggcacgtaacacgaggggcagtacttacttataacggtaaaagactagagccgaattgggcatcggtcaagaaagatttgatttcgtacggtggaggatggaggttaagtgcccaatggcaaaaaggagaagaagttcaagtaattgcagtagaaccaggtaaaaatcctaaaaatttccagacgatgcccggtacatttcaaacaatcactggagagatcggcgcaattgctttagactttaaaccgggcacttccggttcacccataattaatagagaaggtaaggtagtaggactatacggtaatggagttgtaactaaaaacggtggatatgtaagcggaatagcccagactaatgctgaacccgatggaccaacacccgaacttgaagaagaaatgttcaagaaacgaaatcttaccataatggatcttcatcctggtagtggtaagacaagaaaatacctacctgcgattgtgcgagaagctataaagaggcgtcttaggaccttaatactggccccaacaagagtagtggcggctgaaatggaggaggcacttaaaggcctccccatacgataccagactaccgctaccaaatctgaacatacaggaagagagatagtggatttaatgtgtcatgctactttcacaatgcgtctgctgtctccagttagagttcctaactacaacttaattattatggacgaggcccacttcacagatcccgcatcgatagcagcaagaggatacatctccacaagagtgggtatgggggaagcagctgcaatttttatgacggctacgccgccaggaacagccgacgcgtttccccaatccaacgcaccaattcaagacgaggagagggatattccagaaagatcctggaacagcggaaacgaatggattacagattttgcaggaaaaactgtatggtttgtcccgtctatcaaagcaggtaacgacatagctaactgtttaaggaaaaacggcaagaaagtgatccaactaagtagaaaaacgtttgacaccgaatatcagaaaactaaactaaatgattgggatttcgttgtaacgacggatataagtgaaatgggagcgaattttaaggctgatcgagtgatagatccacgtcgatgtcttaagccagtaattttaaccgacgggcccgaacgagtgattttagctgggcctatgccggtgacagcagcatcagcagcgcaaagacggggcagagtaggtagaaacccccaaaaagaaaacgaccaatatatatttacagggcaaccattgaataatgacgaagatcatgcacattggaccgaagcgaaaatgctattagataacatcaacaccccagaagggataataccagcattattcgaacccgaacgtgaaaaatctgccgccatagacggagaatatagattaaaaggagaaagccgcaaaaccttcgtagaattaatgcgtcgcggtgatttaccagtatggctcgcacataaggttgcctcagaaggaattaaatatacggataggaaatggtgttttgacgggcaacgtaataatcaaattctagaagagaatatggacgtagaaatctggactaaagaaggagaaaagaagaaattacggcctcgttggctagacgcgagaacatatagtgacccattggccctcaaagaatttaaagaatttgcggcggggcgaaaatcgattgccttagacctggtaaccgagattgggagagtgccttcacatttggcgcacaggacaagaaatgcactagataaccttgtcatgttacatacatcagaacacgggggccgagcttatcgtcacgcagtggaagaactacctgaaactatggaaactttattactcttgggactaatgatactcctcaccgggggagcaatgttattcctcatatccggcaagggtataggtaaaacatccataggattaatttgtgtaatcgcatcctcaggtatgctatggatggcagaaatacccttacaatggatagcgagcgcgatcgtattggagttctttatgatggttctgttaatcccagaacctgagaaacagcgaacgccacaagataatcaacttgcgtacgttgtaatcggaatcctaaccttggccgccataatcgctgcaaatgagatgggactattagaaacgactaagagggacttggggatgagcaaggaaccgggagtagtgtcaccgacctcgtatctagatgtagacttgcacccagcatccgcatggaccctgtatgcagttgccacgacagtgattacgcctatgttaaggcatacaattgaaaatagtacagctaacgtctcattagcagccattgcgaaccaggcggttgttttaatgggattggacaagggttggccgatatctaaaatggacctaggagttccccttttggccttaggatgctattcacaagtaaacccgttaacgctaacagcggcagtactcttactaattacccactacgccattatcggtccaggactgcaagctaaagctacaagagaagcacaaaagcgaaccgctgcaggcataatgaaaaacccaactgtagacggtataatgacaatcgacctagaccctgtaatatacgattccaagtttgaaaaacaactggggcaagtgatgttattggttctatgtgctgtacaattactgctcatgcgcacttcatgggctttatgtgaagccctaacactggcaacaggaccaattacgacactgtgggaaggttctcccgggaaattttggaatacgacaatcgcagtttccatggcaaatatatttagaggaagctatttggcaggcgccggacttgcgtttagtattatgaagtccgtaggtactggtaaacgaggaacagggtctcaaggggagaccctcggtgagaagtggaagaagaaattaaatcaactctcaagaaaagattttgatctatacaagaaaagcgggatcacggaagtagatcgaacagaagcaaaagaaggactaaaaagaggtgaaattacacatcacgcagtctcaagaggctcggcaaaactccaatggtttgttgaaaggaatatggtaatacctgaaggacgtgtaatcgacctgggatgtggaagagggggctggtcatattattgtgctggtttaaagaaagttactgaagtgcggggatatacaaaaggcgggccgggacacgaggaaccagtaccgatgtcaacctatgggtggaatatcgttaaactaatgagtggaaaggatgtcttttacctgccacctgagaaatgcgacacgcttttatgcgatatcggtgagtcaagccccagtccgacagtcgaagaaagcagaacaatacgcgttctcaaaatggttgaaccttggttgaaaaacaaccaattttgcattaaggttctgaacccatacatgcctaccgttatagaacatttagagcgactacaacgaaaacatggaggcatgctagttcgaaacccactaagtagaaacagtacacatgaaatgtattggatttcaaatggaacgggaaacatcgtggcgtccgttaacatggtaagtcgtttactcttaaaccggttcacgatgacgcatagaaggcctacgatcgagaaggatgtagatctaggagcaggaacaagacacgtaaatgcagaacccgagacgccaaatatggatgttataggagagcggataaagaggattaaagaagaacataattcaacttggcattacgatgacgaaaatccttacaagacttgggcatatcatggatcatacgaggttaaggctacgggatcagcctcctctatgatcaatggagtagtaaaactcttaacgaaaccatgggatgttgttcctatggtaacacaaatggctatgacagatacgacacctttcggccaacaacgagtgtttaaagagaaggtagatactcgtacgccacgaagtatgccagggacacgaagaataatggggataactgcagagtggctgtggaggactcttggccgaaacaaaaagcctcgtctctgtaccagagaagaatttaccaagaaagttaggactaatgcggctatgggcgctgtcttcacagaagaaaaccagtgggacagcgcaaaagcagcggtcgaagatgaagacttttggaagttagtggatcgtgaaagggaattacataaactgggaaaatgcggttcatgtgtatacaacatgatgggcaaaagggagaagaaactaggtgagtttggaaaagcaaaggggagcagagcgatatggtatatgtggctcggagcacgatatttagaatttgaagcactaggatttttaaatgaagatcactggttctcaagagaaaattcatattcgggagtagagggagaagggttacataagttaggctacattttaagggatatttctaaaattcccggtggtgctatgtatgctgatgatacggctggttgggatacacggatcacggaagatgacttacataacgaagagaaaattacccagcaaatggatcccgaacaccgtcaattagctaacgccattttcaaattaacatatcagaataaagttgtgaaagtacaaagaccgacgcccacgggtacagtaatggacattatctctaggaaggatcagagaggatcaggacaagtagggacatatggactaaataccttcacaaatatggaagcgcaattaatcagacaaatggaaggagaaggagtccttagcaaggcagatttagaaaacccacacttaccggagaagaaaattactcaatggcttgagaccaaaggagttgaacgcttgaaacgtatggcaattagtggagacgattgtgtagtaaaaccgatagatgatcgattcgccaacgccctattagcgcttaatgatatgggaaaagtaagaaaggatattccacaatggcaaccatcgaaggggtggcacgattggcagcaagttcctttctgttcacatcacttccacgagctaataatgaaagacggcaggaagctagttgtgccatgtcggccgcaagacgaattaataggccgagcaagaatatcccagggagctggatggagtttgaaggagactgcctgcctgggaaaagcgtatgcacaaatgtggtcgctaatgtatttccataggcgtgatttacgtctcgcaagcaatgccatatgtagcgctgtaccggtacattgggtcccaacaagtaggacaacctggtcaatacatgcacatcaccaatggatgactactgaagacatgctgacggtatggaatagagtgtggatagaagataatccctggatggaagataaaacacctgtaaccacgtgggaaaatgtcccttacttaggtaaacgcgaagatcaatggtgtggcagtttaatcggtctaacatcaagagccacatgggctcaaaatataccaactgccatacaacaagtaagatccttaataggtaacgaagagttcttagattacatgcctagcatgaaacggtttagaaaagaagaagagagtgaaggagcaatttggtaa

SEQ ID NO: 23224 - RNA, 9873 nt, synthetic construct
  misc_feature 1..9873: note = derived and/or modified CDS sequence (opt6) from DENV-3__JN000938__SS-prME
  source 1..9873: mol_type = other RNA
acatcactatgcctaatgatgatcttaccagcggcactggccttccatttgacatcacgggacggagaaccccggatgattgtcggcaaaaatgaaagaggaaaaagtctgctgtttaaaactgctagtggaataaacatgtgtactctaatcgcaatggatctgggagaaatgtgcgacgatactgtaacatataaatgtcctcatataactgaagtcgaacctgaagacattgactgctggtgcaatctaacttccacgtgggtgacatacggtacctgtaatcaggcaggagaacataggcgtgataaaaggtcagtggcacttgcaccacatgttggaatgggtttagatactagaactcaaacttggatgtccgctgaaggggcatggagacaagtagaaaaagtggaaacttgggcgttaagacacccgggtttcaccattttggcgttattccttgcacattacataggtacatctttgacccaaaaagttgtcattttcattctattaatgctagtaaccccatcgatgacaatgagatgtgtcggagtaggaaacagagatttcgtcgaaggtctttcaggggcgacatgggtagacgtggttctagaacacggcggatgtgtgaccaccatggctaaaaacaaacctacactagatattgaacttcagaaaacagaggctacacagttagctaccctacggaaactctgcatagagggaaaaataactaatatcacaacagatagtcggtgtccaacacagggcgaggcaacactaccagaagaacaagatcaaaattacgtttgcaagcatacttatgtagatagaggatggggaaatggctgtggattatttggaaaaggtagtttagttacgtgtgcaaaatttcagtgtctagaacctattgaagggaaagttgttcaatacgagaacttaaaatatacggttattataactgttcacactggagatcaacatcaggtaggaaacgaaacgcaaggtgtaaccgctgaaattacgccccaggcaagtacaacagaggctattttacctgaatatggaactcttggattagagtgttcgcctagaactggcttggactttaacgaaatgatccttttaacaatgaagaacaaagcctggatggtacatcgtcaatggttctttgatttgcctttgccatggacttcaggggccactacagaaacacctacatggaatcgaaaggagctattagtaacattcaaaaatgcacacgccaagaaacaagaagtcgtagtactaggatcgcaggaaggagccatgcataccgcattgaccggcgcgacagaaatacaaaactcgggaggaacaagtattttcgcagggcatttgaagtgtaggctaaaaatggataaattggaactaaagggaatgtcatatgcaatgtgtacaaatacatttgtattaaagaaagaagtgagcgaaactcaacatggaactatactgattaaagtggaatacaaaggtgaagacgtaccctgcaaaattccttttagcaccgaagacggacaaggaaaagctcataacggacgactaatcacagctaatccggttgtgactaagaaagaagaaccagttaacatcgaagctgagccacctttcggcgaatctaacattgttatcgggataggagacaatgctttaaaaataaattggtataagaaaggaagctccatcggtaaaatgtttgaggctacagctcgcggagctcgtagaatggcaatactaggcgacacagcatgggatttcggatcagtagggggtgtattgaactcgttgggaaaaatggtccaccagatatttggatcggcctacacagcacttttctctggggtcagttgggtaatgaaaataggaatcggcgttctattgacctggataggacttaactctaaaaatacatcaatgtcattttcctgtattgcgataggaataataactctatatttgggagcggtagtgcaggcagatatggggtgtgtaataaattggaaaggcaaagaattgaaatgtggtagtggtatattcgtaacaaacgaagtccacacgtggacagaacagtataaatttcaagcagattcgccgaaaagattagcaactgctattgccggagcttgggaaaatggcgtatgtggaattagatctacaacgcgaatggaaaatttattatggaaacaaatagccaatgaactcaactatatattatgggaaaacaatataaaattgacagttgtggtaggtgacataatcggggtgcttgagcaaggaaaacgaaccctaactccccagccaatggaattaaaatactcatggaaaacatggggtaaagccaaaatcgtcactgcagaaactcaaaacagctcctttatcatcgacggaccaaacacccctgaatgcccgagtgtaagtcgagcttggaatgtatgggaagttgaagactatggattcggggtatttactactaatatatggttaaaactacgagaagtttatacccagctatgtgatcaccgtttgatgagcgcagccgttaaagatgagagagcagtacacgctgatatgggatactggatagaatcgcagaaaaatggatcatggaaactcgagaaagcgtctctaatcgaagtaaagacctgtacttggcctaaatcacacacgttatggagcaacggtgttctagagagtgatatgataattccaaaatcactagcagggcctattagccaacataaccatcgcccaggttatcatactcaaacagcagggccttggcacctcggaaagttggaactcgatttcaattattgtgagggaacaacagtggttataacggaaaattgcggtacgcgaggtccatcattgcgaacaaccacagtttccgggaaattaatacatgagtggtgctgccgcagttgtacacttccaccattgagatacatgggagaagacggctgttggtatggaatggagatccgaccatttagtgagaaagaagaaaacatggtgaaatcattagtatcggccggtggaggaaaagtagataacttcactatgggggtgttatgcttagcaatacttttcgaagaagttatgagggggaagttcgggaagaaacatatgatagcgggagtcttctttacttttgtattattactatctggtcaaataacgtggcgagatatggcacacactttaatcatgataggttcgaacgcaagtgatcgaatgggtatgggagtaacttacttggctcttattgcaacattcaagattcagccgttcttagccttagggtttttcttgcgaaaattgactagccgcgagaatttattattaggagtaggtctagcaatggcgacgactctccaactcccagaggacattgaacaaatggcgaatggaatcgcgttaggtctgatggctttgaaactaatcacccaattcgagacataccaattatggacggctctaatttcactcacctgttccaatacgatcttcacactaacggtagcatggcggacagcgacactgatactagctggtgtgtcccttctaccagtgtgccaatcgtcatcaatgaggaaaacagactggcttccaatggccgtggccgctatgggtgtgccaccactccccttgtttatatttgggttgaaagacacattaaaacgtcgttcttggcctctaaatgaaggcgtcatggctgtagggcttgtaagcattctggcgtcgtcacttcttcgaaatgacgttccaatggccggacccctagtagccggagggcttttaatcgcttgttacgttatcacagggacgagcgccgacctcacagttgaaaaagccgcagatataacttgggaggaagaagcagagcaaacaggggtaagtcacaatcttatgataacagttgacgatgacggaacaatgcgaataaaagatgatgagactgaaaatatattaacagtattattaaaaacggctctacttatcgtatcagggatttttccatatagcatcccagcgactctattagtatggcatacctggcaaaagcaaacacaaagaagcggagtattgtgggatgttcctagcccaccagaaacacaaaaggcggagctggaagaaggagtttacagaataaaacaacaaggcattttcggcaaaacccaagtgggtgttggagttcaaaaagagggagtatttcataccatgtggcatgtcacaagaggagctgtgctgacatacaacggaaagagacttgaacccaattgggccagtgtcaagaaagatttaatcagttacggtgggggttggaggttaagtgctcagtggcagaaaggagaagaggttcaggtaatagctgtagaaccggggaagaatccgaaaaacttccaaactatgccaggaaccttccaaacaacgactggtgagataggggcgatcgctcttgacttcaagccaggtacttcgggttctcccataataaaccgcgagggaaaggttgtggggctgtatggaaatggtgtcgtaaccaaaaatggtggatatgttagtggcatcgctcagaccaatgcagaaccagacgggcccacaccagagttagaggaagaaatgttcaaaaagagaaatctaacgattatggatttgcacccaggcagcggcaagaccagaaagtacctgccagcaattgtaagagaagccataaagagaagattacgaactctaattcttgcccctacgagagtagtagcagccgaaatggaggaagcactcaaaggtctcccgattcgataccaaacgaccgcaacaaaatcggaacacactggaagagaaatagttgaccttatgtgtcacgcgactttcactatgagactcttgtcgcccgtcagagtacccaattataacctaataatcatggatgaagcgcattttaccgatcccgcgtcaatcgctgcccggggttatatatccacaagagttggcatgggggaagcagcagccatcttcatgacagcaactccacccggaacagccgacgcatttccacaatcaaacgcacccatccaagatgaggaaagagatattcctgaaagatcgtggaactccggaaatgaatggatcacagatttcgcgggtaaaactgtgtggttcgttcccagcataaaggcgggaaatgatatcgctaattgcctacgtaaaaatggtaagaaagttatacaattatcaagaaaaacgtttgatacagaataccagaagacaaaattaaatgattgggattttgtagttacaacagatatcagtgaaatgggggcaaattttaaagccgaccgggtcattgatcccagacgttgcttaaaacccgtgattttgacggatggcccagaaagagttatccttgcaggaccaatgcccgtgacagcggcctccgctgctcaaagacgtggcagagtgggaagaaacccacagaaagagaacgaccagtacatctttaccggacaaccactaaataatgacgaagatcacgctcactggaccgaagcaaaaatgttgttagacaacattaacacaccagaaggtattatacccgccctttttgaaccagaaagagaaaaatcagcagccatcgatggtgagtatcgcttaaaaggtgagtctcggaaaacattcgtcgaattaatgcgtagaggtgatttacccgtctggctagctcacaaggttgcttcagaaggtattaaatataccgatcgaaaatggtgtttcgatggccagagaaacaaccagattctagaggaaaatatggatgttgaaatatggacaaaggaaggcgagaaaaagaaactcagaccacgatggctcgatgcgagaacgtattctgatcctttagcattaaaagaatttaaagaatttgctgctggtcggaaatcaatagcgttagatctagtgactgaaataggacgagtaccatcacacttagcgcatagaacacgaaatgccctagataatttagttatgctacatacttctgaacacggtggacgagcatatcgccatgccgtggaggaacttccagaaacaatggaaacactccttcttctgggactcatgatattactaacgggaggagctatgctttttctgatatcagggaaagggataggtaagacttctataggtctaatatgtgtaatagctagctcaggcatgctttggatggctgaaatacccttacaatggattgcatcagcaatcgtactagagttctttatgatggtactcctcattccggaaccagaaaaacagagaaccccacaagacaatcaactagcttatgtagtgataggcattttaacattggcggcaataatagctgctaatgaaatgggactattagaaacaaccaaaagagatttaggaatgagtaaggaaccaggagtagtgtccccaacctcgtacctcgatgtagacttacaccctgcatcagcatggacattatacgcagtagctaccacagtaattacaccaatgttacgacatacaatagaaaactcaactgccaacgtaagcctggctgccattgccaaccaagcagtcgtattgatgggattggacaaaggatggccaatatcaaaaatggacctaggagtcccactgcttgcccttggatgttatagtcaagtcaatccactgactttgacggccgccgtactactattaattacacattacgccataattggaccaggacttcaggctaaggctacaagggaagctcagaaaagaacagccgcaggaataatgaaaaatcccacggttgacggtataatgacgatagatctcgaccccgtaatatacgacagtaaattcgaaaaacaactgggtcaggttatgcttttagtattatgcgccgttcaattattattgatgagaacaagttgggcgttatgtgaagcccttacactagccacaggcccaataacaactctatgggaaggtagcccaggaaaattttggaacacaactatagcagtctccatggcaaatatattcaggggttcatatctagctggagcaggattagcattctccattatgaaaagtgtcggtacagggaaacgaggaaccggttctcaaggggaaaccctgggcgaaaagtggaagaagaaactaaaccaactttctagaaaagatttcgacttatataagaaaagtggtatcacagaagtagataggacggaagcgaaagaagggttaaaaagaggtgaaataacccaccatgctgtatccagaggatccgcgaaattacagtggtttgtcgagcgcaatatggtaataccggaaggtagagttatagacctcggatgtggtcgaggtggatggagctattattgtgctggactcaagaaagtaactgaagtccgtggatacacgaaagggggaccgggacacgaggagcctgtacctatgtccacttatggatggaatattgtaaaacttatgtctgggaaagatgtattctacctccctccagaaaaatgtgatactctgctctgcgatattggagagagcagcccttcgccaactgtggaagaatcgagaacaataagagttcttaaaatggttgaaccttggcttaaaaacaaccagttttgcataaaagttctcaatccgtacatgccaactgtaatagaacaccttgaacgtcttcaacggaaacatggtggaatgcttgtacgaaaccctctaagtcgtaactcaactcatgagatgtactggatcagcaatggaactggcaatatcgttgcaagcgtgaacatggtatctagattattactcaatagatttacgatgacacaccgaagacccacaatagaaaaagatgtagatctgggagcaggaaccagacacgtaaatgcagaaccagaaaccccaaacatggatgtgattggcgagagaataaaaagaattaaagaagaacataattcaacatggcactatgatgatgaaaatccgtacaaaacttgggcttaccacggatcctacgaagtcaaagcgactggaagcgccagctcaatgattaatggagtagtaaagttactaactaagccatgggatgtagttccaatggtaactcaaatggccatgacagatacaacaccttttggccaacaacgggtattcaaagaaaaagtagatactagaactccacgatcaatgcctggtacacgtagagtcatggggataacggcagagtggctgtggcgcactctcggtagaaataagaaacctagactatgtaccagagaggaatttactaagaaagtacgaaccaacgccgcaatgggcgcagtgttcactgaagagaaccagtgggattccgcaaaagcagcagtcgaagatgaagatttctggaagctagtcgatagggaacgagaacttcataaactagggaaatgcggaagttgcgtatataatatgatgggaaaaagggagaagaaattgggagaatttgggaaggctaaaggaagtcgtgccatctggtatatgtggcttggggcaagatatctagagttcgaagctctaggtttcttaaatgaggatcattggttctccagagaaaatagttactcaggagttgaaggcgaagggttacataaacttggctacattttacgagacataagtaagattcccggcggagctatgtacgccgatgacacagcggggtgggacacccggataactgaagacgatctacataacgaagagaaaattacccaacaaatggatcccgagcatcgacaattagcaaatgcaatatttaaattaacgtatcagaacaaagtcgtgaaagtacaaagaccaactccaactgggactgtgatggacattatttctagaaaagatcaaagaggtagtggtcaagtaggtacgtacggtttaaatacattcacaaacatggaggctcaattgatacgacaaatggaaggtgaaggtgtcttgtcgaaggcagatttagaaaatccacacttaccggagaagaaaataactcaatggttagaaacaaagggagttgaaagacttaagaggatggcgataagtggtgatgactgtgtcgtgaaaccaattgatgaccgatttgcgaatgctctacttgcactgaatgacatgggcaaagttagaaaagatattccacaatggcaaccatcgaaaggttggcacgactggcaacaagttcctttttgttcccatcactttcatgaacttatcatgaaggatggacgaaagctagtagtaccttgtaggcctcaagatgagcttataggcagagcccgtataagtcaaggtgcgggctggtctttaaaagaaacagcttgtctaggaaaagcctatgctcaaatgtggtctctaatgtatttccaccgaagggatttacgtctagccagtaatgccatttgttcagcagtgccagtccactgggtccccacatcaagaacaacttggagcattcacgcacaccatcaatggatgaccaccgaagatatgctaactgtctggaatcgagtctggatagaagacaatccatggatggaagacaaaacaccagtgaccacatgggaaaatgtaccctaccttggaaaacgtgaggatcaatggtgtggttcattgatcggattaacatctcgagctacatgggcacagaatattccaactgcgatccagcaagtccgaagtttaattggaaatgaagagttcctcgattatatgccttcaatgaaacgctttcgcaaagaagaggaatcagaaggtgcaatatggtaa

SEQ ID NO: 23225 - RNA, 9873 nt, synthetic construct
  misc_feature 1..9873: note = derived and/or modified CDS sequence (opt6) from DENV-3__JN093515__SS-prME
  source 1..9873: mol_type = other RNA
acttctttatgtttgatgatgatattaccagctgcattagcattccacttaacgtctagggatggggaaccgcgcatgatagtggggaaaaatgaacgagggaaatctttgctctttaaaactgcttcaggaattaacatgtgcacattaatagcaatggacctgggagaaatgtgtgatgataccgttacctataaatgtccgcatataacggaagtagagccagaggatattgactgttggtgcaatttgacatctacttgggttacgtacggtacctgcaatcaagccggtgaacaccggagagataaacgaagtgttgcattagcaccgcacgtaggaatgggattggatacacgaactcaaacatggatgagcgcagaaggagcatggagacaagtagagaaagttgaaacatgggctctcaggcatcccggattcacaattcttgcacttttcttagcacactacataggaacgagcctaacgcaaaaagttgtaatatttatactactgatgcttgtcacgccttcaatgactatgagatgtgtcggtgtaggcaatagggactttgtggaagggctctcaggtgcaacatgggtagatgtggtcttggagcatggcggctgtgtaaccactatggcgaaaaataaacccaccttagatatcgaattacagaaaacagaggctacgcaactagccacactcaggaaattgtgcatagaaggaaaaatcacgaacattactaccgatagtcgttgcccaactcaaggagaggctactcttcctgaagaacaggatcaaaattacgtatgtaaacatacttacgtagacaggggctggggaaatggatgtggattatttgggaagggatcacttgtaacatgcgcaaaatttcaatgcttagaaccaatagaaggtaaagttgttcaacatgaaaatctcaaatataccgtcatcattacagttcacacaggggatcaacatcaagtaggaaatgagacacaaggggtcacagctgaaataacgccccaggctagcacaacagaagcaatactcccagaatatggtacgttggggttagaatgctcgcctcgaaccggattagattttaacgaaatgatcctactaaccatgaaaaataaagcgtggatggtgcatagacaatggttcttcgacctaccacttccctggacaagcggggcgacaaccgaaactcccacatggaatcgaaaagagctgctggtgacattcaagaacgcacatgctaagaaacaagaagttgtcgtactaggtagtcaggaaggagcaatgcatacagccctgacaggagcaactgagatccaaaactcaggagggacaagtattttcgccgggcacttaaagtgtagattaaaaatggataaactagaattaaaggggatgagttacgccatgtgcaccaatacctttgttctaaagaaggaagtgagcgaaacgcaacacggcacaatcctgattaaagttgaatacaagggcgaggacgtaccctgtaaaatcccattcagtacggaagatggacaaggcaaggcacacaacggccgcctgataaccgccaatcccgttgtcacaaaacgagaagaaccagtaaatatagaggcagaacctccatttggagaatcgaacatcgtcataggtatcggcgataatgctctcaaaataaactggtataagaaaggttcgtccattggtaagatgttcgaagctaccgcaaggggagcccgcagaatggccatattaggcgacacggcctgggatttcgggtcagtagggggagtactaaattcgcttggtaaaatggtacaccagattttcggctctgcatatacggcactgttcagtggcgtctcttgggtcatgaagataggtataggagtcctattaacttggatcggtttaaatagtaaaaacacaagcatgtcattttcctgtattgctatcggaattatcaccttgtatctcggagcagtagttcaagcagacatgggttgtgtaatcaactggaagggtaaagagttaaaatgtgggagtggtatttttgtaacaaatgaagtacacacctggactgaacaatataaattccaagcagattctccgaaaaggctagctactgcaattgccggtgcatgggagaatggcgtgtgcggaataagatcgactacaagaatggaaaatcttctgtggaagcaaatcgcaaacgaattaaactatattttatgggaaaataatattaaattaactgtagtcgttggtgacataataggtgtgctcgagcagggaaaacgtactttgacaccgcaaccaatggaattaaaatattcgtggaaaacctggggcaaagcgaaaatagtaacagcagaaacgcaaaatagcagttttattatagacggtcccaatactccagaatgcccctcagtttcgcgagcgtggaacgtttgggaggtagaagactatggattcggcgtctttacaacgaatatatggttaaaattacgtgaagtatacactcaactttgcgaccatcgactcatgagcgcagcggtaaaagacgaaagagcagtgcacgctgatatggggtattggattgaatctcagaaaaacgggtcttggaaactggagaaagcatcattaatagaggtaaaaacctgcacatggccgaaaagtcataccttatggtcaaatggcgttctagagtcagatatgataataccaaagagcttagcaggacccatctctcaacataatcacaggccgggttaccacacacaaacagccggaccctggcatctcggcaaactagagctagattttaattactgtgaaggcactacggtcgtgataaccgaaaactgtggtactagaggtccaagtttaaggacaacaactgttagcggtaaacttatacatgaatggtgttgccggagttgtaccctcccaccgcttagatatatgggcgaggacggatgttggtacggaatggagatccggcccatatcagaaaaagaagaaaatatggtcaaatcacttgtaagcgccggctcaggaaaagttgataactttactatgggtgtattatgtctagcaatactatttgaggaagtaatgagaggaaaattcggcaagaaacatatgatagccggtgtatttttcacctttgtattgttgctatcaggacaaattacttggcgcgacatggctcatactttgataatgatcggttccaatgcgtcagacagaatggggatgggtgttacttatctagcactgattgccacatttaagatccagccattcctggctctcggattctttctaagaaaactaacttctagggagaacctgctattaggtgtaggactggccatggctactacacttcaactaccggaagatatagagcaaatggcgaacggaattgcgctaggcctaatggcattaaaattaatcacacaatttgaaatatatcaattatggactgctctaatttcattaacctgttcaaatacaatttttacactaacagttgcatggcgtactgctacactaatattggcaggggtaagcctcctaccaatgtgtcagtcaagcagtatgagaaagacagactggcttcccatggctgttgcagccatgggagtacctcctctgccgcttttcatattctcattaaaagacacattaaaaagacggagctggccattaaatgaaggggttatggcggtcggtctagtaagtattttagcctcgagtttactacgtaatgatgtacctatggccggacccctagtagctggaggactactcatagcttgttacgtaattactgggacgagcgctgatctgacagttgaaaaagctgccgacataacatgggaagaagaggcagaacagacaggagtctcgcacaatctcatgattaccgtagatgacgatgggacaatgaggattaaggacgacgagacggaaaatatattaacggtattgcttaaaaccgcactactaattgtaagcgggatatttccatactcaataccagcaacattgttagtttggcatacatggcagaaacagacccaacgaagtggcgtgctttgggatgtcccttctcctccggagacacaaaaagcggaattagaagaaggggtttatagaattaagcaacaaggaattttcggaaaaacacaagtgggcgtaggagtgcaaaaagagggcgttttccacactatgtggcatgttacaaggggagcggtactaacctacaacggaaaaaggctcgagccgaattgggcgtcagtgaaaaaggacttaatatcatatggaggaggatggagactatccgcacaatggcaaaagggtgaagaggtccaggttattgcagtagaaccaggcaaaaatccaaagaactttcaaacgatgccaggtacctttcaaaccacaacgggggaaattggcgcgattgcactagactttaaacccggaacctctggatcaccaattataaatcgcgagggaaaagttgtcggattatatgggaatggagtcgtaactaaaaatggcggatacgtgtcaggtatagcccagaccaatgccgaacccgacggaccaacaccagaactagaagaagagatgttcaagaaacgtaatcttacgattatggacttacaccccggcagcggcaagacaagaaaatatctacctgcaattgtgagggaagcaataaaacgacgattaagaactctaatactcgccccaacaagggtagttgcggccgaaatggaagaagcgctaaaaggattaccaattcggtaccaaacaacagctactaaatcggaacatactggaagagaaatagtagatctaatgtgtcacgctacctttacaatgagactgctttctcccgttagagtaccgaactacaatttaattataatggacgaagcgcacttcacagaccccgccagcatagcagcaagaggctatatctcaacaagggtaggtatgggagaagcagctgccattttcatgaccgcaacgccacccggtacagcggatgcttttccacagagcaatgcaccaattcaggacgaagaacgagacataccggaaagaagttggaatagcggaaatgaatggattacagacttcgcagggaagacggtttggtttgtgcctagtataaaagctggaaatgatattgcgaactgtttaaggaaaaatggtaaaaaggttatacaattgtcaagaaagaccttcgatacagaatatcaaaagacaaaactgaatgattgggattttgtagttaccactgacataagtgaaatgggtgctaacttcaaagctgatagagtcatagatccgcgacgctgtctcaaacccgtcattttaactgacggtccggaacgagtaatactggcaggaccaatgcctgtcacagcagcctctgcagctcaaagaagaggaagggtaggaagaaatcctcagaaagaaaacgatcaatatatattcacaggccaaccgctaaacaacgatgaagatcacgcccactggactgaagcaaaaatgctactagataatattaatacacctgagggcatcatacctgcattgtttgaaccagagcgggagaaaagtgccgcgatagacggtgaatatagattaaaaggagaaagtagaaaaacattcgtagaactaatgagacgaggagacttaccggtatggctcgctcataaggtagcatcggagggtattaagtatacggaccggaagtggtgcttcgatggacaacggaataatcagattcttgaagaaaacatggatgtagagatatggactaaagaaggtgagaaaaagaaactcaggccccgttggttagatgcacgaacctactccgatccactagctttaaaagaatttaaagagttcgcggcaggccgaaaaagtattgctcttgatcttgtcacagaaattggtcgggtaccttctcacctagcccatagaacaagaaatgcgttggataatctggtcatgctacacacaagtgaacatggaggtagagcttacaggcatgctgtggaagaattgccggaaacgatggaaaccttgttgctgctgggattaatgatcttacttacaggtggtgccatgttatttcttataagtggcaaaggtatagggaaaacttccattggtttgatatgcgttatagcctcatcaggtatgttatggatggcagaaatacctttgcaatggatagcatcggccatagtcctagagttctttatgatggtgctacttattccggaacctgagaaacaacgtactccccaagataatcaactagcatatgtagtcatcggaatcctgacattagctgcaataatcgcggccaatgaaatgggattacttgaaacaacaaaacgagatttaggaatgtctaaagaaccgggagtagttagtcccacaagttaccttgatgtagatctacaccctgcttcggcatggaccctctacgctgtggcgaccacagtaatcacccctatgctaagacataccatagaaaactcaaccgccaatgtttcgttggcagctattgctaatcaagctgtagtgctgatggggttagacaagggctggccaattagtaagatggacttaggggtccctttgctagcattggggtgctactcacaagtgaatcccctaacattgacagcggcggtattattgctaattacacattacgctatcattggcccaggactccaggcaaaagcaacgcgagaggctcagaaaaggacagcagcgggtataatgaaaaatccaactgtggatggaataatgaccattgatctggacccagtaatttacgactccaaatttgaaaaacagttgggacaagtaatgctgcttgttctttgcgttgttcaattactattaatgagaacatcatgggccttatgtgaagcactaaccttagccacaggtcctataaccacgctctgggaaggcagtccaggtaaattttggaatactaccattgccgtttcaatggcaaacatatttagaggttcatatttagcaggggcgggtttagcattcagtattatgaaaagtgtgggaacaggaaagcgaggcacaggttcacaaggagaaactctgggggagaaatggaagaaaaagttgaaccagctaagtcgaaaagatttcgatctatacaagaaaagcgggataactgaagtagatagaacagaggctaaagaaggtttaaaacgtggcgagataacacatcacgcagtttcccgtggttcagcaaaattacaatggtttgtagagagaaacatggtaatcccggaaggcagagttatagatctgggttgtggacgaggagggtggtcatattattgtgccggattaaagaaagtaacggaagtccgtggctacacaaagggagggccaggacacgaagaaccagtgcccatgtccacttacgggtggaacatagtcaaactaatgtcaggaaaggacgtcttttatttaccgccagagaagtgtgatacgttactatgtgatataggagaatccagtccatcacccacagttgaagaatctcgaaccatcagggtactaaagatggtagaaccatggctaaagaataatcaattctgtataaaagtattaaacccttatatgcctacagtcatagaacatttggaacgactccaaagaaaacacggcggtatgttggtgagaaatccgctatccagaaactcaactcatgagatgtattggataagcaacggaacgggaaatatagtagcctccgtcaatatggtaagtagattgctgttaaaccgattcacaatgactcatagacgtccaactatagaaaaagacgtagatctaggagctggaaccagacatgtgaacgcggagcctgaaacgccaaacatggacataataggggaaagaataaaacgtatcaaagaggaacataactcaacatggcattatgatgatgagaatccctataaaacttgggcgtatcatggttcctatgaagttaaagctactggaagcgcgtcctcgatgattaatggagttgtgaaacttctgacaaaaccctgggacgtggtaccaatggttacacaaatggccatgacggatacaacaccatttggtcaacaaagagtttttaaagaaaaagtggacaccagaacaccgcgaagcatgcctggaacccgaagagtcatgggcataactgccgaatggctgtggcgcactctaggccgaaataaaaagccacggctgtgcacaagagaggagttcaccaaaaaggtaaggacaaatgctgcgatgggtgccgtctttacagaggaaaatcaatgggactctgcgaaagcagctgtggaagacgaggacttttggaaactcgtgaatcgcgaacgtgaattgcacaaacttggcaaatgcgggtcttgtgtatataacatgatgggtaaaagagagaaaaagttaggcgagttcggtaaagctaaagggtcaagagcaatatggtatatgtggttgggagcacgatatttggaatttgaggctttaggatttctaaatgaagaccactggttctcccgagaaaactcttactcaggggtcgaaggtgagggactacataaactggggtacatacttcgcgatattagtaaaatacctggtggggccatgtatgcggacgacacagcgggatgggacacacgaataacagaagatgatcttcacaacgaagagaagataactcaacaaatggaccccgagcaccgacaactggcaaacgctatattcaaactaacttaccagaataaagtagtaaaagttcagcgtcctacacccacaggtacagtcatggacattataagcaggaaagaccaaagggggagcgggcaggtaggcacatatggactcaacacctttacaaatatggaagctcaactaattagacaaatggaaggagaaggagtattgtcaaaagcagatctagaaaacccccatctgccagagaagaaaataacgcagtggttagaaactaaaggagttgaacggcttaaaagaatggctataagcggcgacgattgtgtagttaagcctatagatgacagattcgctaacgcattgttagcattgaatgatatgggaaaagttcgaaaagatataccgcaatggcaaccatcgaaagggtggcacgactggcaacaggtaccattttgttcgcatcatttccatgaattgatcatgaaagacggtcgtaaattagtcgtcccatgcagacctcaggacgaactaataggtcgggcacggatatctcaaggagcgggatggtcactcaaagaaactgcgtgtcttggaaaagcatacgcacagatgtggtcattgatgtatttccacagacgagatctaagactcgcatccaatgcaatctgtagcgcagtgcccgtacactgggtaccaacgtcacgcaccacctggagtattcatgcgcatcaccaatggatgactacagaggatatgttaactgtctggaatagagtgtggatagaagacaatccgtggatggaagacaagactccggtaacaacctgggagaatgtaccgtacttaggtaaaagagaagatcaatggtgtgggtccctcattggattaacttcacgtgccacctgggcccaaaatataccaacagcgattcaacaagtgaggagtctaatcggaaatgaagaatttttagattacatgccatcaatgaaaaggttccggaaggaagaagaatcagaaggtgctatttggtaa

SEQ ID NO: 23226 - RNA, 9873 nt, synthetic construct
  misc_feature 1..9873: note = derived and/or modified CDS sequence (opt6) from DENV-3__JF937646__SS-prME
  source 1..9873: mol_type = other RNA
acaagtctttgtcttatgatgatattgcccgccgctttagcatttcacttaacctcgagagacggcgaaccaaggatgatagtcggtaagaacgagagaggcaagagtctattgtttaaaactgcttccggaataaatatgtgcacactaattgctatggatcttggtgaaatgtgtgacgacactgttacatataaatgtccccatatcaccgaagtagaaccagaggatatagattgctggtgtaatttaacctcaacttgggtaacgtacggaacttgcaatcaggccggcgaacacagacgagacaaacgatcagtagcactagctccgcacgtaggaatgggtctagatactagaacccaaacgtggatgagtgcagaaggcgcctggagacaggttgaaaaggtagaaacctgggctctaagacatccaggatttactatattggcactatttttagctcactatatagggactagtttaacgcaaaaagtagtcatattcatattattgatgctagtaacaccatctatgactatgagatgcgtaggaattggcaaccgtgacttcgtagagggactctctggtgcaacctgggtagacgtagttcttgagcatggaggttgtgtaaccaccatggctaagaataaacccactttagatatagaactgcaaaaaaccgaagctactcaattggccacattgaggaagttgtgtattgaaggtaaaataacgaatataacgacagattccaggtgtcctacgcagggagaagcaacactaccggaggagcaagatcaaaactatgtttgtaaacacacgtatgtggacagaggatggggtaacggctgcggactatttggaaaaggcagcctagttacgtgtgcaaaatttcagtgcttggaacctatagagggaaaagtcgttcagtacgaaaacttaaagtacaccgtaataataaccgtacacactggagatcaacatcaagtcggcaacgagactcaaggagtaacagcggaaatcaccccacaggcctctacaacggaagctattttaccagagtacgggaccttagggcttgagtgctctccgagaacggggctagacttcaacgaaatgattttattaacgatgaagaataaagcatggatggtacatagacaatggtttttcgatttacctcttccatggacgtctggagcaacaacagagactccaacatggaaccgcaaagagcttcttgtgacattcaaaaatgctcacgctaaaaagcaggaagtcgtagtattaggcagtcaagaaggagcaatgcataccgcgctgaccggagctacagaaattcaaaatagcggagggacgagtattttcgctggacacttaaagtgtcgactaaaaatggataagttagaattgaaggggatgtcatacgccatgtgcacaaatgcgtttgttttaaagaaagaagtatcggaaactcaacatggcacaattctgattaaagtcgaatataagggagaagacgtaccctgtaaaattccgttttcaaccgaagatggacaagggaaagcacataatggtagattaataactgcaaatccagtcgttacgaagaaggaagaaccagtaaatatagaggccgagccaccatttggagaatcaaacatagtaataggcatcggggataatgcacttaaaattaattggtataaaaaaggatcttcaataggaaaaatgtttgaagcgacagctaggggggctagacggatggcaatactcggagataccgcctgggacttcggatcagttggcggggtactaaactcgcttgggaaaatggtccatcaaatctttggttcagcatatacggccttattctcaggagtttcttgggtcatgaaaataggaattggggtattattaacatggataggattgaactccaaaaacacatcgatgtcgttctcgtgtatcgcaataggtatcataacattatatttaggcgccgttgtacaagctgacatgggctgtgtaattaattggaaaggcaaggaactaaagtgcggttctggaatttttgtaacaaatgaagttcatacgtggactgaacagtataaattccaagcagattcacctaaaagactggccacagccatagctggagcatgggagaacggagtatgtggaataaggtctaccacaagaatggaaaatctcctctggaaacagatcgctaacgaactaaattacattctatgggaaaacaatataaaacttacagtagttgttggagatattattggggtgctggaacaaggtaaacgaacattaacaccgcaaccgatggagctaaaatattcctggaaaacatggggaaaggcaaagattgtcaccgcagagacacaaaactcctcgttcataattgatggacctaacactccagaatgtccaagtgtaagtagagcttggaatgtctgggaagtagaggattatggtttcggtgtatttactacaaatatctggttaaaacttcgagaagtatatacccagttatgcgatcatagacttatgagtgcagccgtaaaagatgaaagagctgtacatgcagatatgggctattggatagaatcgcagaaaaacggaagctggaaattagaaaaagcatccctaatcgaagtaaaaacatgtacttggcccaaatctcatacattatggtcgaacggggtattagaatcagacatgatcataccaaaatccctggcaggacccattagccagcataatcatcggcctggctatcatacacaaacggcagggccttggcatctagggaaattggaattagactttaattattgtgaaggtacgacagttgttataactgagaactgcggaactcgaggaccatcattaaggactacaacagttagtggaaaacttatacacgagtggtgctgcagatcatgtactctacccccattgcggtatatgggtgaagatggatgctggtatggcatggaaattagaccgatttcagaaaaagaagagaatatggttaaatctctagtttcagcggggtccggaaaggtagacaactttactatgggagtgttatgtctcgcaatactatttgaagaagttatgagaggtaagtttggtaaaaaacatatgatagctggcgtcttttttacatttgtcttactccttagtggccagataacatggagagatatggcacatacactaatcatgattggatcaaacgcgtcagatagaatgggcatgggagtgacctacctagctctcattgcaacatttaaaattcagccttttctagctcttggatttttcttgagaaagttgacaagcagagaaaacttattactaggagttggattggcgatggtcacaacattacagcttcctgaagatattgaacaaatggcaaatggaattgcactaggccttatggcacttaagctaatcactcaattcgaaacctatcaattatggacggcacttatctcattaacgtgcagtaacaccatattcacgttgacggtagcatggagaacagctactttgatattagctggggtaagcctgctaccagtctgtcaaagcagttctatgagaaaaacagattggctgccaatggcagtggcggctatgggagttccccctctcccacttttcatctttgggctaaaagatactctaaagagacgctcgtggcctctcaatgaaggtgtcatggctgttggcctggtatcaatattagcttcatctctattaaggaatgatgttccgatggccggacctttagtggcaggtgggttgcttattgcatgctatgtgattaccggtactagtgcggacctcacggtcgaaaaggccgcagatattacttgggaagaagaagcagaacagaccggcgtctcccataatttgatgattacagtagatgatgacggaacaatgagaataaaagatgatgaaacagaaaacatacttaccgttctactaaagacagctttactaatagtatcaggcatatttccctactcgattccggcgaccctgttggtgtggcacacatggcaaaaacaaactcaaagaagtggtgtactctgggacgtaccctctccaccagaaacacaaaaagccgagttggaagagggcgtttatagaataaaacaacaaggtatattcggaaaaacccaggttggagtaggcgtgcaaaaggaaggagtatttcacacgatgtggcatgtaacccgaggggccgtgttaacatataatggcaaacgtctagagccaaattgggcctcagtgaagaaagacctaatatcgtatggaggtggatggagactgagtgcgcaatggcagaagggagaagaagtacaagtaattgccgtggaaccaggaaaaaatcccaagaattttcaaacaatgccaggaacctttcaaacgacaaccggcgaaatcggagcaattgccctagactttaagcctggtacctcgggttctcccataataaacagggagggaaaagtagtagggctctatggtaacggggtcgttacgaaaaatggtggctacgtttccggaatagcccaaaccaatgctgaaccggatggtccaaccccagaattggaagaagagatgttcaaaaagaggaacttaacaatcatggatctacatccaggatcagggaagacgagaaaatatcttccggcaatcgttagagaagcaatcaagcgcagactaagaacactgatattagcgccaacgcgagtagtcgcagcagagatggaagaagcccttaaaggtttaccaatacgctaccaaacgacagctaccaaaagcgaacatacaggaagggagattgtggatttaatgtgtcacgctacgtttacaatgcgtctgttatcacccgtgcgagtaccgaattataacctaataataatggatgaagcgcattttaccgatccggcatctatcgccgcccgcggatatatatcaacacgagttggaatgggggaggctgcagctatatttatgacagctacgcctcctggtacagcagatgcattccctcaaagcaatgcacctattcaagatgaggaacgagacattccagaacgctcatggaatagtggaaacgaatggattactgactttgcgggcaaaacagtatggttcgtgccaagcattaaggtagggaacgatatagcaaactgcttacgaaaaaacggcaagaaagtgattcaactcagcagaaagacgtttgacacagaatatcaaaaaacgaagttgaacgattgggatttcgtagtaacaactgatatttctgagatgggggctaattttaaagccgacagagtaatagatcctaggagatgtctaaaaccagtaatcttaactgatggacccgaacgggttatactggctgggccaatgcctgtgacagcagcttcagcagcacaaaggcgtggccgtgtcggaagaaatccgcagaaagaaaatgaccaatacattttcactggacaaccccttaataatgatgaagaccatgcacactggaccgaagccaaaatgttgttagacaatataaatacgccagaaggaataataccagcactattcgaacctgagagagaaaaaagcgctgcaatagatggggagtatcgattgaaaggagagagtcgcaaaacgttcgtagaacttatgcgtagaggtgatttacccgtgtggttggcacataaagtagctagtgaaggaattaagtacacagatcgaaaatggtgttttgatggtcagcgaaacaaccaaatattagaagaaaatatggatgttgaaatctggactaaagaaggcgagaaaaaaaagctacgtccgagatggttggatgcgaggacttattctgatccgctagcattgaaagaatttaaagagtttgccgcaggaagaaaaagcatagctctggatcttgtcacagaaattggacgcgtcccaagccatctagcacatcgtactcgtaacgcactggacaacctcgtaatgttacacacgtcagagcatggtggaagagcctacagacatgcagtagaggaactaccagaaactatggaaacacttcttttattaggtttgatgattttgttaaccggaggcgccatgttattcttgatatcaggaaaaggtattggaaaaacaagtataggtttaatatgtgtgatagcgtcgtcaggaatgttatggatggcagaaatccctttacaatggattgctagtgcaattgtgttagaatttttcatgatggtcctattaatacctgaacccgaaaaacagcggacccctcaagataatcagcttgcttacgttgtcataggaattttgactcttgccgctataatagcagccaatgaaatggggctattagagacaacaaaaagagacttaggcatgagcaaggaaccaggtgttgtttcacctacttcgtatctcgacgtagatttgcatccggccagtgcatggacattgtatgctgtagccacaactgttattacgccaatgttgcgccacactattgaaaattctacagctaacgtatcattagctgcaatcgcaaatcaagctgtcgttcttatgggtttagataaaggttggccgatatctaaaatggacctcggagtccctctactcgccctaggatgttatagtcaggtgaatcctctaacattaacagcggcagtattactactgataacgcactacgctataattggaccaggactacaagcaaaagctaccagagaggctcagaaacgtaccgcggctggaataatgaagaatccaaccgtagatggcattatgacaatcgacttagatccagttatatacgacagtaagtttgaaaaacagctgggacaggtgatgcttttagttctttgtgcggtgcaattactattgatgcgaacgtcatgggctttgtgcgaggccctaactctcgcgacaggacctatcactacactatgggagggatcgcctggtaaattctggaacacaactattgccgtgagcatggctaatatatttcgtggatcatacctggccggagcaggattggccttctccataatgaagagcgtaggcacaggaaagcgtgggacggggtcccaaggagaaactttgggcgaaaaatggaagaagaagttaaatcaattatcgcggaaggatttcgatctatataaaaaaagcggtataacagaagtagaccggacagaagctaaggaaggattaaagagaggagaaataactcaccacgcagtgagtaggggtagtgcgaagctacaatggtttgtagaaagaaatatggtaatcccagaaggtcgagtgatagatctagggtgcggcagaggaggttggtcatactattgtgccggactaaaaaaagttaccgaggtacggggatacactaaaggtggaccaggacatgaagaaccggtacccatgagcacgtacggctggaatatagtaaaactgatgtcagggaaagatgttttctatttacctccagaaaaatgtgatactttactctgcgacatcggtgaatcgtcgccatctcccactgtagaagagtcacggacgataagggttttgaaaatggtggaaccctggttaaaaaataatcaattttgcattaaagtactaaatccttatatgcccacagtaatagaacacttggaaagattacaacgaaaacacggaggaatgttagtacgaaaccccttatcaaggaatagtactcacgaaatgtattggatatccaatggtacaggaaacatagtggcctccgtaaacatggtatcgagattgctattgaacagatttacaatgacacatagaaggccaactatagaaaaagatgtagatcttggtgccggtactcggcatgtaaacgcagaaccagaaacccccaacatggatgtaataggtgaacgaatcaaaaggataaaagaagaacataatagtacatggcattacgatgacgagaacccttacaagacctgggcctaccacgggtcatatgaagtaaaagcaacaggtagcgcaagcagcatgataaacggagtagtaaaactgctcacaaagccatgggacgtagtcccaatggtaacacaaatggcaatgaccgatacgactccatttgggcaacaacgagtatttaaagaaaaagtagatacaagaacaccaaggtcgatgcctgggaccagacgcgtaatggggataactgcggaatggctgtggagaacccttggaaggaataaaaagccgcgattgtgcaccagggaagaatttacaaaaaaggttcgcacaaacgcagctatgggagctgtcttcaccgaagagaatcaatgggacagcgctaaagcagcagtagaagatgaggatttctggaaattggtagatcgagaacgtgaattgcacaaactgggaaagtgcggatcttgtgtatacaatatgatgggaaagagagagaagaaactaggggaatttggtaaagcgaaagggtcgagagctatatggtatatgtggttgggggctaggtatctcgaatttgaagccttagggttcttaaatgaagaccactggttttccagggaaaatagttatagcggagtagaaggtgagggactgcataagcttgggtatattctccgagacatttcgaaaatacccggcggagcaatgtatgccgatgataccgcgggatgggatacgaggattaccgaagatgatttacataacgaagagaaaatcacccagcaaatggatccagagcacagacaactcgctaatgcaatttttaaattaacataccaaaacaaggtagtaaaggtacagagacccacaccaacgggaacagtaatggatataatttcacgcaaagatcaacgtggttcgggtcaagttggaacatatggcttaaatacattcacaaacatggaagcacagctaattagacaaatggaaggagagggggtactttccaaagcagatctggaaaatccgcacttaccggaaaaaaagatcacccaatggttagaaacaaaaggtgttgaaaggttaaagagaatggcaatatcaggagatgattgtgtagtaaaacccatagacgatcgatttgccaatgcattgttagcattgaatgacatgggaaaagtaagaaaagacattccgcaatggcaaccatccaaaggatggcatgactggcaacaagtgccgttctgttcacaccattttcacgaattaattatgaaagacggacgaaaactagtagtgccctgtagaccacaagatgagctaataggccgagccagaataagtcaaggcgccgggtggtctctcaaagaaactgcgtgtctcggaaaagcctacgcacagatgtggtcactaatgtactttcatagacgagacctgcggttagcttctaacgctatatgctctgcagtgccagtacactgggtgccgacgagtaggaccacctggagcatacatgctcatcaccaatggatgactacggaagatatgttaacagtttggaatagggtatggatagaagacaacccttggatggaggataaaacacctgtaacaacttgggagaatgtaccttatttaggaaaacgggaagatcaatggtgcggcagtcttatagggttaacaagtagagctacctgggctcaaaacatccccaccgcaattcaacaggtacgcagtttaatagggaacgaagaattcctcgactatatgccttcaatgaaaaggttccggaaagaagaagagtccgagggagctatatggtag

SEQ ID NO: 23227 - RNA, 9873 nt, synthetic construct
  misc_feature 1..9873: note = derived and/or modified CDS sequence (opt6) from DENV-3__JF937633__SS-prME
  source 1..9873: mol_type = other RNA
acgagtttatgtttgatgatgatcctaccagcagctttagctttccatctcacgagccgtgatggagaacccagaatgatagtaggcaaaaatgaacgtgggaaatcactgctgttcaaaacagcaagtggaattaatatgtgtacactaatagcaatggatcttggtgaaatgtgtgatgacactgtcacgtacaaatgtcctcatattaccgaagtggaaccagaagatattgactgctggtgcaacctaacttctacttgggtgacgtatggaacctgtaatcaagcgggtgaacatagaagagataaaagatcagtcgccctagccccacatgtcggtatgggactagatacaagaactcaaacgtggatgagcgctgaaggagcttggcgtcaagtagaaaaagttgaaacctgggcactccgccaccctggattcactatcctagctttgttcctcgcacattacatcgggacgagtctaacacaaaaagtagtaattttcatccttttaatgctagttactccgagtatgactatgagatgtgtaggggtgggtaatcgagatttcgtagaaggactcagcggcgcaacttgggtcgatgttgttcttgaacacggtggctgtgtgacaacaatggccaaaaacaaaccaacattagatatcgaactacagaaaacggaagccacacaattagcaactttgcgcaaattatgcatagaaggaaaaataactaatattaccactgactcaaggtgcccaactcaaggcgaagccactctgccagaagaacaagaccaaaactatgtgtgcaaacatacatacgtcgatagaggctggggaaacggatgtgggctgttcggaaaaggttcattagttacctgcgcaaaatttcaatgccttgaaccaatagaaggaaaagtcgtgcaatatgaaaaccttaaatatactgtcataatcacagtccacaccggagaccaacatcaagttggtaatgaaacacaaggcgttacagcagaaattacgccacaagcatcgacaactgaagctatacttccagaatatgggacactcgggctagaatgcagtccacgtacaggcctagactttaatgaaatgattctcttaactatgaaaaacaaagcatggatggttcaccgccaatggtttttcgacttacccctaccttggacatcaggagccacaacagaaactccaacttggaataggaaagaattattagtaacctttaaaaacgcacacgctaagaaacaggaagtagttgtcctaggtagtcaagaaggagccatgcacaccgcattaacaggggctactgaaattcaaaattcaggtggcacgtctatctttgcgggacatttaaaatgcaggctcaaaatggataaactagaactaaaagggatgtcatatgcaatgtgtacaaacacattcgttcttaagaaagaggtcagcgaaacacaacacggtacaatactaataaaagtcgagtataaaggagaagatgtaccctgtaaaattccattcagtacagaagatggacaaggtaaagcccacaatggacgcctcataacggcgaaccctgtcgttaccaagaaagaagaacctgtaaatatagaagcagaaccaccttttggagaatcaaatatcgtaattggcattggtgacaatgctcttaaaataaactggtacaagaaaggatcgtcaatcggtaaaatgtttgaagccaccgctcgaggcgcaagaaggatggcgattcttggagacactgcatgggactttggaagtgttggtggggtacttaacagtctgggaaaaatggtgcatcaaatattcggttcagcctatacagcattatttagtggagtatcgtgggttatgaaaataggaataggagtgctactcacttggataggactaaactccaaaaatacatctatgtctttctcctgcatagccattggcataatcacactttatttaggggcagttgtacaggcggacatgggatgtgtcataaattggaaaggaaaagaactgaaatgtggatcaggaatatttgtcactaatgaagtgcatacctggactgaacaatacaaatttcaggcagattctcccaaaaggctggcaacagcaattgcgggcgcttgggaaaatggtgtttgtggaatacgatcaacaacacgcatggaaaatctgctatggaaacaaatagctaatgagttgaattatatattatgggaaaataatattaagttaactgtagtggtaggagatatcataggcgtattagaacaaggaaaaaggacattgaccccacaacctatggaactaaaatactcatggaaaacgtggggtaaggctaagatagtgaccgcagaaacgcaaaacagctcctttataattgacggtcccaatactccagaatgccctagcgttagcagagcctggaacgtctgggaagtagaggattatggatttggagtctttaccacgaacatatggcttaaattgcgcgaagtctatacccagttatgcgatcatcgactaatgtcggcggccgtgaaagatgaaagggcagttcatgccgacatgggatactggatcgaatcacagaaaaatggctcgtggaaattagaaaaggcttctctaatcgaagtgaaaacttgcacgtggccaaagtcacatacgctatggtccaatggggtattagaatccgatatgattataccgaaatctctagcgggaccgataagccaacacaaccaccgtcccggttatcatacacagacggctggtccctggcacttagggaaattggaactagatttcaactattgtgaaggcactacagtagttataactgaaaattgcggaacaaggggaccgtcactaagaactacaacagtatccggtaagctaatacatgaatggtgttgcagaagttgtactttacctccactaaggtacatgggtgaagatggttgttggtatggaatggaaatacgccctatatcagaaaaagaagaaaacatggtaaaatccttagtaagtgccggatctgggaaagttgacaactttacaatgggtgtcttatgtttagccatactgtttgaagaggtaatgagaggaaagttcggcaagaaacacatgattgcgggcgtattctttactttcgtcctcttgttatctggtcaaataacatggcgcgacatggctcataccctgataatgattggatcaaacgccagcgacagaatgggaatgggcgtaacctacctcgcgttaattgcgacattcaaaattcagcccttcttagccttaggattctttctaaggaagttaacgtcaagagaaaaccttttattaggcgttggcttagcaatggcaacgacactacagctccctgaagatattgaacaaatggccaacgggatagcgttaggtctgatggccctaaaacttataactcaatttgagacatatcaactctggacagccttgatcagtttaacctgcagtaacaccatatttactctaacggtagcatggagaactgctacgctaatactcgccggtgtgtcccttctccccgtctgtcaaagctcatcaatgcgcaaaaccgactggttaccaatggcagtcgctgcgatgggagtaccacctttacccctgttcatatttggtttaaaagacacacttaaacgtaggagttggcctctaaatgaaggagtcatggcagtaggactggtgtccatcttagcgtcatcgctcctaagaaatgatgttccaatggcaggaccccttgttgccggaggattattaattgcatgctacgtaataaccggtacttcggcagacttaacagtagaaaaagcagcggatataacttgggaagaagaagccgaacagactggtgtgtcgcataatctaatgataactgtggacgacgatggaaccatgcgcataaaagacgacgaaacagaaaatattctgacagtactcttaaagacagcacttttaatagtatcaggtatattcccatactcaattccagccacgctgctagtatggcatacttggcaaaagcaaacccaacgaagcggcgtactctgggatgttccttcgcctcctgaaacgcaaaaagccgaactagaagagggagtgtatcgaatcaagcaacaaggcatattcggaaaaacacaggtaggcgtaggtgtccagaaggaaggtgtgttccatacaatgtggcatgttacaaggggagccgttctaacgtataacggaaaaagactggaaccaaattgggccagcgtgaagaaagacctcatatcatatggtggcggctggcgtttaagcgctcaatggcaaaaaggagaagaggttcaagtgattgcagtagaacctggcaagaatcctaaaaattttcaaactatgccgggaacctttcaaacaacgacaggggaaattggcgcgatagccctagattttaaacctgggacctcgggctccccaataatcaacagagaaggtaaagtagtagggctttacgggaatggagttgttactaagaacgggggatatgttagtggtatcgcacaaacaaatgcagaaccggatggcccaacaccagaactcgaagaagagatgttcaagaaaaggaatctaacaataatggatttacacccaggatctggaaagacaagaaaatatttgccagctatcgtacgggaagctatcaaaagaaggttgcgaacactgattttggcaccaaccagagtagttgctgctgaaatggaagaggcactaaaaggtttaccaatacgatatcaaacgacagcgaccaaatcagaacacacaggcagagaaattgtagacttaatgtgccacgcaacttttacgatgagattacttagtccggttagagttcccaactacaatctaataataatggacgaagcccattttaccgaccctgcttctattgcggctagaggctatatatctacgagagtaggaatgggtgaagccgctgccatcttcatgacagccacgccaccgggtacagcagatgctttcccccaatcgaatgcaccgatccaagacgaagaacgcgacataccagaaaggtcatggaactctggaaatgagtggataacagacttcgctggcaaaaccgtatggttcgtaccgtctattaaagcgggaaatgatatagccaattgtctacggaagaatggtaaaaaggtcatacagctatccagaaaaacatttgacacagaataccagaaaacaaaattaaacgactgggactttgtggtaacgacagatatttcagaaatgggtgctaatttcaaggcagatagagttattgatccgcggagatgtttaaagccagtcattctcaccgatgggccagaacgggtgatattagctggacctatgccagtaacagcagcgtctgcggctcagaggaggggtcgcgtaggacggaatcctcaaaaagagaatgatcaatatatatttactggtcagccactaaacaatgacgaagaccatgctcattggacggaagcgaagatgctgttagataatatcaatacgccagaaggaattattccagctctttttgagcccgaacgagagaaatccgcagcaatagacggagaatacagattaaaaggcgaatcaaggaaaacctttgtagagctcatgcggagaggagaccttcctgtatggttagcgcacaaagtggcttctgaaggaatcaagtatacggaccgaaaatggtgtttcgacggtcaaaggaacaatcaaattctagaagaaaacatggacgtggagatatggacaaaagaaggcgagaagaagaaactcagaccccgttggctcgacgccagaacctactcggatccactcgcacttaaagaatttaaggaatttgcagcaggaagaaaaagcataactctagatttagtaaccgaaatcggacgcgttccaagccacttagctcacagaacaaggaatgcattagacaatttagttatgctacacacgtccgaacatgggggacgcgcatatagacatgcagtggaagaactaccggaaaccatggagacattgttattacttggattgatgattcttctaacaggtggagctatgctattcttaataagcggaaagggtatagggaagacgagcatcggccttatctgcgtcatagcaagttcaggcatgttgtggatggctgagataccactacaatggatcgcttccgctatagtacttgagttcttcatgatggtattgttgatcccagaaccggaaaaacaacgcacgccacaagataatcagttagcctatgttgttattggtatacttacactggctgctattatcgctgccaatgaaatgggattacttgaaactactaaaagagatctcggtatgtcaaaggaacccggagtcgttagccctactagctacttggatgtggatctccatccagccagtgcatggaccttatatgctgtcgcaacgacggttataacgcctatgctacggcacacaattgaaaactctacagcaaacgtgagtctagcagccatagcaaatcaagcagtggtactaatgggactagataaaggatggccaatctcgaaaatggatctaggtgtgccactactagctttaggctgttactcccaagtcaatcccctaacactaacagcagcggttctattacttattactcattatgccataataggccctggactccaagccaaagctaccagagaagctcagaaaagaacagctgccggtattatgaagaatccaactgtcgatggcataatgacaatagatttagatcctgtaatttatgattcgaaattcgaaaagcaactcggacaggtgatgttgttggtcttatgtgcggtacagttgctactaatgcgtacgtcatgggcactttgcgaagcattaacactggctacaggaccaattacaaccctttgggaaggaagtcccggcaaattttggaataccaccatagcggtatcaatggctaacatatttagaggatcatatcttgcgggtgccgggttagccttttctataatgaaatcagttggtacaggaaaaaggggtactggtagtcagggagagacactaggagaaaaatggaagaagaaattgaaccagttatccaggaaagactttgatctgtataagaaatcgggaattactgaagtcgatcgaacagaggctaaagaaggtctaaaacggggtgagataacacaccatgcagtatcaagaggatcggctaaactccaatggtttgtcgaaagaaatatggttattccggaaggacgtgtaattgacctagggtgtggaagagggggttggtcttactactgcgctggattgaagaaggtcacggaggtacgaggttacactaaaggaggacctggtcatgaggagcctgtgcctatgagtacatacgggtggaacattgtaaaattaatgagtggaaaagatgtcttttatttaccaccagagaaatgtgatacattattatgtgatatcggagaatcgtctccttcaccaactgtagaagaaagccgcacgatccgtgtcttaaaaatggtggaaccgtggttaaagaataatcaattttgcataaaagttttaaatccatacatgccgacagtaatagaacatctggaaagactacagagaaaacatggaggtatgctagttagaaaccctcttagccgtaattcaacacacgagatgtactggattagtaacggaactggtaatatagtagcgagtgtaaatatggtgtcacgattattgctaaatcgcttcacgatgacccaccgccgcccaaccatcgaaaaagacgtagaccttggagccgggacaaggcacgtaaacgcagaacccgaaacgcctaatatggatgttattggcgaacgtataaaacgaattaaagaagaacacaatagtacttggcactacgatgacgagaatccttacaagacgtgggcatatcatgggtcttatgaagtgaaagccacaggctcagcgtcatcaatgatcaacggagtagtaaaactcctgacaaaaccatgggacgttgttccaatggttacccaaatggcgatgaccgatacaactccctttggacaacaaagagtattcaaggagaaagttgacacacggacacctcgttcaatgccggggacgagacgtgtgatgggtattacagcggaatggctatggagaacattggggcggaataagaaaccaagattatgcacaagggaagagttcacaaagaaagttcgaacaaatgcagcgatgggggctgtgttcacagaagaaaatcagtgggattctgcgaaagcagcggtagaagatgaggatttttggaagctagtggatagggaacgtgaactacataagctcggtaagtgcggatcctgtgtttacaatatgatgggaaaaagagaaaagaaactaggagagttcggcaaagccaaagggtcaagagccatttggtacatgtggctgggggcccgatatttagagttcgaggcactaggatttttaaacgaagatcactggttttcaagagaaaactcatattcaggtgtcgagggagaaggactccataaactaggatatattttgagagacatttcaaaaatcccaggaggagctatgtacgctgacgatactgcagggtgggatacacgaataaccgaagacgatctccataatgaagagaaaatcacccagcaaatggatcccgagcaccgacagttagcaaatgcaatttttaaattgacatatcaaaataaagtagttaaagtgcaaagacccaccccgactggaacagtgatggacataatttcaaggaaagaccaaagagggtcaggccaagtcggaacttacgggctaaatacattcacgaatatggaggcgcaactcattcgtcagatggagggtgaaggtgtattatccaaagccgatttagaaaacccacatctccccgagaagaaaataacacagtggttagagactaaaggcgtagagagattaaagcgaatggcaatatcaggcgacgattgcgtggtaaaacctatagacgacaggttcgctaacgcacttctggccctaaacgatatgggaaaagtaaggaaagacattccccaatggcagcccagcaaaggatggcacgattggcaacaagttcctttctgctcgcatcactttcatgaattaataatgaaagacggtaggaagttagtagttccatgtagacctcaagatgaattaatcggaagggcacggattagccaaggagcaggatggtctctaaaagagacagcttgtcttggcaaagcatatgcacaaatgtggagtttgatgtattttcatagacgagacctccgtctcgcatcaaatgctatctgctccgctgtaccagtacactgggtaccaacaagtaggacgacatggagtatacacgcacatcatcagtggatgactactgaggatatgttaacagtctggaatcgggtatggatagaggacaatccatggatggaagataaaacacccgtaactacctgggaaaatgtgccttacctcgggaaacgagaagatcagtggtgcggttcattgataggtttgacatccagagcaacttgggctcaaaacattcctaccgcaatacaacaagtgaggagtttgataggtaatgaagaatttttagattatatgccgagcatgaaacgcttcagaaaagaggaagaaagtgagggagcgatatggtaa

SEQ ID NO: 23228 - RNA, 9873 nt, synthetic construct
  misc_feature 1..9873: note = derived and/or modified CDS sequence (opt6) from DENV-3__JF937634__SS-prME
  source 1..9873: mol_type = other RNA
accagcttatgcctgatgatgatactaccagctgcacttgcattccatctaacctcgagggacggggaaccaagaatgatagtaggcaaaaacgaaagaggcaaatcattgttattcaaaaccgcttctgggattaatatgtgtaccctaattgcaatggatctcggagaaatgtgcgatgacacggtgacgtacaaatgtccacacattactgaagtagaaccagaagacatagattgttggtgtaatttaacctcgacctgggttacttatggcacgtgtaaccaagcaggagaacataggcgtgataaaagaagtgtggctttagctcctcatgtaggaatgggattggacacaaggactcaaacatggatgtcggcagaaggtgcatggcgacaagtcgaaaaagtcgaaacgtgggctttaagacacccaggctttacaatattagctttatttctggcacattatattgggacgagcttaactcaaaaagtagttattttcatactattaatgctcgtaactccgtcaatgacaatgaggtgcgttggtgttgggaatagggactttgtcgaagggttatctggagccacatgggtagacgtagttctagaacatggtggttgtgtaactacgatggctaaaaataaacccactctagatatagaactacagaaaacagaagcaactcaactggcaacgttaagaaaattatgcatagaaggtaaaattacaaacataacgacagattctcgttgtccaacacaaggcgaagcgaccttacccgaggaacaggatcaaaattatgtgtgtaaacacacatacgtagacagaggctggggtaacggatgcggtcttttcggcaaaggatcgttggtgacctgtgcgaaatttcaatgccttgagccaatagaaggaaaagttgttcaatatgaaaacttaaaatacacggttataatcactgtacatacaggagatcaacaccaagtagggaacgaaacacaaggagttacagcagaaattacaccacaagcatctacaaccgaagcgattctaccggaatatggaacattaggtttagaatgttcaccaaggaccggattggacttcaatgaaatgattctactgacaatgaaaaataaagcgtggatggtccatagacaatggttctttgatttaccacttccttggacatccggagcaacgacggaaacgccgacctggaatagaaaagaactattggtgacattcaaaaacgcgcacgccaagaaacaagaagttgtagtgttgggtagtcaagaaggagcaatgcatactgcattaacaggagcgacagaaattcaaaattcgggaggtacctcaatttttgctggacacttaaaatgcagattgaaaatggacaaactcgaacttaaaggaatgtcatatgctatgtgtactaacacgtttgttctcaagaaagaagttagcgagacacagcatggtactatactgatcaaagtggaatataaaggcgaggatgtaccctgtaaaattcccttcagtaccgaagatggacaagggaaggcacacaatggtcgactaataaccgctaatccagtcgtaactaagaaagaagaaccagtaaacatcgaagctgaacctccatttggagagtcaaatatagtgattggcataggcgataacgcattgaaaattaattggtataagaaagggtcatcaataggtaaaatgttcgaagcgacagcaaggggagctcgtcgaatggcaatattaggagacacagcgtgggacttcggaagcgtgggaggtgtattaaactcacttggaaaaatggtacatcagatattcggaagtgcatacacggcgctattctcgggcgtatcatgggttatgaaaatagggattggtgtcttgttaacttggataggacttaatagcaaaaacacaagtatgagtttctcctgcattgcgataggaataataactttgtatctaggtgccgtcgtgcaagctgatatgggctgtgttataaattggaaaggaaaagagctgaagtgtgggtcaggaatctttgtcacaaacgaagttcatacttggacagaacaatacaaattccaagcagattcacctaaacgacttgctacggcaatagctggtgcttgggaaaatggtgtgtgcggtataagatctaccactcgtatggaaaacttactttggaaacaaatagtcaatgaactaaattacatactgtgggaaaataacatcaagttaaccgtagttgtgggagacataataggagtgttggaacaaggtaaacgaacgttaacaccccaaccaatggaactaaaatattcatggaaaacctggggaaaggctaagatagtaactgctgaaacacagaacagttcattcattatagatggacctaatacccctgaatgcccctctgttagcagggcatggaatgtttgggaggtagaagattatggttttggtgtttttacaacgaacatttggcttaaactcagagaagtatatacacaactttgtgatcacagattaatgtcagccgccgtcaaagacgagagagctgtgcatgccgacatggggtactggatagagtcacagaaaaatgggagctggaaactagaaaaagcatccttaatcgaggtaaaaacttgtacctggcccaagtcgcatacgttatggagtaatggggttctcgaaagcgatatgattattccaaaatccttagcaggacctatatcacagcataatcaccgtcccggatatcatactcaaacagctggcccgtggcacctaggcaaacttgaactagattttaactattgcgaaggcacaacggttgttattacggagaactgtggcaccagaggaccctcattgaggacaacaacggtaagtgggaaacttattcatgaatggtgttgcagatcatgtaccctacctcccctaaggtatatgggtgaagacggatgttggtatggaatggagattagacccatcagtgagaaagaagaaaatatggtcaaatcattggtatctgcaggtagtggcaaagtcgataattttactatgggcgtattatgcttagcgatactttttgaagaagtaatgcgcggcaaattcggcaagaaacacatgatcgcaggggttttctttacattcgtacttttacttagtgggcaaataacgtggagggatatggcacatacattaataatgattggctcaaacgcatcggaccgtatgggcatgggagtgacatacttggcgctaatcgcgacttttaaaatacaaccctttctggcccttggctttttcctacgtaaacttacgagtagagagaacctcctacttggagtgggcttagctatggctacaacactgcaactaccggaagatattgagcaaatggccaatggcatcgccctcggtttaatggcgctgaagttgattacgcagtttgaaacgtaccaattatggactgcacttatcagtctcacgtgtagcaacaccatctttacactaacggtcgcttggcgtacggcaacgttaatccttgcgggtgtgtcactactgcctgtttgccaatccagctcaatgcgaaaaacggattggctaccaatggccgttgcagcaatgggagtaccaccattgccactgtttatcttcggattaaaagacacactaaaaagacgtagttggcctctcaatgaaggagttatggcagtaggattggtaagtatactagcatcgagcctattgaggaatgacgtacccatggccggccccctggtggctgggggtctcctgatagcatgttatgtgataaccggaacatctgcagatctcaccgtagaaaaagcagcagatattacgtgggaagaagaggcggagcaaaccggtgtaagccacaatttgatgattacggtcgatgatgacggaactatgagaattaaagacgatgaaacagaaaatattttaacggttttactaaagacagctttactaattgtatctggcatatttccgtacagtatacccgcgaccctcctagtatggcacacatggcaaaaacagacgcagcgaagtggggttctttgggatgtaccatcacccccagagactcaaaaagcggaattagaggaaggagtatatagaataaaacagcaaggtatatttggtaagacacaggtcggcgttggcgtgcagaaagaaggagtctttcacaccatgtggcatgtgacaaggggtgccgtattgacatataatggcaaacggctcgaaccaaattgggcttcagtcaagaaagatttaataagctacggaggtgggtggagactgtctgcccaatggcaaaaaggagaagaagtacaagtaatagcggtagagcctgggaaaaatccgaaaaacttccagaccatgcctggaacatttcaaacaaccacaggtgaaataggagcaatagcactagacttcaaaccaggaacctccggttcaccaattataaacagagagggtaaagtagtaggtctctatggtaatggtgtagtgactaaaaatggagggtatgtatccggtattgcacaaactaatgccgagccagatggacccacaccagagctagaagaggagatgttcaagaaaagaaatctcacaataatggatctgcaccccgggagtggtaaaacacgcaagtatctgccagcaatagtacgagaggcgataaagcgacggttaaggacactaatactggcgcctaccagagtagttgctgccgagatggaagaagcactgaaagggctcccaataaggtaccagaccactgctactaaatcagaacacactggtagagaaatcgtagatctaatgtgtcacgctactttcacaatgagactattatctcctgttcgggttccaaattacaaccttataatcatggacgaagctcatttcaccgatccggcaagcatagcggcacgagggtacatatcaacacgagtaggtatgggagaagcagcagcgatttttatgacagcaacacctccaggtactgctgatgcctttccccagagtaacgcgccgatccaagacgaagagagagacattccagaaagaagctggaactccggtaatgaatggattactgatttcgccggaaagactgtatggtttgtgcctagcataaaagcaggaaatgacatcgctaactgtctacgaaagaacggaaagaaagtaatacagttatccagaaaaacgttcgatactgagtatcagaaaacaaaactaaatgattgggatttcgtagtgaccactgatatttcagaaatgggtgcaaactttaaagcagaccgagtaatagacccaaggcggtgtcttaagccagtcattcttaccgatggacccgagagagtcatactcgcaggccctatgcccgtaacggctgcatcagcagcacagagacgaggtcgagtgggcagaaatccacaaaaagaaaatgatcaatacatattcacaggacaaccattaaataatgatgaagatcacgcacattggacagaagctaaaatgttattagacaacataaacactccagaaggtataatcccagcgttattcgagccagagcgagaaaaatcagctgcaatagacggggaatatcgtcttaagggtgagtcacgcaaaacatttgtagaattaatgcgtagaggcgatctcccagtatggttagctcataaagtcgcctcggagggtataaaatatacggaccgaaaatggtgctttgatgggcagaggaacaaccaaattttagaagaaaatatggatgttgaaatatggactaaggaaggtgagaaaaagaaactgagaccacgttggcttgatgcccgaacttattcagatcctctcgcactcaaagaatttaaagagttcgcggcaggtagaaaatcgattgctttggacctagttacggaaatcggccgagtcccaagccacttagcccatcgtacgaggaacgcactggacaacctagtgatgcttcatacaagtgagcatggtggtagagcctatcgacatgctgtagaagaattacctgaaacaatggaaactttattactcttaggtctaatgatattgctaacagggggagcaatgctttttcttataagtgggaaaggaattggaaaaaccagcattggactgatatgtgttatcgcttcaagcggtatgctctggatggccgaaattccattacagtggattgcatctgctatcgttttagagttctttatgatggtgttattaataccggaacccgaaaagcagagaacccctcaagacaatcaacttgcttacgtcgttataggcatattaacactggctgccattatcgcggccaatgaaatgggcttgttggaaacaaccaaacgagatttaggtatgtctaaagaacctggagttgtctcccccacgagttatctcgatgtcgatttacatccagcttcagcatggaccttatacgcggtcgctaccaccgtaattacacctatgttacgacacacaattgaaaactcaacagcaaacgtttcattagcggccatagctaatcaggctgtagtactaatgggactggataaaggatggccaatatcgaaaatggatctcggtgttccacttctagcactagggtgctatagccaagtaaatcccttgacactaaccgcggcagttctattacttataacacactacgccattattgggcctggattacaagccaaagctacacgagaagcacagaaaaggacggccgctggaataatgaagaatccaactgttgacggaattatgacaatagacttggacccagttatatatgattcaaaattcgaaaagcagttagggcaggtaatgttgctcgtattatgtgctgtacaactattgcttatgcgaacaagctgggcattgtgtgaagcattgactttggcaaccggtcctataacaactctttgggaaggatccccgggaaaattttggaatactacaatagcagtgtcaatggcaaacatttttcgaggatcatatttagctggtgcaggcttagctttttctataatgaagtctgtcggtactgggaagagaggcaccggctcacagggagagacactaggcgaaaaatggaaaaagaaattaaatcaactttcgcgcaaggattttgacttatacaagaaaagtggaataaccgaggtagacagaacagaggccaaagaggggttaaaacgaggagaaataacacatcatgctgtgagtcgtggctctgcaaaattacaatggtttgtggagagaaacatggttatacctgaaggccgagtaattgacttaggttgtggccgtggtggctggtcatattattgtgcaggtttgaagaaagttactgaagttcgaggatatacaaaaggcggtcctggtcatgaagaaccggtaccaatgtcaacgtatggatggaacatcgtcaagctaatgtcaggaaaagatgtgttctacctacctcctgaaaaatgtgacaccttgctgtgcgatataggtgagagcagtccttcaccaaccgtggaagagtctcgaactatccgcgtattaaaaatggtagaaccctggctcaaaaacaatcaattttgcataaaagtattaaatccctacatgcccacggtcatagaacacttggagagattacaacgcaaacacggcggcatgctagtaagaaatccattaagcagaaattccacacacgagatgtactggatctctaatggaaccggaaacattgtggcgtcggtcaatatggtaagtcgtttattactaaatcgattcacaatgacacataggagaccgacaatagaaaaagatgtggatcttggagcagggactcgacatgtaaacgcagaacctgaaacacctaatatggaagtgataggtgaaaggattaaaagaatcaaagaagaacataacagcacttggcattatgatgacgagaacccatataaaacatgggcttaccatggttcatatgaggttaaagcgacgggcagtgcttcatcaatgatcaatggtgttgtcaagttgctgacgaaaccgtgggacgttgtacccatggttacccaaatggcaatgacagatacgacaccgttcggacaacagcgcgtatttaaagaaaaagtagacacacgtacgccgcgaagtatgcctggaactcgacgcgtcatgggaataacagctgagtggctttggaggacacttggacgaaataagaaaccacgtctgtgtacaagagaagaatttacaaagaaagtacgtacaaacgcagcaatgggggcagtattcactgaggaaaatcaatgggactccgcaaaagctgcggtcgaagatgaagacttctggaagctagtggatcgtgagcgtgagctccacaaattaggaaaatgcgggtcatgtgtctacaatatgatgggtaaaagagagaagaaactcggagagtttggcaaggccaagggcagtcgagcaatatggtacatgtggctaggtgctcgatatctcgagttcgaagctctgggatttttgaatgaggaccattggttcagcagagaaaacagctatagcggagttgaaggggaagggctccacaagctagggtatattctaagagacatatctaaaataccgggaggagctatgtacgcagatgatacagcaggctgggataccagaataactgaagacgatttacacaatgaagagaaaataactcaacaaatggaccccgaacacagacaactagccgatgcaatatttaaactaacctaccagaataaagtcgtaaaagttcagaggccgacaccaacaggcacggtcatggatattatatccagaaaggatcaacggggatctggacaggtcgggacatacggactaaataccttcacaaacatggaggcacaacttatccgtcaaatggaaggtgaaggcgtcctgtctaaagccgatttggaaaatccacacttacctgagaagaaaatcactcaatggcttgaaacaaaaggagtagaacgcttaaagaggatggcaattagtggcgacgattgtgtagtaaaaccaatagacgatagatttgccaacgccttgcttgcactaaacgatatggggaaggtacgaaaggatattccacagtggcagccatcaaaaggctggcacgattggcagcaagtgccattttgtagtcatcacttccatgagctcattatgaaagatggtcgtaagctagtggtcccatgcagacctcaggatgagctaatcggacgcgcacgaatatctcaaggcgcgggttggagtttaaaagagacagcatgcctaggtaaggcttacgcacagatgtggtccctaatgtacttccataggcgtgatttgaggctggctagtaatgcaatatgtagcgcagtaccagtccactgggtacctacttctcggacaacatggtcaatacacgcgcatcatcaatggatgacaactgaagacatgttaacagtttggaatagagtctggattgaggacaatccgtggatggaagataaaacgccggtcacaacatgggaaaacgtaccgtatttaggcaaaagagaagaccagtggtgtggatccttaataggactaacctcacgtgcaacatgggctcaaaacattccaacagccattcagcaagtcagatcgctcataggaaatgaggaatttttagattacatgccatcgatgaagagatttcgtaaagaagaagaatcagaaggcgccatatggtaa

SEQ ID NO: 23229 - RNA, 9873 nt, synthetic construct
  misc_feature 1..9873: note = derived and/or modified CDS sequence (opt6) from DENV-3__JF937636__SS-prME
  source 1..9873: mol_type = other RNA
acgtctttatgtcttatgatgatattgcccgcagcgctagccttccacttgacaagtcgggatggggaaccaagaatgatagtaggcaaaaatgaaagaggaaaatcattactattcaaaacagcgagtggaatcaacatgtgcacactcattgcgatggacttaggtgaaatgtgtgatgatacagtaacatacaaatgtccacacattacagaagtcgaacccgaagatatagattgttggtgtaacttgacttccacgtgggtgacttacggtacatgtaatcaagctggggaacatagaagagataaaagatccgtagcactagcaccccatgtaggaatgggacttgatacacgcacacaaacctggatgtcagcggaaggggcctggagacaagtagaaaaagtagaaacatgggcactaagacatcctggatttacaattttggcactattcttagcccattatattggtacgtcgcttacccaaaaagtcgtgatattcatcttattaatgcttgtaacaccatcaatgacgatgagatgtgttggtgtagggaatcgagactttgttgaaggactttcaggagctacctgggttgatgtagtcttagaacacgggggatgtgtcacaacaatggctaaaaataaaccaacattggatattgaactacagaaaacggaagctacacaattggccacattgcgaaaactatgcatagaaggtaaaataacaaatattacgacagatagtcggtgtccaacccaaggtgaagcgactttgcctgaggagcaagaccaaaattatgtatgcaaacatacatacgttgatcgtgggtggggaaatggttgtggactctttggaaagggttctttagtcacatgcgcaaaatttcaatgtttagaacctatagaaggaaaagttgtacaatatgagaacctaaaatatacagttattattactgtacacaccggagatcaacaccaagtgggtaacgagacccaaggagtaactgccgaaataactccacaagcgagtactacagaagcaatactgcctgaatatggaacgttaggactagagtgttctcccagaacaggattagatttcaacgagatgatcctgctcaccatgaaaaataaggcttggatggtacatcgacaatggttctttgatctacctctaccatggacatcaggagcaacgacagaaacacccacatggaacagaaaagaactattagtcacttttaaaaatgcacatgcgaagaaacaagaggtagtagttttaggatcccaagagggggcaatgcatactgctttaacaggggcaactgaaatccaaaactctggaggaacgagtatattcgctggacatctgaagtgtcgattgaaaatggataaattagaattaaaaggcatgagctacgccatgtgtacaaatacattcgtattaaagaaagaggtgtcggaaacacaacacggaactattctaattaaagttgaatataaaggtgaggatgttccttgtaagataccatttagtacagaagatggacagggaaaagctcataatgggaggctaataacggcaaatcctgtagtaactaagaaagaagaaccagtcaacattgaagcagaacccccttttggtgaatcgaatatcgttatcggtattggtgataatgcgttaaaaattaattggtataaaaagggatcttcgatcggaaaaatgtttgaggcaaccgccagaggtgctcgcagaatggctatactaggagatactgcatgggactttgggtccgttggtggtgtgctaaattcactaggcaaaatggttcatcaaatatttgggtctgcgtatacggcgttatttagcggagtatcctgggtcatgaagatcggaataggcgttcttttaacatggattggactaaattctaaaaatacgtctatgtcatttagttgcattgcaatcggaataattacattatatcttggggcagtggtccaggcagatatgggatgtgttattaattggaagggaaaagagttaaaatgtggtagtggaattttcgtaacgaacgaagtacacacttggacagaacaatataaattccaagcagactctcctaaacggttggcaacagcaatagccggcgcttgggaaaatggggtttgtgggattcggtctacaacccgcatggaaaatttattatggaaacaaatagcaaatgaattaaattatattctgtgggaaaataacatcaagttaacggtcgtggtgggagacataattggagtgttggaacaaggaaaaaggactctaacgccccagccaatggaacttaaatattcctggaaaacttggggtaaggcaaagatagttacagctgaaactcaaaactccagtttcataatagacggtcctaatactccggagtgcccctctgtctccagagcttggaacgtgtgggaagtagaagactatgggtttggggtttttacgacaaatatatggctcaaattgcgagaagtctatacacaactctgcgatcatcgattaatgagtgcggccgtaaaagatgaacgagctgtgcacgcagatatggggtattggatcgaatcgcagaaaaatggttcgtggaaactcgaaaaagcatccttgatagaagtgaaaacatgtacatggccgaaatctcatactttatggagcaacggagtacttgaatctgatatgataataccaaagtcactcgcaggaccgataagccaacataaccatagaccggggtaccatactcagacagcaggcccgtggcacctaggcaaactggagctggatttcaattactgtgaaggtactacagtagtaataacagaaaattgtggaacgcggggccctagtcttcgtacaacaacggtatcaggaaaattgattcacgaatggtgctgtagatcatgtacccttccaccattgcgatatatgggagaagatggatgttggtatgggatggaaataagaccaatatcagaaaaagaagaaaacatggtaaaatctttggtaagcgccggtagcgggaaggttgataattttacgatgggcattctttgtctcgccattttgttcgaagaggtgatgaggggtaagtttggaaagaaacatatgatagcaggagtattctttaccttcgtcctactactaagcggacaaataacatggagggacatggcacacacccttattatgataggatccaatgcttctgacagaatgggaatgggggttacatatttagccctcatcgccactttcaaaatacaaccgtttttagcactcggattctttttaaggaaactaacaagtagagaaaaccttttactaggtgtgggtttagccatggcaactaccttacaattaccagaagacattgagcaaatggcaaatggaattgcgctcggcttaatggcattaaaactgataacacaatttgaaacttatcagctatggaccgctttaataagcctgacgtgttcgaacacaattttcacattaactgtggcttggcggacagctacactaattctcgctggagtgagcctgctacccgtctgccagtcaagttcgatgcggaaaacagattggcttccaatggctgttgccgctatgggcgtacctcccctccctctatttatttttagtttaaaagatacgcttaaaagaagatcatggccgctgaacgaaggtgtaatggcagtcggcttagtgagtatcttggcgtcaagtcttcttaggaatgatgtaccgatggccggacctcttgttgccggagggctcctaatagcgtgttacgtcataacggggacatccgcagacttaactgtagaaaaagctgcagatatcacttgggaagaggaagccgaacaaactggcgtatctcataacttgatgatcacagtagacgatgatggaacaatgcgcataaaagatgacgaaacagaaaacattttaaccgtattactaaagactgctttgctaatcgtcagtggtatatttccttatagcataccagccactctattagtatggcatacgtggcaaaaacaaacccaacgttctggcgtactgtgggatgtacctagtccgccagaaacacaaaaagcagaactggaagaaggcgtttatcgcattaaacaacagggtatttttgggaaaacgcaagtaggtgtaggggtacagaaagaaggtgtctttcatacaatgtggcatgttacacggggcgctgtactaacatataacggtaaaaggcttgaacctaactgggcctctgttaaaaaggatctaattagttacgggggcgggtggagactaagcgcacaatggcaaaaaggtgaagaggtacaagtgatagccgtagagccaggtaaaaaccccaaaaattttcaaaccatgccaggaacatttcaaacgacaacaggagagatcggtgcgatagcccttgacttcaaaccgggcaccagtggttctcctataataaacagagaagggaaggttgtaggtctatatggaaacggggttgtaaccaaaaatggcggatatgtgagcggaatcgctcagactaacgctgaaccagacgggccaacgccagaactagaagaggagatgtttaagaaacggaatttgaccattatggatctgcatccaggatctgggaaaactcgcaagtatctaccagcaatcgttagggaagcgataaggcgtaggttacgaacgcttatattggctcccacaagggtggtagctgccgaaatggaggaagcactaaagggccttccgatacgctaccaaacgacagccacaaagtctgaacacactggaagagagattgtggacttgatgtgccatgctactttcacaatgaggttactctctccagtacgagtccccaattataacctcattataatggacgaagctcattttactgacccggctagtatcgccgctcgaggctacatttctacaagagttggaatgggagaagccgctgcaatatttatgaccgcaactcctcccggtacggcagatgcctttccgcaatcaaatgcccccatacaagacgaggaaagggatatacctgaaagaagttggaactctggaaacgaatggataacagatttcgctgggaaaacagtatggtttgtaccctccataaaagctggtaacgacattgcaaattgtttacgcaaaaacggcaaaaaggtaatacaactctcgagaaaaacgtttgatacagaatatcagaaaacaaaattaaatgactgggactttgttgtgactactgatataagtgagatgggtgcaaattttaaagccgatcgtgttatagatccccgccgatgtttgaaacctgtgattctaacagatggaccagaacgagtgattctcgctggcccaatgcctgtaactgcagcatcagcagcccaaagacgcggtagagtaggcagaaaccctcaaaaagaaaatgaccaatatatattcactggacaaccgttaaataatgacgaagaccacgcacattggactgaagcgaaaatgctgttagataatataaatacgccagagggcattataccagcactattcgagccagaaagagaaaagtccgcagcaatagacggggaataccgattaaaaggcgagtctcgaaagacgtttgtggagctaatgcgacgcggagatttacccgtttggttagctcataaagtagcaagcgaaggaataaagtacacagaccgtaaatggtgtttcgacgggcaacgaaacaatcaaatcctcgaagaaaatatggatgtcgagatttggactaaggaaggtgagaaaaagaagttgcgacccagatggttagacgcgaggacctactcggatcctcttgcgcttaaagaatttaaggaatttgcagctgggagaaaatcaatcgcactagatctcgtgacagaaatagggagagttccaagtcacttagcgcataggacgcgaaatgcactcgataatttagtgatgctacatacatcagagcacggtggcagagcataccgtcacgcagttgaggaacttcccgaaacgatggaaacattattactactaggattaatgattttacttaccggaggcgccatgctatttttaatttcaggaaagggtataggaaaaaccagtataggtctcatttgtgttattgcatcatccggtatgctttggatggctgaaataccccttcaatggattgcaagcgcgatagtcttagaatttttcatgatggtcttgttgattcctgaaccagagaagcaaagaacaccacaagacaaccaactcgcttacgttgttatcggcatcctcactctagcagcaattattgccgctaatgagatgggactattagaaactacaaaaagagatctaggaatgtcgaaggagccaggcgttgtctctccaacctcgtatctcgacgtggatcttcaccctgcatctgcttggactttatatgcggtagccaccactgttattacgcccatgctaaggcatactatagaaaactcaacagcaaatgtttcattggctgctatagcaaaccaagcggtggtattaatgggtttggacaaaggatggccgatttcaaagatggacctaggggtaccattattagctctcggctgttattcacaagtcaatccactaacacttacggctgcagtattattactaataacccattacgcaatcataggaccaggattacaggccaaagcaactagagaagcccagaaacgaactgccgcaggaatcatgaaaaacccaacagtggatggaattatgacaattgacttagacccagtaatatatgactcaaaatttgaaaagcaactaggtcaagttatgttactcgtactctgcgcggtacaattactactaatgcgtacatcatgggcactatgcgaagcgctaactctagctacagggcccattacaaccctatgggaaggaagtccagggaagttttggaacacaaccatagccgtcagtatggcaaacatattccgagggagttacctcgcaggggcaggtttagcattttcgattatgaagagtgtaggcactggaaagcgtggaacgggatcacaaggagaaaccctaggggaaaaatggaaaaagaagctaaaccaactaagtcgtaaagacttcgatttatacaaaaagagcgggattacagaagtcgaccggaccgaagcgaaagaaggtttaaaaagaggggaaataacacatcacgcagttagccgtggtagcgccaaattacaatggttcgtcgaaagaaacatggtcatccccgaaggtagagtgattgatttagggtgtggaaggggaggctggtcttattattgtgcaggactgaagaaagttaccgaggtccgaggctacaccaaaggaggtccgggccacgaagaacctgtcccgatgtcgacatatggttggaacattgttaaattaatgtcaggtaaagatgtattttatctaccaccagaaaagtgcgacactctactttgcgacataggggaaagtagcccatctccaaccgtggaagaatctagaacgatacgcgtactaaaaatggttgaaccctggctcaaaaataatcaattctgcatcaaagtcctaaatccatacatgcccacggttatcgagcacttagaaaggctccagagaaaacatggaggtatgttagttcgcaatccactctcacgtaacagcacacatgaaatgtattggattagtaatggaacggggaatatcgttgcgtcagtcaatatggtatctcgactactattaaaccgattcacaatgactcaccgcaggcctaccattgaaaaagacgttgacctaggcgcaggcacaagacatgtaaacgccgagccagaaacgcccaatatggatgtaataggagaaagaataaaacgcataaaagaagaacataatagcacttggcactacgatgatgaaaatccctataaaacctgggcataccacgggtcatacgaagtaaaggctactggctctgcgagttcaatgataaatggtgttgttaaactccttaccaaaccatgggacgtagttcctatggtaacccaaatggcgatgacagacacaacgcctttcgggcaacagagagtttttaaagaaaaagtagacactaggacaccaagatctatgcctggaactaggagagtgatgggaataacagcggagtggttatggcgtactttaggcaggaacaagaaaccgagactctgtaccagagaagaatttaccaagaaagtgcgtacaaatgcagcaatgggagcagtttttactgaagagaaccagtgggactcagcaaaagcagcggtagaagatgaagatttctggaaacttgtcgacagggaaagagagcttcataagctaggaaaatgcggaagttgtgtttacaacatgatggggaaaagagagaagaaactcggagagttcggtaaagcaaagggctcgcgggccatatggtatatgtggttaggcgcaagatatctggaatttgaggctttaggatttttaaacgaagatcactggttctcgagagaaaattcctattccggtgtcgaaggggaaggtcttcacaagctgggctatatactccgcgacatttcgaaaatacccggtggggcaatgtacgcggatgacactgcaggctgggataccagaattactgaagatgatttacataacgaggagaaaatcacccaacagatggacccagaacaccggcagctagcgaacgcaatatttaaactaacctaccaaaataaagtagttaaagtacagagacccacgcctactggcactgtgatggatataatttcaagaaaagatcaaagaggcagcggtcaagtcggcacatatggtcttaacacttttacgaacatggaggcacaattaataaggcaaatggaaggtgaaggagttctgtcgaaagctgatctggaaaacccccatttacctgagaagaaaataacacaatggttagaaacgaaaggggttgaaagacttaaacgaatggctatatcaggagatgactgcgtggtgaagcctatagatgatagattcgccaacgccttactagctctgaatgatatggggaaagtcaggaaggatattccacagtggcaaccaagtaagggttggcatgattggcaacaagtaccattttgtagccaccatttccatgaattgattatgaaagacggacgaaagttagtagtaccttgcaggccccaggatgagctcataggccgtgcaaggatttcacaaggcgcaggttggtcactgaaagaaactgcatgtctcggtaaagcgtatgcacaaatgtggtcactgatgtactttcacagacgagatttaagattggcctctaatgctatatgttctgcagtccccgtacactgggtaccaacctctcgtacgacatggtcaattcatgcacatcatcagtggatgacaaccgaagatatgttaacagtttggaaccgcgtatggattgaggataatccatggatggaagacaagacaccggtaacaacttgggaaaacgtaccgtatcttggcaagcgtgaagaccaatggtgtggttcgctcatcggactcacctcgagagctacgtgggcacagaatataccaactgctattcaacaagttagatctttaataggcaatgaagagttcttggattatatgccttcaatgaaaagatttcggaaagaagaggaaagcgaaggtgcaatctggtaa

SEQ ID NO: 23230 - RNA, 9873 nt, synthetic construct
  misc_feature 1..9873: note = derived and/or modified CDS sequence (opt6) from DENV-3__JF937626__SS-prME
  source 1..9873: mol_type = other RNA
acttccctttgtttaatgatgatattacctgcagcacttgcatttcacttaacttcaagggatggagaacctagaatgattgtaggtaaaaacgagcgtggaaaaagcctgttattcaaaactgctagcggaataaatatgtgcacactgatagcaatggacctaggagaaatgtgcgatgacacagtgacatataaatgcccacatattaccgaagtggaaccagaggacatagattgttggtgtaatctcacaagtacatgggtaacatacggaacctgtaaccaagcaggagaacatcgcagagacaaacgatcagtggcactagcgccacacgtaggaatgggcttagacacccgaacacaaacgtggatgagtgctgaaggggcgtggaggcaagtagagaaagttgagacatgggcactccgacacccaggattcacaatccttgctttatttcttgcccactatatcggcacttctttgacgcaaaaagtagtcatattcatactattgatgttggtaacaccgagcatgacaatgcgatgtgttggtgtaggcaatcgggatttcgtagagggattaagtggagcgacatgggtcgatgtagttctagaacatgggggatgcgtcaccaccatggccaaaaataaaccgacgcttgatatagagctccagaaaacagaagcaacgcaactggccacactaaggaagctctgtatcgaaggtaaaataacaaatattacaacggatagtagatgtccaacacaaggtgaagcaaccctaccggaggaacaagaccaaaattatgtatgtaaacatacatatgtcgatcgcggatggggaaatggttgcggtttgtttggaaagggatcgttggtaacttgtgctaaattccaatgtttggaacccattgaagggaaagtagtacaatacgaaaatttgaaatatacagtaatcataacagttcacactggtgatcaacatcaagtggggaacgaaacccaaggagtcaccgcggaaataacgccccaagccagtaccactgaagcaatcttaccagagtacggtacgttgggcctcgaatgtagtccaagaactggcttagactttaacgaaatgatattattaaccatgaaaaataaggcgtggatggtccaccggcaatggttctttgacctacctttaccatggacaagtggagcaacaactgaaacaccgacttggaatcgtaaggaattactcgtcacatttaaaaatgcacacgccaagaaacaagaagtggtagtactggggagtcaagaaggtgcaatgcacaccgctctaacaggagcaactgaaatacaaaattcgggaggaacaagtatttttgcaggacacctaaaatgcagattaaaaatggataagctagaattaaaaggtatgtcatacgcgatgtgtacaaacactttcgtacttaagaaagaagtcagcgaaacacaacatggtaccatacttattaaagtggaatataaaggagaagatgttccatgtaaaatcccattttcaactgaagacggccaaggtaaagctcataatggaagactgattacagcaaatcctgtagttactaagaaagaagaacccgtcaacatagaagcagaaccacccttcggtgagtcaaacatagtaataggtataggagacaatgcactaaaaattaactggtataagaaaggttcttccataggaaaaatgtttgaggctaccgctcgaggagccaggaggatggcgatactaggagacactgcgtgggattttggcagcgtcgggggagtattaaatagcctaggtaagatggtgcaccaaatattcggcagtgcgtataccgcattattttcaggagtgtcatgggttatgaaaattggaataggcgtcttattaacatggatcggacttaattcgaaaaatacaagtatgtcctttagttgcattgcaatcgggataattacattgtatcttggagctgtagtgcaagcagatatggggtgtgtgattaattggaagggaaaagaactcaaatgtggatctgggatttttgtaacaaatgaagtacacacatggactgaacaatataaatttcaagccgacagccctaaacggctagcaactgcaatagcaggggcatgggaaaatggggtatgcggtataaggagtactaccaggatggaaaatcttctgtggaaacaaatagcaaatgagttgaattacatcctctgggagaacaacattaaactaactgtagtcgttggggatataatcggagtacttgaacaaggaaaacgtactctcacaccgcaaccaatggaactaaaatatagttggaaaacctggggaaaagccaagattgtcaccgcggagacgcaaaatagtagcttcataatagatggaccaaacactccggaatgcccttcggtatcccgtgcgtggaacgtttgggaagtagaagactacggttttggtgtctttacaacaaacatatggctcaaactgcgagaagtatacactcaattatgtgatcacagacttatgagcgcagcggttaaagatgaaagggcagttcacgcagatatgggatactggattgaaagtcagaaaaatggctcatggaaacttgagaaggcgtcactgatagaggtaaagacatgtacgtggcccaagtcgcatactctttggagcaatggagttttagaatcggacatgattatacccaaatctcttgcaggtcccatctcacaacacaatcatcgaccgggataccatacacaaacggcgggaccttggcatcttggcaagttagaactagattttaactattgtgaaggtacgactgtagtaattacagaaaattgtggcacccgaggcccatcactacgcacaacgacagtatctgggaaacttatacacgaatggtgttgccgatcatgtacactacctcccctacgttacatgggagaggatggatgctggtacggaatggaaattagacctatttctgagaaagaggaaaacatggtcaaaagtttagtatctgctgggtctggtaaagtagacaactttacaatgggagtgctttgtttagcgattctatttgaagaagttatgagggggaaattcggtaagaaacatatgattgccggagtcttcttcacgtttgtccttctgctaagcggacaaatcacttggagggacatggctcacacactaattatgataggcagtaatgcgtcagacaggatgggaatgggagttacttatttggctctgatagcaacatttaaaattcaaccatttttagccttaggcttctttttaaggaaacttaccagtagagaaaatttacttctaggagtaggcttagcaatggctactacattacagttaccagaggatatagaacaaatggcgaatgggatcgcactaggccttatggccctgaaactgattacacagttcgaaacctaccaactatggactgccttaatctcgctgacctgttcgaatacaatattcactttgactgtggcatggaggaccgcgacactcattctagccggagtatccttactaccagtgtgccaatcatcgagtatgcgaaagacagactggctgcctatggccgtcgctgctatgggtgtcccaccgttacccctatttatatttgggctgaaagatacgttaaaaaggagatcgtggcccctcaatgaaggagtcatggctgtgggattagtcagcatattagcgtccagtctgctaagaaatgatgtaccaatggcaggaccactggttgctggagggctgcttatcgcgtgctatgtgataaccggaacgtctgcagacctaacagtagaaaaagctgcagatatgacatgggaagaggaagcagaacaaacgggagttagccataacttaatgataaccgtagacgacgacggaaccatgcgaataaaggatgatgagactgagaatatcttaacagtactactcaagaccgctctactaatagtaagcggaatattcccgtattcaattccagcgactttgctagtatggcatacatggcaaaaacaaacccaacgaagtggggtcttatgggatgttcctagtcctcccgaaacacaaaaagcggagttagaagaaggtgtctatcgaattaagcagcaaggcatttttggaaaaacacaagtgggcgtcggggtgcaaaaagagggagttttccatactatgtggcatgtaactcgcggagcggtactaacatacaacggcaaacgacttgaacctaattgggcaagtgtgaagaaagatcttataagttatggcggcggatggcggctgtccgcacagtggcaaaaaggtgaagaagtccaagtaatagctgtcgaaccgggcaaaaatcctaaaaattttcaaacaatgcccgggacatttcaaactacgacaggagaaataggtgctattgccctagatttcaagccaggtacatctggctcaccaataatcaatagagaaggtaaggttgtaggactatatggaaacggcgtcgtcactaaaaatggtgggtacgtaagcggaatagcccaaacgaacgcggaacccgatggaccgactccagagctcgaggaggaaatgtttaagaaaagaaacttaactattatggacttacaccctgggtcggggaaaacaaggaaatatctccctgcaatagtcagagaagctatcaagagacgacttagaacattgatattagcaccaactagagtagtagccgcagaaatggaagaggctttaaaaggtttaccaattagatatcaaacaaccgcaactaaaagcgaacatactggtcgcgaaattgttgacctcatgtgtcacgctacttttacgatgagactcctcagtccagtacgagtcccgaattataatcttataatcatggatgaggctcattttacggatccagcaagtatagccgcacggggatacatatccacacgagttggcatgggagaagccgccgcaattttcatgacggctacaccgccaggaactgctgacgcctttccacagagcaatgccccaatacaggacgaggaacgagatataccagaacgatcttggaactcagggaacgaatggataacagacttcgccggaaaaacagtctggtttgtcccgtcaataaaagctggtaatgatatagcaaactgtttaagaaagaatggcaagaaagtcatacagttaagtcgtaagaccttcgatacggaataccagaaaactaaacttaatgactgggactttgttgtaacgacggacatatctgaaatgggagcaaattttaaagccgatcgtgtcatagatccaaggaggtgtctaaaaccagttattttgactgatggacctgaaagagtaatcctcgctggaccaatgcccgtgaccgctgctagtgctgcacaacgtcgcggacgggttggcagaaatcctcaaaaagaaaacgaccagtacattttcactgggcaacctcttaataatgatgaggatcacgctcattggaccgaagctaaaatgctgctcgataatataaatactcccgagggcataattccagcgttgttcgaacctgaaagagaaaaatctgcagcgatagatggagagtatcgacttaaaggagaatctcgaaaaacttttgtagagctaatgagacgcggagacttgcctgtgtggctcgctcacaaagtagcaagtgaaggaatcaaatacacagacaggaaatggtgttttgatggtcagcgaaataaccaaatattagaggaaaacatggacgttgaaatctggactaaggaaggagagaaaaagaaattaaggccaagatggctggacgctaggacgtactccgatcctctggcacttaaagagtttaaagagttcgctgcaggtagaaaatccattgctttagaccttgtgacagaaatcggacgagtccctagccatttggcacacagaacacgcaatgcgttagacaatttggtgatgttgcacaccagtgagcacggtgggcgagcatataggcacgctgtagaagaattaccagaaaccatggagacgcttcttcttcttggcttaatgatactcttgaccggaggtgctatgctttttctaattagcggaaaaggtataggaaagacatccattggactcatatgcgtcatcgcaagttcaggtatgctatggatggcagagataccgctgcaatggatcgcaagtgcaatagtgctggagttctttatgatggtcttactaatccccgaacccgaaaaacaaagaacaccacaggataatcaactagcttatgtagttataggaatcctaactctagcagcaatcatagcagcgaatgagatgggtctcctcgaaactacaaaacgtgatttgggaatgagtaaagaacctggagtggtatcgcccacatcatatctagatgtcgatcttcatccagcaagtgcctggacactgtatgcagtagcaacaactgtaataaccccgatgttacggcatacgattgagaactccacagcgaacgtatcgttagcagcaatagctaaccaagcggtagtgttaatggggctagacaaagggtggcctataagtaaaatggacctgggtgtacctctgttggcacttggatgttatagccaagtaaaccctctgactttaaccgctgcagttttactactaattactcattacgctataattggtccggggttacaagcgaaagcaacacgagaagcacagaaaaggaccgccgcggggatcatgaaaaatccaactgtagatggtatcatgactatagatttagatccagtaatatatgattctaaattcgaaaaacaattaggacaagtcatgttgctcgtattatgcgcagtacaattactattgatgcgcacttcgtgggcattgtgtgaagccttaactttagctacaggtcctattaccacattgtgggaagggtcgcctggaaaattttggaatacaacgatcgcagtgtctatggcaaatatatttcgtggcagttatctggcaggcgccggtctagcattctctataatgaaatctgtaggcacaggtaaacgaggtactggtagccagggtgaaactcttggagaaaaatggaaaaagaaattaaatcaactaagcagaaaagatttcgatttatataagaaatctgggataactgaagtagaccggactgaagcaaaagaaggactcaaaagaggtgagattactcaccatgcagtatcccgtggtagcgctaaactacagtggtttgtagaaagaaacatggtagtacctgaaggaagggtaatagacctgggctgtggcagaggagggtggtcctattattgcgcgggtcttaaaaaggtaaccgaagtaagagggtacacaaaaggtggaccagggcatgaagaaccggtacccatgtctacttatggatggaacattgttaagttaatgagtggaaaagatgtgttttatttaccacccgagaaatgtgatacattactatgtgatataggggagtcatcgccctcccctacggtggaagaatcgagaacaatacgggtattaaaaatggtcgaaccatggttgaagaataaccaattttgcatcaaggtattaaatccatatatgccaacagttattgaacatctagaacgtttacagagaaaacacggcggaatgcttgtacggaatccattaagtcgaaattcgactcacgaaatgtactggatctctaatggtacaggcaatatagtagcgtctgttaacatggtcagtcgtctattattaaataggttcactatgacacacaggcgcccaacaatagagaaagacgtagaccttggagcagggaccagacatgtcaatgcggaacctgaaacccctaacatggacgtcattggtgaacgaataaaaagaattaaagaggaacataattcaacttggcattatgatgatgaaaacccgtataagacgtgggcatatcatggtagttatgaagtcaaggcgacaggcagcgcttcctctatgataaatggtgtagtaaaattacttacgaagccgtgggatgttgtaccaatggtcacgcagatggcaatgaccgataccacgccattcgggcaacagcgtgtatttaaagaaaaggtagatacccgtacaccaagatccatgcctggaactagaagggttatgggtattacagcagaatggctttggcgcactctagggcggaataaaaagccacgattatgtactcgcgaagagtttaccaaaaaggtgagaactaacgcagcaatgggtgccgttttcacagaggaaaaccagtgggatagcgcaaaggccgctgttgaagacgaggacttctggaaattagtagacagggaaagggaattacacaaactgggcaaatgtggaagttgcgtatataatatgatgggaaaacgagagaagaaattgggagaatttggcaaagcaaaaggttcgagggcgatatggtatatgtggcttggcgcgcgctatttagaatttgaagcactcgggtttctcaatgaggaccattggttttctagagaaaattcatattctggtgttgaaggggagggattacacaagttaggatatatactaagagatatttcgaaaatacccggcggcgcgatgtacgcagatgatacagcgggatgggatacaagaatcacagaagacgatttgcataatgaagagaaaataacacagcagatggacccagagcacagacaacttgcaaatgcaatattcaaattaacataccaaaacaaagtagtcaaagtccaacgtccaactccaactggaacagttatggatataatctctaggaaggatcaaagagggtctggtcaggtaggcacttatggactcaacacattcactaacatggaggcccaactaataaggcaaatggagggagaaggggttttatctaaagcagacttagaaaatcctcacttacccgagaagaaaattacccaatggctagaaactaaaggcgtagaaagactgaaaagaatggctatttcaggcgatgattgcgtagtaaaaccaatcgacgatcgctttgcgaatgctctgctcgccctgaacgacatggggaaagtaagaaaagatatacctcaatggcagccatcaaaaggttggcatgattggcaacaagtccccttctgcagccatcattttcatgagttaataatgaaagatggaagaaaattggtcgtcccatgtaggccacaagatgagctgataggccgtgcccgaatatcccaaggtgcagggtggagtctcaaagagacagcttgtcttggaaaagcatacgcacagatgtggtccttaatgtatttccatagaagggatttgagattggcgtcaaatgctatctgctcggcagtacccgtacactgggtcccaacatctcgaactacctggtctattcatgctcatcatcagtggatgacaacagaggacatgctaactgtctggaatagagtttggatagaagacaatccttggatggaagataaaacaccggtaacaacttgggagaacgtaccatatttagggaaaagagaagatcaatggtgtggaagtctgataggattaacttccagagctacatgggcacaaaatataccaacagcaatacaacaagtacgaagtttaatcggaaacgaggaatttctcgattacatgcccagtatgaaacgatttcgtaaagaggaagaaagcgaaggggctatttggtaa

SEQ ID NO: 23231 - RNA, 9873 nt, synthetic construct
  misc_feature 1..9873: note = derived and/or modified CDS sequence (opt6) from DENV-3__JF937621__SS-prME
  source 1..9873: mol_type = other RNA
acttcgctatgcctgatgatgatattgccggcagcattagcatttcatctaactagcagggatggtgaaccacgcatgatagttgggaaaaatgaaaggggtaaatcactattgtttaaaaccgctagtggtattaatatgtgcacattaattgcaatggacctaggtgaaatgtgtgatgatacagttacttataaatgtccacatattacagaagtagagccagaagacatcgattgctggtgcaatctaacatccacctgggtgacgtatggaacgtgtaaccaagccggtgaacatagaagggacaaaagatctgttgctttagctccacacgtaggaatgggacttgatacccgaacacaaacttggatgtcagccgaaggggcatggagacaagttgagaaagtggaaacatgggcgctaagacaccctgggtttacaatattagctctatttttggcgcattatatcggaacctcgctaacacaaaaagtagtcatctttatactccttatgttagtcaccccgtccatgactatgcgatgcgtaggagtgggaaatcgtgatttcgtagaaggcctctcaggggcaacctgggtcgatgtagttttagaacatggtggatgtgttactacaatggccaaaaacaaaccaacgctggatatcgaactccagaaaacagaggcgacacaattggcaactctaagaaaactttgtatagaaggcaaaatcactaacattacgacagattcaagatgccctacacaaggagaagctaccttaccagaagaacaagaccaaaattacgtatgcaaacatacgtacgttgatagaggttggggcaacggttgtgggttgttcggaaaaggatctcttgtgacctgcgctaaattccaatgccttgaacccatcgaaggcaaagtagttcaatatgagaatttgaaatacaccgttattataactgtgcatacaggagaccaacaccaagtcggaaacgaaactcaaggggtcacagccgaaattactccccaagccagtacaacagaagctatcctacctgaatatggtactcttggcttagaatgctcccctcgaacagggctcgacttcaacgaaatgatacttctgactatgaaaaataaagcatggatggttcatagacaatggttctttgatttaccccttccatggaccagtggagcaacaacagagacgccaacatggaatcgaaaagagttacttgtgacctttaaaaacgcacatgccaagaaacaagaagtggtagtactcggttctcaagaaggtgcgatgcatacggcactaaccggggcaacagaaatacaaaattcgggaggcacctccatatttgcagggcatctgaagtgcagacttaaaatggacaaattagaattgaagggcatgtcctatgctatgtgcacaaatacgtttgtcctaaagaaagaagttagtgagacgcaacatggaaccattttaatcaaagtagaatacaaaggtgaagatgttccatgcaagattccatttagcacagaagatggccaaggaaaagcccacaacggcagactaataaccgctaacccagttgtgactaaaaaggaggaacccgttaatatcgaagcagaaccaccatttggcgagtcaaacatcgtgataggaattggagacaatgcactgaaaattaactggtacaaaaaggggagttccataggcaaaatgttcgaagctactgcaaggggagctagacgaatggctatactaggtgacaccgcttgggattttggaagtgtaggaggcgtccttaacagcttaggaaaaatggttcatcaaatattcggatctgcatacacggcactattttctggggttagttgggtaatgaagattggtataggagtgcttcttacatggataggtttaaattcgaaaaacacttcaatgagtttttcctgtatagcaattggcataataacactctatcttggtgcagtagtacaagctgacatgggttgtgttattaactggaaaggaaaagagcttaaatgtggctcaggaatatttgttacaaatgaagtgcacacttggactgaacaatacaaatttcaagcggattctcctaagaggttagcaacagcgatcgctggagcttgggaaaatggagtttgtggcataagatcgacaaccaggatggaaaatctgctctggaaacaaatagcgaatgaattaaattatatattatgggaaaataacatcaaattaactgtcgtggtgggagatattattggagtgttagaacaaggtaaaagaacactcacaccccaaccaatggaactaaagtattcttggaaaacttgggggaaggcaaaaatagtaaccgcagaaacccagaactcatcattcatcatcgacgggccaaacactccagaatgtccatctgttagtagggcctggaacgtttgggaagtagaagactatgggtttggtgtatttacaacaaacatatggttaaaacttcgggaagtctatactcagctgtgtgatcatagactaatgagtgccgcagtgaaggatgaaagagcggtacacgcggatatggggtattggattgagagtcagaaaaatggatcatggaaacttgaaaaagcctcattaatcgaggttaagacttgtacttggccaaaatcccatactttatggtcaaacggagtgctggaaagcgatatgataattccaaaatctctagcgggacctatctcgcaacacaatcatagacccggttatcatacccaaacggcaggaccctggcacctaggaaaattggaacttgattttaattattgcgagggaactacagtggtaattacggaaaattgcggtacaagaggaccgtcattacgtactacaacagtcagtggaaaactaatacatgagtggtgttgccgatcatgtactttaccacccctacgatatatgggggaggatggatgctggtacggaatggaaattcgacctattagcgaaaaagaggaaaatatggtgaaatctctagttagtgctggtagtggtaaggtagacaactttacaatgggagttctatgtctggccatactttttgaagaagtgatgcgtggaaaattcggaaagaagcatatgattgcgggtgttttctttacatttgtgttactactcagtgggcaaattacctggcgagatatggcacatacccttattatgatagggtcaaatgcatcggaccgtatgggaatgggagttacatacctcgcgttaatagctacattcaaaatacaaccgtttctcgcacttggattctttttaagaaaattaacctcaagagagaacctgctactcggtgtaggactggctatggcaacaaccttacaacttccggaagacatagaacaaatggcgaacggtatagccttgggactaatggcgcttaaacttataactcaattcgaaacatatcaactctggacagcactcattagtcttacttgttctaatacaatatttacattaactgtggcatggcgaacagctacactgatacttgcgggagtctcgctattaccagtttgtcagagttcatccatgaggaaaactgattggcttccgatggcagtagcagcaatgggtgttccccctctcccactttttatatttggactcaaggatactctaaaaagaagatcatggccactaaatgaaggagtaatggcagtagggttagtttctattttagcgagttcattgttaagaaacgatgtaccgatggctggacctctagtagcaggcgggttacttatagcatgctatgtaataaccggtacatctgcagatctcactgttgaacgggcagcagatataacttgggaagaagaggccgaacagactggagtttctcataatttgatgataacagttgatgacgatgggacaatgagaataaaggacgatgaaacagaaaacatcttgacggtactgcttaaaactgcgctattgatagtcagcgggatatttccttacagcatacctgctacgcttttagtatggcacacatggcaaaaacagactcaaagaagtggcgtcttatgggacgtaccttcaccaccggaaacacagaaagcggaactcgaggaaggggtgtataggataaaacaacaaggcatattcggcaagactcaagtcggcgtaggcgttcaaaaagagggagtgtttcatacaatgtggcatgtaacgcgaggcgctgtacttacttataacggaaagagactagaacccaattgggcttcggtgaaaaaggacttaatttcatacggtggaggctggagattatcagcacagtggcaaaaaggcgaggaagttcaagttatcgcagtagaaccgggcaaaaatcccaaaaacttccagaccatgccaggaacatttcagacgactacgggcgagattggtgctatagcacttgactttaaaccaggtacgtccgggagcccaattataaacagagaaggtaaagtcgtaggattatatggtaatggagtcgtaaccaaaaatggagggtatgttagtgggatcgcgcaaactaatgcggaacccgacggaccaacacctgaattagaagaagaaatgtttaagaaacgaaacctgacaataatggacctgcatcctggatcagggaagactcggaagtacttacctgcaatagtaagagaggctatcaaaagaaggctccgcacattaatactagccccaacaagggtagtggccgcagaaatggaggaagctctaaaaggattgccaatacgataccagacaacagcaaccaaaagcgagcatacgggtcgtgaaatagtagatctaatgtgtcatgcaacgttcactatgcgactattatcacccgttagagttccaaactacaacctaataataatggatgaagcacattttaccgatccagcttcaattgctgcgcgtgggtatatcagcacaagggtaggcatgggggaggcagctgcaatctttatgacggcaacccctcccggaactgcggacgcatttcctcaatctaatgccccaattcaagatgaagaacgtgatatacctgaacgatcgtggaactctggaaacgaatggattacagactttgcaggcaagacggtgtggttcgtaccatcgataaaagcgggtaatgatatcgcgaactgtttgcgtaaaaatgggaagaaagtaatacaacttagccgaaaaacatttgacaccgaataccagaaaactaaattaaatgattgggactttgtagttactacagacatatccgagatgggagccaattttaaggctgatagagtgattgatcccagaaggtgtctcaaacccgtaatactcacagatggcccagagcgggtcatattagcagggccaatgcctgtaactgcggcatcagcagcgcaacgcagagggagggtaggcaggaatccccaaaaagaaaatgaccaatatatatttactggccaacctcttaataacgatgaagaccatgctcactggacagaagcaaaaatgctgttggataatataaacacgcctgaaggaatcataccagcacttttcgaacctgaacgtgaaaaatcggcagcgatcgatggtgaataccgattaaaaggtgagtcccgaaaaactttcgtcgaacttatgcgtcgtggtgacttgccggtctggcttgcgcataaagtagccagtgagggaataaaatacacggatagaaaatggtgcttcgatggacaaagaaataaccaaatattagaggaaaacatggatgttgaaatctggacaaaggaaggagagaagaagaaattgagaccccgctggttagatgctcgaacatatagcgatccactagccctaaaagaatttaaggaatttgcagccggtagaaagtctatagctttagacctcgtgacagagataggaagagtaccttcccatcttgcccatcgaacaagaaacgctcttgacaatctggttatgcttcacacttcggaacatggaggcagagcctaccgacacgctgtggaagaacttccggagacgatggaaacactattgctgttaggattgatgatattattaacaggaggtgcgatgttatttttgatatcgggaaaagggataggtaagacaagcattggattgatctgcgtaattgcttcctcaggaatgttatggatggcagaaattccattgcaatggatagcttccgcaattgtcctagagtttttcatgatggttctcctaatacccgaacccgaaaaacaaagaacaccacaagacaaccaattagcctacgttgtcataggtatattgacattagcggcgataatagcagccaatgaaatgggtttactagaaacaactaaacgggatctcggaatgtccaaagagcccggagtagtttctcctacgtcatatttagatgtagacttacatcccgcatccgcgtggacactatacgcggtagcaacaaccgtcatcaccccgatgttaagacatacgatcgaaaattcaacggccaacgtttcattagcagctattgccaaccaggctgtagttctaatgggactggataaaggctggccaattagcaaaatggatctaggtgttcctctcctcgcactcggctgctatagtcaagttaacccgttaactctgacagcggccgtgcttttactcataactcattacgcgatcataggaccaggactgcaagcaaaggccacacgggaagctcagaaaagaacagcagctggcataatgaaaaacccaacagtagacggaatcatgactatagatcttgatcccgtaatatacgattctaaattcgaaaaacaattgggacaagtgatgctcttagttctatgcgcagttcaactgttattgatgcgcacatcctgggctttatgtgaagccctaacactagctaccggtcctataacaacattatgggaaggttctccaggaaagttctggaataccacgatcgccgtcagtatggctaatatattccgaggttcttatctggcaggggccggacttgcgttttccataatgaaatcagttggtaccggaaaaagaggaacagggtcacaaggtgaaacgctcggcgaaaaatggaagaagaaattaaatcaactgtccagaaaagattttgatttgtacaaaaagagtggaataactgaggtggacagaacagaagcaaaagagggattaaaaagaggagagatcacacaccatgctgtatcgcgtggttcggcgaagttacagtggttcgtagaacgtaatatggttattccagaaggacgggtcatagatctaggctgcggaagaggtggttggtcatactattgtgctggtctgaaaaaggtcaccgaagttcgcgggtatacaaaaggtggacctggacatgaggaacctgtgcctatgagcacttatggatggaatattgtgaaattaatgagcggaaaggatgtattttaccttccacctgaaaaatgtgacacactattatgtgatattggcgaatcatccccttcacctacagtagaagagagccgtacaatacgcgtactcaaaatggtcgaaccgtggctcaaaaacaatcaattttgcataaaagtcctaaatccatacatgccaacggtaattgaacatctagaacgtctccaacgaaaacacggaggtatgttagtaagaaatcccttatcacgaaattcaacacacgaaatgtattggatatcaaatgggacagggaatatagttgcaagtgtgaacatggtaagtcgccttcttcttaatcggtttacgatgacacatagaaggccaacgatagagaaggacgttgatctgggagcgggaaccaggcacgttaacgccgaaccggagacaccaaacatggacgttatcggtgaaaggataaaacgcataaaagaagaacataattctacttggcattatgacgacgagaatccttataaaacgtgggcgtatcatggttcctatgaagttaaggcaactggcagtgcaagcagcatgataaatggagtagtcaaattgttaacaaagccatgggatgtagtaccgatggtaacgcaaatggctatgaccgatacgactccatttggccaacaacgcgttttcaaggaaaaggtagatacaaggacaccgcggtcaatgccgggaacgaggagggtaatgggaataactgctgaatggttatggagaacattgggaagaaataagaaaccgagactttgcacccgcgaggaatttacaaagaaagttagaacaaatgctgcgatgggagccgtatttacagaagagaatcaatgggatagcgctaaagccgcggttgaggatgaggacttctggaaactcgttgatagggaacgagagttgcataagctaggaaaatgcggtagctgtgtatacaatatgatgggaaaacgtgagaagaaactgggagaatttggcaaagctaaagggtctagagcaatatggtatatgtggctaggagcacgatatctagaatttgaagcgctaggattcctcaacgaagatcactggttttcaagggaaaatagctatagtggggttgaaggagaaggcctgcacaaattaggctatattctaagggatatttcgaaaatacccgggggagcgatgtatgccgacgatacagcgggctgggacactaggataacagaagatgacctgcacaacgaggagaaaattacacaacagatggaccctgaacataggcaactagcaaacgctatattcaagttgacctatcaaaacaaggtagtaaaggttcagcggcctacccccaccggaacagttatggacataatatcaagaaaggaccaacggggaagtggccaggtcggtacatacgggttaaatactttcaccaatatggaagcgcaattaataaggcagatggagggtgaaggagtgctgagcaaagcggatctcgaaaatccccatctacccgagaagaaaataactcaatggttagaaacaaaaggcgtagagagattaaagagaatggcaataagtggagacgattgtgtagtcaagccaatagacgaccgattcgcaaacgcactcctagctctaaacgacatgggtaaagtccggaaagatataccgcaatggcaaccatcaaaggggtggcacgactggcaacaagtaccattttgcagtcatcatttccatgagctcataatgaaagatggaagaaagttagtagtgccatgtaggccacaagatgagcttatcggacgggccagaataagccaaggagccggttggagcttgaaagaaaccgcatgtttaggtaaagcatacgctcaaatgtggtctttaatgtactttcacagaagagatctgcgtttagcatctaatgcgatatgttcggcggtccctgtacactgggtcccaacatcaagaacgacatggtcaatacacgctcaccatcaatggatgactaccgaagacatgctaactgtctggaatcgtgtttggatagaagataatccatggatggaagataaaacgccagtcacaacatgggaaaacgtaccttatttagggaaaagagaagatcagtggtgtggctcgcttattggtctaacttcgcgagcaacatgggcccaaaacatcccaactgcaatacaacaagtaagaagtttgattggaaacgaggagtttcttgactatatgccaagtatgaaaagattccgaaaagaagaagagtctgagggagccatctggtaa

SEQ ID NO: 23232 - RNA, 9873 nt, synthetic construct
  misc_feature 1..9873: note = derived and/or modified CDS sequence (opt6) from DENV-3__JF937623__SS-prME
  source 1..9873: mol_type = other RNA
gcttccctttgcttaatgatgatattaccagcggcacttgcattccatctaaccagtagggatggtgaacctaggatgattgtaggtaaaaatgaaaggggaaaatcattactatttaaaacagcaagtgggatcaacatgtgcactttaattgcaatggaccttggggaaatgtgtgatgatacggtaacatataaatgtccacacatcaccgaagtcgaacctgaagatatagactgttggtgtaatctaacaagtacttgggtgacatatggaacgtgtaatcaagccggggaacacagacgtgataaaagatcagttgccctagccccacatgtcggtatgggcttggacacaagaacacaaacatggatgtccgcagaaggagcatggcgacaagtcgaaaaagttgaaacttgggcactacgtcatccgggatttacaatactggctctgtttttagcccactatataggaacttcgttgactcaaaaagtagtgatttttatactattgatgctagtcaccccctctatgacgatgcgatgcgtgggcgtaggaaaccgagatttcgtggaagggctcagtggagctacctgggtagacgtagtattagaacacggtggttgtgtaacaacaatggccaaaaataaaccgacactagacatcgagctccagaaaacggaagcaacacaattggctaccctgcgcaaactgtgtatcgagggtaaaataaccaacataacaacagactctcgctgcccaactcaaggcgaagcaactttacccgaagaacaagatcaaaactacgtctgtaaacacacctatgttgaccgaggatgggggaacggttgtggtctgttcgggaaaggaagccttgtaacttgcgcgaaattccaatgcttggaacctattgagggaaaagttgtgcagtatgagaatctaaaatatacagtaatcataactgtgcacacgggcgatcagcaccaagttggtaacgaaacccaaggagtcacagcagaaattacacctcaggcttctactacagaagccattctaccagagtacggaacactaggcttagaatgttcccctagaaccggacttgacttcaacgaaatgatactattaactatgaaaaacaaagcatggatggttcatcgacaatggtttttcgacttaccgctaccttggacatcaggagccacaactgaaaccccaacatggaatcgaaaagaactgcttgtaacgtttaaaaatgcacatgcgaagaaacaagaagttgtagttcttggaagccaggaaggtgcgatgcacactgctctaactggcgctaccgagatacaaaacagcgggggtacttcaatctttgctggacacctaaaatgtaggctaaaaatggataaacttgaattaaaaggtatgtcatacgcgatgtgtactaatacatttgtgttaaagaaagaagtttcagaaacccaacacgggacgatcttaataaaagttgagtataaaggagaagacgttccttgtaaaatcccattcagcacagaggatggccaaggaaaagctcataacggtagactgataacagcaaatcctgttgttaccaagaaagaggaacctgtaaatatagaagccgaacctccctttggagagtctaacatagtcataggaattggagacaatgccttgaaaataaactggtataagaaaggatcgtcaatagggaaaatgtttgaagcaacagctaggggagcaagaagaatggcgattctcggagacaccgcctgggacttcggttcagtgggaggggtgctaaattcactagggaagatggtacatcagatctttggttcagcttacactgcactattctcaggtgtatcttgggtaatgaagataggaataggggttttactaacatggataggcctcaactccaaaaataccagcatgtcgttttcgtgtatagctatcggtattataacgctttacctaggagctgttgttcaagcagatatgggatgtgttataaactggaagggtaaagaattgaagtgcggctccggaatcttcgtgactaacgaggtacatacatggacagaacaatacaagtttcaggcagattctcctaaaaggttagcgacagcaattgcgggcgcctgggaaaatggagtttgcggaatcagatcgacgacaaggatggaaaacctactctggaagcaaattgcaaatgaattgaattatatattatgggagaataacataaaattaactgttgttgtaggtgatatcataggggtcctagagcaagggaaacgaaccctcactcctcagcctatggagttaaaatattcatggaaaacatggggaaaagccaaaatcgttactgcagaaactcaaaacagcagcttcatcattgatggtccaaatactcccgaatgcccctctgtgtcaagggcatggaatgtatgggaagtagaggattatggattcggagtattcacgacaaatatttggcttaaactcagggaagtatatacacaattatgcgaccatagactaatgagtgcggctgtaaaggatgagagagcagtacatgctgatatgggatattggattgaaagtcagaaaaatggaagctggaaacttgaaaaagcctcgttaatagaagttaaaacttgtacttggcctaaatcccacacactttggtcaaatggagttttagaatctgatatgattattcccaaaagcctggctggacctattagtcaacataaccacaggccgggctatcatactcagacggcaggcccatggcatttaggaaaattagaattggatttcaactattgcgaaggcacgacagtcgtaataactgaaaattgtggaacacgtggaccaagtcttagaacaacgacagtttccggcaagctaatccatgaatggtgctgccgctcctgtacattacctccactaaggtatatgggtgaggatggttgttggtatggaatggaaatccgaccaatttcggaaaaggaagaaaatatggtgaagtcattagttagcgccggatctggtaaagtagataatttcacaatgggtgttctgtgccttgcaatcttattcgaagaagtaatgcgaggaaaattcggcaagaaacatatgatagccggaatattctttacatttgtactattgctatcaggacaaataacctggagagacatggcacacactttaataatgattgggtccaacgcgtcggatcggatgggaatgggggtcacgtatctggcactaatcgcaacttttaagatacaaccattcttagcacttggatttttcttaagaaagttgacatcacgtgagaatctacttttaggagtcggattagcaatggccaccaccctacagttaccggaggacatagaacaaatggcaaacggcatagctcttggacttatggctctaaagctaataacacaattcgaaacataccaactctggacagctctaatatcattaacttgctccaacacgatctttacactaacagtcgcttggaggacagcaacactaattttagcaggggtaagtcttctcccagtttgtcaaagctcatccatgcgaaaaacggattggttacccatggctgtggcggccatgggcgttccacccctcccattatttattttcggactcaaagatacattaaaaagaagatcatggcccctcaatgaaggtgttatggcagtaggattagttagtatcttggcaagctccttgctaaggaatgatgtacccatggcaggcccattggttgccggtggtttgttgatcgcttgttacgtaataacaggtacctcagccgacttaaccgttgaaaaggcggctgatatgacctgggaagaagaggcggaacaaacaggagtatcacataatttgatgatcactgtggacgacgatggaactatgcggataaaagatgatgaaactgaaaacattctcacagttcttcttaaaactgcgcttcttattgtaagcggcattttcccctactcaattcctgctactctactcgtgtggcacacatggcagaaacaaacgcaacgatccggggtcctatgggacgttccctcgccacctgagactcaaaaagctgaactagaagaaggaatctacagaataaaacaacaaggaatattcggcaagactcaagtcggagtaggagtccagaaagagggtgttttccatacaatgtggcacgttacacgcggagcggtacttacatacaatggtaagcgattagagccgaattgggcatctgttaagaaagacttaatttcctatggaggaggctggcgactatcggcacaatggcaaaaaggagaggaggtacaagtaatagcagtagaaccaggcaaaaatccgaaaaacttccagacaatgcctgggacattccaaacaacaacaggcgagataggggcaattgccctggattttaagccgggaacaagtggatcaccgataattaacagagaaggtaaggtagtagggctctatggaaatggagtagttaccaagaatggtggttatgtcagtggaattgcacaaactaatgcagagccggacggtccaacacccgaacttgaagaggaaatgttcaagaaacgaaatttaaccattatggaccttcatccagggagtggaaaaacgcgaaagtatctcccagctatagtaagagaggcaataaaacgcagactaaggacactcattttagctccaacaagggttgttgcagcagaaatggaagaagccttaaaaggattaccaatcagatatcaaacgactgcaacaaaatcagaacacacagggagggaaattgtcgacttaatgtgccacgcgactttcactatgcgattgttatctccagttagagtaccgaattataatcttattattatggatgaagcccactttacagatcccgctagcattgccgctagaggttatatatccacaagagttgggatgggtgaagcggcagctatctttatgaccgcaacacccccaggaacagccgatgcatttccgcaaagtaatgcaccgatacaagatgaggaaagagacatacctgaaaggagctggaactctggtaatgaatggataaccgattttgctgggaaaacagtctggtttgtacctagtataaaagcagggaacgatatagcaaattgcctgaggaagaatggtaagaaagtaatacaattaagccgaaagacgtttgatactgagtatcaaaagactaaacttaatgactgggatttcgtagtaaccacagacataagtgaaatgggggcaaattttaaagcggatagagttatcgatccccgcagatgcttaaaacctgtcatattaactgatggcccagaaagggtaatattagctggacccatgcctgtaacagcagcttcagcggcccaacgaaggggaagagtgggcaggaatcctcaaaaagagaatgatcaatacatttttaccggccaacctttaaataatgacgaagatcacgcacattggaccgaagcaaaaatgttgttagacaatataaacacgccagaaggaatcattcccgcgctatttgaacctgaaagggaaaaatctgccgcaatagatggagaatacagactaaagggggagtcgagaaagacttttgtggagcttatgcgacgtggtgatctaccagtttggttagctcataaagtcgcttcggaaggtataaagtatactgaccgcaaatggtgttttgatggacaacgaaacaatcagattctggaagaaaacatggatgtagagatttggacaaaggaaggagagaagaagaaactgaggccacgatggttagatgctcggacatactcagatccactggccttgaaagagttcaaagagttcgctgcagggcgaaaatcaatagctttggacctggtaacggagatagggcgtgtacctagtcacctcgcacatcgtacaaggaatgcccttgacaatttagtaatgctacatacttcagaacatgggggacgagcttatcgacacgcagtagaagaattaccagaaactatggaaaccttactactcctaggcctcatgatattgctaactggaggagcaatgctattcctgatttctgggaaaggaatagggaaaacatccataggcttaatatgtgtaatagcttcgtctggtatgttatggatggcagagataccgctgcagtggattgcgagtgcaattgtactagagttctttatgatggtactcctaatacccgaaccagaaaaacaacgaacccctcaggataaccaattagcatatgtagtaataggaatattaacgttagcagccataatcgcggcaaacgaaatgggactactagagactaccaaaagggacctcggcatgagtaaagaaccaggagtagtatcgccaacgtcgtatctcgatgtagatttgcaccctgcatccgcttggactttatatgctgtcgcaactaccgtaattacgccaatgttaagacacaccattgaaaattccacggcaaacgtgtcacttgcagcaatcgcaaatcaagcggtggtgctaatgggattagataaaggctggccgatctcaaaaatggatctgggggtacctctgttggcactagggtgttattctcaagtaaatccattaactttgactgcagcagtattactattaattacgcattatgcaattataggacctgggctacaggctaaagcaactagagaagcacaaaagaggactgctgcaggtattatgaaaaatccaaccgtagatggcataatgactattgatctagatccagtgatttacgacagcaaattcgaaaaacaactaggtcaagttatgcttctagtcttatgcgcagttcaactattgctaatgcgaacatcttgggcattatgcgaggccttgactctggccacaggtccaatcacaacactctgggaaggttcgcccggaaaattctggaatacaactatcgcggtatcaatggcaaacattttccgaggaagctatttagctggagcaggtttagcatttagcataatgaagtccgtggggacaggaaagagagggaccgggtcacagggagaaaccttaggggaaaaatggaaaaagaaattaaatcagttatcgagaaaagatttcgatctatacaagaaatctggaatcacagaagtagacaggactgaagcaaaagaaggtttgaaaagaggcgaaattacccaccacgctgtaagtcgaggtagtgccaagttacaatggtttgtggaacgaaacatggtaattccagaaggtagagtgatagatttaggttgtgggagaggagggtggagttactactgcgcaggtttgaagaaagtaacagaggtgcgtggatataccaaaggaggccccggccacgaagaacccgtaccaatgtcaacttacggctggaatatagttaagttaatgtccggaaaagatgtattctatttaccgccggagaaatgtgatacacttttatgtgatatcggagaatcaagtccttcacctacagtagaagagtctcgcacaataagagtgctaaaaatggttgaaccatggcttaaaaataaccaattttgtatcaaggtactaaatccgtacatgccaactgtaattgagcacctagaacgattacaaaggaaacacggaggaatgctggtacgcaatccattgagccgaaattcgactcatgaaatgtactggatttcaaatggaacgggtaatatagtcgcaagcgtaaacatggtaagtagacttttattaaatcgattcactatgacacacaggcgacctacaatagaaaaagatgtggacctgggtgcaggtacgagacatgtcaacgctgagccggagacaccgaacatggacgttattggagagaggattaaaaggataaaagaagaacataatagcacttggcactatgacgatgagaacccttataaaacatgggcatatcatggatcctatgaggtcaaggcaacaggaagcgctagctctatgataaacggggtggtgaaactactaactaaaccgtgggacgtagtgccgatggttactcaaatggcgatgacagatacgacgccctttggacaacaacgagtattcaaggagaaggtagatacgagaactccgagatcgatgccaggaacgaggcgagtaatgggaataacagctgaatggctatggagaacactgggcaggaataagaaaccccggctatgcacgagggaggaatttaccaagaaagtaagaacaaacgccgccatgggtgctgtattcacggaagagaatcaatgggacagcgccaaagccgctgtagaggacgaagacttttggaaacttgttgatcgagagagggaattacacaaactagggaaatgcggctcgtgcgtttataatatgatgggaaaacgtgagaagaagctgggcgaatttggaaaagcaaaagggtctagggcaatatggtacatgtggttaggagcacgctatttagagtttgaagcacttggtttcttaaatgaagatcattggttctcgagagaaaactcatactctggggtcgaaggggaaggattacacaaactaggttatattttgagagacatttctaaaataccaggaggtgcaatgtatgcggatgataccgctgggtgggacaccaggattactgaagacgatctgcataacgaagagaaaatcacacaacaaatggatcctgaacatcgtcaactagcgaacgcaatatttaaacttacttaccaaaataaagtggtcaaagtacaaagaccaacacctaccggcacggttatggatattataagtaggaaggaccaaagaggttccggccaagtcggcacttatggcctaaatacatttaccaatatggaggctcagttaattcgacagatggaaggtgaaggtgttctctccaaggcagaccttgaaaatccacatttacccgagaagaaaattacgcaatggcttgaaacaaaaggggtggagaggttaaaaagaatggcaataagtggagacgattgcgttgttaaacccattgatgacaggtttgccaacgccttattagcgcttaatgacatgggtaaagtccgcaaggacatcccgcaatggcagccgagcaaaggatggcacgattggcagcaggtccccttttgtagtcaccattttcatgaacttattatgaaagatggcaggaaattagtagtcccatgccgtccacaagacgagttgataggacgagctcgaatcagccaaggagcgggctggtcattgaaagagacagcgtgtttaggtaaagcctatgctcaaatgtggtctctaatgtattttcatcgtcgcgaccttagattggcaagcaatgctatttgctctgcagtacctgttcactgggtccctacctcgagaactacttggtccatacatgcgcaccatcaatggatgactactgaagacatgttgacagtatggaacagagtctggattgaggataatccttggatggaggataaaactccagtcaccacttgggaaaacgtcccttacttaggcaaaagggaagaccagtggtgtggatctttaatagggcttacttcccgagctacatgggcccaaaacataccaacggcaattcaacaagtacggtcattaataggcaacgaagaatttctagattacatgccatccatgaagaggtttagaaaggaagaagagagtgaaggggctatttggtaa

SEQ ID NO: 23233 - RNA, 9873 nt, synthetic construct
  misc_feature 1..9873: note = derived and/or modified CDS sequence (opt6) from DENV-3__JF937637__SS-prME
  source 1..9873: mol_type = other RNA
accagcttatgcctaatgatgattttgcccgctgcgctggcatttcacctaacaagtagggatggagaaccacgtatgatcgtggggaaaaatgaaagagggaaaagtctattatttaaaaccgcatctggtattaatatgtgcactttaatagcaatggacctgggagaaatgtgtgatgatacagtaacttacaaatgtcctcacataactgaagtagaaccagaagatatagattgttggtgtaatctaacgagcacatgggtaacatacgggacttgcaatcaggcaggagaacataggagagataaacgttcagtggctttagcaccccacgtaggtatgggactagacacacgaactcaaacgtggatgtcagcggaaggagcatggagacaagtcgaaaaagttgaaacatgggctttaagacacccagggtttacgatactagcattatttttagcccactatataggtacgagtttaactcagaaagttgtcatctttatactattaatgttagtaactcctagtatgacaatgcgatgcgtaggtgtaggcaacagagattttgttgaaggactaagtggagctacatgggtagacgtggtactggaacatggaggatgcgttaccactatggccaaaaataaaccaacgcttgacatagaactgcagaaaaccgaagcaacacaattagctacacttcgaaaactttgtatagaaggaaaaattactaatatcactacagattccagatgtccaacacaaggagaagcaactctacccgaagaacaagaccaaaactacgtgtgtaaacatacatacgtagatcgtggctggggtaacggatgtgggctttttggtaaaggatctcttgttacatgtgccaaatttcaatgtttagaacctattgaaggtaaagtagtccaatatgaaaacctaaaatacacggtcataataacagtgcacacgggagatcagcatcaagtaggcaatgagacccaaggtgtcactgcggaaataactccccaagcaagcacaactgaagctattttacccgaatatggcacgttgggactggaatgtagtccacggacaggtcttgattttaacgaaatgattctattaacaatgaaaaataaggcttggatggtacaccgccaatggttctttgacctaccattgccatggacgagcggtgccaccactgaaacacccacctggaatagaaaagagttgttagtaacgtttaaaaatgctcacgctaagaaacaagaagtagtggtactcggttcccaagagggagcaatgcatacagcactgacaggtgcgacagaaattcaaaattctggaggtacttccatatttgccggtcatttgaaatgtcggttgaaaatggacaaattagaattgaaaggtatgtcatacgccatgtgcacaaacgcatttgtgctcaagaaagaagtatcagagacccagcatggaacaattctgatcaaggtggaatataagggagaagacgttccgtgcaagatacccttttccacggaagatgggcaaggaaaagcgcataatggtcggctaataactgcgaatcctgtagtcacaaagaaggaagaacccgttaacatagaagctgagccaccgtttggagaatccaacattgttataggaataggcgataacgcattaaagattaactggtataagaaaggtagttccataggcaaaatgttcgaagctaccgcaagaggggcacgacgaatggcaatactaggagacactgcgtgggattttggaagtgtcggtggggtcctcaatagtctagggaaaatggtacatcaaatttttggaagcgcctatacggcgctcttttcaggtgtctcatgggtaatgaaaataggcataggagtattactgacatggatcggcctgaactctaagaatacgtctatgagttttagttgcattgctataggtataattactttatacttaggtgcggtagtacaggcagatatgggatgtgtaataaattggaaaggaaaggaattaaagtgtggtagtggaatattcgtaacgaatgaagtacatacctggacagaacaatataaatttcaagcagattctccaaaacgattagctactgcgattgcaggagcatgggaaaatggcgtctgtggaattagaagcacaacacgcatggaaaatttgctctggaaacaaattgctaatgaacttaattacattctatgggaaaacaatattaaactaacagtagtagtgggtgatattataggagtccttgagcaaggaaaaaggacacttactcctcagccaatggaactaaagtacagttggaagacgtggggcaaagccaaaattgtcactgcagaaacacaaaactcaagttttataattgacggtcctaacacaccagagtgtccaagcgtatcacgagcatggaacgtttgggaggttgaagattatggattcggagtctttacaacaaacatatggctaaaacttcgcgaagtttatacccaactttgtgatcataggctaatgtctgccgcagtgaaggacgagagagcagtgcacgctgatatggggtattggatagaaagccagaagaacggttcctggaaattggagaaagctagtttaatagaggtaaaaacatgcacatggcctaaatcacatactctgtggtctaatggagtactagaaagcgatatgatcataccgaagtctctagctggaccgatcagtcaacataatcatagacctggctatcatactcaaacggctggaccgtggcatcttggaaagctagaattagattttaattattgtgagggaacaactgtagtcattacagaaaattgtggaactagaggaccaagtcttcgaaccacaacggtgtcaggtaaacttatccatgaatggtgctgccgaagttgtacccttcctccgctaaggtatatgggagaggacggatgctggtatggcatggaaatcaggcctatctccgagaaagaagagaatatggttaaaagtttagtcagtgcgggaagcggtaaagtagataacttcactatgggagtcttatgccttgcaatattattcgaggaagtaatgagagggaagttcggaaagaagcacatgatcgcgggtgtattctttacatttgttcttttattaagtggccaaattacatggcgcgatatggcacatactttaattatgataggttcgaacgctagcgatagaatgggtatgggggtcacatacttagctttaattgccacttttaaaatacaaccatttcttgccttaggcttctttcttagaaaattaaccagcagggaaaatctgttgctcggcgtcggtctagcgatggcaactaccctacaactccctgaggacatagagcaaatggctaatggtatcgccctagggctcatggcacttaaattaattacgcaattcgaaacatatcagttgtggacggcattgatatcattaacatgctcaaacacaatctttacgctcacggtagcttggaggacggccacgttgatactggccggagtaagtctgctaccagtgtgccaaagttctagcatgcgaaaaactgattggctaccaatggcggttgcagcgatgggtgttccaccattacctctattcatcttcggtttaaaggacacattgaaacggcgatcatggccattaaatgaaggtgttatggcagttggcctagtaagcatccttgcatccagcctactcagaaatgacgtgcccatggccggtccattagttgcaggaggccttcttatagcctgttacgtcatcacgggaacatctgccgatttgactgttgaaaaggctgcggatataacttgggaagaagaagctgagcaaactggagtaagtcacaatctgatgataactgtcgatgacgacggcactatgaggataaaagatgatgagaccgagaacatcctcacggtcttattgaagacagctttactaatagtaagtgggatattcccttattcgatacccgctactctattagtttggcacacctggcaaaagcaaacccagcggagtggtgtcctttgggacgtcccctcaccaccagaaacacaaaaagctgaattggaggagggagtttaccgaatcaaacaacaggggatttttggcaaaactcaggtcggagttggagttcagaaagagggagtttttcacacaatgtggcacgtaacccgaggagcggttctaacctacaatggaaagcgactagaaccgaattgggcatccgttaagaaagatctcatttcctatggaggtggctggagattatcagcgcagtggcaaaaaggggaggaagtacaagtcatagcagttgaacctggtaaaaaccctaagaattttcaaacaatgccaggcacttttcagaccaccacgggcgaaattggggccatagcactagactttaagcccggcactagcggcagtccaattataaaccgggaaggaaaagtagttgggttgtatggaaatggagtcgttactaaaaacggaggctatgtatcgggtattgcgcaaacaaatgcagaaccggacggcccaacccctgaattagaagaagagatgtttaagaagcgcaatctcactatcatggacctacaccctggctcagggaaaactcggaaatatttacctgctatagtaagagaagccatcaaaagacggctaagaacattaatactggctccaacaagagtcgtggccgctgaaatggaagaagcacttaaaggattacctattcggtatcaaacgacagctacaaagtctgaacatacgggaagggaaatagtggacttaatgtgccatgcaacattcacaatgaggctactttcaccagtaagagtgcctaactataatttaataattatggatgaggctcactttactgatcccgcaagcatcgcggcccgaggatacattagcaccagagttggtatgggtgaagccgccgctatttttatgacagctacgccaccagggacagccgatgctttccctcaatcaaatgcacccatccaagatgaggaaagagatataccagaaaggtcatggaactctggcaatgaatggattacggattttgcgggaaaaacagtgtggtttgtaccctcaataaaagccggtaatgacatagctaattgtctacgcaaaaatgggaagaaagttatccaactgagtagaaaaacttttgatactgagtatcagaaaactaaacttaacgactgggactttgttgtgacaacagatataagtgaaatgggcgcaaactttaaagccgatcgggttatagaccctcgaagatgcctcaagcccgtcatactaacagacggaccagagagggtgatactagctggtccaatgcctgtaactgcagcaagcgcggctcaacgtcgtggacgtgtaggaagaaacccacaaaaggagaacgaccaatacatatttacaggtcaacccctcaacaatgacgaggatcacgcacattggactgaagcaaaaatgctcttagacaatataaacactcctgaaggcatcattcctgcactttttgaaccagaaagagagaaaagtgcagctatcgacggcgagtacagactaaaaggcgagtcaagaaaaacgttcgtagaacttatgagacgtggtgatcttcctgtatggctagcacacaaggtggcaagtgaaggaattaaatacacagaccgcaagtggtgtttcgatggacaaagaaacaaccagatccttgaagaaaacatggatgttgagatatggactaaagaaggagagaagaagaaattgcgaccacgatggcttgatgctagaacatatagtgatccattggcattaaaagaatttaaagaatttgcggcagggagaaaatctattgcgctcgacctcgtaacggaaattggtcgagttccttcacatttagcacaccgaacgcgaaacgcgcttgataatttagtaatgttacatacttctgaacatggaggcagagcttatcgacacgccgtggaagaactaccagaaacaatggagacattacttctattaggtttgatgatactactaacaggaggagccatgttgtttttaatttcgggtaaaggaataggcaaaacctcaattggtctaatctgcgtaatcgccagttcaggtatgctttggatggctgaaataccactacagtggatagcttctgctatcgtgctcgagttctttatgatggtattattgatacctgaaccagaaaaacaaagaacaccacaagataaccaattagcatatgtcgtaatcggcatcctaacactagcagccatcatagctgcaaacgaaatgggactgttggaaacaactaaaagggatttaggtatgagtaaagagccaggtgtagtgagtccaacgtcatacctggacgtagatctacacccagccagcgcctggacgttgtatgcagtggccacaaccgtcatcacaccaatgttgagacatacaatagaaaacagtacagcaaatgtctcactagcagctatagcaaatcaggctgtggtattaatgggacttgacaaaggatggcccataagtaagatggacctaggtgtaccgttattagcactcgggtgttatagtcaagttaatccattaacactcactgcagctgttttactcttgataacacactacgctataatcggaccaggtttacaggcaaaagcgactcgtgaggctcaaaagcgtaccgcggccggaataatgaagaaccccacagtagacggtataatgacaattgatttggatcccgttatatatgattcgaaatttgaaaaacagctagggcaagtgatgttactggtactatgtgctgttcagctcttattaatgcgaacatcttgggccctatgtgaggcattgactctggcgaccggaccgataactacgttatgggaaggaagcccaggcaaattttggaatacaactatcgcagtgtccatggcaaatatattcaggggtagttatctcgctggggcgggacttgcgttcagtataatgaaaagcgttggaacaggcaaacgagggactggatcacagggagagacattgggtgaaaagtggaagaagaaactgaaccaactttcaagaaaagattttgacttatacaagaaatctggaataacggaagtagaccgaacggaggccaaagagggattaaaaagaggggaaatcacacaccacgctgtatctagaggcagtgccaaattgcaatggttcgtagaaagaaatatggtaataccagaagggagagttattgatctcggatgtggaaggggtggatggtcatactattgcgcaggattgaaaaaggtcacagaagtacgaggatatactaaaggtggaccaggtcacgaggaacccgttccaatgagcacttacggctggaatattgtcaaattaatgagtggaaaagatgtattttatctgcctccagagaaatgtgatacattactatgtgacattggcgaaagttcgccctccccgacagttgaggaatctaggactatacgcgttttaaaaatggtagaaccttggctcaaaaataaccagttctgtataaaagttcttaatccctacatgcccacggtaatcgagcaccttgagaggctccagcgtaaacatggtgggatgttagtccgaaatccactttcgaggaacagtacccacgagatgtactggattagcaacggcacaggaaacattgttgctagcgtgaacatggtcagccggcttttacttaaccgattcaccatgacgcatagacgcccaacaatagaaaaagatgtggatctgggagccggcacaagacatgtcaacgctgaaccagaaacgccaaacatggacgtaatcggtgaacgcataaaaaggattaaagaagaacataattctacatggcattacgacgacgaaaatccatacaaaacttgggcatatcatgggtcctatgaagtaaaagcaacgggatcagctagttcgatgataaatggggtggtaaaattattgacaaaaccgtgggatgtagttcctatggtgacgcagatggctatgacagatacaacgccattcggccaacaaagagtgttcaaagaaaaagtggatacaaggacacccaggtcaatgccgggaacacgaagagtgatgggaatcacagccgagtggttatggcgaaccctgggaagaaacaagaaaccaaggttatgtactcgagaagaatttacgaagaaagtaagaacaaacgccgcaatgggagcagtatttacagaagaaaatcaatgggatagtgcaaaagctgctgtagaagacgaagatttttggaaattagtcgacagggagagagaactacacaagttaggcaaatgtggttcttgtgtctataatatgatgggaaagagagagaagaaactaggcgagtttggaaaagctaaaggaagtcgtgctatatggtacatgtggttaggtgcaaggtacctagaatttgaagcgttaggatttctgaatgaagatcattggttcagcagagaaaactcctatagtggagtcgagggggaaggtctacacaaactgggatatatattacgagatataagcaaaattccagggggagcaatgtacgcagacgataccgcaggatgggatactaggattacagaggacgatctacataatgaagagaaaataacacaacaaatggaccctgaacatcgacaattagcgaacgcaatttttaagctaacgtatcaaaataaagtggtaaaagtccagcgccccacacccaccgggactgtaatggacattatctcacgtaaagaccagcgcggtagcggacaggttggtacttacggcctcaacacatttaccaacatggaggctcaactaatccgacagatggaaggtgaaggagtcttgctcaaagcagaccttgaaaacccacatttaccagagaagaaaataactcaatggctagagactaaaggagttgagagattaaaaaggatggcgataagcggtgatgattgtgtggttaagccgatagacgatcgtttcgcaaatgcactactggcccttaatgatatgggaaaagtacggaaagacataccacagtggcagccaagcaaagggtggcacgattggcaacaggtaccattttgctcccaccattttcatgaattaataatgaaggatggtagaaaactcgttgtaccctgtcgaccacaggatgagctaataggacgcgctagaatatcacagggggccggctggtctcttaaggaaacggcatgtttaggcaaagcatatgcccagatgtggagtctaatgtactttcacagaagagatctacgcttagccagtaacgcaatctgttcagcggtacctgtacactgggtaccgacaagtaggacaacatggtcaatccatgcacatcaccaatggatgacaactgaagatatgttaaccgtatggaatagggtatggatagaggataatccatggatggaagacaaaacaccagttactacatgggaaaacgtgccgtatctcggcaagcgggaggaccaatggtgtggcagcctaattggattgacaagtcgcgcaacttgggcacaaaatatccccacagcaattcagcaagttagatcattgattggtaatgaagagttcctggactacatgccgagtatgaaacgctttcgtaaagaggaagagtcagaaggcgcaatttggtaa

SEQ ID NO: 23234 - RNA, 9873 nt, synthetic construct
  misc_feature 1..9873: note = derived and/or modified CDS sequence (opt6) from DENV-3__JF937638__SS-prME
  source 1..9873: mol_type = other RNA
acaagcctatgtctattaatgatactgcctgctgcactagcatttcatcttactagtagagatggcgaaccacgaatgatagtaggcaaaaacgaaagaggcaaatcattattatttaaaacggcctctggcataaatatgtgtacactaatagctatggatctaggtgaaatgtgtgatgacaccgtaacctacaagtgtccccatataactgaggtggaacctgaggacatagattgttggtgtaacctaacgtcgacatgggtgacatacggtacttgtaatcaagctggcgagcacagacgcgataaaagatcagtagcattggcacctcacgtaggcatgggattagatacaagaacccaaacgtggatgagtgctgaaggcgcgtggcgacaagtcgaaaaggttgagacgtgggcattacggcatccgggatttacaatcctagcactctttctcgcacactatataggcacaagtttaacccaaaaagtggtaatattcatactcctaatgcttgtaactccgagtatgacaatgaggtgcgttggtgtaggcaatcgtgatttcgtcgaaggccttagcggcgcaacatgggtagacgtggtcctggaacatggcggatgtgttactacaatggcaaagaataagcctacactagacatagaactacaaaaaaccgaggcgacacagttagcaacgttacgtaaactatgtattgaggggaagataacgaacataactacggactcaaggtgtccaactcagggggaagcgacattgccagaagaacaggaccaaaattatgtctgcaaacatacgtacgtagataggggatgggggaatgggtgtggtttatttggtaaagggtcactagtcacatgcgcaaaatttcaatgcttagaaccaattgaaggaaaagtagtacaatatgaaaatttaaaatacactgtaatcataaccgttcatactggagatcaacatcaggtgggcaatgagacccaaggtgttactgctgagataacaccacaggcatctactaccgaagcaatacttcccgaatacggcacactcggattggaatgtagtcccaggacaggtttagattttaatgaaatgatattactaaccatgaagaataaagcatggatggtccacagacaatggttttttgatttaccacttccttggaccagtggagcgacgacggaaactcccacttggaatcgcaaagaactgctagtaacattcaaaaatgcccacgccaaaaaacaagaagttgtggtgctaggtagtcaagaaggcgcaatgcatactgctctgactggtgcgactgagatccaaaattctggtggtacgtcaattttcgcaggtcacttaaaatgtcgcttaaaaatggacaaactagaactaaaaggcatgagctacgcaatgtgcacaaacacatttgttctcaagaaagaagtaagtgaaacccaacatggtactatattaataaaagtagaatacaaaggagaggatgtcccatgcaaaattccattctctacggaagatgggcaaggaaaagcccacaacggaagactaatcacagcaaaccccgttgtaacaaaaaaagaagaacctgtaaatatagaggccgaaccgccattcggagaatctaatatcgttattggaatcggcgataatgccttaaagattaattggtacaaaaaaggtagctcaataggaaaaatgtttgaagcaacagctagaggcgcacgtcggatggcaatattaggcgatacggcgtgggattttggaagcgtgggaggagtcctcaactctctcgggaaaatggtgcaccaaatatttggttcagcctacacagcattattctcaggtgtgagttgggtgatgaaaatagggataggtgtgctgctcacatggataggattaaatagtaaaaatacaagtatgtcattttcctgtattgcgatagggattattacactatacctaggggccgtagttcaagccgacatgggttgtgtgataaattggaaagggaaagaactaaaatgtggcagtggtatatttgtaactaatgaagtccatacgtggaccgaacagtacaaattccaagcagacagtccaaagcgcttagcgactgctattgcgggcgcctgggaaaatggcgtatgcggaataagaagcacgacccgaatggaaaatcttttatggaaacaaatagcaaacgaattaaactacattctttgggaaaataacataaagttgactgttgtagtaggcgatataatcggagtactggaacaaggcaagagaacactaacaccccaaccaatggaacttaaatattcgtggaaaacatggggaaaagctaaaattgtgaccgctgaaacacagaactcaagtttcattatagacgggcctaacacgcccgaatgtccatccgtatcccgagcatggaatgtttgggaagtagaagattatggtttcggggtttttactacaaatatatggttaaaacttcgagaggtatatacacagctatgtgaccatcgtctgatgagtgctgccgtgaaggatgaaagagcagtacatgcggacatgggctattggatagaaagccaaaagaatgggtcttggaaactagagaaagccagccttatagaagttaaaacctgcacctggcccaaaagtcacacgctttggtcgaatggcgtgctagagtcggacatgataatcccaaaatcgttggctggtccaatatcgcagcataaccaccgacctggctatcatacgcaaactgctgggccgtggcatttgggaaaactcgaactagactttaactattgcgaaggaacaacagtcgtaatcacagaaaattgtgggaccagaggcccatcattgagaactacgaccgtttctggtaaactgattcatgaatggtgctgcagaagctgcaccttgccccccctcaggtacatgggagaagatggatgttggtacggaatggaaatccgtccaatttcggaaaaagaagaaaacatggtaaaaagcttagtttcagcaggaagtggaaaagtagataattttaccatgggagttctttgtttggccatcttattcgaggaggtaatgagaggtaaatttggcaaaaagcacatgattgctggagtgtttttcacgttcgttctgctattatcaggccaaataacctggagagatatggcgcacaccttaattatgattggttctaacgcaagtgatcggatgggaatgggagtgacgtacttagcattaattgcgacctttaaaatccagccttttttggctttaggattctttttacggcgcctaacgtcacgtgaaaatttgctacttggtgttgggctggcaatggctacaaccttacagctaccagaagacatcgaacagatggctaacggaattgccctcgggctgatggcactgaaattaataacacaattcgaaacctatcaactttggactgctttaatatcattaacttgtagtaatactattttcacactaacagtagcatggagaacagctaccttgattctagcaggggtatcgttgcttccagtatgccgatcttcgtcaatgagaaaaacagactggttacccatggctgtcgcagccatgggcgtcccacccttaccactctttatttttagcctaaaggatacattgaagagacggtcttggccactaaacgagggggtaatggcggtaggattagtaagcatcctagcatctagtctcttgaggaatgacgtacccatggccggaccattagtagcgggtggtctacttatagcatgctacgttataaccggaacatccgcagatctaactgtggaaaaggcagccgacattacctgggaggaagaagctgaacagacaggcgtaagccataatttaatgataacagtagatgatgacgggacaatgagaattaaagatgacgaaacagagaatatactaaccgttttacttaagacagccttgctgatagtaagcggtatatttccctattcaattcctgcaacgttacttgtatggcacacatggcaaaaacagacacaaaggtcaggcgtcctctgggatgtaccaagtcctcctgaaactcagaaagcagagttggaggaaggagtatacagaattaaacaacaaggtatatttggaaaaactcaagtaggagttggtgtacagaaggaaggtgtcttccacacaatgtggcacgtaacaaggggtgctgtgcttacctacaacggtaagagattagaaccaaactgggcgagtgttaagaaagacttaattagctatggtggcggttggcgactttctgctcaatggcagaaaggagaagaagtgcaagtaatagcggtagaacctggaaaaaaccctaaaaacttccaaaccatgccaggtacgttccagacaacaacaggcgaaatcggggcaattgcactagattttaaaccaggaacaagcggctccccgattattaatcgagaaggaaaagtcgttggattatacggaaatggcgttgtaaccaaaaatggcggatatgtgagcgggattgctcaaaccaatgcggagccggacggcccaacaccagaactagaagaagagatgtttaagaaacgcaacttaactataatggatctacatcctggatctggaaaaacaagaaagtatctgcctgctatcgtccgggaagctataaaaagaagactacgaactcttatactagcaccgactagggtcgtagctgctgagatggaagaagcgttaaaaggcttaccgattcgttatcagacaactgcaacaaaatccgaacatacgggccgtgaaatagttgacctaatgtgccacgcaactttcacgatgcgactattaagcccagtacgagtaccaaactacaatctcattattatggacgaagcccacttcacggacccagcatctattgctgctagaggatacatttccacccgcgtagggatgggtgaagcggctgcaatattcatgacagctacgccgcccggtactgcagacgcgtttccacagagtaatgcgccaatacaggatgaggaacgagatatacctgaaagatcatggaatagcgggaatgaatggataaccgattttgccggtaagacagtttggtttgtaccaagtatcaaagcagggaacgatatagcaaactgcctgcgaaaaaatgggaaaaaagtaattcagttgtccagaaagacattcgacacagagtaccagaaaacaaagttaaatgattgggactttgttgttactacagacatatctgaaatgggcgctaactttaaagctgacagagttatagatcctcgacgatgtctaaaacctgtaattttaacggacggtccagaacgtgtaatcttagctggtccaatgcctgtaacagcagcttcagccgcccaaaggcgcggaagggtaggtagaaacccacagaaagaaaatgaccagtatatctttactggccaaccacttaataacgacgaagatcatgcccattggacagaggctaaaatgctgttagacaatatcaatacgcctgaggggatcataccagccctatttgagcccgaaagggaaaaatcagcagctatcgatggcgaatatagactgaaaggggaaagtaggaaaaccttcgtagagctaatgcgacgaggcgacctaccggtatggttagctcacaaagttgcttcagaaggaataaaatacaccgacagaaaatggtgttttgatggtcaacggaataatcaaatcctcgaggaaaatatggatgttgagatttggactaaagaaggagaaaagaagaaattacgcccaaggtggttagatgccagaacatatagtgacccattagctctaaaagaatttaaggaattcgctgccgggagaaaatcaatcgctctagatttagttacggaaatcggtcgtgtcccaagccacttagcccacagaaccagaaatgctttagataatttagtaatgctccatacctcagaacatggaggacgagcttaccgtcacgcagtggaggagttacctgagactatggaaacgttactcttactaggcttgatgattctcttaactggcggagcaatgctcttcctaatatcagggaaagggattggcaaaacatcgatcgggctaatttgtgtcatagcaagtagtggaatgttgtggatggctgaaataccattacagtggatagcgagcgcaatagtgctggaatttttcatgatggtacttttaatacccgaaccggaaaaacaacggaccccgcaagacaaccaacttgcttatgttgtgatcggaatcttgacattagcggcgattatagctgcgaatgaaatgggactattagaaactactaaacgtgaccttggaatgagcaaagaacctggagttgtatcaccaacgtcctatcttgacgtcgatctacatccagcctcagcatggacactatacgccgtagctactacagtaataacccctatgctccgccataccatagaaaatagcacagccaatgttagtcttgctgcgatagccaatcaagcagtagttctaatgggtttggacaagggatggccgatttcaaaaatggatctaggagtaccacttctcgcactgggatgttatagtcaggtaaaccctctgaccctcaccgctgcagtcttattacttataacacattatgcaataataggacctggcttacaagccaaagcaactcgagaagcacaaaaacgtactgctgcaggaatcatgaaaaacccaaccgtggatggtatcatgactatagaccttgatcccgtcatctatgacagcaaattcgaaaaacaattgggtcaagtaatgctattagttttatgtgcagttcaacttcttctaatgaggactagctgggcattgtgcgaagcgctaacacttgcgacaggacctatcactacgctttgggaaggatcgccgggtaaattctggaacacaaccatagcagttagtatggcgaatatatttagggggtcgtatctggcaggtgcgggattagcgtttagtattatgaaatcagtaggaacaggaaaacggggaacaggcagtcaaggagaaactttgggggaaaaatggaaaagaaaactaaatcaattaagtcgtaaagactttgatttatataagaaaagtggaataaccgaagttgacaggactgaagctaaagaaggactgaaaagaggagaaataactcatcatgctgtgagcaggggtagcgcaaaattgcaatggtttgtagaaagaaatatggtaacgcccgaaggtagggtgatagacttggggtgtggtaggggaggctggtcttactattgtgctggactaaaaaaagttacagaagtgaggggatatacaaaaggtggccctggacatgaagaacccgtgccaatgagcacatatgggtggaatatagtgaaacttatgtctggtaaagacgtattctacctgcccccagaaaaatgcgatacactattgtgtgacattggcgagagttcaccctctcccacagtagaagaatctagaactataagagtattaaagatggtggaaccctggctcaagaataatcaattctgtataaaggtattaaacccatacatgccaacagttatagaacatctagaaagactacaacggaagcatggaggaatgctggtccgtaatcctttaagcagaaattcgactcatgaaatgtattggatatccaatgggactgggaatatagttgcaagcgtaaatatggtatctcgcttactactgaaccgattcaccatgactcataggcgtccaaccatagaaaaagatgtagatctaggcgcaggaacgcgccatgtaaacgcagaaccagagacacctaatatggatgttatcggggaacgtattaaaagaatcaaggaggaacataacttaacatggcactacgatgatgaaaatccctacaaaacgtgggcctatcacgggagttatgaagtaaaagctacaggttcggcatcatcaatgataaatggagttgttaaattactaactaaaccatgggacgtagtgccaatggtcacacaaatggcgatgacagatacaactcctttcggacaacaaagagtctttaaagaaaaagtagatacacgaacacctaggtctatgcctggtacacgtagagtcatgggaattacagccgaatggttatggcgcactctcggtcgaaataaaaaaccacgtttgtgcacaagagaagaatttacaaaaaaagtgaggacgaacgcagcaatgggtgctgtattcactgaagagaaccagtgggatagcgcgaaagcggccgtagaggatgaagacttttggaagctcgtagatagagaacgggaattacataaactggggaaatgcggatcatgtgtgtataatatgatgggcaaacgcgaaaaaaagttgggagaatttggcaaggccaaaggcagtagagctatctggtacatgtggctcggcgcacgttacttagagttcgaagcgttaggcttcctaaatgaagaccactggttcagtcgtgaaaatagctattccggagtggagggagagggactgcataaattagggtacatcctaagggatataagtaaaatccccggtggggccatgtacgctgatgacactgctggttgggatacaaggataacagaagatgatttgcataacgaagaaaaaatcactcaacaaatggacccagaacataggcagttagcaaatgcaatcttcaagctaacgtatcaaaataaagtagtcaaagtgcagaggccgactcctactggtacggtaatggatattatctcacgcaaagatcaaagagggagcggtcaagttggaacttatggtttaaatacattcacaaacatggaggctcaaattatcagacaaatggaaggtgaaggagtcttatctaaagcagatttagaaaacccgcatcttccggagaaaaaaattacacaatggctcgaaaccaaaggggtagagaggttgaaaagaatggcaatatccggcgatgattgtgtagtaaaaccaattgatgatagattcgcaaacgcccttcttgccctgaacgatatgggcaaagtaaggaaggacatcccacaatggcaaccatcaaaaggatggcatgactggcaacaagtgccgttctgttcacatcatttccacgaactcataatgaaagatggacgaaaactggtcgtgccttgccgtccacaggatgagctcataggccgtgcaagaattagtcaaggtgctgggtggtcgttaaaagaaactgcatgcctcggaaaagcttacgcacaaatgtggtcactgatgtacttccacagacgtgatctacgattagcaagtaacgcaatatgttccgcagtcccggtgcactgggttccgacctctagaacaacatggagcatccatgcacaccaccaatggatgactactgaagacatgcttacggtgtggaacagagtatggatagaggacaacccttggatggaggataagacaccggttactacgtgggaaaatgtgccttacttaggtaaaagagaagatcaatggtgcggaagtctaataggtctaacatctagggccacgtgggcacaaaacattcctacagctattcaacaagtcaggagcttaattggcaatgaagagtttctagactatatgccatcaatgaaacgttttcgcaaagaagaagaatctgagggggctatatggtaa

SEQ ID NO: 23235 - RNA, 9873 nt, synthetic construct
  misc_feature 1..9873: note = derived and/or modified CDS sequence (opt6) from DENV-3__JF937639__SS-prME
  source 1..9873: mol_type = other RNA
acttcgttatgtttaatgatgatattgccagcagctctagcattccatctaacaagtagagatggagaaccccgaatgatagtaggcaaaaatgaacgaggaaaaagccttttatttaaaactgcatctggtataaacatgtgtaccctcattgccatggacctaggagaaatgtgtgacgacacagtaacctacaaatgtcctcatattactgaagtggaaccggaagatattgattgttggtgcaatcttacttccacctgggttacctatggtacatgcaaccaagccggtgaacatcgccgagacaaacggagtgtggctttagcaccacatgtaggaatgggactagatacccgcacacaaacatggatgtctgcggaaggcgcttggcgacaagttgaaaaagtagaaacatgggcattgcgacaccctggtttcacaatactagcgttattcctagcacattacataggcacaagtcttacccaaaaagtagtaatctttatattacttatgttagtgactccaagtatgactatgagatgtgttggcgtaggaaatcgagattttgtggaaggtctaagtggcgctacgtgggttgatgtcgtgcttgaacacggagggtgcgtgacaacgatggccaaaaataaaccgacactcgacattgaattacagaaaactgaagcgactcaattggcaaccttgagaaaattatgtatagaaggcaaaataacaaacattacaacagactcaagatgtcctactcaaggtgaagcaacacttccagaagaacaagatcaaaattatgtctgtaaacatacttacgtagacagagggtggggcaatggttgcgggctctttggcaagggtagccttgtaacatgcgcgaaatttcaatgtttggagccaatagagggcaaagtagtacaatatgaaaaccttaaatatacggtcattattactgttcataccggagatcagcaccaagtaggtaatgaaactcagggagttactgcagaaataactccgcaagcaagcaccacagaagcaatcttaccggaatatgggacactcggcttggaatgttctccgcgaacgggattagatttcaatgaaatgatcttattaacaatgaaaaataaagcctggatggtacacaggcaatggttctttgatcttcctcttccatggacatcgggtgcgactactgaaactccgacctggaaccgaaaagaactattagttacatttaagaatgcccatgcaaagaagcaggaggtagtagttttaggatcgcaagaaggtgctatgcacactgcattaacaggcgcaactgaaatccaaaactccggcggaacatcaattttcgcaggccatctaaaatgccgtttgaagatggacaaactagagctaaaaggaatgagttatgcaatgtgtactaatacgttcgttctcaaaaaggaagtaagcgaaacacaacatggaacaatattaataaaagttgaatataaaggcgaagacgctccctgcaaaattcctttcagcacagaggacgggcagggcaaagcacataatgggcgcttgataacagcgaaccctgtagttactaagaaagaagaaccagtaaatattgaagcagagcctccatttggagaatcgaatattgtgatagggattggagacaacgcactaaaaataaactggtacaagaagggctctagcattggtaaaatgtttgaggctaccgcaagaggggccaggagaatggcaatattaggagatacagcttgggattttggatccgtaggaggggtccttaactctttaggaaaaatggttcatcaaatatttggctcagcctataccgcgctgttttccggggtttcatgggttatgaaaattggaataggagtactactaacatggatagggcttaattcaaggaacacttctatgtctttctcatgcatagcaataggtattataacgctttatcttggtgcagtggtacaagctgatatgggttgtgtaatcaactggaaaggtaaagagttaaaatgtgggagcggtatatttgttacaaatgaagtgcacacctggacggagcagtataaattccaagccgactcgccaaaaagactcgccactgcgatagctggtgcttgggaaaatggagtttgtgggatcagatctacgacccgtatggaaaacttactctggaaacagatagctaacgagctaaactatatactctgggaaaacaatataaaactaacagttgttgttggagatataatcggggtgctagagcaaggaaagaggacgttaactcctcaaccaatggagctaaagtactcgtggaagacatggggaaaagcaaaaatagttacagccgaaacacagaactcttcctttattatagacggtccaaatacgccagaatgtcccagcgtttcccgagcatggaatgtttgggaagtagaagactatggattcggggtatttaccacgaatatatggctaaaattgagagaggcctacactcaattatgcgaccatagactcatgagcgctgcagtaaaagacgaaagggcagtacatgctgatatgggatattggatagaatcccagaaaaacggatcgtggaagctagagaaagcgagtttaatagaggtaaagacatgcacatggccgaagtctcatactatttggtctaatggggtcctcgagagtgacatgataattccaaagagcctggccggaccgatcagccaacataatcaccgtccaggttatcacacacaaactgcaggtccatggcacctagggaagctggagctcgactttaactactgtgaaggaacaacagttgttattacagaaaattgtggaactagaggtccatctttgcgaacaactaccgtttcaggtaagctcattcacgaatggtgctgtagatcatgtaccctaccacccctgcgatatatgggcgaagacggctgctggtatggtatggagatacgaccaataagcgaaaaggaggaaaacatggtaaagagcttagtatcagccgggtcgggaaaagtagataattttactatgggggttctatgtcttgcgatattattcgaggaggtaatgcgtggtaagtttggcaagaaacacatgattgccggtgtatttcttacgtttgttttattgttatccgggcagataacatggagagacatggctcacactctcataatgatcggcagcaatgcgagtgatagaatgggaatgggagtaacttaccttgcactaatcgcaacttttaagatccagccgtttttagcgcttggattctttttacgaaaactgactagcagagaaaatctcttacttggtgtaggactagcgatggccactaccctacaattgccggaagatatcgagcagatggcaaatggcatagcgttagggctcatggctttgaaacttattactcaatttgaaacctatcagctatggaccgcgttaatttcgttgacctgtagcaatacgatattcacacttaccgtggcgtggcgaacagcaacgctaatcttggctggcgtaagtctcctccccgtgtgccaatcaagcagcatgcgaaagacagattggttgccaatggctgtagcagcgatgggagtaccgccattgccacttttcatattcagtctcaaggatacgctaaaacgaagatcgtggccgttaaacgaaggggttatggccgtaggtctggtatcaattttagcgtctagcttattacgaaacgatgttcctatggctggaccattggtcgctggaggcttactcatagcttgttatgtaatcactggaacaagtgctgacttaacagtcgaaaaagctgccgacataacttgggaagaggaagcggaacaaaccggtgtttctcataacctcatgataaccgtagatgacgacggtacaatgagaataaaagatgacgaaactgaaaatatcttaactgtattacttaaaacagctttactaattgtgagcggaatatttccgtattcaataccggccacattattggtatggcatacgtggcaaaaacagaccaagcggagcggagttctttgggatgtgcctagtccacccgaaacccaaaaagcagaacttgaagaaggagtttatcgcataaaacaacaaggaatatttgggaaaacacaagtcggagttggtgtacaaaaagaaggagtatttcatacaatgtggcatgtgacaagaggtgctgtcctaacatacaatggaaaaagactagaacctaattgggcatcggttaagaaagaccttataagctacggaggagggtggaggctctcagcacaatggcaaaaaggtgaagaggtccaagtcattgccgttgagccaggtaaaaaccctaagaacttccaaaccatgcctggaacgtttcaaacaaccacaggcgaaataggtgcgatagcactagactttaaacccggaacaagtggttcacccatcataaatagagaaggtaaagtcgtcggattatatggaaacggagtagttactaaaaacggcggatatgtgtctggcatagcacaaacgaacgcagaacccgacggtcctacgcctgaattggaggaggagatgttcaaaaagaggaacttaaccatcatggacttacatcctgggtctggtaaaacaagaaaatatttacctgcaatagttcgcgaggcaataaaaagacggttgagaacattgatcctagccccaacaagggtagtagcagcagagatggaagaagctctaaaaggacttcccatcagatatcagactacagccacgaagagtgaacacacaggaagagaaatcgttgatttgatgtgtcatgcaacttttacaatgcgtctactaagccctgtacgagtgccgaattacaatttgataataatggacgaagcccacttcacagacccagcaagtatagcagcgagaggctatatatcgacacgagtagggatgggggaagccgcagcaatttttatgacagcaactcctccaggaacggctgacgcatttcctcagtccaacgccccaattcaagatgaagaacgtgatatacctgaaagaagttggaatagcgggaacgaatggattactgattttgctgggaaaacagtatggtttgtgccttccataaaagcaggaaacgacatagccaattgtttacgaaagaatgggaagaaagttattcagttatcaaggaaaactttcgatacagagtatcagaaaacgaaattgaacgactgggactttgtagttacgaccgacatcagcgaaatgggggcgaattttaaagcggatcgcgtgattgacccacgtcgttgcttgaaacccgttatactcacagatggtcctgaaagggtcatacttgccggtccaatgcctgtgacggcggcctcagcagcgcaaagacgagggcgcgtgggtcgtaatccccaaaaagaaaatgatcaatatatttttacgggacaacctttaaataacgatgaagatcatgcacactggacggaagcaaaaatgcttctagataatataaacacaccggaaggtatcattccagcattattcgagccagaacgtgaaaaatcggccgcaatagatggagagtacagactcaagggagaatcccgaaaaacatttgttgagttaatgagacgaggggatctaccagtgtggctagcacacaaggtcgcatcggaagggattaaatatactgatcgaaagtggtgcttcgacggtcaacgaaacaaccagatattagaggagaacatggatgtcgaaatatggaccaaagaaggtgagaaaaagaaattacgtcctagatggttggacgctagaacgtatagtgacccactagcactaaaagaatttaaagaatttgcggcgggaaggaaatcaattgcgcttgacctagtgactgaaatcggaagagtcccatctcatctagcccatagaacaagaaatgcactagataatttagtgatgctccatacatctgaacatggaggacgggcttataggcacgcagttgaagagttaccggaaactatggagacgctattattattagggcttatgatattactcacagggggagcaatgctatttttaatttctggtaaagggataggaaaaacatcaattggactcatatgtgttatagcttcctcgggaatgttgtggatggctgaaatacctcttcagtggatagcctcagcgatagtgctagagttctttatgatggtgttactcatcccggaaccagaaaaacagagaactccacaggacaatcagttagcttacgttgtaattggaatactaacgctagcagcgatcatagccgctaacgaaatgggattattggaaactactaaaagagaccttggcatgtctaaggaaccaggagttgtatcacctacctcctatttagatgtagatctacatccggcgagcgcctggacattatacgcagtagctactacggtcatcacaccaatgttaagacatacaattgaaaattcaacagcgaacgtctcactcgcggctattgcgaaccaagcagtggtcctaatgggacttgacaaagggtggcctatatcaaaaatggatttaggggtaccattacttgcccttggatgttattcacaggttaatccactaacgttaacggccgccgtattattacttatcacacactatgcaataataggtcccggattacaagctaaggccacgcgtgaggcgcagaaaagaactgctgcaggaataatgaaaaacccaaccgttgacggcataatgacgattgatttagatcccgtaatttatgatagcaagttcgaaaaacagcttggacaagtgatgttattagtcttgtgcgccgtccagcttctcttgatgaggacaagttgggcattatgcgaagcgctaactttagctacaggaccgattacaacattgtgggaagggagtccaggtaaattttggaacacaactatagcagttagcatggcgaacatttttcgcggatcataccttgctggggccggactcgcattttcaattatgaaaagtgtaggcaccggcaaacgaggcacaggctcacaaggcgaaacccttggagaaaaatggaaaaagaaactaaatcagctttcaagaaaagattttgatctctataagaaatcaggaattaccgaagtggataggacagaagctaaagaaggactgaaaagaggtgagattacgcaccacgcggtatcaaggggctcagctaagttacaatggttcgtagagcgaaatatggtaattcctgaaggacgagtcattgatttaggttgtggaagaggtggctggtcttactattgtgctggtcttaaaaaggtgaccgaagtcaggggatacacaaaaggcggacctggccacgaagaaccagttccaatgtcgacttatggatggaatattgttaaattgatgtctggaaaagatgtattctatctccctcctgaaaaatgtgacactcttctatgcgatatcggtgagagtagcccaagtccgactgtggaagaatcgagaactatacgcgtgctaaaaatggtcgaaccctggcttaagaacaatcaattttgtattaaagtattaaacccatacatgccgacagtaatcgaacatctggagagattacaaagaaaacacggaggcatgctagtaagaaacccactaagcagaaattccacacatgaaatgtattggataagcaatggaactggaaatatagttgcttctgtaaatatggttagtaggcttctactgaatagattcactatgacccatagaagacccacaatagaaaaagacgtcgatttaggcgcaggaacgagacatgttaatgcagagccagaaacacccaacatggacgtcattggcgaaagaatcaagagaataaaagaagaacacaactcaacctggcactatgatgatgaaaatccctataaaacttgggcctaccatggaagttatgaggtaaaggcgacgggcagcgcgtcgagcatgatcaatggagtagtaaaactacttacaaagccctgggatgttgtgcccatggttacgcaaatggctatgacggacacaaccccatttggacagcaacgtgtttttaaggaaaaggtcgatacgagaacccctaggtctatgccaggcacgcgaagagtgatgggaatcaccgctgaatggctatggagaacacttggaagaaataagaaacctcgattatgcaccagagaagagttcactaagaaagttagaaccaacgccgctatgggggcagtttttacagaagagaatcaatgggattcagcaaaggcagctgtagaggatgaagacttttggaagttggtagatagagagagggaacttcacaaactcggaaaatgtggtagttgtgtctacaatatgatgggaaagagagagaagaaacttggagagttcggaaaagcgaaaggctcaagggctatttggtacatgtggttaggagctagatacctagagttcgaagcactaggatttctaaatgaagatcactggttctcccgagaaaacagctacagcggggtagaaggggaaggattgcataagttaggatatatactacgtgatataagtaaaatcccgggaggcgctatgtatgcagacgacacggccggctgggacacgcgaataacagaggatgaccttcataacgaagagaaaattacacaacaaatggacccagaacatcgccagctggcaaacgcaatttttaaattaacctatcaaaacaaagtcgtcaaagttcagcgacctacaccgacaggcacggtaatggatattatatctcgtaaagatcagcgcggatccggtcaagttggtacctacgggttaaatacattcaccaatatggaagcacaacttataaggcaaatggagggtgaaggcgtcttaagcaaagctgacttagaaaaccctcacttaccagaaaagaaaataacacaatggctcgagactaaaggtgtcgagaggctcaagagaatggcaatatcgggcgacgactgtgttgttaaacctattgatgatagatttgctaatgcactactcgctctaaatgatatggggaaggtgcgaaaagacattcctcagtggcaaccatcaaaaggatggcacgactggcaacaagttcccttctgctcgcaccactttcacgaattaattatgaaagacggacgtaaacttgtggtcccttgccgtccacaagatgaactaataggtagggcgagaatctcacaaggagcaggttggagtctcaaagagacagcctgtttgggcaaagcgtatgcacaaatgtggagcttaatgtacttccacagacgcgaccttagactagcatctaatgcaatatgctcggcggtacccgtacattgggtacctacgtctagaacaacatggtctatacacgcacatcaccaatggatgacaacagaagatatgttgactgtttggaacagggtctggattgaggataatccgtggatggaagacaagactccagtaacaacttgggagaacgtgccgtatctaggaaaacgagaggaccaatggtgtgggagtctgattgggttaacaagtcgcgcaacttgggcccaaaatataccaacagccatacaacaggtaaggagtcttataggaaatgaagagtttttagactatatgccgtcaatgaaacgatttcgaaaggaagaggaatcagagggcgccatatggtaa

SEQ ID NO: 23236 - RNA, 9873 nt, synthetic construct
  misc_feature 1..9873: note = derived and/or modified CDS sequence (opt6) from DENV-3__JF937627__SS-prME
  source 1..9873: mol_type = other RNA
acatctttgtgcctaatgatgatactcccagcagctttagcatttcacttgacaagccgagatggagaaccacgaatgatagtaggcaaaaatgaaagaggaaaatcattactattcaaaacagcatctggaatcaacatgtgcacattaatcgcaatggatttgggtgaaatgtgtgatgatacggttacctataaatgtccacacataactgaagtagaacctgaagatattgattgctggtgtaatctgacaagcacatgggtcacatatggcacctgtaaccaagcaggagaacacagaagggataaaagatcggtagctttagcgccacatgttggtatgggacttgatactagaacacaaacttggatgtcagcagaaggagcctggcgtcaagtagaaaaagttgaaacctgggcactacgccatcctggattcacaatattggctctatttttagcacattatattgggacaagtttaactcaaaaagtagttatttttatcttactgatgttagtaacaccatcaatgacgatgcgatgtgtcggtgttggaaatcgagattttgtagaaggactgtcgggagcaacttgggttgatgttgtacttgaacacggaggttgtgtcacaactatggccaaaaataaacccacgttagacatagaacttcagaaaactgaagcaacacaattagcgacattacggaaactatgtatagaaggaaaaataacgaacatcacaaccgattcaagatgtcctacccaaggagaagcaaccctgcccgaagaacaagatcaaaattatgtttgcaaacacacgtatgtagatagaggatggggaaacggttgtggacttttcggtaaaggaagcctagtaacatgcgcgaaatttcaatgcctagaacccatagagggaaaagtggtccaacatgaaaatctcaaatatactgtgataattacagtgcataccggagatcagcaccaagtaggtaatgagacacagggggtaactgcagaaataacaccacaggcttctacaacggaagcaatattacctgaatatggaacactaggtctagaatgttcaccaaggacaggactagacttcaatgaaatgatactccttactatgaaaaacaaagcctggatggtccacaggcagtggtttttcgacttgccactaccctggacgagtggcgcaacaactgaaacccctacttggaaccgaaaagagctattggtaactttcaaaaacgcgcacgcaaagaaacaggaagttgtagtgctaggaagtcaagaaggagcaatgcacaccgcgttaacgggtgctactgaaatacaaaactcgggtggtacctccattttcgccggccatttaaagtgtagacttaaaatggataaactcgaattgaaaggaatgtcttatgctatgtgtacaaacacctttgtacttaagaaagaagtaagtgagacacaacacggtacaatcttgataaaagtcgagtataaaggagaggatgttccttgtaagataccatttagtacggaagatggccagggtaaagcacacaatggaagattaatcacagcaaatccagtagtcacaaagagagaagaacccgttaatatagaagcagaacctccttttggtgaatccaacatagtaataggaataggcgataacgccttgaaaatcaactggtacaagaagggatcaagtataggcaaaatgtttgaagccacggcgcggggagcacgtaggatggctatcttaggtgatactgcatgggattttggatcggtaggaggagtattaaactctttaggtaaaatggtccaccagatatttggtagtgcttataccgcactgttctcgggtgtgagttgggtaatgaaaataggaataggcgtactgttaacctggataggactcaacagcaaaaacacatcgatgtcatttagttgtatagccataggaataattaccttatacctaggagctgtcgtgcaggccgacatgggatgtgttataaattggaaaggcaaagagctaaaatgtggctcaggcattttcgtgactaatgaggtgcacacgtggactgaacaatataaatttcaggctgactcccctaaacgattagctactgccatcgcaggcgcttgggaaaacggagtgtgtgggatacgatctaccactcgcatggaaaatttactatggaagcaaattgcgaatgagcttaattatattctgtgggaaaataatataaaattaacagtagtcgtaggtgacataattggcgtactcgagcaaggaaaacgcactttaaccccgcagccaatggaacttaaatattcttggaaaacgtgggggaaagctaaaattgttacggcagagacacaaaactcatcatttataatcgatggaccgaatactccagagtgtccaagtgtgtcaagggcttggaacgtttgggaagtggaagattacggattcggagtttttacaaccaacatatggctcaaactacgagaagtttacacacagttatgtgatcatcgattgatgagtgctgcggtaaaagatgagagagccgttcatgctgatatgggttactggatagagtcacaaaagaacggttcttggaaactagaaaaggcttcgcttattgaagtaaaaacatgtacatggccgaagagtcacacgttatggtctaatggagtattagagagcgatatgatcattccaaagtcgttagctggccccataagccaacataaccatagaccgggatatcatacgcaaacggcgggtccgtggcatttgggcaaactagaactagattttaattattgcgaaggtactacagtcgttataacagagaattgcggcactagaggaccttctcttagaacgacaacagttagcggcaaattaatccatgaatggtgctgtcgtagttgtacattacctccactgagatatatgggagaagatggttgctggtatggtatggaaataagaccgataagtgaaaaggaagaaaacatggtaaagagcctagtttcagctggttcaggcaaagtagacaattttaccatgggtgttttatgtctggccatattgtttgaagaagtaatgcgtggaaagttcgggaaaaagcatatgattgcaggagtattctttacgtttgtactactactcagtggccaaatcacgtggagggatatggcccacacacttataatgattggatcgaatgcatccgatcgcatgggtatgggagtcacatatctagcactcattgcaacattcaaaattcagcccttcttagcattgggattcttcttacgcaaattgacaagtcgtgaaaacctacttcttggagtagggctagctatggcgacgaccttacaacttccggaagatatcgaacagatggcaaatgggatcgcgttaggactaatggcactaaagttaataacacagttcgaaatatatcagctgtggacagcactaatctcactgacttgctcaaacaccatatttacacttaccgtagcctggagaacagcaacactaattttagcgggcgttagcttgctccccatgtgtcagtctagctcaatgcggaagaccgattggttgccgatggccgtagccgcgatgggcgtacctcctttaccattattcatattttctctcaaagacacgttgaaacgccggtcatggcccctgaacgaaggtgtaatggcagtagggttagtatctattctcgcaagttcactactccgaaatgacgtacctatggcaggtccccttgtagcagggggtctcttgattgcatgttacgttataaccggaacatcagcggaccttacggtagaaaaagctgctgacatcacgtgggaagaggaagctgagcagacaggagtatcccataacttaatgatcacggtagacgacgacgggaccatgcgcattaaagatgatgaaacagaaaatatacttactgtacttttgaaaaccgcacttcttatcgtcagcggaatattcccgtactcgataccagcaactttattggtttggcacacatggcaaaaacaaacacagagaagtggagtattatgggacgtgccatcgcctcctgagacacaaaaggcagaattagaggaaggtgtgtacagaataaaacaacaaggaatatttggtaaaacccaagttggggttggtgtccaaaaggaaggagtgttccacacaatgtggcatgtgactcgaggagcagtgttaacatacaacgggaagagactagaacccaactgggcaagtgtcaagaaagacctgatatcgtatggagggggctggcgtttgtcagcacagtggcaaaagggagaggaggttcaggtcatcgctgttgagccaggcaaaaaccccaaaaatttccagactatgccaggcacgtttcaaaccacgaccggtgaaataggagccattgctcttgattttaaaccggggactagcggttcaccgataattaatagagaaggtaaagtagtggggctatacggaaatggagtcgttacaaagaatggcggatatgtgagtggaatagcgcaaaccaatgctgagccagatggaccgacgccagaattggaggaagaaatgtttaaaaagcgtaacttaaccataatggatttgcacccaggatctggaaaaacacgcaagtaccttccagcgattgttagggaagctatcaaacgtcgacttagaacactaatcttggcccccacacgcgtggttgcagcggaaatggaagaggctttgaaagggcttccaatacggtaccaaacaacagcaacaaagtcagaacatacagggagagaaatcgtagatttaatgtgtcatgcaacattcacaatgagattactgagtccagtacgagttcctaattataatttgattattatggacgaagcacacttcacggaccctgcgtcgatagctgcccgaggatacatatcgactcgtgtaggtatgggagaggcagcagctatatttatgacggccacgccaccgggcacagcggatgcttttccccaatcaaacgctccaattcaagatgaagaacgagatatacctgaaagaagctggaactccggtaacgagtggatcactgacttcgccggtaaaacggtctggttcgtaccatccattaaagccggaaatgacattgctaattgcctccgcaaaaatggaaagaaagtaattcaattaagtagaaaaacattcgacactgaataccagaaaacaaaactgaatgactgggattttgttgttacaactgatatctcagaaatgggagccaatttcaaggcagatagagtaatagatccccgtagatgccttaaaccggttattctaactgacggaccagagagagttattcttgcaggtccaatgccggtaactgctgccagtgcggcccaacgtcgaggtcgagtgggaagaaatccacaaaaagagaatgatcaatatatttttactggacaaccactaaataatgatgaagatcatgcacactggacagaagccaaaatgctcttagataatattaacacaccagaaggtataatccctgcgttatttgagccagagagagagaaatcggccgcaatagacggtgaatatagactgaagggcgaatcacgcaagacattcgtggaattaatgcgcagaggtgacttacccgtctggctagcacacaaggtagctagtgaaggtataaagtacacagatcgaaaatggtgctttgatggtcaacgtaataatcaaattttggaagaaaacatggatgtcgaaatatggacgaaagagggagaaaagaaaaagctgcgacccagatggcttgatgcaaggacttattctgacccactagctctaaaagagtttaaagaatttgcagcgggtcggaaatcaatagcccttgatttagtgacagaaataggtcgagtaccaagtcatttagcacatagaacgaggaatgctctcgataacctagtaatgcttcacacctcggaacatgggggcagagcctatcgacatgctgtagaagaattgccagaaacaatggaaacattgttactgcttggactcatgatactgctaacgggaggcgcgatgctatttctaatctcgggtaaggggattggaaaaacatcaataggtttaatatgtgtaatcgctagttcaggtatgctatggatggctgagattcccctacaatggatagcgtcggcaatagtccttgagttctttatgatggtcttgctaatacccgaacctgaaaaacaaagaacccctcaggacaaccagcttgcctatgtagtcataggtattttaacgctagctgctataattgcagcaaacgaaatgggacttcttgaaaccaccaaaagagatttgggcatgagcaaggaaccaggagtagtatcaccaacgtcttatcttgatgtagatctacatcccgcatcagcttggacactatacgcagttgccacgactgtaataactcctatgttgaggcacactattgaaaactccacagccaacgtaagtctagccgcgatcgcaaatcaggctgttgtcctgatgggtttagataaaggatggccaataagcaagatggatttgggagttccactattagccctaggctgctatagccaagtaaatcctctaacacttacagcagcggtactcttgttaattactcactatgcaatcataggaccaggcctacaggcgaaagcgacacgagaagcacagaaaagaacggcagcaggaataatgaagaaccctaccgttgatggaattatgacaattgatcttgacccggtgatatacgactctaaattcgagaagcaactaggacaagtgatgctattggttttatgtgtagtccaacttttattaatgcgcacttcttgggctctttgtgaagcactaacacttgcaacaggtccaataaccacattatgggaaggaagtcccggaaaattttggaacactactattgctgtctctatggcaaacattttcagagggtcttatttagcaggagcaggtttggcattctcaataatgaaaagcgtaggaactggtaagcggggcacgggaagccaaggagagacattaggggagaaatggaaaaagaaactaaaccaactatctcgtaaagacttcgatttgtataagaaaagcgggataaccgaagtagacagaactgaagctaaagaaggactaaaacgtggcgaaataacacatcatgcagtatcacgcggttctgccaaattacagtggttcgttgaacgtaatatggtaataccggaaggtcgtgtgatagacttaggatgtggtagaggaggatggtcatattattgtgcaggattgaagaaagtcacagaagtaagaggatacaccaaaggaggtccggggcacgaagaacccgtgcctatgagcacttatgggtggaacatcgtaaaattaatgagcggcaaagatgtcttctacctccctcccgaaaaatgcgatactttattatgcgacattggagaatcgtctccgagccccacagtggaagaatccaggaccatacgagtattaaaaatggtagaaccatggctcaaaaataatcaattttgtatcaaggtactgaatccttacatgccaacagtaattgaacacctggaacgtctgcaacgaaaacacggaggcatgttggtacgaaaccctctgagtcgaaattctacacacgaaatgtattggatatctaatggaactggaaatattgtggcatcagtgaatatggtttcaaggttgttgttaaacagatttaccatgacacatagaaggcctactatagaaaaagacgtagacctcggggcgggaacaaggcacgtaaacgccgagccagaaacaccaaatatggatatcataggggaaagaataaaacgaataaaagaggaacataacagtacttggcactatgacgatgagaacccctataagacctgggcgtaccatggcagctacgaggtaaaagctaccggatcagctagttcgatgatcaacggagtggtaaaattacttactaagccttgggatgtagtacctatggtcactcaaatggcaatgacagacacaacaccctttggtcagcagagggtattcaaggaaaaagtagatacgagaactccacgatctatgcctggcacaagaagggtaatgggaataacggcagagtggttatggagaactttaggacgcaataagaaacctagattatgtactagagaagagttcaccaagaaagtaaggaccaacgccgcaatgggcgccgtttttacagaagaaaaccaatgggatagcgccaaggctgccgtagaagatgaagatttctggaagttggtaaataaggaaagggaactacacaaattgggaaagtgtggctcatgtgtatataatatgatgggaaaacgggagaagaaactaggtgagtttggaaaagcaaaaggatcaagggctatatggtatatgtggcttggtgctcgatacctagagttcgaagccttaggatttttaaatgaagatcattggttttcaagagaaaacagttacagtggcgtagaaggcgaagggcttcataagctaggatacatattgcgagatatatcaaagatacccggaggagcgatgtacgcagacgacacggcaggatgggatacgcgaattacagaagatgacctgcataatgaagagaaaattacgcaacagatggatccagagcatagacaattggcaaatgcgattttcaaactcacataccaaaacaaagtcgtaaaagtacaaagaccgaccccaaccggaacagtcatggacataattagccgtaaggaccaacgcggttctggtcaagtgggaacctacgggttaaatacattcacaaatatggaagctcaacttattcggcaaatggaaggagaaggagtattgtcgaaagcggatttggagaatcctcacctcccagagaagaaaattacacaatggctggagacgaaaggtgtcgaacgattaaaaaggatggcaattagcggcgatgattgtgtagtaaaaccaattgatgaccgattcgcaaacgcgttgttagcattaaatgatatgggaaaagtacgcaaggatataccacaatggcaaccgagcaaaggttggcatgactggcaacaagttccgttttgtagtcatcattttcacgagctaataatgaaagatggcagaaaacttgtagttccatgtagacctcaagacgaactaataggacgagcaagaataagtcaaggagcaggttggtcattaaaagaaaccgcatgtctaggaaaagcgtacgcccaaatgtggagcttgatgtatttccacaggagagatctacgtttagcgagcaacgcaatatgttctgccgtacccgtacactgggtgcctacgagtagaactacttggagtattcatgcacatcatcaatggatgacaaccgaagacatgttgacagtttggaatagagtttggatagaggataatccatggatggaggataaaacaccagtaacgacatgggaaaacgtgccatatctaggcaaaagagaagatcaatggtgtggatccttaattggactaacctcacgtgccacctgggctcaaaatattccaaccgccattcaacaggttagaagtctcataggcaacgaagaatttttagattacatgccgtcgatgaaaagattcagaaaagaggaagaatcagaaggagctatatggtaa

SEQ ID NO: 23237 - RNA, 9873 nt, synthetic construct
  misc_feature 1..9873: note = derived and/or modified CDS sequence (opt6) from DENV-3__KF973476__SS-prME
  source 1..9873: mol_type = other RNA
acatctttatgcctaatgatgatcctaccagctgcattagcctttcatctaacgagtcgagatggagaaccgcgaatgatagtagggaaaaatgaacgaggtaaaagtttgttatttaaaacagcatctggaataaatatgtgtacgttgattgcgatggatctaggagaaatgtgcgacgatactgtaacatacaaatgccctcatataactgaggtggaaccagaagatatagactgttggtgtaatttgacgtcgacatgggttacatacggaacttgtaaccaagctggagaacatcgacgtgacaaacgctcagtcgcacttgcaccgcacgtggggatgggattagacacaaggacccaaacttggatgagcgcagaaggtgcctggagacaagtagaaaaagtagaaacatgggcattaagacacccagggttcacaattctagccttgttcttagcacattatataggaacatctctaacgcaaaaagttgtcatttttatattacttatgctagtgaccccttcgatgacaatgaggtgcgtcggtgtaggaaatcgagattttgtagaaggcttgtcaggagcaacttgggtagatgttgtacttgaacatggagggtgtgttacgactatggctaaaaataaaccaacactagacatcgaattgcagaaaacggaagcgacacaacttgccactttacggaaactttgtatagaaggaaaaataacgaacatcactactgattcacggtgtccgactcaaggcgaagcgacacttcctgaggaacaagaccaaaactacgtatgtaaacacacgtatgtagaccgtggctggggtaatggatgtggattgttcggcaaaggatcactcgttacgtgtgctaaatttcaatgtcttgaaccaatagaagggaaagtagtccaatatgaaaatctcaaatacacggtgataataacagtacacacaggtgatcaacaccaagtaggaaatgaaacacaaggggtaacagcggaaataaccccacaagcgagcacaacagaggcaattctaccggagtacggaacactaggattagaatgttccccacgaacaggattagacttcaacgagatgatcttattgacaatgaaaaacaaagcgtggatggtacacagacagtggttctttgatctacccctcccttggacatcaggagcaacgacagagacgccaacatggaaccgaaaagaactactggtgacatttaaaaatgctcacgcaaagaaacaggaagtagtagtcctaggtagccaggagggcgcaatgcacacagctttaacaggtgctactgaaattcaaaattcaggaggaacctctatattcgcaggccatctaaaatgtcgactaaaaatggacaaactagagttaaaaggcatgagctacgcaatgtgcaccaatacctttgtgctcaagaaagaagtatctgaaacacaacatggaacaatactaataaaagtggaatacaaaggagaggatgtgccatgtaaaattccgtttagcacagaagacggacaaggcaaagcgcacaatggcagactgataacagccaatccagtcgtgactaagaaagaagaaccagtaaacatagaagctgaaccaccttttggtgaatccaatatcgtgattggaataggcgacaatgcacttaaaattaactggtacaagaaaggttcgtcaataggtaaaatgtttgaagcaactgctcgtggagcacgcagaatggcgattcttggtgatactgcatgggacttcgggtcagtcggaggagtcctaaacagcctcggtaaaatggtacatcaaatatttgggtcggcttataccgctctattttccggtgtgagttgggtaatgaaaataggcatcggagtgttgctgacttggattggtctaaacagtaagaacactagcatgagctttagttgcatcgcaataggaattataaccctctacttaggcgcagtggtacaagccgatatgggatgtgttataaattggaaaggtaaagaactaaagtgcggaagcgggatattcgtcacaaatgaggtgcatacgtggactgaacagtataagtttcaagcagatagtccaaagagattagccactgccatagcaggagcctgggaaaatggggtatgtgggatcagatcaacaaccagaatggaaaacctcttgtggaaacagatcgcaaacgagctgaactacatattgtgggagaacaacataaaattgaccgtggttgtcggtgatataattggcgtcctcgaacagggtaaaagaacactaacaccgcaacccatggaactcaaatacagttggaaaacatggggtaaagcaaagatagtaaccgcagagacccaaaattcatcattcatcatagatggacccaataccccagaatgcccttcagtctcaagagcttggaatgtttgggaagtggaggattatgggttcggagtattcaccacgaacatttggttaaaattgcgtgaggtttatacacaactttgtgaccatcggttgatgtcggccgcagtgaaagatgaacgcgcagttcacgctgatatggggtattggatagagtcccagaaaaatggaagttggaaattagaaaaggcttcactgattgaagtaaaaacctgcacgtggccaaaaagtcatacactgtggtcgaacggagtacttgagtctgatatgataatacctaaaagtctggcaggccctattagtcaacataaccaccggccaggttaccatactcaaacagcaggaccctggcatttagggaaactagagcttgattttaattattgtgaaggaaccacggtcgtcatcactgagaattgtggaacaagagggccttcacttaggacaaccactgtttcaggaaaattaatccatgaatggtgttgtcgctcctgcacactcccaccgttacgatacataggggaagacggctgctggtatggaatggaaattagaccaatatcggaaaaggaggaaaacatggtgaaatcattggtgtctgcagggagtggaaaagtggacaattttacgatgggtgtgttatgtttggcgatattattcgaggaggtaatgaggggaaagtttggcaagaaacatatgatcgcaggggtctttttcactttcgtcctactactatcgggacaaataacttggcgagatatggctcacactttgattatgattggttccaatgcaagcgaccgcatgggaatgggcgtcacctaccttgcgcttatagcaacgttcaaaatccagccattcctagcacttggattctttttaagacgtctaacttctagagagaatcttttattaggggttggtttagctatggctacaactttacaactacctgaagacattgaacagatggcaaatggtatcgccctcggactgatggcgctaaaattaatcactcaatttgagacgtatcaactatggactgcactgatttcactaacatgttcaaacacaatttttaccctcactgtcgcatggagaacagctacgttaatattagccggtgtctcactgttacccgtttgtcaatcatcgtcaatgcgaaaaactgactggttaccaatggcggtcgcggccatgggagttccaccattaccattgtttatattctcgttaaaagatacactgaaacgacggtcatggcctttgaatgaaggagtgatggcggtcgggcttgtatcaattttagcttcaagtttattaagaaatgacgtgccgatggcaggacccttagtagcaggaggactacttattgcatgttacgtcattacgggaacatcggctgacctaacagtagaaaaagccgctgatatcacatgggaagaagaggctgaacaaacgggcgtaagccataatctaatgataacagttgacgacgacggaacgatgagaataaaagatgatgaaacagaaaatatattaacagtacttctaaaaacagcactgttaatcgtttccggaattttcccatatagtattccagcgacactcctagtctggcatacatggcaaaagcaaacacaaagaagtggggtactgtgggatgtaccatctccaccagaaacccaaaaggctgaattggaagagggtgtatatagaattaagcagcaaggtattttcggaaagacgcaagtaggtgtaggtgtgcaaaaggagggggtcttccacaccatgtggcacgtaactcgcggtgccgtgctgacttataacgggaagcgcctagaaccgaattgggcttcagtgaaaaaggatttgatttcatacggaggaggatggagactgtcagcacaatggcaaaaaggagaagaggtacaagtaatcgcagtcgagccaggtaaaaatcctaaaaactttcaaaccatgccaggaacttttcaaacaacaactggtgagataggcgcaattgcacttgattttaaaccaggtacttctggaagtccgattataaatagaggcgggaaagtcgttggactttatggaaatggtgtcgtaacaaagaatggagggtatgtaagcggaatagcccaaacgaatgcagaacctgatggtcccacacctgaactggaagaagagatgttcaagaaacggaatctgacaataatggatctccatcctggttctggtaaaacaagaaaatatctaccagccatagtcagagaagcgataacaagaagattaaggactcttatattggctcccacaagagtagtggccgcagaaatggaggaagcattaaaaggattaccaattaggtatcaaaccaccgcaaccaaatctgagcataccggaagggaaatagtggacctcatgtgccatgctacattcacaatgagattgctctcaccagtacgggttccaaactataacctcataataatggacgaagcacatttcactgaccccgctagcatcgctgcacgaggctacatatctacaagggttggaatgggagaggctgccgcaatttttatgaccgcgactccaccaggaactgcggacgcttttcctcaatccaatgccccaatacaggacgaagaaagagatataccagagaggagctggaactccggtaatgaatggatcactgactttgctggaaaaactgtatggttcgtcccctcgataaaggcgggtaacgatatcgcaaattgtttacgcaaaaatggcaagaaagtaatacagctatctaggaagacatttgatactgaatatcagaaaactaaacttaatgactgggactttgtagtgaccacagacattagcgaaatgggtgcgaacttcaaagcagatagagtcatagatccgagaagatgtttgaaaccggtgatattaacagacgggcctgaacgcgtcatattggcgggtccaatgccagtaaccgctgctagcgctgcccaaagacgggggagagtcgggagaaatccgcaaaaagaaaacgaccaatatatattcaccggccaacctttaaataatgacgaagatcatgcccactggactgaagccaaaatgctgttggacaatattaatactccagaaggcatcattcctgcactattcgagccagaaagagagaaaagcgcagcagtagatggtgaataccgattaaagggggaaagcaggaagacgttcgtagaattaatgaggcgaggtgacttaccagtttggcttgcacacaaagtagcgtctgaaggaatcaagtacacagatcgaaaatggtgtttcgacggacaacggaataaccaaattttggaagaaaatatggacgtggaaatatggacaaaagaaggcgagaagaagaaacttagaccaaggtggttagacgcgcgaacttatagtgacccattggcacttaaagaatttaaggaatttgcagcgggaaggaaatcaatcgcattagatcttgtaaccgaaatcggaagagtaccgtcacatctagctcatcgcactagaaatgctttagacaacctagttatgctacatacaagtgaacacggtgggcgagcttacagacatgcagtagaagagttaccagaaacgatggagacattactgctattagggttaatgatactactcacaggaggggcaatgctattccttatatctggaaaagggataggtaaaacaagtattggtcttatctgtgttatagcaagctccggaatgctgtggatggccgaaataccgcttcagtggatcgcgtctgctatcgtcctcgagttctttatgatggtccttctcattcctgaaccggagaagcagcgcacgccgcaagataatcagctagcatacgtagtaataggaattttgacgctagctgcgataatagcggcaaacgaaatgggactattagaaaccaccaagagagatctaggaatgtcgaaggaaccgggagtagtaagcccaaccagttatttagatgtggatctacatcctgcatctgcgtggacattatatgccgtagctacaacggttattacaccgatgctacgacatacaatagaaaattcaaccgctaacgtgagccttgctgccatagcaaatcaagcagtagtgttaatgggactggacaaagggtggcctattagcaagatggacctgggagttcctttgctagcattaggatgttactcgcaggtcaacccgttaacccttactgctgcagtattattactcattacacattacgcaatcatcgggcccggcttacaagcgaaagcaaccagggaagctcaaaaacgaactgccgcaggtataatgaagaacccaaccgtagacggaataatgacaatagatttagatcccgtaatatatgatagtaagtttgagaaacaactaggacaagttatgttactcgttctatgtgctgtccagttactattaatgcgtactagctgggcactctgtgaagcattaactcttgcaacaggccctataacaacattatgggaaggatcgccaggcaaattttggaatactactatagcagtcagtatggcaaacatatttaggggatcctatctggcaggggctggcttggcttttagtataatgaaatcggttggaacgggcaaacgcggaactggttcacaaggagaaacattaggggaaaaatggaaacggaaattaaatcaactaagtagaaaagactttgatctgtataagaaatcaggtataacagaggtagatagaacagaagccaaagagggtttaaagcgtggagagatcactcatcacgcagtatcaaggggctcagctaaattacagtggtttgtagaacgtaatatggttatcccagaaggtagagtaattgaccttggttgtggaagaggaggttggagttactactgtgcaggattgaagaaagtaaccgaggtaaggggatatacaaaaggcggacctggacacgaagaaccagttccaatgtccacatacggatggaacatagtaaaactaatgtctggaaaagacgtattttacctgccaccggaaaaatgtgatacacttctttgcgatataggagaatcaagtcctagtccaacagtagaagaaagtagaactatacgcgtattaaaaatggtagaaccctggcttaaaaataaccagttttgtattaaagtactaaatccgtatatgcctacggtaatagaacatctggagcgactccaaagaaaacatggtggtatgttagtgagaaaccccttgtcgcgtaatagtactcatgagatgtactggattagtaacgggactggtaatattgtggccagcgttaacatggtctcgagactcctgttaaaccggtttacgatgacacatcgccggcctaccatcgagaaggatgttgatctcggcgctggaacacggcatgtaaatgcagaacccgaaactcctaacatggatgtaataggggaacgcattaagaggattaaggaagaacacaattcgacctggcactatgatgacgaaaacccttacaaaacctgggcgtatcatggaagttacgaagttaaagcgacagggtcagcaagttcgatgattaatggagtcgttaaattattaaccaaaccgtgggatgtcgttcctatggtcactcaaatggccatgacagatacgacaccgtttggccaacaacgagtctttaaagaaaaagttgacacacggacgccacggagcatgccaggaacaagaagagtcatgggtatcacagctgaatggttatggaggacactgggaagaaataagaaacctcgactgtgtacgcgagaagaatttaccaagaaagttcgaacaaatgcagcaatgggtgcagtctttacggaagagaatcaatgggatagtgccaaagctgctgtagaagacgaagacttttggaaacttgtggatagagaaagagaactacacaaactaggaaaatgtggttcatgtgtctataacatgatgggtaaaagggagaaaaagctcggagagttcggaaaggctaaaggaagccgagcaatttggtatatgtggcttggagcaagatatttagagtttgaagcactaggatttttaaatgaagaccattggtttagccgtgaaaactcatattccggcgtggaaggcgaaggactccacaaattgggatatatcctcagagatatttcaaagattccaggcggagccatgtatgctgacgataccgccggatgggatacacgaatcacagaagacgacttacacaatgaggagaagattacacaacagatggatccagagcaccggcaactggcaaacgcaatatttaaattaacatatcagaataaagtagttaaagttcaaagaccaactcctaccggtacagtaatggacattatcagcagaaaagatcaaagagggtcaggacaagtaggaacgtatggattaaatacttttacaaatatggaagcgcaattaatccgccagatggaaggggaaggagtcctttcaaaagccgacttagaaaacccatacctacctgagaagaaaatcactcaatggctggaaaccaaaggagttgaacgtctgaagcgaatggccatttcaggagatgattgtgttgtcaaaccaatagatgatcgctttgctaacgcactacttgcattaaacgacatgggaaaagtccgtaaagatatacctcaatggcaaccctcaaaaggttggcatgattggcaacaagtacctttctgcagtcaccactttcatgaactaattatgaaagacggtcgaaagctagtcgtaccttgccgcccacaggatgaattaatcggcagagcacgcatatcacaaggagctggctggagcttaaaagaaacagcttgtttaggcaaggcctatgcacaaatgtggagcttaatgtactttcacagacgtgatcttagactcgcaagcaatgctatttgctcagctgttcctgtacattgggtaccaacctcgcgaacgacatggtcaatacatgctcatcatcaatggatgactacagaagacatgctaaccgtatggaaccgtgtctggattgaagacaatccatggatggaagacaaaacaccagtaaccacatgggaaaacgttccatatttaggcaaacgagaagaccaatggtgtggatctttaattggattgaccagcagagcgacctgggcacaaaacatcccaacagcaattcaacaagtgagatctttaatcggaaatgaagagtttcttgactacatgcctagcatgaagagatttcgaaaggaagaagaaagcgaaggtgcgatttggtaa

SEQ ID NO: 23238 - RNA, 9873 nt, synthetic construct
  misc_feature 1..9873: note = derived and/or modified CDS sequence (opt6) from DENV-3__KF973478__SS-prME
  source 1..9873: mol_type = other RNA
acatcgttatgtttaatgatgatattgccggcagcactagcattccacctaacttccagagacggtgaaccaagaatgatagtaggcaaaaatgaacgcggtaaaagtcttctttttaaaacagcaagcggaatcaatatgtgcacattaattgctatggacttaggcgaaatgtgcgacgatactgtaacctataaatgcccgcatattacggaagtagagcctgaagacattgattgttggtgcaacttaacgagcacttgggtgacctacggcacttgtaaccaagccggtgaacacagacgagataaaaggagtgtcgcgctagctccacacgttggtatgggtctggacacgagaacacaaacgtggatgtctgctgaaggagcatggcgtcaagttgaaaaagttgaaacgtgggcactacgacacccaggtttcacgatactagcgctatttctagcccattatataggtacaagtttaacccaaaaagtagtaatttttatcttgttaatgctagtaactccttctatgaccatgagatgtgtaggagtaggaaacagggatttcgtcgagggactctccggagcaacatgggttgatgtggttttagaacacggtggatgcgtcaccaccatggctaaaaataaaccaactctagatattgaattgcagaaaacagaagccacacaattggcgactttaaggaaactttgcatagagggaaaaattacaaacatcacgaccgactctcgatgtccaacgcagggtgaggcaaccttaccagaagaacaggatcaaaattatgtgtgcaaacatacatatgtagatagaggatggggcaacggttgtggtctctttggtaaaggaagcctagtcacatgtgcaaaattccaatgtctcgaacctattgaggggaaagtagttcaacatgaaaatttaaaatatacagtaataatcacagtacataccggggatcaacatcaggtcggtaacgaaacacaaggagttacagctgaaataacaccgcaggcgagcactactgaggctatattacctgaatatgggactttaggtctagaatgttctccgcgaacaggattagactttaatgaaatgatactcttaacgatgaaaaataaagcgtggatggtacaccgccaatggttctttgatctgccgcttccatggacatccggggcaaccacagagaccccaacttggaaccgcaaagagttgcttgtaacattcaaaaacgcacatgcaaagaaacaagaagtagtagttctaggaagtcaggagggtgcaatgcatacagctttaactggtgcaaccgagatacagaactcaggaggaacttcgattttcgcaggacacttaaagtgtcgactgaaaatggataaattggagttaaaaggaatgtcttacgctatgtgcacaaatactttcgtattgaagaaggaagtatcggaaacacaacacggcacaatattaattaaggttgaatataaaggagaggatgttccatgtaaaatcccgttttcgacagaagatggacaaggcaaagcccataatggcagattaataactgcaaatccggtagtgactaagaaagaggaaccagtaaacatagaagcagaacctccctttggagaaagcaatatagtaattgggattggtgataatgcactaaaaataaattggtacaagaagggtagtagcattggaaagatgtttgaagcgacggctcgtggtgcccggagaatggcaatactcggagacaccgcatgggatttcggtagtgtcgggggcgtacttaacagtctgggcaaaatggtacatcaaatttttggaagcgcatatacagccctattttcgggggtaagctgggtcatgaaaataggtattggtgtactgttaacctggattggactcaatagtaaaaacaccagtatgtcattttcatgcattgccataggcataataacattatatctaggagctgttgttcaagcagacatgggctgtgtaataaactggaagggtaaagaattaaaatgcggaagcggtattttcgttacaaacgaagttcacacatggaccgaacagtacaaatttcaggctgattcacccaagcgcttagccacagcaattgctggtgcatgggaaaacggtgtttgtggaattaggtccactacacgtatggaaaacttactctggaaacaaattgcaaatgagttaaactacatcctttgggaaaataatataaagctcactgttgttgttggagatattataggagtacttgagcaaggaaaaagaacactaacaagtcagcccatggaacttaaatactcctggaagacatggggcaaagcaaaaatagtcactgcggaaacccaaaactcatcctttataattgatggcccaaacacgcctgagtgcccatccgtaagtcgggcctggaatgtctgggaggtagaagattatggattcggagtctttactacaaatatctggttaaaattaagagaagtgtatacgcaactatgcgaccataggttgatgagtgccgccgtgaaagatgagcgcgctgttcatgccgatatgggttattggatagagtcacagaaaaatggaagctggaagttagaaaaggcgtctctgatcgaggtgaaaacctgtacttggcctaaaagccatacgctatggtcaaatggggttctggaatcagatatgataatacccaaatcgctagcaggtccaatctcacagcataatcatagacctgggtaccatacacaaacagctggtccgtggcatctcggaaagttggaattagacttcaattactgcgagggaactacggttgtaataactgaaaattgtgggacaaggggtccatcattaagaactacaacagtatctggcaaacttatacacgaatggtgctgccgttcatgtaccctaccaccactaaggtatatgggcgaagatggttgctggtatggaatggagatcagacccatttcggaaaaagaggaaaacatggtaaaaagtttggtgtctgcagggagtggtaaagtggacaactttactatgggcgtattatgcctcgccatccttttcgaagaggttatgcgcggaaaattcggcaagaagcacatgatcgcgggcgtattctttacgttcgtcttgctactcagcggtcagattacctggagagacatggcgcacaccctgatcatgataggtagtaatgcaagtgatagaatgggcatgggagttacctatttagccttaatcgccacgttcaaaatacagccattcctggctctcggcttctttttaagaaagctaacgtcgagggaaaatctattactaggggtaggccttgcaatggccactacacttcaactaccggaagacatcgagcaaatggcgaacggcatagctctaggcttaatggcactcaaattaataactcagtttgagacatatcaattatggacggcgttgatttctttaacctgtagtaatactattttcacgctcactgtcgcttggcgtactgcgacgttaattttagcaggggtttcattactaccagtatgtcaaagctcgtcgatgcgaaaaacagactggctaccgatggcagttgcagcgatgggcgtacctccgcttcctttatttatatttggtttaaaagacaccttgaaacgaaggtcatggccattaaatgagggagtaatggcagtcggactggtcagtattcttgcgagctcattacttcgaaatgacgttccaatggcaggaccactggtggcgggcggattgttgattgcgtgttacgtaatcaccggaacctcggcagacctaactgttgaaaaagccgcggacattacatgggaagaggaagcggagcaaacaggcgtgtcacataatcttatgatcacagtggacgatgacggtacaatgcgaattaaggatgacgagacagaaaatatacttaccgtacttttaaaaacagctttactgatagttagtggaatctttccctacagtattccagccacgttacttgtatggcatacctggcaaaagcaaacacagcggagtggggtcctgtgggacgtaccatccccacctgaaactcagaaagcggagttggaggagggtgtatatagaataaaacaacaaggcatttttggcaaaacacaggtcggggttggtgtacaaaaggaaggtgtctttcacacaatgtggcatgttacacgaggagctgtattaacatataacggaaaacgcttagaacctaattgggcgtctgtcaagaaagatctcatctcttacggcggcggctggagactttcagcgcaatggcaaaaaggcgaagaagttcaggtcatagcagtagagccagggaaaaatcccaaaaatttccaaaccatgccggggacattccagacgaccacaggcgagattggggcaattgctttagattttaaacccggaacatccggttccccaataataaatagagaagggaaagtggttggcctttatggcaacggcgttgttactaaaaatggagggtacgtatcaggcatagcgcaaacaaatgcagagcctgacggacctacgcccgagttggaggaagaaatgtttaagaaaaggaatttgactataatggacttacacccagggtcaggcaagacacgaaaatacttaccagctatagtgcgggaagctatcaagagaagactaagaacactaattttagcccctacacgagtagtagcagcagaaatggaagaagctcttaagggactccccatcaggtatcagaccacggcgacaaagagtgagcacacaggacgggaaatagttgacctaatgtgccatgcaacatttacaatgcgccttttaagtccagtacgggtaccaaattataaccttataatcatggacgaagcgcattttacagatccagcgtccatagcagcaagaggctatataagtacaagagttggtatgggagaagcagccgcaattttcatgacagctaccccaccgggaacagcagacgcttttcctcaatcaaatgcgcctattcaagacgaagaaagagacatacccgagcgttcgtggaactcagggaatgagtggatcacagattttgcgggaaagacggtatggttcgtcccgtctataaaagctggaaacgacatcgcaaattgcttacgcaagaatggaaagaaagtaatacagttaagtagaaagacttttgacacggagtatcagaaaacgaaattgaatgactgggactttgtagtaacaacagatatttcagaaatgggcgctaattttaaagctgatagagtcatcgatcctcgtaggtgccttaaacctgtaatactcacagatggaccagaacgggtcatactagccgggcctatgcctgtaacagcagcgagtgctgctcaacgtagaggaagagtaggacgaaatccacaaaaagagaatgaccaatacatttttacgggacagccccttaataatgacgaggaccacgcacattggacagaagcaaaaatgttattggacaacataaatacaccagaaggtataatacccgcgctattcgagcccgagagagaaaaatcagcagctatagacggggaatatcgattaaagggagaatcgcgaaaaacttttgtagagttgatgcgcagaggagacttaccggtgtggttagcgcataaggtagcatccgagggaattaaatatacggatcgtaaatggtgcttcgacggccaaaggaacaaccagatattagaagaaaatatggatgtagagatatggacaaaagaaggagagaagaagaaattaagacctaggtggcttgacgcaagaacatatagtgatccacttgcactcaaagagtttaaagaatttgcagcaggacgtaaatccatagcattagatctcgtaacagagataggacgagttcctagtcatttagcccaccgaaccaggaatgcactcgataacctagtaatgttgcacacaagcgaacacggaggtcgagcctatagacatgcagttgaagaactacctgaaacaatggaaacacttttattgcttggattaatgatattactaacaggaggagctatgctatttttgataagcgggaaaggtatagggaagacctccattggattaatttgtgtcatcgccagctccgggatgctgtggatggcagagatacctctacaatggatagcaagcgccatcgttttagaatttttcatgatggtacttttgatcccggaacccgagaagcagcgaacccctcaagacaatcaactcgcttacgttgtgattggtatcctcactcttgctgcaatcattgcagctaatgaaatgggacttctagaaactacgaaaagagacttagggatgtccaaagaaccaggtgtagtttcgccaacttcgtatctcgacgtagacttacaccccgcatcagcttggacactatacgctgtcgctactaccgtaatcacaccaatgttaagacatacaatagaaaactccacagctaacgtttcattagccgcaatagcaaatcaagccgtcgtcctcatgggcttagacaaaggatggcctataagcaagatggatctaggcgtaccgttattagctctaggttgttacagccaagtaaacccccttactctcacagcagcagtattattgcttattacacactacgctataataggaccaggactacaggccaaagcgaccagggaagcacagaagcgaacggccgccgggataatgaaaaatcctactgtagacgggattatgacaatcgatttagaccccgtcatctacgacagtaagtttgaaaagcaattaggccaagtcatgctccttgtactctgtgcagtgcaattactactaatgagaacaagttgggcgctatgtgaagcgctaacattagctactggcccaataacgaccctatgggagggatcacctggtaaattttggaataccacgatagcagtgtccatggcaaacatctttaggggttcttaccttgctggcgcgggactcgcctttagcataatgaaatcagtggggaccggaaagcgtggaaccggatcacaaggggagaccctgggtgagaaatggaagaagaaattgaatcaattaagtagaaaagattttgatttatataagaaatccggtataacggaggtagatagaaccgaagcaaaagaagggctcaaacgtggggagataacgcaccatgctgttagtcgaggatcggctaaactacaatggttcgtagaaagaaacatggtcataccagaaggaagagtcatcgacctaggttgtggaagagggggatggagttactactgtgcaggactcaagaaagttacagaagtccgtgggtatacaaagggcggaccgggccatgaggaaccagttccaatgtcaacatacggatggaacatcgtaaaactgatgagtggcaaagacgtgttttatctacctccagaaaaatgtgacacgttactatgtgatatcggagaaagcagcccatctcccactgtagaggaatcgcgaacaataagagttctaaaaatggttgaaccttggctaaagaataatcaattttgtatcaaagtacttaatccatatatgccaactgtaattgaacatttagaacgcttacaacgaaagcatggaggaatgctagtcaggaacccattatcacgtaattcaacgcatgaaatgtattggattagtaacggtacaggtaacattgtggctagtgtgaatatggttagcagattacttttaaacagattcacgatgactcataggcggccaactatagaaaaggacgtagacttaggggcaggtacgagacacgtaaatgcagaaccagaaacgcctaatatggatgtaataggggagcgaataaaaagaataaaagaagaacacaacagtacttggcattacgatgatgagaatccgtataaaacatgggcatatcatggtagctatgaagtgaaggctacaggatcggcatcatcaatgataaatggtgtggtcaaactactgacaaaaccatgggacgtagtccctatggtcacccaaatggccatgaccgacacgacgccatttgggcaacaacgtgtgttcaaagaaaaagtagatacgagaacgccaaggtcaatgccaggaacgaggagagttatgggtataacagctgagtggctgtggcgaactttaggaagaaataaaaagcctaggctttgcacacgcgaagaatttaccaaaaaggtgagaactaacgctgccatgggagcagtattcactgaagagaaccaatgggactcagcaaaagcggcggtagaagatgaagacttttggaaactggtcgaccgcgaaagagaactacataaattgggaaaatgtgggagctgcgtctataacatgatgggtaaacgagagaagaaacttggcgaatttggtaaggctaaaggcagcagagcaatctggtacatgtggctcggtgcaagatatctagaatttgaagctctcggattccttaacgaagaccattggttttcaagggaaaattcatacagcggtgtagagggcgaaggcttacaccgtctaggttacattttacgcgatatatcgaaaatacccggtggcgccatgtacgcagatgatactgctggatgggataccaggataacagaagacgatctacataatgaggagaaaatcacccaacaaatggatccagaacatagacagttagctaatgcgatcttcaagctaacatatcaaaataaagtagtcaaggtacaaaggccaacaccgacggggacagttatggatattatatcaagaaaagatcaacgcggatcaggtcaagtgggaacatatggattgaatacatttacaaacatggaagcacagttgattcgacagatggaaggcgaaggagtactatctaaagcagacttagagaacccacatttaccagagaagaaaattacacaatggttagaaacaaagggtgttgaaagattaaaacgtatggccattagtggagacgattgtgttgtaaaacctattgacgatagattcgctaacgccctattagcactaaacgatatgggtaaagtacgtaaagacattccacaatggcaaccgtcaaaaggctggcacgattggcagcaagtacccttttgtagtcaccattttcacgaattaattatgaaagacggacgaaaacttgtagtcccctgtcgtcctcaggatgagctaattggtcgagccaggataagccagggcgcaggttggtctttgaaagaaacagcatgtctagggaaagcatatgcacaaatgtggagtctaatgtactttcataggagggacttaagattagcatcaaacgcaatctgctcagctgtacccgtgcattgggtaccaacatcaagaactacatggtctatacacgctcatcatcaatggatgactacagaagatatgctaacagtatggaatcgcgtatggattgaagacaacccttggatggaagataaaaccccagtaactacatgggaaaatgtgccatatttagggaaacgtgaagatcaatggtgcggatcactaattggtttaacgagtcgtgcgacttgggcccaaaacatccctacagctattcaacaggtacgctctctaatcggcaatgaagagtttttagattatatgccttcgatgaaaagatttagaaaggaagaggaatctgaaggcgctatttggtag

SEQ ID NO: 23239 - RNA, 9873 nt, synthetic construct
  misc_feature 1..9873: note = derived and/or modified CDS sequence (opt6) from DENV-3__KF973479__SS-prME
  source 1..9873: mol_type = other RNA
acttctctgtgcctgatgatgatcttacctgctgcactggcctttcatttaacaagccgcgatggtgaaccaaggatgatagtgggcaaaaatgaaagaggtaagagcttattgtttaaaaccgcatccgggatcaatatgtgtactcttattgcaatggatttaggtgaaatgtgtgacgacacagttacatacaaatgcccacacatcactgaagtagaacctgaagacattgactgctggtgtaatttaactagcacgtgggtcacatatggaacctgtaatcaggccggagaacataggagagacaagcgatccgttgccctcgcgcctcatgttggaatgggattagacactcgaacacaaacttggatgagcgctgaaggagcttggcggcaagtagaaaaagttgaaacatgggcactaagacatccaggatttacaattctagcactatttctagctcattatatcggaacctctcttacacaaaaagttgtaatatttatattattaatgctagtaaccccgagtatgacaatgcgatgcgttggagtgggaaatagggatttcgtagaaggactaagtggtgccacttgggtggacgtagtgctcgaacatggcggttgtgtaactacaatggcgaaaaataaaccaacactggatatcgaactacagaaaacagaagcaacacaacttgcgaccctgaggaaattatgtatagaaggaaaaattacaaacattactaccgatagccgatgccccactcaaggtgaagcaactctacccgaggagcaagatcaaaactacgtatgcaaacatacttatgtagacaggggatggggaaatggctgtggattatttggcaaaggcagcttagtaacatgtgccaaatttcagtgccttgaaccaatagaagggaaagtagtacaatatgagaatctcaaatataccgtaatcattacagtgcacacaggagatcaacatcaggtaggaaacgaaacccaaggagttaccgcagagatcacacctcaagccagtaccacagaagcaattttacctgaatatggaacgttgggattggagtgctctcctcgtacaggactggacttcaatgagatgattcttttaaccatgaaaaataaagcatggatggttcataggcagtggttctttgacttaccgttaccatggacctcgggagccacaactgaaacaccgacctggaatcgaaaagaactcttggtaacatttaaaaacgctcacgccaagaaacaagaagtcgtcgttctcggatcccaagaaggcgctatgcacacggcacttactggcgctactgagattcaaaatttagggggtacctccattttcgccggccatttaaaatgtcgtttgaaaatggacaaattggagttaaaaggaatgtcgtacgcaatgtgtacaaacacgtttgtattgaagaaagaggtatcagaaacacaacatggaacaattttaataaaagtggagtacaaaggagaagacgcaccatgtaaaatacccttcagtactgaagatggtcaaggtaaggcacacaacggtcgattgataaccgccaaccccgtggttacaaagaaagaagaaccggtcaatatagaagcggagccaccctttggcgaatccaatatagttataggaattggcgataacgcactaaaaatcaactggtacaagaagggttcatcgatcggtaaaatgttcgaagcaactgcccgaggagcaagacgaatggcaattttgggagacacagcatgggacttcggttctgtgggcggtgtgcttaattcgttgggaaagatggttcatcagattttcggttcagcgtatactgctctttttagtggagtaagttgggtgatgaagataggcataggggtcttattaacatggattggattaaatagcaaaaacacgagcatgtccttctcatgtatcgcaataggtatcattactttgtatctcggggctgtagtacaagcagatatgggctgcgttataaactggaaaggcaaggaattaaagtgcggatcaggtatattcgtgactaatgaggttcacacttggacagaacaatataaatttcaagctgacagcccaaaacgattagccacggccattgctggagcttgggaaaatggtgtgtgtggaattagaagtactactcgaatggaaaacttactgtggaaacaaatcgcgaacgaacttaattatatattgtgggaaaacaacattaaactgacagtagttgtcggagatatcataggagtactagagcagggaaaacgaacacttaccccgcaaccaatggaactaaaatacagctggaaaacttggggaaaagcaaaaatagtcactgcagaaacccaaaattcttcgttcataatcgatggaccgaatacacctgaatgtccgtctgttagccgggcttggaatgtttgggaagtcgaggattacggctttggagtttttactaccaacatatggcttaagctaagggaagtctatacgcagctgtgtgaccacagactcatgtcagctgcagtaaaagatgagcgcgcagtgcatgcggacatgggatactggatagagtctcagaagaatggctcatggaagctagagaaagccagtttaatagaagtcaaaacatgtacgtggcccaaatcacacacactatggagtaatggtgtattagagtccgatatgattattccaaagagcttggctggtcccatatcccaacacaatcataggccaggataccatactcagacggcaggaccttggcatctgggcaaactagagttggattttaattattgtgaaggaacaactgttgtcatcacagaaaattgtggaactcggggacccagcttaaggaccactacagtttcgggaaagttaatccacgaatggtgttgtagatcatgcactttacctcccttacgctatatgggggaagatggctgttggtatggaatggaaataagacctatcagtgaaaaggaagagaacatggtaaaaagtctggtatctgcaggatcaggaaaggtagataatttcacgatgggcgtgttatgtttggcgattctgttcgaagaagtaatgagggggaagttcggtaagaaacacatgatagcaggggtcttctttaccttcgtgttattattatcaggccaaataacttggagagacatggcccatactctaataatgataggatctagcgccagcgatcgaatggggatgggagtaacctaccttgcactaattgcaacgttcaaaatacaaccttttctcgccctggggtttttcttaagaaagttaacttcgcgagaaaacctgctactcggagtcggactagctatggctacaactttacagttgcccgaagacatagaacaaatggcaaacgggatcgcactagggctcatggcgttaaagttaataactcaattcgaaacctatcagttatggaccgcgttgatctctcttacatgttctaacacgatattcacccttactgtagcctggcgaacagccaccctaatactggctggcgtctcgcttttaccagtctgtcaatctagcagcatgcgaaaaacggattggttacccatggcggtagctgctatgggggtaccaccacttccactattcatttttggattgaaagataccctaaagcgtagaagctggcctttgaatgaaggggtgatggcagtaggtctcgtatctattctggccagttctcttttgaggaatgatgtgcctatggctggaccattggttgcaggagggttgctgatcgcttgctacgttataacgggtacctctgcggatttaacagtagaaaaagcagctgacataacctgggaagaagaggccgagcaaacgggagtaagtcataatctgatgattaccgtggatgacgatggcaccatgagaattaaagacgacgagacagagaacattcttacagtgttactaaaaactgcattactcattgtgagcgggatctttccctactccattcctgccacactacttgtatggcacacttggcaaaaacaaactcaaagaagcggtgtcctatgggatgttccgagcccacctgagacacaaaaagcagaactcgaagaaggtgtatatagaattaagcagcaaggtatattcggaaaaacccaagtaggtgttggagttcaaaaagagggtgttttccacacaatgtggcatgtaacacgcggtgcagttctgacatataatggcaaaagattagaacctaattgggcgtcagtaaagaaggatctaatctcttatggcggtggatggagactttccgcgcagtggcagaagggcgaagaagtacaagtcatcgcagttgaaccaggcaaaaatcctaaaaatttccaaaccatgccaggaacatttcaaacaacaaccggagaaattggagctatagcattagatttcaaaccaggaacaagtggctctcctatcataaatcgagaaggtaaggtagtaggcttatacggcaacggtgtggtaaccaaaaacggtgggtatgtgtctgggattgcacagacaaatgcagaaccggatggccctacaccagaactagaagaggaaatgtttaagaaaagaaatctaactatcatggacctacatcctggtagtggaaaaacaagaaaatatttaccggccatcgtaagggaggcgataaaaagacgacttaggactctcatcttagcgccaactcgagtcgttgcggccgaaatggaggaggctttgaaaggattaccaatcagatatcagacaacggcaacgaaaagcgagcatacaggaagagaaatagtagatctaatgtgtcacgcgacgttcacgatgcgtttgctgtctcctgttcgagtacccaattacaacctaattataatggacgaagcccacttcaccgacccggctagcatcgcagcaagaggatatatatctactagagttggtatgggagaagcagccgcaatatttatgacggcaacgccgcctggcacggcagatgcatttccacaaagtaatgctccaatacaagatgaggaacgtgacatcccagaaaggagttggaactcaggaaacgaatggattacggattttgctggaaaaacagtatggttcgtcccctctataaaagctggtaatgacatcgcgaactgtttgaggaaaaatggcaagaaagtaatacaattaagcagaaaaacgtttgacacagagtatcagaaaacaaaacttaacgactgggattttgtagtgactactgacattagtgaaatgggcgctaatttcaaagccgacagagtgatcgacccgagaagatgtcttaaaccagttatcctaacagatggacctgagagagttatattggcaggtcccatgcccgtaacagcagcaagcgccgcgcaaagacggggtagagtcgggcggaatccgcaaaaagaaaacgatcagtatatatttacaggccaacctttgaataacgacgaagatcacgctcactggacagaagctaaaatgctactagacaatataaatacaccagaaggaataatccccgctttatttgaaccagaaagggagaaaagtgctgccattgatggagaatatcggctaaagggtgaatcaaggaaaacctttgtagaacttatgcggagaggggacttaccggtttggttggcccacaaggtagctagcgaaggaataaaatacacagatagaaaatggtgtttcgacggacagaggaataaccaaatattagaagaaaacatggatgtggagatatggactaaagagggtgaaaagaagaaacttcgccctagatggttagatgcacgaacctattccgatccgcttgctctaaaggaatttaaagaatttgcagcaggtaggaaatcaatcgcactagaccttgtgaccgaaataggtagggtcccatcgcatttggcacatagaaccaggaatgcgctcgacaatttagttatgttgcacacatccgagcatggtggcagagcatatagacacgccgtagaagaactgcctgaaactatggaaacattattactattaggattaatgatattacttacaggaggcgcaatgctattcttaatatcgggaaaagggataggaaaaacaagtataggacttatatgcgttatagcaagtagtggtatgctgtggatggccgagataccgcttcaatggattgcatccgcaattgtcttagagttctttatgatggtactgttgataccggaaccagaaaagcaacgtacaccccaagacaatcaacttgcatatgtagtaatcggtattttaacgttagctgcaattatcgctgcaaatgaaatgggactactcgaaactacgaagcgagacttgggaatgagcaaagaaccaggtgtagtaagccccaccagctatctagacgttgacctgcatcctgctagtgcatggacactatatgcagtagcaacgactgtgataacgcccatgctaagacatacgatagaaaattcgactgcaaacgtctcgttggctgcgattgccaatcaggcagtggttttaatgggacttgacaaaggatggccaataagcaaaatggatttaggcgtaccattactagcactcggatgttattctcaagtaaatcctcttactttaactgcagcagtcttactattgataacccattatgcgataatagggccgggtctgcaggcaaaagcaacaagggaagcacagaaaagaaccgctgccggtataatgaagaatccgacagtggatggaataatgactattgatctggacccagttatatatgattcaaagttcgaaaaacagcttggccaagtaatgttattggtattatgtgctgtacaattgcttctcatgcgaacgtcatgggcattgtgtgaggccttgacattagcaactggacccataactacgctttgggaaggtagcccgggcaaattctggaatacaacaatcgcggtgtcaatggccaatatattcagaggatcatacctcgccggagcaggtcttgcctttagcattatgaaaagtgtgggcactggaaaacgcgggactggaagtcaaggtgaaacattaggggaaaagtggaagaagaaactgaatcaacttagtagaaaagatttcgatttatataagaaatcaggcataactgaagttgatagaaccgaagcaaaagagggtcttaaacgaggagaaatcacccatcacgctgtttccagaggatccgcgaaattacagtggtttgtggaacggaacatggttatcccagagggacgtgtgattgatcttggatgtggccgtggaggatggtcctattactgcgctggactcaagaaagtaacagaagtccgtggttacacgaaaggaggaccaggacatgaagaacctgttccaatgagcacttacggttggaacattgtaaaattgatgtcaggtaaggatgtcttttatttaccccctgagaagtgcgacaccttactttgcgacatcggagagagcagcccatctcccacggtggaagaatcaagaacaatacgagttcttaaaatggtagaaccatggcttaaaaacaaccagttctgcataaaagtcctaaacccatatatgccaacagttatagagcacctagagagactacaaaggaagcatggtggtatgctagttaggaacccgctgagccgaaacagtacacatgagatgtattggatatcgaatggaacgggtaatatagtagcctcagtaaatatggtctcacgattgctgttgaacagatttactatgacccacaggcggccaaccatagaaaaagatgtagatctaggagcgggaacaagacatgttaacgcagaaccagaaacaccaaacatggacgtcataggtgaaagaataaaaagaatcaaagaagaacacaattctacctggcactacgacgatgaaaatccctataagacgtgggcttatcacgggtcatacgaagttaaagcaacaggatcggcttcgtcgatgattaacggggtagtcaaactactaaccaaaccctgggatgtcgtaccaatggtaactcaaatggcaatgacagatacgactccgttcggacaacaaagagtattcaaagagaaggttgataccagaacccctagaagtatgcccggaacacgaagagtaatgggaattactgccgaatggttatggagaaccttagggcgcaacaagaaaccaagattatgcaccagggaagagttcactaagaaagtaagaacgaacgccgcaatgggcgctgtgtttactgaagagaaccaatgggacagtgcaaaagctgcagtggaagatgaggacttttggaagttggttgacagggagagagaactccataaattgggcaaatgtgggtcttgcgtatataacatgatgggaaaacgagagaagaaactcggagaatttggtaaagccaaaggcagccgtgcgatatggtatatgtggctcggtgcacgatatctggaatttgaagcattaggatttttaaatgaggatcattggttttcacgtgaaaactcatatagtggtgtagaaggtgagggcctacataaacttggttatatcctcagagacataagtaagatccctggtggcgcaatgtatgctgacgacaccgcgggatgggacacgagaataacggaggatgatttacataatgaagagaaaattacacagcaaatggatcctgaacatcgccaactagcaaacgctattttcaaactaacgtaccaaaacaaagtagtaaaagtgcagcgaccaaccccaacaggaacggtaatggatatcatctccagaaaagaccaacgtggatcaggccaggttgggacatatggactaaatacattcacgaatatggaagcccaattaatccggcaaatggagggtgagggtgtcttgagcaaagcggatttagaaaacccccatcttccagagaagaaaataacgcaatggctcgagaccaaaggagtcgagaggttaaagagaatggctatatctggagatgattgtgtagttaaacctatagacgatagatttgcaaacgcactactggctctcaatgacatgggaaaagtaagaaaggatataccgcagtggcaaccttcaaagggatggcatgattggcaacaagtaccattttgttcccatcattttcatgaactcataatgaaagacggacgaaaattggtagtcccctgtaggccccaggacgaactaattggacgggctagaatcagtcaaggagcaggctggtccctaaaagagactgcatgtttgggaaaggcttacgcgcaaatgtggtcactaatgtattttcataggagagatctacgactggcatcaaacgctatatgtagcgccgtaccagtacattgggtaccaactagcaggacgacgtggtccatacatgctcaccaccaatggatgaccactgaagatatgttgaccgtttggaacagggtatggatcgaagataatccatggatggaagataaaactcccgtaaccacgtgggaaaatgtaccctatttaggaaaaagagaagatcaatggtgcggttcattaattggattgacatcacgtgcaacgtgggctcaaaatataccaactgcgatacaacaagtacgctcattaataggtaatgaggaatttcttgattacatgccctcgatgaaaaggtttcgaaaagaagaagaaagcgagggagcgatctggtga

SEQ ID NO: 23240 - RNA, 9873 nt, synthetic construct
  misc_feature 1..9873: note = derived and/or modified CDS sequence (opt6) from DENV-3__KF973480__SS-prME
  source 1..9873: mol_type = other RNA
actagcttatgcctaatgatgatattacctgcagcacttgcttttcatctgacgtcacgtgatggcgaaccccgaatgatcgttggcaaaaatgaacggggtaaatcattgcttttcaaaacagcaagtggcatcaatatgtgtacgctgatagctatggacttaggggaaatgtgtgatgacacagtcacttacaaatgtccccatattacagaagtagaaccagaagacatcgattgttggtgcaacctcacaagcacttgggtgacctatgggacttgtaatcaagctggcgaacatcggagagataaaagaagtgtcgcgcttgcgccccatgttggcatgggccttgacactagaacacaaacttggatgtctgcagaaggagcatggaggcaagtcgaaaaagttgaaacttgggcacttagacacccaggtttcacaatattagctttattcctagcacattatataggtacgagtctaacgcaaaaagtagtgatatttacattactgatgttggtgaccccaagtatgacgatgaggtgcgtgggagttggaaacagagattttgttgaaggactaagcggcgcaacctgggtagacgtcgtcttagaacatggaggttgtgtaactactatggccaaaaataaaccaacactagatattgagttacagaaaacggaggcaacccaacttgctaccttaagaaaactatgtatagagggaaaaataactaacattacgaccgatagccggtgtccaacacaaggcgaagcaacattaccggaggaacaagaccaaaactacgtgtgcaaacacacttatgtggacagaggatggggtaacggatgtgggctattcggaaaaggtagtctggtaacgtgtgcaaaattccaatgcttagaacctatagaagggaaagtagttcaatacgaaaatctgaaatatacggttattattacggtgcatacaggtgaccaacaccaagtcggaaacgaaacacaaggagtaacggccgaaattacaccccaagcatccaccacagaagctatcctaccagagtacggtactctagggcttgaatgttctccaaggacaggattagacttcaacgaaatgatacttttaaccatgaaaaacaaagcatggatggtccaccggcaatggttcttcgaccttccactaccgtggacaagcggtgctactaccgaaacacctacctggaatcgaaaagaattattagttacattcaaaaatgcccatgccaagaaacaagaggttgtggttttaggatctcaagaaggcgcaatgcacacggcattaacaggggcaactgagatacaaaactcaggcgggacatcaattttcgcagggcacttaaaatgtaggctaaaaatggataaacttgaattgaaaggcatgagttatgcaatgtgcactaatacattcgtcctcaagaaagaagtcagcgaaacacaacatggtactattttaataaaagtagaatataaaggtgaggacgtcccgtgtaaaattccatttagcactgaagacggccaaggaaaagcgcacaatggacgattaataacagctaacccagtagttaccaagaaagaagaaccagttaatatagaggcggagccaccttttggagagtccaacattgtaataggaataggagataatgcgttaaaaattaactggtataagaaaggatcatctattggaaaaatctttgaggcaacagcccgaggagcccggaggatggctatcttaggagacacggcctgggatttcggaagtgtaggaggggtactaaactcattaggcaaaatggtacaccaaatatttggaagcgcatacactgccttgttttccggagtttcgtgggtcatgaaaatagggattggagtattacttacgtggatcggcctcaattccaaaaacacaagcatgtcatttagttgcatcgcaatcggtataattacactctacttaggggctgttgttcaagctgacatgggatgtgtcataaattggaaaggcaaagaattaaaatgcgggtcgggtattttcgtgacaaacgaagtgcatacatggacagaacagtacaaatttcaagcagatagtccaaaaagattagcaacggctatagcgggggcatgggaaaacggagtatgtggcatacgttcaacaacccgaatggaaaatttattatggaagcagatagccaatgagttaaattatatattatgggaaaacaacataaaactaaccgttgtcgtcggagacattatcggagtccttgaacaaggtaaaagaacactaactccgcaaccaatggaattaaagtattcctggaaaacatggggcaaggctaaaattgtcactgccgaaactcaaaattcaagtttcataatagatggcccaaatacgcctgagtgtccaagcgttagcagggcgtggaatgtatgggaggtcgaggactatggcttcggtgtatttacaacaaacatatggctaaaattgagagaagtctatacccaactatgtgaccacagattaatgtcagcagcagtcaaagacgaaagggcagttcacgcagatatgggctactggatagaatcacagaaaaatggaagttggaaattagaaaaagcgtctcttattgaagttaagacatgtacgtggccaaaatcccatacgttatggtctaatggcgtccttgaatcagatatgatcataccaaagtctttagcaggtcccatcagccaacacaatcatcggcctggttaccatacccaaactgctggtccttggcatctcggtaaactagaattggacttcaattattgtgagggaactacggttgtaataacagagaattgtggcacacgtggccccagtcttaggactacgaccgtatccgggaaattaatacatgagtggtgttgccgatcatgtactctccctccattgagatacatgggcgaagacggatgttggtacggcatggaaatacgtccgatatcagagaaagaggaaaatatggtcaaaagcctagtaagtgcaggctcgggtaaagtagacaactttaccatgggtgtgttatgccttgccatcctcttcgaagaggtaatgagaggaaaatttgggaaaaagcacatgatagcaggggtgtttttcacatttgccctactcttaagcggtcagattacatggcgcgatatggcacatactttaattatgataggatcaaatgcatcggaccgaatgggtatgggggttacataccttgcactaatcgcaacatttaaaatacagccatttttagccttaggattctttttaagaaaactaacatcaagagaaaatttattattaggagtgggattagccatggcaacaaccttacagctaccagaagatatagaacagatggcaaacggaatagcactgggcctgatggcccttaaacttattactcaatttgagacatatcaactctggacggcattaatctcactcacgtgtagtaacactatttttacattaacagttgcctggagaaccgcaacattaatactagccggtgtatccttattacccgtctgccaatcgtcaagtatgaggaaaactgattggttaccaatggcagtcgctgcaatgggagttcctccactaccactgtttatattcgggttaaaagatacactaaagaggcgatcatggcctttaaatgaaggggtaatggcggtaggattagtaagtatattagcctctagtttacttagaaacgatgtaccaatggcaggacccctagttgcgggtggattactcatagcatgttatgtgatcacaggaacgagcgcagatctcactgtagaaaaagcggcggacattacttgggaagaggaagccgaacaaaccggtgtgagccataatcttatgatcactgtagatgacgacggtacaatgcgaattaaggatgatgaaacagaaaacatattaaccgttctattaaagactgcattacttattgtatccgggatattcccctacagcataccagcaactcttttagtatggcatacctggcaaaaacaaactcaaaggagcggtgttctatgggacgtcccgagtccaccagaaactcaaaaagccgagttagaagaaggagtctacaggataaaacaacaaggaatatttgggaagacgcaagtcggagttggtgtacaaaaagaaggggttttccacacaatgtggcatgtgacgaggggagcggtgttgacatataatggtaagagactagaaccgaattgggcaagcgtcaagaaagacctcatttcatacggaggaggatggaggctgagcgcccaatggcagaaaggtgaggaggttcaggtaatagcagtcgaacctggaaagaatccaaagaactttcagactatgcctggcacattccagacaacaacaggggagattggtgcaatcgcactcgactttaaacctggtacgtcaggttccccgattataaatagagagggtaaagtggtaggtttatacggtaacggcgtagtaactaaaaacggaggttatgtgagcggtatagctcaaaccaacgctgaaccagacggaccaacacccgaactagaagaagagatgttcaagaaaaggaatttaaccataatggatcttcatcccgggtccggaaaaacaagaaagtacctcccggcaatagtgagagaagctatcaaaagacgtttaagaacgctcatcctggcccctacacgtgttgtggccgcagaaatggaagaagcgttaaagggtttacctatccgataccaaacaactgcaacaaagtccgagcacacgggtcgtgaaatagttgacttaatgtgtcacgcaacattcacaatgagattactctcaccggttagggtaccgaattacaacttaataataatggacgaagcccattttacggaccctgcgagcatagccgctcgcggatatatttcaacacgggtcggcatgggggaagctgcagctatatttatgaccgcgacaccaccaggaacagcggacgctttcccacaaagcaatgccccaatccaggacgaggagcgagatattccagaacgttcttggaactcgggtaatgaatggataacagactttgccggaaaaacggtgtggttcgtaccaagtataaaggctggcaacgacatagccaattgtctaaggaaaaatggtaagaaagttattcagttgtccagaaaaaccttcgatactgagtatcagaaaactaaactaaatgactgggattttgtagtaaccacagatattagcgaaatgggtgccaattttaaggccgatagagttatagatccgcgtcggtgtcttaagccggttatattaacagatggaccggagagagtcatcttagcaggaccaatgcccgtaacagcagcaagcgcggcacaacgtagaggtcgtgtaggcagaaaccctcaaaaagaaaatgatcaatacatcttcacaggccaacctctaaacaacgatgaagaccacgcgcattggacagaggccaaaatgcttctagacaatataaacacaccagaaggcatcattccagcacttttcgagccggaaagagaaaagtcagcagctatagacggagagtatagattaaagggagagtctagaaaaaccttcgtggaactcatgcggaggggagatctaccagtatggctagcacacaaagtggcttcagaaggtataaaatatacagaccgtaaatggtgttttgatggtcaaagaaataatcaaatcttagaagagaatatggacgtggaaatatggacaaaggaaggagagaaaaagaaattacgacctagatggttggatgcccgaacctacagtgatccattggcgctaaaagagttcaaagaatttgccgccggtagaaaaagtatagcactagacctcgtaacagaaataggccgagtaccttcacatctagcccaccggacacgtaacgctctcgataatttagttatgctacacacctcagaacatggtggtagggcttaccgacatgccgttgaagaactgcccgaaacaatggagacactcttacttcttggactcatgattctattaactggaggggctatgctattcctaatatccggtaaaggtattggaaaaacctcaattggactaatatgtgttatagcgtccagtggtatgttatggatggcggagatccctcttcaatggattgcaagtgccatagttctcgagttctttatgatggttttgttaattcctgaaccggagaaacaacgtactcctcaagataaccaacttgcctatgtagtaattggaattttaacactagcagccattatcgcagctaatgaaatgggtcttttagaaacgacgaaacgtgatcttggcatgtcaaaagaaccaggagtagtaagtcctacaagttaccttgatgtagatctccacccagccagtgcctggacactctatgccgtcgcaacaacagtaattactcctatgctaagacacacaatcgaaaattccactgccaatgttagtttagcagccatagcaaaccaagcagttgtactaatggggttagataagggttggccgatttctaaaatggaccttggtgtaccattattggcattgggatgttattcccaggttaatccgctcacacttactgcagcagtcctactactaataactcactatgctatcattggaccggggctccaagcaaaggctacacgtgaagcacaaaagagaacagctgctggaataatgaagaatccgacggtagacggtatcatgacaatagacttagatcccgtgatctacgatagcaagtttgagaaacagttagggcaagtgatgctactcgtgctttgtgcggtgcagttattacttatgcggacaagttgggcgctctgtgaggctttaacattggcaacgggaccaattacaaccctatgggaaggaagccctggaaaattctggaatacgacaatagcagtgagcatggcaaacatcttcagaggctcatatcttgctggggcaggtctcgcatttagtattatgaaatctgtcggtacaggaaaacgcggtacaggcagtcaaggagaaacattgggtgaaaaatggaagaagaaattaaatcaattaagtcgtaaggattttgacttatataagaaatccggaataacggaagttgatcgaacggaagccaaagaaggcctgaaacgaggagaaatcactcatcacgcagtatcacgtggatctgccaaattgcaatggtttgtagaacgaaatatggtaatacctgagggacgagtaatagatctgggatgtggcagagggggttggtcatattattgtgcagggctaaagaaagtcacggaagtcagaggatacactaaagggggtcctgggcacgaagaaccagtaccaatgtcaacctatggttggaatatagttaaattaatgtcgggaaaagacgtcttctatttgccgccagaaaaatgcgatacactcctttgtgacatcggggaaagcagcccaagcccaaccgtcgaagaatcccggacaatacgtgtattaaaaatggttgagccctggctcaaaaataaccagttctgcataaaggtgctgaatccttacatgcctaccgtaatcgagcatcttgagagattacaaagaaaacatggaggaatgctagtcagaaaccccttaagcagaaattcaacacacgaaatgtactggatctctaacggaacgggcaacatagtagcaagcgtcaatatggtctcaagactgttactaaacagattcaccatgacgcaccggagacctactatagaaaaggatgtagatttaggggccggtacgaggcacgtaaacgcagaacctgaaacacctaacatggatgttatcggagagcgtataaaaagaataaaggaagaacataacagtacgtggcattatgatgacgaaaacccgtacaaaacgtgggcataccatggttcctatgaggttaaggccacaggatcagcctcaagtatgattaacggggtagtgaagctattaacaaaaccttgggacgtggtaccaatggtcacgcagatggcgatgactgatacaacccctttcgggcaacaaagggttttcaaagaaaaggtagacacacgaacgccaagatctatgccaggaaccagaagagtaatgggtataaccgcggaatggttatggcgcacattagggagaaacaagaaaccccgattgtgtactagagaagagtttaccaagaaagtccggacaaatgctgccatgggtgcagtctttactgaagagaatcagtgggactccgcaaaggcagccgtagaagacgaagacttctggaaattagtagatagagagagggaactccacaaacttggaaaatgcggtagctgcgtatataacatgatgggcaaacgcgagaaaaagttaggagaatttgggaaagcaaaaggaagtcgggcaatttggtacatgtggctaggcgctcgttacctagaatttgaagccctaggtttcctcaatgaagatcattggttcagtcgggaaaactcgtattcgggtgtagagggagaaggcctacacaaacttggctacatattacgtgatatctcaaaaattccgggaggtgcaatgtatgctgatgatacagccggctgggacacgcgaatcacagaagatgatctccataatgaagagaagataactcaacagatggatccagagcaccgacaattagcaaatgctatttttaagctaacgtaccagaacaaagtcgtaaaggtacagagaccaacaccaacaggtacagtcatggatatcatttcacgaaaagaccagcgagggtcgggacaagtaggaacctatggtttaaacacatttaccaacatggaagcacagttgattaggcaaatggaaggagagggtgtactatcaaaggctgatttagaaaatcctcacctcccagagaagaaaataacacaatggctagaaacaaaaggagtggagcgattgaagaggatggcaatatcaggagatgactgcgtcgttaaaccaattgacgacagatttgcgaatgcgttattggcactaaatgatatgggtaaagtacgtaaagacataccacagtggcaaccaagcaaaggatggcacgactggcaacaggttccattttgtagtcatcatttccatgaactaattatgaaggatggtcggaagctggtagtaccgtgtagacctcaagatgagctaataggacgcgcgaggatatcacaaggtgcaggttggtcgttaaaagaaacagcttgcctggggaaagcatatgcacaaatgtggtctcttatgtactttcacagaagggacctacgtttagcgtcaaatgcgatttgctccgcagtgccggtacactgggtaccaacaagtaggacaacctggagcatccacgcacaccatcaatggatgacaacagaggacatgcttacggtgtggaatagggtatggatcgaggataacccatggatggaggataagacaccagtgaccacatgggaaaatgttccttatttaggcaaacgagaagaccagtggtgtggaagtttaataggcctgacttcaagagccacttgggcccagaatataccaacagccatacaacaagttcggtctctaatcggcaacgaggagttcttggattacatgccgtctatgaaaagatttagaaaagaagaagagtctgagggggctatatggtaa

SEQ ID NO: 23241 - RNA, 9873 nt, synthetic construct
  misc_feature 1..9873: note = derived and/or modified CDS sequence (opt6) from DENV-3__KF973481__SS-prME
  source 1..9873: mol_type = other RNA
accagcttatgcttaatgatgatattacctgcagctctagcattccatctaacttctagagacggagaacctcgcatgatagtagggaaaaatgaacgtggaaaatctctactttttaaaacagcaagcggaataaacatgtgtacattaattgcaatggatttaggagaaatgtgtgatgatacagtaacgtacaaatgccctcacatcactgaagtcgaacctgaagacatcgattgttggtgtaatttgacgagtacgtgggtcacttacggaacttgcaatcaagcgggcgaacaccgtcgcgacaaacgaagcgtagcactagcaccacatgtgggaatgggcttagacactagaacacaaacctggatgtccgcggaaggggcatggaggcaggtcgaaaaagtagaaacatgggcattacgtcatcctggatttactatcctagctctgtttctagcacattatataggaactagcttaacacaaaaagttgtaatttttatcctacttatgttagttacacccagtatgactatgaggtgtgtaggagtcggtaacagagattttgtggaaggattaagcggggcaacttgggttgatgtggtactagaacacggtggatgtgtaacaacaatggccaaaaataaaccaaccttagacatcgaacttcagaaaacggaagctactcaacttgcaacattacgaaaactgtgcatagagggcaaaatcacaaatatcacaaccgacagcagatgtccaactcagggagaagccactttgccggaagaacaggatcaaaattacgtctgcaaacacacctacgttgacagagggtggggtaatgggtgtggcctctttggaaaaggatcactggtaacatgtgcaaaatttcagtgcctagaacctatagaaggaaaagttgttcaatacgaaaatctaaaatatactataataatcacagtccacacaggtgaccaacatcaagttgggaatgaaacacaaggagtaacagcagagataactccccaagcgagtacaactgaagccatcctgcctgaatatggaacgcttggtctcgaatgtagtccacgaacgggactcgacttcaacgaaatgatcctattaacgatgaaaaataaggcttggatggtacatcggcaatggttcttcgacttaccacttccatggacgagcggtgcaaccactgaaacaccaacttggaatcgaaaagaactattagtaacttttaaaaacgcgcatgctaagaaacaagaagtcgtcgtcttaggaagccaagaaggtgcaatgcacacggctctgactggtgcaacagaaatacaaaactcaggcggcacaagcatcttcgccggacacctaaaatgtcgtctaaaaatggacaaactcgaattaaaaggaatgtcttacgctatgtgtacaaacacatttgtcctaaagaaagaagttagcgagacccaacatggaacaatactaataaaagtagaatataaaggggaggatgtcccttgcaaaatccctttcagtacggaagatggtcaaggtaaagcgcataacggtaggcttataactgcaaatcctgtagtaacgaagaaagaagaaccagtaaatatcgaggcggaaccaccgttcggcgaatcgaatatagtaattgggataggagacaacgctcttaaaattaactggtataagaaaggttctagcataggaaaaatgtttgaagcgactgctagaggagcgagacgaatggcaatcctgggcgataccgcctgggattttggttcagttgggggagtgctgaatagtttagggaaaatggtacaccaaatctttggtagcgcttataccgctctattttcgggagtctcatgggttatgaagataggtataggggtactgttgacttggataggactaaatagcaaaaatacttcaatgtccttctcctgcatagcaattgggataatcactttataccttggggccgtcgtacaggcagatatgggatgcgtgataaattggaagggcaaagagttaaagtgtggctcgggcatatttgtcacaaatgaagtgcacacttggacagaacaatataagtttcaagcagatagcccaaaaaggcttgcgacagcaatagcaggggcgtgggagaatggcgtttgtggtattcggagcacaactcgcatggaaaatctattatggaagcaaattgcaaatgaattaaactacatattgtgggagaataatatcaaacttacagtggttgtaggagacatcattggagtcttagaacaaggaaaaagaactttaacaccgcaaccgatggagctgaaatattcatggaaaacatggggtaaagcaaaaattgttacagctgagacacaaaattccagttttataattgatggcccaaacactccggaatgtccgagtgtaagtagggcgtggaacgtgtgggaagtagaagattatggtttcggagtcttcactacaaatatctggttaaaacttcgagaagtatacacacagctatgtgaccacaggttaatgtcagccgccgtaaaagacgaaagagccgtacacgcggatatgggatattggatagaaagtcaaaagaatggtagttggaaattggaaaaagcaagtttaattgaagtgaaaacatgtacatggccaaagagtcataccttatggtcaaatggagtattagagtcagacatgattattccaaaatctctagcaggtcccataagccaacacaatcatagaccaggatatcatactcagactgcaggtccgtggcatttaggaaaactagagctagattttaactattgtgaaggcaccacagtagtcattaccgaaaactgtggaacgagagggccatcacttagaacaacgactgtgtctgggaaactcatacatgagtggtgttgtaggtcctgtactcttccacccctaagatacatgggtgaagacggatgttggtacggaatggaaatcaggccaataagtgaaaaagaggagaatatggtgaaaagtttagtaagtgcgggtagcggcaaagtcgataacttcacagtaggcgtactgtgcctagcaatattattcgaagaagtcatgagaggaaaattcggcaagaaacacatgatagcaggggtcttctttacattcgtattattattatctggacagataacatggcgagacatggcccatacccttattatgataggatcaaatgctagtgatcgaatgggaatgggggtaacatatcttgcactcatcgcaaccttcaaaatacagccttttctagctttaggattcttcctaagaaaactcacaagtcgagaaaatcttttattgggagtcggattagcgatggcaacgacattacagttacccgaagatatagaacaaatggctaatggaatagcgttaggactgatggcattaaaactaataactcaattcgaaacctaccaactctggacggcattaatatcactaacatgttcaaatacaattttcacattgacggttgcatggcgaacagcaacccttattctcgcaggagtcagtcttttaccagtttgccaatcatcctcaatgagaaaaaccgactggttacctatggcagttgctgcaatgggcgtgcctcccctgcctctatttatctttggattaaaagacacactcaaacgcagatcttggcccttaaacgaaggagtaatggcagttggattagttagtatacttgctagctccttattacgaaatgatgtacccatggccggcccattagtagccggtggtctattaatagcatgttacgtaataacagggacaagtgcggacctcactgtagaaaaagccgcggatatcacctgggaagaagaagcggaacagacaggtgtaagtcataacttaatgataacagtggacgatgacgggacaatgcgaattaaagatgatgagaccgagaatatactaacagtgctacttaaaactgccttactgatcgtttcaggaattttcccttattcaatacccgctacacttctagtgtggcacacatggcagaaacaaacacaaagatcaggtgttctttgggatgtcccttctccacccgaaacccagaaagcagagctagaggaaggcgtctacagaatcaaacaacaaggtatatttggaaaaactcaagtcggcgttggcgtgcaaaaagaaggagtgttccatactatgtggcatgtcaccagaggagcagtgcttacatacaacggcaagagactcgaacctaattgggcatcagtcaagaaagacttaatctcttacggcggtggttggcgactaagtgcacaatggcaaaaaggtgaagaagttcaagtgatagccgtggaacctggtaaaaatcctaaaaatttccaaactatgcccggcactttccaaacgacgactggggagatcggggcaatagcgttggatttcaagcccggcacatctggaagtccgataatcaaccgtgagggcaaagttgttggactttacgggaatggagttgtaactaaaaacgggggatatgtcagcggtattgcacaaactaacgcagaaccagatggacccactccggaattagaagaggaaatgttcaaaaagcgaaatctaacaattatggatttgcatccaggaagtggcaaaacaagaaaatacttgcccgcaattgtgagggaagcaataaaaagacgacttcgaacgttgatcctcgctccaacaagagtggtagctgctgaaatggaagaggctttaaaaggccttccgattcgataccaaacaaccgcgacaaaaagtgaacataccggaagagaaattgttgacctcatgtgtcatgccacatttactatgcgactgttatcccctgtgcgagtacccaattacaatctcattataatggatgaagcgcatttcacagacccagcaagtattgcagctcgcggctatatcagtacaagagtcggaatgggtgaggcggcagctatatttatgaccgcaacacctcctggaactgccgatgcattcccccaaagtaacgcaccaatacaggatgaagaaagggacatcccagagcggagttggaatagtggaaacgagtggataactgacttcgcaggtaaaaccgtatggtttgtgccgtctataaaggctggaaatgacattgctaattgccttcgtaaaaatggtaagaaagtaatacaattgtccagaaaaacattcgataccgagtatcagaaaacaaagttaaacgattgggatttcgtagtaacaacagacataagcgaaatgggtgcaaactttaaggcagatagagtaatagaccccagaagatgcctcaaaccagtaatattaacagacgggccagaaagagttatactcgcaggtccgatgcctgtaactgcggcatcagcggcacaacgcagagggagagtcggaagaaatccacagaaagaaaatgatcaatacatctttacaggtcaacctttaaataacgacgaggatcacgcgcactggactgaggcaaaaatgttattagataatatcaacactcccgaaggaataataccagccctattcgaaccagagagggagaagagtgccgccattgatggggaatatagattaaaaggagaaagtagaaaaacttttgttgaattaatgcgcaggggagatttaccagtctggttagcacacaaagttgcaagtgaaggcattaagtacaccgatcgtaagtggtgtttcgacggacagagaaacaatcaaatattagaagaaaacatggacgttgagatatggaccaaagaaggggagaagaagaaactgcgcccccgatggctcgacgccaggacgtacagtgatccattggctcttaaagaatttaaagagttcgcagcaggaagaaaaagtatcgcacttgatctagtaacagaaatcgggagagtcccgtcacatttagcacatcgaaccagaaatgcacttgataatttagttatgctacacacttcggaacatggaggtagggcatatagacatgcggttgaagagttgccagaaacaatggagacattacttcttcttggattgatgatcctactaacgggcggcgcaatgctgtttttaatcagtggtaaaggaatcggtaaaaccagcattggcttgatatgtgttattgcctcatccggtatgttatggatggcagagattcctttgcaatggatagcatccgccattgttttggagttcttcatgatggttctgttgattccagaaccagaaaaacaaagaacacctcaggataatcaattagcatatgtcgtaataggaatcctaacactagcggcgataattgcagccaatgagatgggactactcgaaaccacgaaacgagatttgggtatgagtaaggagcccggtgtcgtatcgcctacaagttacctagacgtagatctacatcccgcaagcgcgtggaccttatacgcagtggccaccacagtaataacacccatgcttcgccatacgatagaaaacagtactgcaaatgtatctctagccgcgattgcaaaccaagcagttgtgctcatgggattggataaaggctggcctataagtaaaatggatctaggagtgcctttattggcacttggatgctacagccaagttaatcctttaacattaaccgcggctgtgcttctcctaatcacccactatgctattatagggcctggactccaagccaaagccactagagaagcccaaaaacgaacagctgcgggtataatgaagaatcctactgtagatggcataatgactattgatcttgacccggtaatatacgatagcaaatttgagaaacagttggggcaagtaatgctattagtattgtgtgcagtacaactcttattaatgcgaacaagttgggcactgtgtgaagcgttaacgcttgcaactggacccataactacattatgggagggctccccgggtaaattttggaatacgaccatagctgtaagtatggcaaatatctttagaggaagttatttggccggtgctgggcttgccttctcaattatgaaaagcgtgggtacaggcaaacggggaactggttcccaaggcgaaacgctaggagaaaaatggaaaaagaaacttaaccagctttcaagaaaggatttcgatttatataagaaatcaggcatcacagaagttgatagaactgaagcaaaggaaggactaaaaagaggggaaataacacatcatgctgtctcaaggggttcagcgaaacttcagtggttcgtggaaaggaacatggtaataccagaaggaagagtgattgatcttggatgcggtagaggaggttggtcctactattgtgcaggcttaaagaaagtgaccgaagtaaggggatatacaaagggtggaccaggacacgaggaaccagtccctatgagtacctatggatggaacatagtcaaacttatgagtggcaaagatgtattctatctaccgcccgaaaaatgcgacacattgctatgtgacataggtgagagttcgcctagccctactgtcgaagaatcgcgaaccataagagttttgaaaatggtggaaccttggctcaaaaacaaccaattttgtattaaagtacttaatccttatatgccgacggtcatagaacacctagagaggcttcaacgaaagcatgggggtatgttagttagaaatccattaagcaggaactcgactcatgaaatgtattggatatctaatggaacgggtaatatcgttgcttcggtaaatatggtctcaaggttacttttaaatcgcttcacgatgacacacagaaggccaaccattgaaaaagacgttgatttgggtgcaggtacgagacatgtcaacgcagagccagagactccgaatatggatgtaatcggagaaaggatcaagcggatcaaagaggagcacaactccacttggcattacgacgatgaaaatccatataaaacatgggcctaccacgggagttatgaagtaaaagctacaggatcagcctcctcgatgataaatggtgttgtgaagctcttaacaaaaccatgggatgtagtccccatggtaacacagatggctatgactgatacaactccgttcggacaacagcgcgtatttaaggagaaagtagacactcgtacccctcgaagtatgcctggcaccagacgagttatgggaatcacagcagaatggttatggaggacacttggccgcaataagaaaccacgattgtgcacacgtgaagagttcactaagaaagttagaacaaatgccgctatgggcgcggtattcacagaagagaatcagtgggattcagccaaggcggctgttgaagatgaggatttctggaaattagtggatagagaaagagaactacataaattaggtaaatgcggaagttgtgtttacaacatgatgggtaagagggagaagaaattaggtgagtttggcaaagcaaagggaagcagagccatctggtatatgtggttgggggctcgatatctggagttcgaagccctaggtttcctaaatgaggatcattggttcagtagagagaactcgtatagtggcgtagagggagaaggcttacataaactaggctacatacttcgtgatatatctaaaataccgggaggggctatgtacgcagatgatacagctggctgggatactagaataaccgaagatgacctccataatgaagaaaagatcacgcaacaaatggatccagaacatcgacaattagccaatgcgatatttaaattaacatatcaaaacaaagtcgtaaaggtgcaaaggcctactccgacaggtacagttatggacataataagtaggaaagaccagagaggctccgggcaagttgggacctacggactcaacacgtttactaacatggaagcacaattaattagacaaatggaaggagaaggggttttatcgaaggcggacttagagaacccgcatttaccagagaagaaaatcactcaatggctggagacaaaaggagtggaacggcttaaacgtatggcaatttcaggggacgattgcgtggtcaaacctatagatgataggttcgcaaatgccttattagctctaaacgatatgggaaaagttcgaaaggatattccacaatggcaaccttcaaaaggatggcacgactggcaacaagtacctttctgctcccaccactttcatgagctcataatgaaggatgggcgaaaattagtcgtaccttgcagaccacaagacgaattaattggacgagccagaatatcgcaaggggccggctggtcgcttaaagaaacggcttgtctagggaaggcttacgcgcaaatgtggagcttaatgtattttcatcgtcgggatttgcgattagcaagcaacgctatttgctcggccgtcccagtgcattgggtacctacatcgagaacaacttggtccatacatgctcaccatcaatggatgacaacagaggatatgctgaccgtctggaatagagtttggattgaagataatccttggatggaggacaaaacgcccgtaacgacgtgggaaaacgttccttatcttggaaagagagaagaccaatggtgtggcagcttaataggcttaacttccagggcaacctgggcacaaaacattcctacagctattcaacaggtcagaagtctaattggaaatgaggaatttttagattatatgcctagtatgaaaagattcagaaaggaggaagaaagcgaaggggcaatctggtga

SEQ ID NO: 23242 - RNA, 9873 nt, synthetic construct
  misc_feature 1..9873: note = derived and/or modified CDS sequence (opt6) from DENV-3__KF973482__SS-prME
  source 1..9873: mol_type = other RNA
accagtttgtgcttaatgatgatcttaccagcggccctcgcatttcatttaacttcgagagatggagaacctcgtatgatagtaggcaaaaatgaaagagggaaatctctcttattcaaaacggcttcgggaattaatatgtgtacactaatagcaatggaccttggagaaatgtgcgacgacactgtcacatataaatgtccgcacatcactgaagttgaacctgaagatatagattgctggtgcaacctaacgagtacgtgggttacatatggaacatgcaaccaagcaggagaacaccgtcgagataaacgtagcgttgcactggcaccccacgttggtatgggcctcgacacgcgtactcaaacatggatgtcggcggaaggagcttggcgtcaagtagaaaaagtcgaaacttgggcactaagacacccaggtttcaccattttagcattgtttctagcacactacattggaaccagcctaacacaaaaagtagtcatatttatattgctaatgttagtaacgccatcgatgacgatgagatgcgtgggagtcggcaacagagactttgtagaagggttaagcggggcaacatgggttgatgtagttctcgaacatgggggatgtgtgactaccatggccaaaaacaaaccgaccctcgacattgaactacagaaaacggaagctacacaactggccaccctaaggaaactttgtattgaaggcaaaattacaaacattacaactgatagtcgctgccctacccaaggagaagccacattacccgaagaacaagatcaaaactatgtttgtaaacatacctacgttgatcggggatggggcaacggttgtggattgtttggaaaaggatcgctggtgacgtgcgcaaaatttcaatgtttggaaccaatcgaaggaaaagtagtgcaatatgaaaacctaaaatacacaattataatcactgttcatacaggtgaccagcaccaagtcggcaatgaaactcaaggtgttacggcagaaataacaccccaggcttctacaacagaggcaattctaccggaatatggcactctaggtttggaatgttcaccccgtacaggcttagactttaatgagatgattttattgacgatgaagaataaagcatggatggttcaccgacaatggttctttgacttaccactaccctggacttccggagcaacaacagaaacacctacttggaatcgaaaagaactattggttacatttaaaaatgcccatgcgaagaaacaggaagtagtcgtattaggatcccaagaaggcgccatgcacaccgcccttacgggagcaacagaaattcagaatagtggcggcacaagtatattcgccgggcatttaaaatgccgattaaaaatggataaattagaattaaaaggtatgagttacgcgatgtgtacaaatacatttgtcctaaagaaagaagtgagcgaaactcagcatgggaccatattaatcaaggttgaatataaaggagaggatgtaccttgcaagatcccattcagtactgaagatgggcagggcaaggcacacaacggaagattaatcacagccaatcccgttgtcaccaaaaaggaagaaccagtgaatatcgaagcagaaccaccattcggtgaaagtaatatagtaattggcataggggataacgccttaaaaattaactggtacaagaaaggtagtagcatcggcaaaatgttcgaagcaacagctcgtggggctagacgaatggcaatactcggggatacagcatgggattttggatctgtgggaggggttcttaattcgttaggaaaaatggtacaccaaatattcgggagtgcttatacagcactattttcaggcgtatcttgggtaatgaaaattggtataggtgttttgctcacatggataggcctaaatagtaagaatacctcgatgtcattttcttgtatagcaataggaatcattaccctttatttgggcgccgttgttcaagccgacatgggatgtgtaataaactggaaaggaaaagaactgaaatgtgggtcaggtatatttgtaacaaatgaagttcacacatggactgaacaatacaaatttcaagccgatagcccaaaaaggttagccacagcaatagccggagcttgggaaaatggggtttgtggcatcaggtccacgacacgtatggaaaatttgttatggaaacagatcgcgaacgaattaaattatattttatgggaaaataacattaagctcacggtagtcgtgggagacattataggagtactagaacaaggaaagaggactttaacaccccaaccaatggaattaaagtattcgtggaaaacatggggaaaagcaaagatagtaacagcggagactcaaaactcgagtttcataatagatggtccaaacactccggaatgcccctccgttagtagagcttggaacgtatgggaagtcgaagactacggtttcggtgttttcaccactaatatatggctaaagttacgagaggtgtatacacaattatgcgatcacagactaatgagcgccgcagtaaaagatgaaagggctgtccacgccgatatgggttattggatagaatctcaaaagaatggatcatggaaactggaaaaagctagtttaattgaggtgaaaacatgcacatggcccaaatcgcatacgttatggtcgaacggtgtcttagaatcagatatgattatcccgaaatccctcgctggaccaatttctcaacacaatcaccgaccaggctatcatacacagactgcaggaccctggcatttaggtaagctagaattagatttcaactattgtgaaggaacaacagtggtaataacggagaactgtggcacgcggggtcctagcttaagaacgaccacagtgagtggaaaattgatccacgaatggtgttgccgaagttgcacgctaccaccattacgatacatgggcgaggatggatgctggtacggaatggagattcggcccatatctgaaaaagaagagaatatggtgaagtctctcgtctcggcaggttcgggtaaagtagataattttacagttggcgttctctgtttagccatactgtttgaggaagtaatgcgtggtaaattcggcaagaaacatatgatagctggcgtgttcttcacttttgtcttgttactatctggccaaataacgtggcgtgacatggcccacacattaataatgattgggagtaatgcaagcgacagaatgggcatgggcgtgacgtatctcgcactaatagcaactttcaaaattcaaccctttctagctctaggattctttctccgaaaactaacatccagagaaaacttactgctcggtgtaggtctcgccatggctacaacactacaattacccgaggacatagaacagatggctaacggaatcgcattagggctaatggcactcaaattaatcactcaatttgaaacttaccagttatggacagcacttatctccttaacatgtagcaatacaatctttacattaacagtcgcctggcgtaccgcaactcttattttggcaggagttagcttattacccgtatgccaatcctcaagtatgaggaagactgactggcttcctatggcagtggcagccatgggtgtaccacctttaccattatttatttttggactgaaagacacgttaaagagacgatcttggccattaaacgaaggtgttatggcagtaggattagtttcgattctggctagttcgttgctccgaaacgacgttccaatggcggggccactggtcgccggcggtttgttaatagcgtgttacgtaataactggcacctcagctgatcttacagtggaaaaggctgcagatattacttgggaagaagaagctgagcagacgggtgtttcacataacctaatgatcactgtagatgatgatggaacaatgcgaattaaagatgacgaaacagaaaatatattgactgttctacttaaaacagctctacttatagtatcaggcatatttccttatagtattccggctactttattagtatggcatacgtggcagaaacagacacaaaggagtggcgtgttatgggacgtaccatcaccccctgaaacacaaaaggcagagttagaagagggtgtgtatagaattaagcaacaaggtatattcgggaaaacacaggtaggagtcggggtacaaaaggagggagtgtttcatacaatgtggcacgttacgagaggagctgtcctgacctacaatgggaaacgactagaaccaaactgggcatcagttaagaaagaccttatttcctacggtggaggttggagacttagtgcacagtggcaaaagggagaagaagtacaagtcattgcggtagagcctggcaagaatcccaaaaactttcaaaccatgccgggtacattccaaactactacgggtgagataggcgcaattgccttagacttcaaacccggcacatctggctcgcctatcattaatcgggaaggtaaagttgttggcttgtatggaaacggtgttgttacaaagaatggagggtacgtcagcggaatagcgcaaacaaatgctgaacccgatggcccaactccagaactagaggaagagatgttcaaaaagaggaatctaaccataatggatttacatcccgggtccgggaaaacacgaaaatatttgcctgcaattgttagagaggcgatcaaaagacgcctacgtacattaatattagctccgacgagagtggttgccgcagaaatggaagaggctcttaaaggacttccgattaggtatcaaacaactgccaccaaatcagaacatacaggtcgagaaatagtagatttgatgtgtcatgctacgtttacaatgcgtctattatctcccgtccgtgtaccgaattataacttgattataatggacgaggcacactttaccgacccagcaagtatagctgcgagaggttatataagtacgcgtgtcggtatgggagaagcagcagctatattcatgacagccacaccacccggaacagcagatgcatttcctcaatcaaatgcgccaatccaagatgaagaacgggatatacctgaaaggagctggaactccggcaatgaatggataaccgattttgctggaaaaacggtctggttcgtgccttctataaaagccggtaacgacatagctaactgtttacgcaagaatggcaagaaagttattcaactatcaagaaaaaccttcgatacagaatatcagaaaacaaaacttaacgattgggacttcgttgttaccactgatataagtgaaatgggggccaactttaaggctgacagagtgatagatcccaggagatgtttgaaaccggttattcttacagacgggcccgagagagtaatcctcgcaggtcccatgcctgttaccgcggctagtgcagcgcaaagacgcggaagagtaggtagaaaccctcaaaaagaaaacgatcaatacatattcaccggacaacccctaaacaatgacgaagaccacgcccactggacagaagctaaaatgttactcgacaatatcaatacgccagagggtataattccagccttattcgagcctgaacgagagaaaagcgcagccattgatggagaatatcgtctgaagggagaatcacgcaaaacattcgttgaattaatgagaagaggagatttacctgtatggctagcacataaggtagcaagtgaaggaataaagtacactgatcgcaaatggtgcttcgacggtcaacggaacaatcaaatccttgaagaaaatatggacgtagaaatctggacgaaagagggtgagaagaagaaattaagaccaaggtggctagacgctagaacatattctgatcctctagccctaaaagagttcaaagagtttgctgcaggaaggaaaagcatcgcattagaccttgtcaccgaaatcggtcgcgtaccctcgcacttagcacaccgtacaaggaatgccctagataacttagtaatgttgcatacatcggaacatggcgggagggcctatcgacacgcagtggaagaactgccggaaacaatggaaactttacttttgttagggctgatgattttattaaccggaggcgctatgttattccttatctccggcaaaggaattggaaaaacatcgataggacttatatgtgtaatagcctcttccggaatgttatggatggcagaaatacccctgcaatggatcgcatcggcaattgtgttggaatttttcatgatggtattattgattcccgaaccagaaaaacagcgaactccgcaagataaccaattagcctacgtagtaatcggcatccttacattagctgcaataatagctgctaacgaaatgggactccttgaaacaaccaaacgtgacctaggtatgtccaaagagccaggtgttgtttcacctacgtcttatttagatgttgatctacatcccgcgtcagcttggacattatacgcagtcgctactacagttataacacctatgctaagacacaccatagaaaacagtactgccaacgttagtttagctgcgatcgcaaaccaggctgttgtgctaatggggctggataaaggatggccaatatctaaaatggatttaggagttccactgttagccctgggttgctacagccaagtaaaccccttaacactcactgccgccgtcttattactaataacacactatgctataattggcccggggctgcaggcaaaagctacgcgggaagcgcaaaaacgtactgcagcaggtattatgaaaaaccccacagtggatgggataatgacaattgacctagatcctgtaatatacgatagcaagttcgaaaaacaacttggacaggtaatgctcctagtactgtgtgcagtacaattacttcttatgaggacctcctgggctctttgtgaagcgctaacactggcaacgggccctataacaacactttgggaaggatcacctggaaaattctggaatactacaatagcggtgagcatggcgaacatctttcgaggatcatatctagccggagcaggtcttgcattcagtataatgaaatctgttggaacgggaaaaagaggaacgggtagtcaaggagaaacactgggtgagaagtggaagaagaaactgaatcaactatctagaaaagactttgacctatacaagaaatctggaatcacagaagtggacagaacagaagcaaaggagggcctcaaaagaggggaaatcacacatcatgctgtttcacgtggctcagccaaacttcaatggtttgtcgaacgaaatatggtaattcctgaaggccgggtcatcgatctcggttgtggacgcggaggatggtcgtactactgtgccggcctaaagaaagtaacagaggttcgtggatacacgaaaggtggaccaggacacgaagaacccgttcctatgtcaacttacggctggaatatagtaaaactaatgagtggaaaagacgtattttacctcccaccggaaaaatgtgacaccctgctatgtgatatcggcgagtcatcaccttcaccaactgttgaagagtcaagaactatcagagtcttaaaaatggtcgagccttggcttaaaaataatcagttttgtataaaagttttaaatccttacatgccaacggtaatagaacatctggaaagattgcaaagaaaacacggaggaatgctcgtacgtaacccattatcacggaatagtactcacgaaatgtactggataagtaacggtactggaaatattgtcgctagtgttaacatggtttctcgactgcttttaaatagatttacaatgactcatcgaaggcctacaattgagaaagatgtcgatttgggcgcaggaacacgacatgtaaatgcggaacccgaaactccgaatatggatgttataggtgaacgtatcaaaagaattaaagaagaacataatagcacatggcattatgatgatgagaatccatataaaacatgggcgtaccatggttcttatgaggttaaagctacaggttctgcctcttccatgacaaatggagtagttaaacttttgacaaaaccttgggatgtagtacctatggtaacgcaaatggcgatgactgatacaaccccttttggtcaacaaagagttttcaaagaaaaggtagacactcgaacccccaggagcatgcctggcacgagaagggttatgggaataactgctgaatggctctggcggactttgggacgtaacaagaaaccgagattatgcactcgggaagagttcactaagaaagttagaacgaacgcggcgatgggagcagttttcacagaagaaaaccaatgggactcagcaaaggcggctgtagaagacgaagacttttggaaattggtggatagagaaagagaattacacaaattgggaaaatgtgggtcgtgcgtatacaatatgatgggaaaacgagagaagaaacttggtgagttcggcaaagcaaaaggaagtagagctatatggtatatgtggctaggagccaggtatttagaatttgaagccctgggatttctaaacgaggatcattggttctcaagagaaaactcttatagtggggtagaaggagaagggctgcataaattgggctacatactcagggacatttcaaaaattccgggcggagcaatgtacgcagatgatacggccggatgggatacccgtattacagaagatgatctccataacgaggagaaaattactcaacaaatggacccagagcatagacagctagcgaacgcgatttttaaacttacctatcaaaacaaagtagtgaaagtccagcggccaaccccaactgggactgttatggacattatatcacgtaaagaccaacgaggatcaggccaagtaggcacatacggattaaatacgtttaccaacatggaagctcaacttattcggcaaatggaaggagagggagtcttatcaaaggccgatcttgaaaatccacacttaccagagaagaaaataacgcaatggctagagacaaaaggggtggaacgactcaaaaggatggctatatccggagatgattgtgttgttaagcccatcgatgacaggtttgctaacgccctcttagcactgaacgatatgggaaaagtaaggaaagacattccacaatggcagccgagtaagggatggcacgactggcaacaagttccattctgctcccatcattttcacgaactaatcatgaaagatggaaggaaactcgttgtcccatgcagaccgcaagatgaactaatcggtagagccaggataagtcaaggcgcaggttggagtcttaaagaaaccgcttgtctcggaaaggcatacgcccagatgtggtcattaatgtatttccatcgaagggacttaagactagcgagcaatgcaatttgcagcgcggtacctgttcattgggtccctaccagtagaacaacctggtcgattcatgcacatcaccaatggatgactactgaagacatgttaaccgtatggaatcgagtatggatagaagacaacccttggatggaagataaaacaccggtaacaacatgggaaaatgttccatatctaggtaagagagaagaccaatggtgcggttcattaataggcctaacatctagggctacatgggcccaaaatataccaacagcaatccaacaagtaagatcgcttataggcaatgaagagttccttgattatatgccaagcatgaagagatttaggaaagaagaggaatcagagggcgctatatggtag

SEQ ID NO: 23243 - RNA, 9873 nt, synthetic construct
  misc_feature 1..9873: note = derived and/or modified CDS sequence (opt6) from DENV-3__KF973483__SS-prME
  source 1..9873: mol_type = other RNA
acaagcctctgtttaatgatgatcttaccagcagcattagcatttcatttaacgagtagagatggggaaccgcgaatgatcgtaggtaaaaacgaacgaggaaaatcattgctctttaaaacagcaagcggaataaatatgtgtacactcatagcaatggatcttggggaaatgtgcgatgacacggtgacgtacaaatgtccccacataacagaagttgaacccgaagacatagactgttggtgcaatttaacatcaacctgggtcacatacggtacctgcaaccaggcgggggaacacaggagggataaaagatcagtcgcgctagcacctcatgttgggatgggacttgataccagaacacaaacgtggatgtcggcggaaggagcatggaggcaagttgaaaaagttgaaacgtgggctctacggcatcctggatttaccatattagcactgttcttagcacattatatcggaacttcattaacgcaaaaagtagtaatatttatcctattaatgttagtaactcccagtatgactatgagatgcgtaggggtaggaaatcgtgattttgtagaaggactctcaggagcaacatgggtagatgtggttctcgaacatggcgggtgcgtcacaactatggccaaaaataaacccactttggatattgaattgcagaaaaccgaggctacacaactagcaactctacggaaactatgtatagaggggaaaataactaatataacaactgacagtagatgtccaacacaaggtgaagctacactaccagaggaacaagatcaaaattacgtttgtaaacatacatatgtcgacagaggctggggaaacggttgtggacttttcggtaaaggttctctagtaacttgtgcaaaatttcagtgtttagaaccaattgaaggcaaagtggttcaatatgaaaatttgaaatacacagtaataattacagtgcacacgggtgaccagcatcaagtgggaaacgaaactcaaggggttaccgctgaaattacaccccaggcaagtaccacagaagcaattcttccagaatacggtactcttggactagaatgttcgcccagaacggggttagattttaatgaaatgatcctattaacaatgaaaaataaagcctggatggttcatagacaatggttctttgatctgccactgccttggacatcgggagcaacgacagaaacaccaacatggaatcgaaaagaactattagtcacattcaaaaacgcacacgccaagaaacaggaagtagtagtgttaggaagtcaagaaggagccatgcacacagcactaactggagcaacggagatacagaactctggcggtactagcatcttcgccggacatttaaaatgccgtcttaaaatggataaactggaattgaaaggaatgtcatatgcaatgtgcactaacaccttcgtgctaaagaaagaggtctccgaaactcaacatggtaccattctaataaaagtagaatacaaaggtgaggacgctccttgcaaaattccttttagcacggaagacggtcaggggaaagctcacaatggaagattgattacagcaaatcccgtagtcactaagaaagaagaacctgtaaatattgaagctgaaccacctttcggagaatcgaatatcgttataggtatcggcgacaacgcgctgaaaataaattggtataagaaaggttcgagtatcggaaaaatgtttgaggcaacagcacgtggagcaagacgaatggctatcctgggagatacagcatgggacttcgggtccgttggcggagtgttaaattcattaggaaagatggttcaccaaatattcgggtcagcttatacagcccttttctctggggtatcttgggtaatgaagataggaataggagtattgttaacctggataggacttaattcccgaaatacctcgatgtcatttagttgcattgcaataggaattatcactctctatttaggggcagtagttcaagccgacatgggatgtgtaatcaattggaagggaaaagaactaaaatgcgggagcgggattttcgtaactaatgaggttcacacgtggacagaacaatacaagtttcaagcagactcccccaagcgcttagctacggcgatcgttggtgcgtgggagaacggcgtttgtggcatacgatctacaacaaggatggaaaatctattatggaaacaaatagcaaatgagttaaattacatattgtgggaaaataatataaaactaacagtcgttgtgggagatataataggggtgcttgaacaaggaaagagaacgctaacccctcagcctatggagcttaagtattcatggaaaacatggggtaaagctaagatagttacagcagagacacaaaatagctcattcattattgacggtccaaataccccagagtgcccctcggtaagccgagcatggaacgtatgggaagtagaagattatggattcggggttttcacaacaaatatttggctaaaattgagagaaacgtatacacaattatgtgaccatcgtctcatgagtgcagccgtgaaagatgagagagcggttcatgctgacatgggctactggatagaaagccagaaaaatggaagttggaaattggagaaagcatccttaatagaagttaaaacttgtacatggcctaaatcacacacaatatggagcaacggagtattggaaagcgatatgataattccaaagagtctagcgggtccaatctcccaacataaccatcgaccgggatatcatactcagacagccggcccatggcatttaggaaagctagaattagacttcaactactgtgaagggactacagtcgtaattaccgaaaattgtggaacgcggggacctagcttacgaactacaacagtgagtggaaaactaattcatgaatggtgttgccgcagctgtacactgcctccactacgatatatgggggaagatggttgttggtacggtatggaaatccgtccgatttcggagaaagaggaaaatatggtaaagagcttggtcagcgcaggttcggggaaagtcgataattttaccatgggggtactatgtcttgcgatcctctttgaagaagtaatgagaggaaaattcggtaagaaacacatgattgccggagtcttcctaacgtttgttttgttgctgtcaggacaaataacatggagagatatggctcatactcttatcatgatcggaagtaacgcttctgataggatgggtatgggagttacttatctagctttaatagccacatttaaaatacaaccattccttgcgcttgggttctttctaagaaagttgacgagtagagagaacttacttttaggagtagggctagcgatggccacgacattgcagcttcctgaagatatagaacaaatggcaaatggtattgcgttaggtcttatggctctaaaattaatcactcaatttgaaacttaccaattgtggacagcattaatatcgctaacttgtagtaatacaatctttactttaacagtagcctggagaacagcgactttaatactcgcgggggtcagtttactacccgtatgtcaaagctctagcatgagaaaaactgactggttaccgatggcagttgcagctatgggcgtacctcctctgccactctttatcttcagtctaaaagacacattaaagagacggtcctggccactaaatgagggtgttatggctgtcggtttggtcagtattctggctagctcactcttaagaaatgatgtgccaatggccggccctctagtagccggtggcttgctcatagcatgctatgtaataaccggaacaagcgctgacctaaccgttgaaaaggcggcagatataacatgggaagaagaagcagaacaaactggtgtaagtcacaatctcatgataacagttgatgacgatggaacaatgagaattaaagatgatgaaacagaaaatatactcacagtcttattgaaaacagccctgttaattgtgagcggtatctttccatattctattccagctacgctgttagtgtggcacacatggcaaaagcaaacacaaagatctggagtactttgggacgttccatcccctcctgaaacccaaaaagctgaactggaagaaggagtttaccgaataaaacagcaagggatattcggaaaaacacaagtaggtgttggagtacaaaaagaaggggtgtttcatacaatgtggcacgtgacaagaggtgctgtcttgacttacaatggaaaacgattagaacctaattgggctagtgtcaagaaagacctaatcagctatggaggaggatggaggttatccgcacagtggcaaaaaggagaagaggtacaagtaatagccgtagaacccggcaaaaatcccaaaaactttcaaacgatgccaggtacgttccagacaacgacaggagaaataggggctatcgcactggactttaagcccgggacgtcaggctcccccattatcaacagagaaggaaaagttgtaggcttatatggtaatggagttgtaaccaaaaatggagggtatgtctctggaatcgctcaaacaaatgcagaaccagatgggcccacacccgagttagaagaggaaatgttcaagaaacgtaacctcacaattatggatttacatccgggctcaggtaaaaccagaaaatacctaccagcaattgtacgagaggccattaaaagacggctaaggacgctcatattagcaccaacgagggtagtcgcagcagagatggaagaagcactgaaagggcttcctattaggtaccaaactacagcaactaaaagtgaacataccggaagggagatagtcgatttgatgtgtcacgcaacattcacgatgagactactcagccctgtacgagtacctaattataatttaataataatggacgaagcacattttacagacccagcctctatagcggcgcgaggttacatatcaactagggtaggaatgggggaggccgccgcaatctttatgacggctactcccccgggaacagcagatgctttccctcaatccaacgccccaattcaagatgaggaaagggatataccagagagatcatggaatagtgggaatgaatggattacagactttgcaggaaaaacagtatggttcgtaccaagtataaaagctggaaatgacatagctaactgtctaaggaaaaacgggaagaaagtaatacaattaagtcgtaaaactttcgatacggaataccaaaagacgaaactaaatgactgggatttcgtagtaacaactgatataagtgaaatgggagcaaactttaaggccgatagagtaatcgatccgagacgatgtctaaaaccagttatattaactgatggcccagaacgagtaatattagcaggaccaatgcctgtaactgcggcatcagcagcacaacgcaggggacgcgtaggacgaaacccacagaaagaaaatgatcagtatatatttaccggccaacctctaaataacgacgaagaccacgcacattggacagaagcaaagatgctcctcgataatatcaatactccagaggggatcattcctgcactatttgaaccagaaagagagaaaagcgcggcaattgatggtgagtatcgattgaagggcgaatctagaaaaacatttgtcgaactcatgcgtagaggggacctcccagtgtggctcgcccataaagttgctagcgaaggtataaagtacaccgatagaaagtggtgcttcgatggccaacgcaataatcaaattttagaagaaaatatggacgtcgaaatttggaccaaggaaggcgagaagaagaaactgagacctagatggttagatgcccgaacctattctgatcccttagcattaaaggagtttaaggagtttgcagctggcagaaagagcatagcactcgatcttgtaactgagattggccgggtcccctcacatctcgcacataggacccgaaatgcgctcgataatcttgtaatgctgcacacctcagaacatggaggacgcgcttatcgacatgcggtggaagaactaccagagactatggaaacacttttactcttgggtctgatgatattactcacagggggcgctatgttattcttaatttccgggaaggggattggaaaaacctctataggactaatctgcgtaatagcgtccagtggtatgctatggatggcagaaatccctctccaatggatagccagcgcaatcgttctggagttctttatgatggtattactgatcccagagcctgaaaagcagagaacacctcaagataatcaactcgcttatgttgttatagggatactaactttagctgccataatagcagccaatgaaatgggactactggagaccactaaacgtgacctagggatgtccaaagaaccaggcgtggtgagcccaacgtcatatctcgacgtagatctccatcctgcttctgcctggacactatacgcagtggcaacgacagtaataacgccaatgttacggcacaccatcgaaaatagcaccgcaaatgtttcattagcggcaatcgcgaatcaggcagtggtattgatggggttagacaaaggctggcctatatcaaagatggatttaggggttccccttttagcacttgggtgttactcacaagtgaaccccttaactctcacagccgctgtactattattaatcactcattacgcaattataggaccgggcctacaagcgaaagcaaccagagaagcgcaaaagagaaccgcagctggaataatgaagaatcctacagtagacggaataatgactatcgatctagacccggtcatatacgacagcaaatttgagaagcaattggggcaagtaatgctcctagtactatgtgctgttcagttactgcttatgagaacttcgtgggcattatgtgaagcccttactctagcaacgggccccatcactacattatgggaaggttcacccgggaaattttggaatacgaccatagcagtttcaatggccaatatttttcgtggcagttacttagcgggtgctgggttagcttttagcatcatgaagtcagtcggaacaggaaaaaggggtactggcagccagggagaaactcttggggaaaagtggaaaaagaaattaaaccagttatctaggaaggattttgatttgtataagaaatcaggcataacagaggttgaccgcacggaagccaaagaaggactaaagcggggcgaaataactcaccatgcagttagcaggggaagcgctaaactccaatggtttgtggaacgtaacatggtaatacccgaaggtagagtcatcgatttagggtgcggccgaggaggatggagctactactgtgcaggtctgaagaaagttacggaagttagagggtacactaaaggaggacctggtcacgaggaaccggtgccaatgtccacgtacggttggaacatcgtaaagttgatgagtggaaaagacgttttctatctaccacctgaaaaatgtgatactctcttatgtgatataggagagtctagtcctagtccaaccgtagaagagtcgagaacaatccgagtattgaaaatggtcgaaccatggctgaaaaacaaccaattttgcataaaagtgcttaacccatacatgcccacagtgattgagcatttagaaagactacaaaggaaacatggagggatgttagtacgaaaccccttgtcaagaaattcaacccatgaaatgtattggatttccaacggtacgggtaatatagtggcatctgttaacatggtgtcaagattattgcttaaccgcttcacgatgacgcatagaaggcctactatagaaaaagatgtcgatttgggtgcaggaacacgacatgtaaatgctgaaccggaaactcctaatatggatgttataggtgaaagaattaagagaataaaagaagaacataactctacttggcattatgacgatgagaatccttacaaaacctgggcttaccatggatcatatgaggtaaaagcaactgggtcggcaagttcaatgataaacggagttgtcaaactcctaacaaaaccttgggatgtagttcccatggtaacacaaatggcaatgacggatactacaccatttggacaacagagagtgtttaaagaaaaggtggacacaaggactccgaggagtatgccgggcacgcgtagagtaatgggaataaccgcagagtggctatggcgaacacttggaaggaacaagaaaccacgtctgtgcacacgcgaagagttcactaaaaaggttcgaaccaatgcagcaatgggagcagttttcacagaagagaaccaatgggattcagcaaaggcagcggttgaggatgaggacttttggaaacttgtcgatagggaacgcgaattgcacaaactgggtaagtgtggctcttgcgtatacaacatgatgggtaagcgggaaaagaaattaggcgagttcggaaaggcaaaaggatctagagcaatatggtatatgtggctgggtgctcggtatttagagttcgaagcattgggattcttaaatgaagaccattggtttagtagagaaaatagttattcgggtgtagaaggagaaggactacacaaattaggctatatacttcgagatattagtaaaattccaggaggagcgatgtatgctgatgatacagcaggatgggacacacgtatcactgaagacgacctacacaacgaagagaaaatcacacaacagatggacccagaacacaggcaactcgccaatgctatattcaaattgacttaccaaaacaaggtagtgaaagtgcaaagacctaccccaacaggaacagtcatggacatcatatcgaggaaagaccaacgggggtcaggacaagtgggcacctatggattaaatacattcacaaatatggaagcacaattaataagacaaatggaaggggaaggagttttgagtaaagccgacttggaaaatcctcacctaccggagaagaaaatcactcaatggctagaaacaaagggtgtcgaaaggctgaaacgaatggctatttccggtgatgattgtgtagtcaaaccaatcgatgacagatttgcaaatgcattattagcattgaatgacatgggtaaagtacgaaaagatataccacaatggcaaccatctaaaggatggcatgattggcaacaagtaccattctgtagtcaccacttccatgaactaataatgaaagatggccgcaagctagttgtaccttgtaggccgcaagatgagttgatcggacgtgccaggatttctcagggggcgggttggagcctgaaggaaactgcatgtcttggtaaagcatacgcgcagatgtggagcctaatgtattttcacagaagggacctaaggttagcaagtaatgcaatatgcagtgcagttccggttcactgggtaccaacaagtagaactacgtggagcattcacgcgcatcaccaatggatgacgacagaggacatgctcacagtgtggaatagagtgtggatagaagacaatccatggatggaagataaaacccctgttacgacatgggaaaacgtgccatacttaggtaagagagaggaccaatggtgtggttcactaatagggctaacatcacgcgcaacatgggcgcaaaatatcccaacggcaattcaacaagtacgatcgcttattggaaatgaagagtttttagactacatgccgagtatgaagagattccggaaagaagaagaaagtgagggcgcaatatggtga

SEQ ID NO: 23244 - RNA, 9873 nt, synthetic construct
  misc_feature 1..9873: note = derived and/or modified CDS sequence (opt6) from DENV-3__KF973485__SS-prME
  source 1..9873: mol_type = other RNA
actagcttatgtctaatgatgatccttccggcagctctagcgttccacttgacatctagagatggtgaaccccggatgatagtaggtaaaaacgaacgtggaaaaagcctactattcaaaacggcgtcaggtattaatatgtgcaccttgatagctatggacttgggtgaaatgtgcgatgatactgtaacgtacaaatgtccccatattaccgaagtcgaaccggaagacatagattgttggtgtaaccttacaagtacatgggtaacctacggtacatgtaatcaagcgggagaacatcgaagagataaaagaagtgtagctttagcaccacacgtaggaatgggccttgatacacgcacacaaacctggatgtcggctgaaggtgcatggcgccaagtcgaaaaagtcgaaacttgggcattacgtcatcccggctttacaatcttagcgttatttcttgcacactacattggaacgtctctaacgcaaaaagtagtaattttcatccttctaatgttggtaaccccgagtatgacaatgagatgtgttggtgtcggtaaccgggattttgttgaagggttgtcaggggctacttgggtagacgtagttctggagcatggtggatgtgtcacaacgatggccaaaaacaaaccaactctggatattgaattacagaaaaccgaagctacacagttagccacattaagaaaactatgcatagaaggaaaaattactaacataaccacagacagcagatgtccaacccaaggggaagctactttaccagaagaacaagaccaaaattatgtatgcaaacacacctatgtagatcgtggatgggggaatggctgtggattatttggaaaaggcagtctggtaacatgtgcgaaatttcaatgtttagaaccaatagaaggcaaagtcgttcaatatgagaatcttaaatacactgtcataatcacagtccataccggtgatcaacatcaagtgggaaatgaaacacagggagttacagccgaaataacgccacaggcttcaacaacagaagcaatactccctgaatacggtacattagggttagaatgcagtcctcgtacaggcttggatttcaacgaaatgattttattaactatgaaaaacaaagcatggatggttcaccgacaatggtttttcgatctcccactgccttggacctctggagccactaccgaaaccccaacatggaacaagaaagagttgttagtcacctttaaaaatgctcacgccaagaaacaggaggtagttgttttgggaagtcaagaaggagctatgcatactgctctaacgggggcgacagaaatacaaaattcaggcgggacatctatctttgctggacatctaaaatgcagattgaaaatggataaattagaacttaaagggatgagctatgcaatgtgtactaacacttttgttctgaagaaagaagtgagtgaaacacaacatgggacaatccttataaaagtagaatataaaggtgaagatgtcccatgtaaaatcccgtttagtacagaggatggccaaggtaaagcacataacgggcgtttgattacggcaaacccagtagttactaagaaagaagaaccggtaaatatagaagcagaaccacccttcggagagtcaaatatcgtaatagggattggagacaatgctttaaaaataaactggtataagaaaggttcgtcgattggtaaaatgtttgaagccacagcacgaggtgctagaagaatggcaatcttgggagatactgcatgggattttggatcagtaggaggagtattaaactcactaggcaaaatggtacatcaaatcttcgggagtgcttacacagccttattctccggagtgtcatgggttatgaaaattggcataggggttttattaacttggatagggctcaatagtaagaacaccagcatgtccttttcttgcatagcaataggtattatcacgctttatttaggagctgtagttcaagcagacatgggatgtgttataaactggaaaggtaaagaactaaaatgcggctctggaatttttgttaccaatgaagttcacacatggaccgaacaatacaaatttcaagccgactccccaaaacgattagcaaccgcaattgcgggagcttgggaaaacggtgtttgtggtataaggtctactaccagaatggaaaatttgttgtggaaacaaatagctaacgaactgaactatatattatgggagaacaatatcaaactgactgtagttgttggtgacatcattggggtattagaacaaggaaagcgaacgttaactcctcaaccgatggagctaaaatacagctggaaaacgtggggaaaagcaaaaatcgtaacggcagaaactcaaaatagctcatttatcattgatggacccaacacgccggagtgcccctcggtatcgagagcatggaatgtatgggaagtagaagattacgggtttggggtatttacgacaaacatctggctcaaactacgagaagtacacactcaactatgcgatcatagactaatgagcgcggccgtgaaagatgaaagagcggttcatgcagatatgggatactggatagaaagccagaaaaatggttcgtggaaattagaaaaggcgagcttaatcgaggtcaagacatgtacttggcccaaaagtcataccctctggtcaaatggcgtactggaatcagatatgattatacctaaatcgttggccggaccaatctctcaacacaatcaccgacctggctatcacacacaaactgccggtccatggcacttaggaaaattggaattggatttcaattattgtgaaggaaccactgtggttatcacagaaaactgcggtacacgaggtccttcactacgaacgacaacagtaagtggtaaacttattcacgaatggtgctgcagaagctgtacattgccgcccctgaggtatatgggagaagacggatgctggtacggtatggaaatacggcccatatccgaaaaagaggaaaatatggtaaaatcactcgttagcgctgggtcaggaaaagtggacaacttcaccatgggggtcctgtgtttggcaatccttttcgaggaagtaatgagaggtaagtttggcaagaaacacatgatagccggtgtattctttacctttgttttgctcttaagcggacaaataacttggcgtgatatggcgcatacactaattatgatcggatccaatgcctctgatagaatgggaatgggtgtaacttacctggcattaatagccacttttaaaatacaaccctttttagcgctaggattctttctgagaaaattgacatccagggaaaatctactattgggagtaggtttagcaatggctaccacactccagctacccgaagatattgaacagatggctaacggaatagcactaggacttatggccttgaaactaataacgcaattcgaaacctatcaactatggactgcactcataagtctaacctgctctaacacgatattcacccttacagtagcatggagaacagcaacactcatcctcgcaggcgtgagtcttttaccagtatgccagagctcgtcaatgcgaaaaacagattggttacctatggctgttgcagctatgggagtccctcctctaccactattcattttcggcttaaaggacactctgaaaagaaggtcatggccactaaatgaaggagtaatggctgtcggccttgttagtattctagccagttcgctgttaaggaacgatgtgccaatggcaggtcctctagtagcgggaggcctattaatagcttgctatgtgattacgggcacatcagcagacctaacggtagaaaaagcggcagatatcacatgggaggaagaggctgaacaaacaggtgtgtcacataatctcatgataacagtagacgacgatggaacaatgagaataaaagatgacgaaaccgaaaatatacttaccgtattacttaagactgccctcttaatagtctccggaatatttccatattcgataccagcaactttattagtgtggcatacttggcaaaaacaaacacaaagaagcggtgtattatgggatgtcccaagcccaccagaaacacagaaggccgagctagaagaaggcgtttacagaatcaaacaacaaggtattttcggaaaaacacaggtcggtgtgggtgttcaaaaagagggcgtgtttcatacaatgtggcacgtaacgagaggggcggttttaacctacaatggtaaaagactagagcccaattgggcttctgtcaagaaagatctgattagttatggaggaggttggcgcctgtctgcacagtggaagaaaggagaagaagttcaagttattgcagtggaaccaggtaaaaatccgaaaaattttcaaacaatgccgggtacatttcaaaccacaactggtgagataggagcaatagcgttagacttcaaacctggaacgtcaggaagtccaattataaacagggaagggaaagtggttggactctatggcaatggagtcgttacgaaaaatggtggatacgtatctggcattgcacagacaaatgcagagcccgatgggcctacacctgagctggaagaagaaatgtttaagaaaagaaacttgacaattatggatttacacccaggaagcggcaaaacgagaaaatacttgccggcaatagtaagagaagccattaaaagacgtcttcgaaccctcatattggcaccgacacgcgtcgtggcagcggaaatggaggaggcactgaaaggcttaccgataagatatcaaactactgcaacaaaatcagaacacacaggaagagaaatagtggacctgatgtgtcacgctactttcacaatgcggttgttatcaccagttagagtgccaaactacaatcttatcataatggatgaagcacattttaccgatccggcgtctatagcagcacggggctatatcagtacacgggtgggaatgggagaagctgcggcaatattcatgactgccacacccccaggcacagcggatgcatttccacagagtaacgcgcccatacaagacgaagaaagagatataccagagcgaagttggaacagcggaaacgagtggataactgatttcgctggtaagacagtttggttcgtacctagtataaaggcgggaaatgacatagctaattgtctcaggaaaaacgggaagaaagtaatccaactttctcgaaaaactttcgacacggagtaccagaaaacaaaacttaatgattgggactttgtagtcactacggatatatctgaaatgggcgcaaactttaaagcggatagagtcatagatccacgacggtgcttaaagcctgtgatcttgacagacggcccggaaagagttattctagctggtccgatgcctgtaacggtagcttcggctgcacaaaggagaggacgagtcggacggaacccacagaaagagaatgaccagtacatattcactggtcaacccctcaataacgatgaagaccatgcgcactggaccgaagctaaaatgctgctggataatataaatactccagaaggaataataccagcactatttgaacctgaacgcgagaaatctgcagcgatagatggcgagtatcgtctaaaaggggaaagccggaagacttttgtcgaactaatgaggcgtggtgacctaccagtctggctagcacataaggtcgcaagtgaaggtatcaaatacacggatcgcaaatggtgtttcgacggacaaagaaataatcaaattctggaggagaacatggatgttgaaatttggactaaggaaggtgagaagaagaaattaagaccacgatggcttgatgcaagaacctattctgatccccttgccttgaaagaatttaaagaatttgccgcaggaagaaaatctatcgcattagatctagtaactgaaataggtagggtgccttcccacctagctcacagaacacggaatgccttagacaacttagtaatgctacacacaagtgaacacggcgggagagcatacagacatgccgttgaggagttaccagaaactatggaaactttgttgctactaggcttaatgattcttctaactggcggagcgatgctatttctgattagtggtaaaggcataggaaaaacatccatcggattgatatgtgtaattgcatcgagcggcatgttatggatggccgagataccacttcagtggatcgcttcggccatagttctagagttcttcatgatggtattgttaataccggaaccagaaaaacaacggactccccaggacaatcaattagcatacgtcgtcattggaatcctaacgctggctgccattattgctgccaacgaaatgggacttttagaaacaacaaaaagggacctaggaatgagtaaggaaccaggtgtagtaagtccaactagctatctagatgtagatttacatccggcttcagcatggacactttatgccgtagcaacaacagttatcactccaatgttacgccatacgatagaaaattctacggctaatgtgagtttagcagcaatagcgaatcaagcagttgtccttatgggtcttgacaaaggctggccaatcagcaaaatggacttaggggtaccattgcttgcgctgggatgctattcacaggtaaacccattaaccctaacggcagctgtcttattactcataacacattatgccatcataggacctgggttacaagctaaagcaactagagaagctcagaagcgcactgcagcaggaattatgaaaaatccaaccgttgacggtattatgacgatagacttagacccagtcatatatgattcaaaattcgaaaaacagttagggcaggtaatgcttcttgttttatgtgtcgtacaacttctattgatgagaacaagctgggcgttatgcgaagcattaactctggctacagggcccataacaacattatgggagggtagtcctggaaaattttggaacaccactattgcagttagcatggccaatatttttcggggttcctacctagccggagcaggcttagcgttctcaataatgaaaagtgtggggactggaaaaagaggtacaggatctcaaggagaaaccttgggtgaaaagtggaagaagaaacttaatcaattaagccgaaaagactttgatttatacaagaaaagtggaataacagaagtggatcggacagaagctaaagaaggtttgaaacgtggtgaaataacacatcatgcggttagtcgtggatctgcaaaacttcaatggttcgtcgagagaaatatggtaataccagagggtcgagtgatagacctcggatgtggacgagggggttggagttactactgtgcgggcttgaagaaagtaacagaggtaagaggatatacgaaaggcggaccagggcacgaagaaccggtacccatgtcgacgtacggctggaatatagttaaattgatgagcggcaaagatgtcttctatctcccgccagagaaatgtgatacattgttgtgtgatatcggagaaagttccccatcaccgactgtcgaggagagccgtacgatccgagttctcaaaatggttgaaccttggcttaaaaacaaccagttctgcattaaagtattaaacccatacatgcctaccgtaatagaacacttagaaagactgcaacgaaaacatggaggtatgcttgtaagaaatccgctatcaagaaactcaacccatgagatgtattggatatctaacgggactggcaatattgtagctagcgtaaatatggtatcaagactactactgaacagatttacgatgactcaccgtagaccaaccatagaaaaggacgtagacttaggagctggcacgaggcacgtgaacgccgaaccagaaaccccaaacatggaggttataggagagagaataaaacgaatcaaagaagaacataattcaacatggcattacgacgacgaaaatccatacaaaacatgggcttatcatggttcatatgaggtaaaagccacaggtagcgcgtcaagcatgataaacggagtagtgaaattattgacaaagccttgggatatggtgcctatggtgacgcaaatggcaatgacagacacaacaccgtttggacaacaacgtgtattcaaagaaaaagtagacacacgaaccccaagatctatgcctggtactagacgtgttatgggaataaccgcagagtggctttggaggacgcttggtcgcaataagaaaccgcgactatgtactagggaagagttcactaagaaagtacggacaaatgccgctatgggtgctgtttttacagaggagaatcagtgggactcagcaaaagcagccgtggaggatgaagacttctggaaacttgtcgatcgtgagagagagttacacaaactcggcaaatgtgggtcgtgcgtatataatatgatgggaaaaagagagaagaaactaggagagttcggaaaagcaaaaggttcacgagcaatatggtatatgtggttaggtgcgaggtacctagagttcgaggctttaggtttccttaacgaagatcactggttcagtagagaaaattcatactcgggagttgaaggtgagggcctgcataaattagggtacatcttgcgagatatatcaaaaattcccggaggtgcaatgtatgcagacgacacagcaggctgggataccagaatcactgaagatgatttacataacgaagagaaaattactcaacagatggacccagaacatagacaactggcagatgcaatttttaagctgacgtaccagaacaaagtggtaaaagttcaaagacctacgcctacaggtacagttatggacataattagtcgaaaagaccaacggggctcaggacaagtaggtacttacggtttaaatacatttactaacatggaagcacaattaattcgtcaaatggaaggagaaggagtattatcgaaagctgatctggagaatcctcatctccctgagaagaaaataacccaatggttagagactaagggagtggaaaggttgaaaagaatggcaatttctggtgatgactgtgtggttaaaccaatcgatgacagattcgcgaacgcgttattggcgttgaatgacatgggtaaggtaagaaaagatatccctcagtggcaacccagcaagggatggcacgattggcaacaagttccgttttgttctcatcactttcacgaactaataatgaaggatggtagaaaactggtggtaccatgcagaccccaggacgaattgatagggagggcccggatttcacagggagcaggctggagtctaaaagagactgcttgtctgggaaaagcatatgcgcaaatgtggtcactaatgtattttcacagaagggacctaagactagcaagtaatgcaatatgctcagcggtccctgtacattgggtaccaacgtctcgcactacatggtcaatacatgcacaccatcaatggatgaccacagaagatatgttaacagtctggaaccgcgtatggatcgaagacaatccttggatggaggacaaaacacctgttacgacttgggaaaatgttccctacctaggaaaacgagaggaccaatggtgcgggagtctaataggattaacatcacgtgcaacgtgggcccaaaatattccaacagctattcaacaagtaagatcgctcataggcaatgaggagttcctagactatatgcccagcatgaaaagatttagaaaagaagaagagagcgaaggtgctatatggtag

SEQ ID NO: 23245 - RNA, 9873 nt, synthetic construct
  misc_feature 1..9873: note = derived and/or modified CDS sequence (opt6) from DENV-3__KF973486__SS-prME
  source 1..9873: mol_type = other RNA
acaagtctgtgcctcatgatgatactgcctgcagctctggcttttcacttaacaagcagagatggagaaccaagaatgatcgtcggcaaaaatgaaagaggtaaatccctattatttaaaactgcgtcaggtataaacatgtgcacactcatcgcaatggacctcggagaaatgtgtgatgacactgttacgtataaatgcccacatatcacagaagtagaacctgaagatatcgattgctggtgtaatctaacatcaacctgggtaacatatggtacctgcaaccaagcgggagaacacaggagagataaaagatcagtcgcattagcacctcatgtcgggatgggtctagatacgaggacgcaaacgtggatgtccgcagaaggtgcatggcgtcaggtagaaaaagtggagacgtgggcgctgaggcatccgggatttacaattcttgcacttttcctagctcactacataggtacatcattaacacagaaagtcgtcatatttatattacttatgcttgtgacacccagtatgactatgagatgcgtaggggttggaaaccgagattttgtcgagggtctgagcggtgcaacatgggtggatgtagttttagaacatggtgggtgcgttactacgatggccaaaaacaaacctacattagacatagaactacagaaaactgaagcaacacaacttgctaccctaaggaaattatgtatcgaaggaaaaattactaatataaccacggattctcgctgtccaactcaaggtgaagctacgcttccagaagaacaagatcaaaattacgtatgtaaacacacatatgtagacaggggttggggaaacggctgtggtttgttcggtaaaggtagcttagtgacgtgtgctaagtttcagtgccttgaaccaatagagggtaaagtagtacaatatgaaaatcttaaatacacggtgattattactgtacacacaggagaccagcaccaggtcggaaacgaaacccaaggtgttactgcagaaattacacctcaggcttctacgacagaagcaatactcccagaatacggaacgctaggccttgagtgtagtcctcgcactggtctggactttaacgaaatgatcctactaacaatgaaaaataaagcatggatggttcaccgccagtggttctttgacctacctttaccttggacaagcggcgctacaacagaaacaccaacatggaaccggaaagaattattagttacatttaaaaacgcacatgccaagaaacaagaagtcgtcgttttaggatcccaagagggcgcaatgcacacagctttgacaggagcaaccgaaatacaaaactcagggggaacatcaatcttcgcaggacatctaaaatgtaggcttaaaatggataaattagaactaaaaggaatgagctacgctatgtgtacaaatacatttgtcctgaagaaagaggtatctgagacacaacatggcaccatcctaataaaagtcgaatataaaggtgaagatgtaccatgtaaaataccctttagtaccgaagacggccagggtaaagcacataatggtagattaattacggcgaatcctgtagtaaccaagaaagaggagcctgtaaacatcgaagcagaacccccatttggagaatctaatattgtaatcggtattggagacaacgcactcaaaataaactggtataagaaaggatcaagcatagggaaaatgtttgaagctactgcccgcggagcaagaagaatggccatactcggcgatacggcttgggattttggatcagtaggcggggttctaaattctttaggaaagatggtccatcagatctttggttcagcatacacagcactattttcgggagtatcttgggtaatgaaaatcggaataggcgtattactaacatggattggcctaaacagcaaaaatactagcatgagtttttcctgtattgcaatcgggattataacactttaccttggcgcagtggtacaggcagatatgggctgcgtcataaactggaaagggaaggagttaaaatgcggttcgggtatattcgtcacaaatgaagtacacacatggactgagcaatataaatttcaagcagactcaccaaagagattggccacggctattgctggagcatgggaaaacggggtctgtgggattagatccacgacaaggatggaaaatttgctatggaaacaaattgcaaacgaactcaattacatactatgggaaaataacataaagctgacggttgtagttggagatattattggagtgctagaacagggtaagagaacacttacaccacaacctatggaactaaaatattcatggaagacttggggtaaggcgaaaattgtgaccgcagaaacacaaaactcatcgtttataattgatggacccaacacaccagaatgtcctagcgtgtcgagggcgtggaatgtttgggaggtcgaagactacggtttcggcgttttcacaacaaacatttggttaaaacttagagaagtatatactcaactatgcgatcatagattgatgagtgccgccgtcaaagatgaaagggcagtacatgctgatatgggttactggattgagtcgcagaaaaatggaagctggaaactggagaaagcatcactgatagaggtaaaaacatgtacttggccaaaaagtcacacgttatggagcaatggggtactcgaatccgatatgattattccaaaatctctagccgggccaatatctcaacataaccatagacccggataccacacccaaacagccggaccatggcatttagggaaactagaactcgattttaactactgcgaaggcacaactgttgtaattacagaaaactgtggcactcgaggtccttctctcaggacaaccacagtctcaggtaaactaatccacgaatggtgttgccgcagctgtactttacctccattgagatatatgggtgaagacggatgctggtacgggatggaaatccgaccaataagtgagaaagaagaaaatatggtcaagtctctagttagtgccggatcagggaaagtcgataatttcactatgggcgttctatgcctagcaatcctatttgaagaggtcatgaggggaaaatttggcaagaaacacatgattgccggcgtattctttacatttgtattattactatctggacaaatcacatggcgtgatatggcccatactttaattatgattggatcaaatgccagcgataggatgggaatgggtgttacatatctagctctgatagctacatttaaaattcaaccctttttggcactcggctttttccttcggaaacttacctcccgggaaaatttactacttggtgtaggccttgctatggctacaacgttacaactcccagaagatatagagcagatggctaatggaattgctttaggcctgatggctctcaaactaattactcagtttgaaacataccagctgtggactgcattaatatctttaacgtgctcaaataccatatttacgctgacggtagcatggaggacagctacattgatccttgctggagtttcattgctgcccgtttgtcaaagctcctcgatgagaaaaacagactggttgcccatggcggtcgcagctatgggtgtgcctcctttgccactctttatttttggattaaaagacactttgaaaagaagaagttggcctctcaatgagggcgtgatggctgtaggtctggtatcaatactggctagctcattactccgcaatgatgttccaatggctggcccgttagtcgcagggggtttgcttatcgcgtgttacgttataactggtacatctgccgatctaactgtcgaaaaagcagcggatattacatgggaagaagaagctgaacaaacaggagtatcccacaacctaatgataactgtggacgacgatggaactatgagaataaaagacgacgaaaccgaaaacattttaacagtcttgcttaaaacggcgttactcatagtcagtggaatctttccttacagcattcctgctacacttctagtttggcacacctggcagaaacaaacacagagatcaggagtactatgggacgtcccgtctccgccagagacacaaaaagcggagcttgaagagggtgtatatcgcataaaacaacaagggatctttggaaagacacaggttggtgtgggagtccagaaagaaggggtattccatacaatgtggcatgtaacaagaggagccgtcctaacatataacggcaagcgactcgagcctaactgggcatcggtgaaaaaggacctgataagctacggtggaggatggcgattatctgcccaatggcaaaagggcgaagaggtacaagtgattgcagtagaaccagggaaaaacccaaagaatttccagacgatgccgggcacttttcaaacgaccacgggagagataggagcaattgcactagattttaaaccaggcacgtcaggttcaccaataattaatcgggagggaaaagtggtaggtctgtatgggaacggcgtggttaccaaaaatggaggatatgtcagcgggatcgcacaaacaaacgctgaaccagacggtccaaccccagaattagaagaagaaatgttcaagaagaggaacttgacaataatggacttgcatccaggttcgggcaagacgagaaagtacctcccagcaatagtccgtgaagcgataaaacgaaggctaagaacattgattttggcacccactagagtagtagctgctgagatggaagaagcgctcaaagggctaccgatcagataccagacaacagcaactaaaagtgaacacacgggacgggaaatagtagatctgatgtgtcacgcaaccttcactatgagattactaagccctgtacgcgtaccaaattacaacttaataataatggacgaggctcatttcacggaccctgcctcaattgcagcaagaggatatataagtacccgtgttggaatgggggaagcagcagcaattttcatgacagccactccacccgggacagctgatgcatttccccaatctaatgcaccgatacaagatgaagaaagggatatccccgaaagaagctggaacagtggaaacgaatggataacagattttgcgggcaagacggtatggttcgtaccatccattaaagctggaaatgatattgcaaactgtttaaggaaaaatgggaagaaagttatacaactttcaagaaaaacgttcgataccgaatatcaaaagactaaattgaatgactgggacttcgtggtgactacagatatttcagagatgggtgctaattttaaagcagacagagtaatagatccacggcgttgtctaaaaccagttattcttacagatggcccagaaagagtaatactggccggtccgatgcccgtgactgcagcgagtgcagcacagagaaggggaagagtaggccgaaatcctcagaaagaaaatgaccagtatattttcacaggacagcctctgaataatgatgaagatcacgcacactggacggaggctaaaatgttattggacaacataaatacgccagaagggataatcccggccttatttgaaccagaacgagaaaaatccgcagctatagatggcgaatacagactaaaaggagaatcacgaaagacgttcgtggaactaatgaggaggggtgatttacctgtatggttggctcacaaagttgcatccgagggaattaaatacacggaccgtaaatggtgtttcgatggacaacgcaataatcagattctagaagaaaacatggacgtagaaatatggactaaagaaggtgagaagaagaaactccgaccccgatggttggacgcccgtacatactcagatcccctagctcttaaagagttcaaagaatttgctgccggacgtaagtctatagccctagacttagttaccgaaatagggagggtgccttcgcacttggctcatcgcacgaggaatgctttagataatcttgttatgttacatacgagtgaacatggaggacgcgcgtacagacatgcggttgaggaactgccagaaacgatggaaacactattgctacttggtcttatgatactcttaactggcggcgctatgctattcctgatatctggaaaagggattggcaaaacatcaataggactaatatgcgtaatagcgtcctcaggaatgctatggatggcagaaataccactacaatggatagcatcagcaatagtactggagttctttatgatggttttactgataccagaaccagaaaaacaaagaacgccacaagacaatcaattagcttacgtcgtcattggcatactgacattggcggccataatagcagcgaacgaaatggggctgttggaaacgaccaagcgtgatttaggtatgagtaaagaaccaggtgtcgtatcacctacatcataccttgacgtagatctacacccagcatctgcctggacactgtatgctgtcgcaaccacagtaattactccaatgttacgacatacgatcgaaaattctaccgcaaatgtttcactggctgccattgctaatcaagcggttgttttaatgggattagataaaggatggcccatctcaaagatggaccttggcgcaccgctactcgcgttgggatgttatagccaagtcaatcctttaacgctaaccgctgccgtcctactattaataactcattacgcaataatcggaccaggattacaagcaaaagcaactcgtgaagcacagaaaagaacagctgccggaataatgaaaaatccgactgttgatgggattatgacaattgacctggacccagtcatatacgattctaaatttgaaaagcaactcggacaagttatgcttttagtgttatgtgcagtacaactactcttaatgagaacatcatgggcgttgtgtgaagcacttactctggcaacaggtcccattactactttatgggagggctcccccggcaaattttggaatactactattgcagtttcaatggcaaatatattccgaggctcatatcttgctggtgctggattggcatttagtataatgaagtcagttgggacaggaaaaagaggtactggtagtcaaggagaaactcttggagaaaaatggaagaagaaattgaaccaactaagtcgtaaagattttgacttatataagaaatccggaattactgaagttgaccgaaccgaggcaaaagaaggattgaaacgaggagaaataacacatcatgcagttagtaggggctctgcaaagttacaatggtttgtggaacggaacatggtaataccggaaggacgggtaatagatttaggatgcggacgaggcggatggagctattattgtgcaggcctcaagaaggtaacggaagttcgcggctatactaaaggaggacccggtcacgaagaaccagtacccatgtcgacatacggttggaatatcgtaaaacttatgagcggaaaagatgtattctacttacctcctgaaaaatgtgacacattgctgtgcgatataggggagtccagcccaagtccaaccgtagaggaaagtagaacgatacgggtcttaaagatggtcgaaccgtggttaaagaacaaccagttctgcataaaggtcttgaatccatacatgcctacggttatagagcatctagaaagactgcaaaggaaacatggaggaatgcttgtaaggaaccctttgtcacgtaatagtacccatgagatgtactggataagcaacggaactggcaacatagtggctagtgttaacatggtaagtcgtttactactaaacagattcactatgacacacaggaggccaactattgaaaaagatgtagatttgggtgctggtacgagacatgtgaatgcagaaccagaaacacccaacatggatgtaattggagagagaataaaaaggataaaagaggagcataacagcacgtggcattacgatgatgaaaacccttacaagacttgggcatatcatggatcatatgaagtaaaggcaacaggatcagcatcaagcatgataaacggagtagtgaaacttctaacaaaaccatgggatgtggtaccaatggtcacccagatggccatgaccgatacgacaccctttggacaacaacgtgtatttaaagaaaaagtggatacaagaacaccaaggtcaatgcctgggacaaggcgcgtcatgggcattacggctgaatggttatggaggacgttaggacgcaataaaaagccgagactgtgcacaagagaagaatttaccaagaaagtccgcacaaatgctgctatgggggcagtatttacagaagaaaatcaatgggattcagcaaaagccgctgttgaggacgaagatttctggaagctcgtagatcgagagagggagttacataaacttggaaaatgcggtagttgtgtttataatatgatggggaaacgcgagaagaaattaggagagtttggtaaagcgaaaggatctcgcgccatatggtatatgtggctgggagcccgctatctcgagttcgaagcattgggatttttaaatgaagaccactggtttagccgagaaaacagttatagtggcgtcgaaggggaaggccttcacaagctgggatatatccttcgtgatataagtaagataccgggaggagctatgtatgcggatgatacggcaggctgggatactcggattacagaggatgatctgcacaacgaagaaaagataacacaacaaatggaccccgagcatagacaattagcaaatgccatatttaaacttacttaccaaaataaagtcgtaaaggttcagcgcccgactcctacgggaaccgtgatggatatcatatctagaaaagatcaaagaggaagcggccaagtaggaacctatggattaaatactttcaccaacatggaggcccaattgattagacaaatggaaggagaaggagtcttaagtaaagcagacttggagaatcctcatttacctgagaagaaaataactcaatggctagaaacgaaaggggtagagagactaaaaagaatggcaatctcaggggacgattgtgttgtaaaaccaatcgatgataggttcgcgaatgcactcttagctttgaacgacatggggaaggtgaggaaagatattccgcagtggcaacccagtaaaggatggcatgattggcaacaggtacctttctgctcgcaccattttcacgaattgattatgaaagacgggagaaaattagtagttccatgtcgcccgcaagatgagctcataggccgagctagaatttctcaaggggccggttggtcattaaaggaaacagcatgcctcggaaaagcgtatgcacagatgtggagtctcatgtacttccatagacgcgatctcagactggcctctaacgcaatatgcagtgctgtccccgtccactgggttcctaccagtagaacaacttggagcattcatgcacaccaccagtggatgacgaccgaggacatgcttacagtatggaatagagtctggatagaagataacccgtggatggaagacaagaccccagtcacgacatgggaaaatgtcccatatctgggaaaacgagaagatcaatggtgtggaagcctaatcggacttacgagcagggcgacatgggcacaaaatatacctacagccattcaacaagttagaagtttaatcggcaatgaggaatttctcgattatatgcccagtatgaaaagatttcgcaaagaagaagaaagcgagggtgccatctggtaa

SEQ ID NO: 23246 - RNA, 9873 nt, synthetic construct
  misc_feature 1..9873: note = derived and/or modified CDS sequence (opt6) from DENV-3__FJ898458__SS-prME
  source 1..9873: mol_type = other RNA
acttccttgtgtctaatgatgatactaccggcagcattggctttccatttaacatctagagatggagaaccgcggatgatagtagggaaaaatgaaagaggtaaaacattgcttttcaaaacagcatcaggaataaacatgtgcacgcttatcgccatggacttaggagaaatgtgcgatgacactgtgacttataaatgccctcacatcacagaagtagaaccagaagacatcgattgttggtgtaacctaacgtcaacttgggtcacgtacggaacatgtaaccaagcgggggaacaccggagagacaaaagatcagtagcacttgccccgcatgtgggtatgggactagacacacgtacacaaacatggatgtccgccgagggagcctggaggcaggtcgaaaaagtagaaacttgggccttaaggcaccctgggttcacaattttagccctctttctagcacattacattggaacaagtttgacccaaaaagtagttatatttatattgttaatgctagtcacgccatcgatgacgatgcgctgcgttggtgttggaaatcgagactttgttgaaggacttagcggggcaacatgggtagatgtagtcttagaacatggaggatgtgtcacgacaatggctaaaaataaaccaaccctagacattgaactccagaaaaccgaagctacacaactagctacacttaggaaactatgcatcgaaggaaaaatcacaaatataactacagatagtagatgccccacacaaggcgaggcggtcctccccgaagaacaagatcagaattatgtgtgtaaacacacatatgtggatagaggctggggaaacggttgtggtttgttcggcaagggtagtctagtgacttgcgcaaaattccaatgcttagaaccaatagaaggcaaagtagtacaatatgaaaatttgaaatacaccgtaattattaccgttcacaccggtgatcaacaccaagttggtaatgagactcaaggagttactgcagaaataaccccacaagcctccacaacagaagctatactacctgagtacggtacattaggattagaatgttcacctagaacggggttagattttaacgagatgatactattaactatgaaaaacaaagcatggatggtgcacaggcagtggttcttcgatttaccacttccctggacaagtggtgctacaaccgaaacaccgacatggaacagaaaagaactactcgtaacgttcaaaaatgcacacgccaaaaagcaagaggttgtagtactaggaagtcaagaaggagcgatgcataccgcactaacgggggccaccgaaatccaaaatagcggtgggacgtcgatctttgcaggccacttaaaatgtcgcctaaagatggataaattagaattgaaaggaatgtcttatgctatgtgtacaaatacttttgtactaaagaaagaggtatctgaaacacaacacggaaccatactaataaaagtcgaatataagggcgaggacgttccatgcaagattccattttccacggaagatggacatgggaaagcccataatggaagattgataacggctaaccctgtagttactaaaaaggaagaaccggtaaacatagaagcagaaccaccgtttggggaatcgaatatagtaatcggtattggtgacaatgcactaaaaataaactggtacaagaaaggttcatccataggaaaaatgtttgaggctactgcacggggcgcacgcagaatggcaatattaggagatacggcgtgggacttcgggtcggtaggtggagtactaaactccttagggaagatggtccaccaaatattcggtagtgcatacacggctctattctcaggtgtaagctgggtcatgaaaatcggtataggcgtactcctaacttggatcggactgaactcaaagaacactagcatgtcgtttagctgtatcgcaataggaatcataacattatacctaggcgctgtcgtacaagcagatatgggatgcgttataaattggaaaggtaaagaactaaaatgtggttcaggaatatttgtaactaatgaagtacacacttggacggagcaatataaattccaagctgatagtcctaaaagattagcgaccgctattgctggagcgtgggaaaacggtgtatgcggtataagatctactacgcgtatggaaaacctcttgtggaagcaaatagctaacgaattgaactatatactttgggaaaataacattaaattgacggtagtcgtaggagacatcattggagttttagaacaaggaaaaagaacgcttacaccgcagcctatggaactaaaatacagctggaaaacatggggcaaggcaaaaatagttaccgcagaaacacaaaattcttcctttataatagatggcccaaataccccagaatgtccgtcagcctcaagggcttggaacgtatgggaggtcgaagattatggatttggagtctttacgacaaacatttggttgaagttaagagaagtatacactcaactatgcgaccacagattaatgtccgctgccgttaaagatgaacgcgcggttcacgccgatatgggctattggattgaatcgcagaaaaatggtagctggaagttagaaaaggcatccttaattgaagtaaaaacatgtacttggccaaaaagtcatacattgtggtcaaatggagtgctcgaatctgacatgatcatccctaaatccttggccggacctataagtcagcataatcaccgaccaggataccacacgcaaacagcaggaccctggcacttaggtaaactcgaattagacttcaattattgtgaaggcacaaccgtcgttataactgaaaactgcggtacaaggggtccctcgctcagaaccacgacagtctctggaaaattaatccatgaatggtgttgtcgatcttgtaccctgccccctctaagatatatgggcgaagacggttgttggtacggtatggaaattagaccaatctcagagaaagaagagaatatggtaaaatccctagtttctgcaggctcaggtaaagtagacaatttcacaatgggtgttttatgtttagccatcctgttcgaagaggtgatgagaggtaagttcggaaagaaacatatgatagccggtgtgttctttacctttgtcttgttattaagtggacagatcacatggagagacatggcacacacgctcatcatgataggctcaaatgcgtcagatagaatgggaatgggtgttacataccttgcattaattgcaacattcaaaatacaaccatttcttgctcttggattctttttacgtaagctaacatcgcgtgaaaacctcttactgggagtaggattagctatggcaacaacacttcaattgcccgaagatattgaacaaatggctaacggaatagccttagggctaatggctttaaaactaattacacagttcgaaacatatcaactttggacagcattaatatcgttaacttgctccaacacaatctttacattaacagtggcttggagaactgcaacgttgatcttagcaggagtaagtctcctgcctgtatgccaaagcagtagtatgcgaaaaaccgattggttaccaatgaccgtcgcggcaatgggagtaccgccgctacccctatttatattttctttaaaggacactctcaaaagaagatcatggccattaaacgaaggtgtcatggcagtgggcttggtatctatattagcgtcatctttactaagaaatgacgtaccgatggctgggccgttggtggccggtgggctgttaattgcgtgttatgtaataactggtacatcagcagacctaacagtggaaaaagcagcagacataacatgggaagaagaagccgaacaaaccggagtatcacataacttaatgattaccgttgacgatgatggaaccatgaggataaaagacgatgaaacggagaacattttaacagttctgctcaaaacggcactactaatagtcagtggaatattcccctactcaattcccgcaacattgttggtatggcatacctggcaaaaacagacacaaagaagtggcgtactatgggacgtgcccagtccaccagaaacacaaaaagcagaactagaagagggagtatatagaatcaaacaacaaggtatattcgggaaaacccaagtaggcgtaggggttcaaaaggaaggagtctttcataccatgtggcatgtaacaagaggagcagtactcacatacaacggcaagagattagaaccaaactgggcaagcgtcaagaaagatttgatttcttatggaggagggtggagattgtctgcccaatggaagaaaggagaagaagtgcaggtcatagcagtggaaccgggcaaaaaccccaaaaacttccaaacaatgccaggaacttttcaaacaaccacaggtgaaataggcgcaattgctctggactttaaaccaggtacatcgggctcacccattataaacagagaaggcaaagtggtagggttatacggaaatggggtcgttacaaagaatggaggatatgttagcggaatagctcagacaaacgcagaaccggatggtcccacacctgagttggaagaagaaatgtttaaaaagcgtaatctgacaatcatggacctacacccggggagtggaaaaaccagaaagtacctacccgcgattgtaagggaagcaatcaaaagaagattgcggacgcttatattggcgcccacccgcgttgtcgcagcagaaatggaggaagcattaaaaggcttaccaattagatatcaaacgactgctacaaaaagcgaacacactggacgagagatagtagatctcatgtgccatgctacgtttacaatgcgactattgtcacctgtcagggtaccgaactacaatcttataataatggacgaagctcatttcacagatccagcaagtatagccgccaggggctatatttcaaccagagtaggaatgggtgaagcagcggctatatttatgacagcaacaccacctgggacggcggacgcattcccgcaaagcaacgcacccatccaagatgaagaaagagatatacctgaaagatcatggaatagtgggaatgaatggataactgactttgcagggaaaaccgtgtggttcgtaccttcgatcaaagcgggtaacgatatagccaattgtttaaggaaaaatggcaagaaagtaattcaacttagccgcaaaacattcgacaccgaatatcaaaagacaaaactcaatgactgggattttgtcgtcacaactgatatatcagagatgggagccaatttcaaagcagacagagttattgacccacgaagatgccttaagccagtaatactaaccgatggtcctgaaagagtgatattagcaggcccgatgcccgttaccgccgcatcagcagcacaaagaagaggtcgagtagggcgaaacccacagaaagaaaatgaccagtacatctttaccggacaaccacttaataacgacgaagaccatgctcattggaccgaagcaaaaatgttattggataacataaatactccagaaggcatcatcccagcactatttgaaccggaaagggagaaaagtgcagctattgacggagaatatcgacttaagggagaaagtagaaaaacattcgttgaactaatgaggcgaggagacctaccggtgtggcttgctcacaaagtggcctcggagggaataaaatacacagaccgtaaatggtgtttcgacggacaaagaaacaatcaaatcttagaggaaaacatggacgtggagatatggactaaagaaggggaaaagaagaaactgcgtccccgctggctggatgcacgtacatatagtgatccactagcattaaaggaatttaaagatttcgctgccggtcgtaagtcaatagctctcgatttggtaacagaaataggaagagttccttctcacttagcacaccgaaccagaaacgcattagacaatctagtaatgctacatacatccgaacacggaggcagagcttaccgtcacgccgtagaggagctacctgaaacgatggaaaccctattacttttaggtctgatgatacttttaaccggaggagcgatgttgttccttataagtggaaaaggaatcggaaaaacatctataggactcatttgtgtcattgcatcgagcggaatgttgtggatggcagaaattccgctccaatggatagcatccgctattgtgttagaatttttcatgatggtactattaatacccgaacccgagaagcagcggacaccacaggataatcaattagcatacgtagtaatcggcattcttaccctagctgctattatagccgcgaacgaaatgggcttgcttgaaacaacaaaaagagatctaggaatgtcaaaagagccaggagttgtctcacccacttcgtatctagatgtagatcttcaccctgccagtgcttggacgctatatgcagtagctacgacagtaataacgcctatgttgagacacacaatagagaacagtacagctaatgtctccctagcagccatagcaaaccaagccgtggtacttatggggctagataaaggatggcccatatcaaaaatggacttaggcgttccacttctcgctctaggttgctattctcaagtaaatcctttgacacttacagccgctgtcttactgttaataacccattatgcaataatcgggcctggtctgcaggcaaaagcaactagagaagcgcagaagagaacggctgcaggaataatgaagaatcctaccgtagatgggattatgactatagacctggacccagtaatttatgacagcaagttcgagaagcagctcggtcaagtgatgttactggtactatgcgcggtacaactactcttaatgcgtacatcatgggctttatgtgaggcacttacgctcgccaccggaccaatcactactttgtgggaagggagtcctggcaagttttggaatacaactattgcagtgtcgatggcaaatatatttaggggtagctatctcgccggcgctggattggccttctctataatgaagtcagtaggtactggcaaaaggggcacgggaagccagggtgaaacattgggggagaaatggaagaagaaacttaatcagctatcgagaaaggaatttgacttatataagaagagtggaattaccgaagtagataggactgaagcaaaagaaggattaaagagaggggagattacccaccatgcggtttccaggggatccgcaaaactgcaatggtttgtagaacgtaacatggtaattcctgagggaagagtaatagacctaggatgtggtcggggcgggtggtcttactactgcgcaggtcttaagaaagtcaccgaagttagaggctacacaaagggtggtccgggccatgaagaaccagtacctatgagtacttatgggtggaatattgtaaaattaatgtcaggaaaagacgtcttttatctgccaccggagaaatgcgacacactgctgtgtgatatcggcgaaagttctccgagtcccactgtagaggagagcagaacgatcagagtattaaaaatggtcgagccatggttaaagaacaaccagttctgcatcaaagttttaaatccatatatgcctacagtaatagaacacctagaacgattacaacgcaaacacggtgggatgttggttcggaatccactaagcagaaattcgacccatgagatgtattggatatcgaatggaaccggtaacattgtggcatcggtgaatatggtatctagacttttactgaaccggtttacaatgacacatcgcaggccaaccatagagaaagacgtggatttaggtgctggaacacgtcacgtaaatgcagaaccagaaaccccaaacatggacgtaattggcgagagaattaaacgtataaaagaagaacataattctacgtggcattatgacgacgaaaacccatacaaaacttgggcataccatggtagttacgaagtaaaggcaactggctcggcctcgagcatgataaacggtgtagtgaaactattaacaaagccttgggatgtagtacccatggtaacacaaatggcaatgacggacacaacaccatttggacaacagcgagtgttcaaagagaaagttgatacccgtaccccacggtcaatgccgggaacacgaagagtaatgggtatcacagctgaatggctgtggcgtactcttgggaggaacaagaagcccagactatgcacaagagaagaatttaccaagaaagttaggacaaacgcagctatgggcgcggtattcacggaggaaaatcaatgggactcagctaaagcagcggtggaggatgaagacttttggaaactcgttgatagggagcgtgaattacataaacttggaaaatgcggttcatgtgtttataacatgatggggaaaagagagaagaaacttggcgagtttgggaaagcaaaaggttccagagccatctggtacatgtggttaggtgcaagatatcttgaatttgaagccctaggatttctaaatgaggatcattggtttagcagagaaaactcatatagtggggtagaaggtgagggactacataaattaggatatatactaagagatattagtaagatacccgggggagcaatgtacgcagatgatactgcaggctgggacacacgaataacggaagacgatttacataatgaggagaaaattacacagcaaatggatccagaacatcgacagttagccaacgcaatctttaaattaacatatcaaaacaaggtggttaaggtacaaaggccaaccccgacaggcacagtaatggatatcataagtagaaaagaccaacgcggttcaggacaagtcggaacgtatggacttaacacatttacaaatatggaagcacaattaataagacagatggaaggagaaggagtactgtccaaagctgatttagaaaaccctcatttacccgagaagaaaataactcaatggttagaaacgaaaggagtagaacgacttaaaagaatggcgatttcaggagatgattgcgtcgtaaaaccaatcgatgatagattcgcaaacgcgcttctcgctcttaatgacatgggaaaagtacgaaaagatattcctcaatggcagccatcaaaaggatggcatgattggcaacaagtgcccttctgctctcatcatttccacgaactaataatgaaagatggacgcaagctagtagttccatgtagaccgcaagatgaacttatcggacgagctcgcatatcacaaggtgcaggatggagcttaagagagactgcgtgcttaggtaaagcctatgctcaaatgtggagcttgatgtactttcataggcgggacttacgccttgcatcaaacgctatatgttctgccgtaccagttcattgggtccctacgtcacggaccacttggtctatccacgcgcaccatcaatggatgaccactgaagatatgctaacagtgtggaacagagtttggatagaggataacccgtggatggaagataaaacccccgttacaacgtgggaaaatgttccatacctaggaaaacgggaggatcaatggtgtggtagtttaataggtctaacttctagagctacatgggcacaaaatatacctacagctatacaacaggttagatcattaataggtaacgaagaatttctagactatatgcctagtatgaagcgatttagaaaagaagaagaatcagagggagcaatttggtga

SEQ ID NO: 23247 - RNA, 9873 nt, synthetic construct
  misc_feature 1..9873: note = derived and/or modified CDS sequence (opt6) from DENV-3__KJ189256__SS-prME
  source 1..9873: mol_type = other RNA
acatctttatgcctgatgatgatattgccagcggcattagcgttccacttaacatcacgggacggagaacctcgaatgatagttggcaaaaacgaacgaggtaaatccttattattcaaaacagcatcaggaattaacatgtgtacactaatagcaatggacttaggagaaatgtgtgatgatacagtgacatacaaatgtccgcatattacggaagttgaaccagaagatatagactgctggtgtaacctaacttcgacttgggtaacttacggaacgtgtaatcaagccggtgaacataggcgggataaaaggtcggtagcattagctcctcatgtgggcatggggctcgacacacgcacgcaaacatggatgtcggctgaaggagcatggcgacaagtggaaaaagtagaaacgtgggcattgagacacccaggctttaccatacttgcgttattcctggcccattatataggcacatctctaacgcaaaaagtagtaatttttatcctcttaatgctcgtcacaccatctatgacaatgcgctgcgttggagttggaaatcgtgattttgtggaagggctatccggggcaacatgggtagatgtagtattagaacatggaggttgtgtgacaactatggcgaaaaataaaccaactttggatatcgaactgcagaaaactgaagcaacccaactagcaacattacgaaaactatgtatagaaggaaaaattacgaacataacaactgattccaggtgtccaacacaaggggaagctgtgttaccagaagaacaagatcaaaattatgtctgcaaacatacatatgtagatagggggtgggggaatggatgcggactcttcggtaaagggtcattggtcacatgcgccaaattccaatgtctcgaaccaatagaaggtaaagtcgtccaatatgaaaatctaaaatacactgtcataatcactgtgcatacaggagatcaacatcaagtcggaaatgaaactcagggtgtgactgcagaaattacaccacaagcaagcacaacagaagctatattacctgaatacggaacattagggctggaatgttccccacgaactgggctggattttaatgaaatgatactcctcaccatgaaaaataaagcatggatggtgcatcgccaatggttctttgatttaccattgccatggacaagtggagcaacgacagaaacgcctacttggaaccggaaagaattgttggttacatttaaaaatgcacacgctaagaaacaagaagtggtagtattgggtagtcaagaaggggccatgcatacagctctaactggagcaacagagatacaaaacagtggtgggacgagtatattcgctggacacttaaaatgtaggctaaaaatggataaactagaattgaaaggaatgagctatgcaatgtgtacgaacacattcgtgctaaagaaagaagtttctgagactcaacatggaacgattttaataaaagtagagtacaaaggtgaggacgttccatgcaaaatcccgttttcaacagaagatggacacggtaaagcacataacgggcgtttaataacagccaatccagtagtcactaagaaagaagaacccgtcaatattgaggcggaacctccttttggggaatcaaacattgtaataggtataggagataatgcattgaaaattaactggtataagaaagggagttcaattggaaaaatgttcgaggctacagcaagaggtgcaaggagaatggcaatactaggggacacggcatgggattttggctcggttggaggagtcttaaatagcctcggaaaaatggttcaccagatttttggctcagcatacacggcccttttcagtggagttagttgggtgatgaaaatagggatcggagtactcctcacttggataggactcaactctaaaaacacaagtatgagtttttcgtgcatcgctataggtatcataaccctatacctgggcgctgttgtccaagctgacatgggttgtgtcataaactggaaaggtaaagaactgaaatgcgggagcggtatcttcgttacgaacgaagtgcatacctggacggaacagtataaattccaagcggatagtccaaaaaggttagctactgccattgctggggcttgggaaaacggtgtatgcggaataagatcaaccacgcgaatggagaatctcttatggaaacaaatagccaacgaactgaattatatattatgggaaaataacattaaactaaccgtagtagtgggcgacataataggagtgctggagcaaggtaaaaggacccttactcctcaaccaatggaattgaaatatagttggaaaacttggggaaaagctaaaatcgttacggctgaaacacaaaacagctcatttatcattgacggtccaaacacaccggaatgtccatccgcttcaagagcttggaatgtatgggaagttgaagactatggatttggggtattcacaacaaatatatggttaaaattgcgggaagtatacacacagctctgtgatcatcgactaatgagcgccgccgtaaaagatgaaagggcagtgcacgctgatatgggttactggattgagtcacagaaaaatggatcatggaagctcgaaaaagcctccctaatagaagtaaagacgtgcacatggccgaaatcacatacactgtggagcaatggagtcctagaaagtgatatgataataccgaagtcgttagctgggccaatctctcaacataaccaccgccctggttatcatacccagaccgctggaccatggcatctcggcaaactagagttagatttcaactactgtgaggggacaacagttgtcattacggaaaactgtggaactagggggccatccctccgaacaacaaccgttagtggaaaacttattcatgaatggtgttgtcgctcatgtacgctccctcccctgaggtacatgggcgaagatggatgttggtatggcatggaaataagacccatatcagaaaaagaagaaaacatggtgaaatctttagtttcagcaggttcaggtaaggtggataatttcaccatgggtgttttgtgtttagcgatactgtttgaggaggtaatgagaggtaaatttggaaagaaacacatgatagcgggagtcttcttcacatttgtattgctattatcagggcaaataacatggagagatatggcacatacgctcattatgataggatctaatgcaagcgatcgtatgggtatgggtgtgacctacttggcactaattgccacctttaaaatacaaccatttcttgccttaggattctttttaagaaaattaacttcaagagaaaatttattattaggagttggtctagccatggcaacaacccttcagctacctgaggacattgaacaaatggcaaatggaatcgctctgggtcttatggctctcaaattgataacacaatttgaaacatatcaattgtggaccgctttaataagtcttacctgctcaaacacaatattcacacttacggtggcgtggcggacagcaaccctaatacttgctggagtaagcctgttacctgtatgtcagagttcatcaatgaggaaaactgactggctcccaatggcagtagccgcaatgggagtcccaccactaccgttattcatcttctctcttaaagacacattgaagcgacgtagttggccactcaatgaaggagtaatggcagtaggattagtgagcatccttgcgagcagcctacttaggaatgatgtacctatggccggacctttggtagcagggggactgctgatcgcttgttacgtaattaccgggacatccgcagacttgacagtcgaaaaagcggcagatatcacctgggaggaagaagctgaacaaaccggggtatcgcacaatcttatgataactgtcgatgatgacggtacaatgcgaataaaagacgatgagacagagaacatcctcacggtcttactgaaaacagcgctgttgatagtgagcggaatatttccctatagtataccagcaacacttctcgtttggcatacttggcaaaaacaaacgcaaagaagcggcgtcttatgggatgtgcctagtccacccgaaactcaaaaggcagaattagaagaaggcgtataccggattaaacagcagggaatatttggcaagacacaagtcggtgtgggagtacaaaaagaaggtgtattccacacaatgtggcacgtaacaaggggcgccgtattaacatataatggcaaaaggctggaacctaactgggcttcagtgaagaaagatttgatttcgtacggaggcggttggaggttaagtgcacaatggcaaaaaggagaggaagtccaagtaatagctgtagaacctggcaaaaatcccaaaaattttcagacaatgccaggaaccttccaaacaacgacaggggaaataggcgcaatagctcttgacttcaagccaggcactagcggttccccgattataaacagagaaggaaaagtcgttggactgtacggtaatggagtagtaactaaaaacggaggatatgtctctggtattgcacaaacgaatgcagaaccagatggaccaacaccagaactagaagaagagatgtttaagaaaagaaacttaacaataatggatctgcatccaggatccggcaaaactagaaaataccttcctgcaattgtgagggaggcaattaagcgacgattaagaacattaattttagccccaacaagagtagtggccgcagaaatggaggaagcattaaagggattaccaatccgatatcaaactacagctacaaaatccgagcacacgggacgcgaaatagtggacctaatgtgccacgcaacatttacaatgcgcctattatcaccagtccgagttccaaattacaatttgataataatggatgaagcacattttactgaccctgcaagtatagcggcaagaggatacataagcacaagagtaggtatgggtgaagcagctgcaatttttatgaccgcaacaccccctgggacagctgacgcctttccccagagtaacgccccaattcaagatgaggaacgagatattcccgagcgaagttggaactctggaaatgaatggattacggattttgccgggaagacagtttggtttgttccgtctatcaaagcaggtaatgatatcgcaaactgtctcaggaaaaatggtaagaaagtcatccaactctcacgtaaaacctttgacacggaatatcagaaaactaaattaaatgattgggatttcgtagtaacaactgacatttcagaaatgggcgccaattttaaagctgaccgggtaatcgaccccaggagatgtttaaaaccggttattttgactgatggtccagaacgcgtaatccttgccggtcccatgccggttacagctgctagtgcggcccaaagaagagggcgcgtaggcagaaacccccagaaagaaaatgaccaatatatattcactggacaacctttaaataacgacgaagatcacgcgcattggacagaagcaaaaatgttattagataatattaacacgcctgaaggaattataccagccctatttgaacctgaacgcgagaaaagtgccgcaattgacggagaatacagacttaagggcgaatctcgaaaaacgttcgtagaactaatgaggcgcggagacttacctgtttggttggcccataaagtagcatcagaaggaattaagtacaccgacagaaaatggtgttttgatggtcaacggaataatcagatattggaagaaaacatggatgttgaaatatggacaaaagaaggcgagaagaagaaactacggccgagatggttagacgccagaacttatagcgaccctctagccctcaaagaatttaaagattttgccgctggtcggaaatcaattgcactggatctcgtgactgaaattggaagagtaccatcgcacctggcacaccgaaccagaaatgcactagacaacctagtaatgctacatacaagtgagcacggtgggagagcgtatcgacatgccgttgaggagctccccgaaacaatggaaacccttttattgctaggactgatgatactccttacaggtggagctatgctttttcttatcagcgggaaaggaatcggcaaaacatcaattggattaatatgcgtcatagcctccagcggaatgttatggatggcagaaatacctttacaatggatagccagtgcaatagtactagagttctttatgatggtattactaatccctgaacctgaaaaacaacggactccccaagataaccaattagcatacgttgtaattgggatattaactctagcagctataatagccgcaaatgaaatgggtcttctggaaacaactaaacgtgatttaggaatgagtaaagaaccgggggtagtcagtccgacttcatatctcgacgtagacctacacccagcttctgcttggacactatatgccgtagcaacgactgttataacccctatgttaaggcataccatagaaaatagcacggctaacgtatccctcgctgctatcgcaaatcaagcagtagtactaatgggattagataaaggatggcctatctctaaaatggacttaggtgtacccttattagcattgggttgttattcgcaagtgaatcctttaacattgacggctgcagtactcctcctaataactcattacgcaattattggtccaggactccaagcaaaggcaacaagagaggcacaaaaacggacagcggcaggtattatgaaaaatcccacagtagacggcataatgactattgacctagatccagtaatttatgacagtaaatttgaaaagcagctgggtcaagttatgttgctggtcctgtgtgcagtacagttattactgatgcgaacatcatgggccctatgcgaggcattaacattagccaccggccctattacgacactatgggaaggaagtccaggtaagttttggaatacgactatagcagtttcaatggctaatatttttcgaggatcttatctagcaggagcgggattggcttttagtatcatgaaatcagtgggcacaggaaaaagaggcacaggaagccagggtgagaccctaggagaaaaatggaagaagaaactaaatcaattatccagaaaagagtttgacctctataagaagtctggtattactgaagtggataggacggaggcaaaggaaggcttaaaaaggggagaaattacacaccacgcagtaagccgaggaagcgcaaaattacaatggttcgtcgaacgaaatatggtaattccagaaggacgcgtaattgatttaggatgcggtcgaggaggatggagctattattgtgccgggctgaagaaagtaacagaagttagaggatacacaaaaggagggccaggacatgaagaaccagtccctatgtcaacttatggttggaacattgtcaaattaatgagtggtaaggatgtattttatctgccacctgaaaaatgtgacacgttattgtgtgatattggggagagctcaccttcaccgacagtagaagagtcgaggacgatcagggtgttaaagatggtcgaaccctggctaaagaacaaccaattctgcatcaaagttctaaacccctacatgcctactgtaatagaacacttagagcgacttcagagaaaacatggagggatgctagtccgcaatccactaagcaggaatagcacccatgaaatgtattggatatccaatggtacagggaatatcgtcgcaagtgttaacatggtttccagattactactaaaccgatttaccatgacccatcggagaccgaccatagagaaagacgtagatttgggagctggaacaagacacgttaacgcggaaccagaaactccgaatatggatgtaattggtgaaagaattaaaagaattaaagaagaacataatagtacctggcactacgacgacgagaatccttataaaacgtgggcataccatgggtcctacgaggtaaaagcaacgggatcagcaagtagtatgataaatggcgtagttaaactgttaacgaagccatgggacgtcgttccaatggttactcaaatggccatgacagacactactccgttcggacaacaaagagtatttaaggagaaagtcgataccaggacaccaaggagtatgcccggcacaagaagagttatggggataacagcagaatggttgtggagaacattaggtcgcaacaaaaagccacggctttgtacgcgcgaagaatttaccaagaaagtcagaacaaatgcagctatgggcgcagttttcactgaagaaaaccagtgggactcagccaaagcggcagtcgaagatgaagatttttggaaattagtggatagggaaagagaactacacaagctcggtaaatgtgggtcttgcgtttataatatgatgggtaaaagagagaagaaattaggagaatttggtaaagctaaaggttcaagggcgatatggtatatgtggctgggtgcccgttacttagaatttgaagcactaggatttttgaatgaagatcattggttcagtagagaaaatagttatagtggagtcgaaggggaagggctccacaaactgggttatatattacgtgatatttccaaaatcccaggtggggccatgtatgcagacgatacggcaggttgggacacaagaattactgaagatgatctacataatgaggagaaaatcacgcagcaaatggatccagagcacagacaactagccaatgcaatattcaaactaacctatcaaaataaagtagttaaagtgcagcgtccaacaccgactgggacagtcatggatatcatctctcgtaaggatcagagaggttccggacaggtaggtacctacgggttgaacactttcaccaacatggaagctcagctaattagacaaatggaaggtgaaggagtactatcgaaggccgatttagagaatccacacctaccagaaaagaagatcacacaatggctagaaacaaaaggtgtggaaagacttaaacgcatggctataagtggagatgactgtgtagtcaaacccatcgatgatagattcgccaatgccttattagcccttaacgatatgggcaaagttaggaaagacataccgcagtggcaacccagtaaaggttggcatgattggcagcaagtcccattttgttcccaccattttcatgaactaatcatgaaggatggcaggaaactcgtcgtaccatgcagacctcaagatgagctcatagggagagctagaattagtcagggcgcaggctggagtttgcgtgaaaccgcctgtttgggcaaagcctatgcccaaatgtggagtctcatgtacttccatagacgggatttacgattagcatccaacgcgatatgcagtgcagttccggtacattgggtcccaacaagcagaacaacgtggtcaatacatgcacaccatcaatggatgactacagaggatatgcttacagtttggaaccgcgtatggatcgaagataacccgtggatggaagataaaacaccagtaacaacctgggaaaatgttccatatttgggcaaaagagaagatcaatggtgcggatctctcattggtttaacaagtagggccacatgggcacaaaatatcccaacagcaatacagcaagttagaagtctcataggtaatgaagagttcctagattacatgccaagcatgaaacgttttcggaaggaagaagagtcagaaggcgctatttggtaa

SEQ ID NO: 23248 - RNA, 9873 nt, synthetic construct
  misc_feature 1..9873: note = derived and/or modified CDS sequence (opt6) from DENV-3__KJ189257__SS-prME
  source 1..9873: mol_type = other RNA
acaagcctgtgtttgatgatgatactgcccgctgccttagcattccatttaacctcaagagacggtgaacccagaatgattgtaggcaaaaacgaaagggggaagtcgttattattcaaaacagcatcaggcatcaatatgtgtacattaatcgcaatggatctaggtgagatgtgcgatgacactgtcacctacaaatgcccccacattacagaggttgaaccagaagacatcgattgttggtgcaatttaacctctacgtgggttacatatggaacatgtaatcaagcaggggaacatagacgtgataaacgaagtgtagctttagcaccacatgtaggaatggggttggatacccgaacacaaacttggatgtcggcagagggtgcctggcgtcaagtcgaaaaggtagaaacctgggccttgcgacaccccgggtttacaatcctcgctttgtttctagcacattatatagggacgagtctaacgcagaaagtagtaatctttatattattgatgcttgttacgcccagcatgaccatgagatgcgtaggcgtgggcaacagagattttgtagagggactgagcggagcaacatgggtagacgttgtattagaacacggtggctgtgtaaccactatggctaagaacaaaccaacacttgatatagagctgcaaaaaacggaggcaacgcaactggcaacattaagaaaattgtgcatagagggaaagataacaaatataactaccgatagtcgatgccccacacagggagaagctgttttaccagaagaacaagaccaaaattatgtgtgcaaacacacatacgttgaccggggatggggaaacggctgcggacttttcggaaagggcagccttgtaacctgcgctaaatttcaatgcctagaaccaatagaaggcaaagtcgtccaatacgaaaatctgaaatacactgtcattattacagtgcatacaggcgatcaacaccaagtaggtaatgaaacacagggagttaccgcggaaataacaccacaagcgtcaaccactgaagctatattaccggagtacggaacattgggattagagtgcagcccacggacaggcctcgattttaatgagatgatactattaacgatgaaaaataaagcgtggatggttcacaggcaatggttttttgacttacctttaccatggacaagcggcgcaacgacagaaacgcccacttggaatcgaaaagaattactagtaactttcaaaaacgcacatgccaaaaaacaagaagtagtcgtgttaggatcgcaggaaggggcaatgcacacggcgctgactggagctaccgaaattcaaaatagtggaggtacttcaattttcgcaggacaccttaagtgtcgattaaagatggataagttagaacttaaaggaatgtcatacgcaatgtgcacaaatacatttgtcttaaaaaaagaagtatctgaaactcaacatggaacaatattaataaaagtcgaatataaaggcgaagacgtaccatgcaaaattcctttttcaactgaagatggacatggtaaagcccataacggacgtttaataacagcaaatccggtagttacaaaaaaagaagagccagtcaatatcgaagcagaaccacccttcggcgaaagtaatatagtaataggaatcggagataatgcacttaaaattaactggtataaaaagggcagttctataggtaagatgtttgaagcaacagctcgaggtgcgaggagaatggccattttgggagatacagcatgggattttggttctgtaggaggagtcctgaactccttaggcaaaatggttcaccagatattcggaagcgcctatacggctttattcagtggagtctcgtgggtaatgaaaattggcattggagttctattaacttggatcggattaaactcaaagaatacttcaatgtctttctcatgtatagctattggaataataactctttaccttggagcggttgttcaggcagacatgggatgtgtgattaactggaaaggaaaagaacttaaatgtggctctggtattttcgtaactaatgaagtacatacgtggaccgagcaatataaatttcaagctgattcgccgaaaagattagcaactgctattgctggagcttgggaaaatggagtatgcggaataagaagtaccactaggatggaaaatttgttgtggaagcagatagcgaacgaattaaactatatattatgggaaaataatattaaattaacggtagttgtaggagacattataggtgttttagaacaaggaaagcgtactttaaccccccagcctatggagttaaaatattcgtggaagacatggggaaaagcaaagatagttactgcagaaacacaaaatagtagtttcataatagatggaccaaacacaccagaatgcccttccgcatccagagcttggaatgtatgggaggtagaagactacgggtttggggtatttactacaaatatatggctgaagttacgtgaggtctacacccaactttgtgaccaccgacttatgtccgcagcagtaaaagacgagagggcagtgcatgcagacatgggatattggatagaatcccaaaagaatggatcctggaaactagagaaagctagcttaatcgaagtgaaaacttgtacatggccaaaaagtcataccctatggtcaaatggggtactagaatccgatatgataataccgaaatcactcgcaggccccatttcacaacataatcaccgcccgggctaccacacccaaaccgcgggaccatggcatttgggtaaacttgaattagatttcaattattgtgaagggacaacagtagtaataacggaaaattgcggaacaaggggaccatctctgcgaaccacaactgttagtggaaaactcatacatgaatggtgctgcaggtcttgtacactacctcctttaagatacatgggggaagacggttgctggtacggtatggaaatccgtcctataagtgaaaaagaagaaaacatggtaaaaagtttggtgagtgcaggatcaggaaaagtggataactttaccatgggggtgctctgcctcgctatcttgttcgaagaagtaatgagaggtaaattcggaaagaaacatatgatagccggagtatttttcacgtttgtcctacttttgagtggccaaataacttggcgggacatggcgcacacattaataatgatcggatcaaatacgagtgacaggatgggaatgggggttacctacctcgcactcattgccacattcaaaattcaaccttttttagctctagggttcttcttacgaaaactaacatcgagggagaacctattactgggtgttggtctggcaatggcaacgacattgcagcttccagaggatatagagcaaatggcaaacggaattgctctcggcctgatggcgctgaaattaataacgcagtttgaaacttaccaattgtggacagcactaattagtttaacatgttcaaacactatcttcactctaacagtagcctggcgaacggctactcttatcctagctggcgtttcactattacccgtatgccaatcaagttccatgagaaaaactgattggctaccaatggcggttgcagcaatgggtgttccaccattacccctttttattttttcattgaaggacactctaaaaagaagaagttggcccttgaacgagggagttatggctgtaggattagtttctatattagcgagtagcctattaaggaacgatgttccaatggctggcccattggtagctggaggactactaatagcatgctatgtaattacaggtacctcagccgacttaaccgtagagaaagcagcagatatcacgtgggaagaagaggcagagcagactggggtaagccacaatctcatgataacggtggacgatgatggcacaatgcgaataaaggacgatgaaacggaaaacatcctcacagtcttactgaaaactgcacttctaattgtatctgggatatttccatatagtatcccagcgacccttttagtctggcacacatggcaaaagcaaacacaacgctcaggcgtattatgggacgtcccatctccaccagagacgcaaaaagcggaactagaggagggcgtgtatcggataaaacaacaaggaatttttgggaaaacgcaggtgggagttggtgtacaaaaagaaggggtttttcatacaatgtggcatgtcacaagaggtgcagtgctaacgtataacggtaagaggcttgaacctaattgggcatccgttaaaaaagatcttatatcttacgggggaggatggagactaagcgcccaatggcagaaaggagaagaggttcaagtcatcgcggttgaacccggtaaaaatccaaaaaacttccagacaatgccgggcacattccaaactacaacaggagagataggcgcgatagctcttgactttaaaccaggaacatcaggaagtcccataataaatcgcgaaggtaaagttgttggactatatggaaacggagttgtaactaaaaatggtgggtatgttagtggcatagcgcaaactaacgccgaacctgatggcccaacacccgaactagaagaagagatgttcaaaaaaagaaatttgaccataatggatcttcatcctggtagtggtaagaccagaaaatatctcccagctatagttagggaggccataaaaaggcgcctacgcacattaatactagcaccaacaagagtggtcgcagctgaaatggaagaagccttgaaaggtctacccattcgttaccaaacaaccgcaaccaaaagtgaacatactgggagagaaatcgttgaccttatgtgtcatgctacatttaccatgaggttactatcacctgtacgggtaccaaattataacttaatcataatggacgaagctcattttacagatccagcaagtatcgctgctagaggatacatctctacgcgtgttggaatgggcgaagctgccgcaattttcatgacggcaacaccaccaggcactgctgacgcatttcctcagagcaatgcgccaatacaagacgaagaaagagacatccccgaacgatcatggaacagcggtaacgagtggattaccgattttgcaggcaaaaccgtttggtttgttccgtctattaaagcgggaaatgacatagccaactgcttacgtaaaaacggcaaaaaagtcattcaactaagtaggaaaacattcgataccgaataccaaaaaactaagctaaatgactgggattttgtagtaacaactgacatatcagaaatgggagctaacttcaaagcagacagagtgatcgaccccaggcgatgtctgaaaccagttatattaacagatggcccagaaagagttatcttggcgggaccaatgcctgtaaccgcagcttccgcagcacagcgtcggggtagagtgggtcgtaaccctcagaaggaaaacgatcaatatatttttaccgggcaacctctgaacaatgacgaagaccatgctcactggacagaagcaaagatgttattagataatattaataccccggaaggtataataccagctctcttcgaacctgaacgggagaaatccgctgccatagatggtgaatacaggctaaagggagaatcgagaaaaacgtttgtggaactcatgagacggggagaccttccagtttggttagcacataaagttgcctcagaaggcataaaatatactgatagaaaatggtgctttgatggacaacgcaacaaccaaattttagaagaaaacatggatgtagaaatttggactaaggaaggggagaagaaaaaattaagaccaagatggctagatgctagaacatattcagatcccttagcgttgaaagaattcaaagattttgcggcaggaagaaaatcgatagccctcgacttggttactgagattggaagagtaccatcacatctagcccatagaaccaggaacgcattggacaatttggtaatgttacacactagtgaacacggaggaagagcatataggcatgctgtggaagaattacctgaaacgatggaaactttactattattagggctgatgattctgctgactggtggcgcaatgctttttctcatatctgggaaaggcataggaaaaacaagcattggcttaatatgcgttatagctagctcaggaatgttatggatggctgagataccattacaatggatagcgagtgcaatcgttttagaattctttatgatggtcctactgatcccagagcccgaaaagcaacgcacaccgcaagataatcaattggcgtacgtagtaatcggtattcttacattagcggctattatcgctgctaatgagatgggactactagaaacaactaaaagagatcttggaatgtcaaaagaacctggagtggtatcaccaacatcatatttagacgtggatctccatccagctagtgcctggacactatacgctgtggcgactacagtaatcacgccaatgttgcgacatactatagagaattcaaccgcaaacgtgtcactagctgccatagcaaaccaagcggtggtattaatggggttagacaaaggatggccaatatcgaagatggatttaggagtgcctcttttggccctcgggtgttatagccaggtgaatccgttgacactaacggcagccgtcttcctcttaatcacacattatgcgataattggcccggggttgcaagcaaaagccacaagagaggcacaaaagagaactgcagcgggtataatgaaaaaccctactgtagatggaattatgaccatagatttagatcctgttatctacgactctaaattcgaaaaacaactcgggcaggtaatgttacttgtactatgcgccgttcagctccttttaatgcggaccagctgggctttgtgcgaagcgctaacactagcaacgggaccaattactacactatgggaagggtcccccggtaagttttggaacacaactatagcagtttcaatggctaacatattcagaggttcttatctcgcgggcgctggattggcctttagtataatgaaatcagttggtacgggcaagcgaggtaccgggtcacagggagaaactttaggagagaaatggaaaaagaaactcaaccagctatctaggaaagagttcgacctatataaaaaatccggaataacggaagttgatagaaccgaagcaaaagaaggactcaaacgaggagaaataacacatcacgcagtgagtagaggaagtgcaaagctacaatggttcgttgagcgaaacatggtcatacctgaaggacgggtaatagacttaggatgtggccgtgggggctggtcttattattgtgcgggactaaagaaagtcaccgaagtccgaggctatacaaaaggagggccaggacacgaggaaccagtcccaatgtcaacatacggatggaatatagttaaattaatgagtgggaaggacgtgttctatctacctccagaaaaatgcgatacgctattatgtgatataggtgagtcctcgcctagtccaacagtagaagagtcacggacgatccgcgtattgaaaatggtcgagccatggctcaagaataatcagttctgtattaaagtactaaacccatatatgccaacggtcatagagcacttagaaagactgcagcggaagcacggaggcatgcttgtccgcaacccactgtcaagaaatagtacccatgaaatgtattggatctcaaatggcacagggaacatagtagctagcgtcaatatggtaagcagattgttattgaatagatttaccatgacacatcgtcgacctactattgaaaaggatgtagacctaggggctggcacacgccacgttaacgctgaacccgaaacacccaatatggatgttataggcgagcgtataaaacgaatcaaagaagaacataattctacctggcattacgatgacgaaaacccctacaaaacctgggcttatcacggttcctatgaagtgaaagctacgggatctgcttcctctatgataaacggagtggtaaagttgcttacaaaaccatgggacgtagtaccaatggtgactcaaatggcgatgacagatacaacacccttcggacaacaacgtgtttttaaggaaaaggtggatacaagaactccaagaagtatgcccggaacgcgaagggttatgggaattaccgcagagtggttatggagaactctggggaggaataaaaagccccgcttatgtaccagagaagaattcactaagaaagtaagaacaaatgcagcaatgggcgcagtattcacggaagaaaatcagtgggacagtgcgaaagcagcggtcgaagatgaagacttttggaaattggttgatagggagcgagaacttcacaagctgggaaagtgtgggtcttgcgtatacaacatgatgggtaagagagaaaagaaattaggcgaattcggtaaagccaaaggatcgagggcaatctggtacatgtggcttggggcgcgatatttggagtttgaagccttgggttttttaaatgaagatcactggttctctcgagaaaacagctattccggagtggaaggtgagggtctgcataaacttggttatatattaagggacatatcgaaaataccagggggtgcaatgtacgcagatgacacagctggttgggatacaagaataacagaagatgatttacataacgaggaaaaaataacacaacaaatggaccctgaacaccgtcaactagcgaatgctatttttaaactgacgtatcaaaacaaagtagttaaggttcagagaccgacacctactggtactgttatggacatcatatcaagaaaagatcaacgaggcagcggacaggtagggacatatggtctgaatacgtttactaatatggaagcacaattgataagacaaatggaaggagaaggagttttaagcaaagcagatttagaaaaccctcatctacctgagaaaaagattactcaatggctagaaactaagggggtagaaaggctaaaaaggatggcaatatccggagacgattgcgtcgttaaacctattgatgaccggttcgcaaacgccctacttgcattgaatgacatgggaaaagtacgaaaagacataccacagtggcaaccctcgaaaggatggcatgattggcaacaagtaccgttttgttcacatcatttccacgaattgataatgaaagacggtcgaaaattagtggtaccatgtagaccacaagacgaacttataggcagagctagaataagccaaggcgctggatggtcgttacgagagacggcctgcttaggaaaagcatacgcgcaaatgtggtcattaatgtatttccatcgtcgcgaccttagactggcgtccaacgccatctgctcagccgtaccggtacattgggttccgacatctaggacaacctggtccattcacgcacaccaccaatggatgacaactgaggatatgctaacagtttggaatcgagtctggattgaagacaatccctggatggaggacaaaaccccggtgacaacatgggaaaacgtgccttatctaggcaagagagaagaccaatggtgtggatcgctgatagggttgacatcgcgcgcgacctgggcacaaaatataccaacagctattcaacaagtaaggtccctcattggcaatgaagaattcctagattatatgcccagcatgaagaggtttaggaaagaagaagaatcagaaggtgcaatttggtag

SEQ ID NO: 23249 - RNA, 9873 nt, synthetic construct
  misc_feature 1..9873: note = derived and/or modified CDS sequence (opt6) from DENV-3__KJ189262__SS-prME
  source 1..9873: mol_type = other RNA
acaagtctttgcctaatgatgatattacccgctgcattagcatttcacttaacgtctagggacggagaaccaagaatgatcgtgggcaaaaatgaaagggggaaatcgctgttatttaaaaccgcatccggtattaacatgtgtaccctaatcgccatggatttaggagaaatgtgcgacgacaccgtgacatataaatgtccacatatcactgaagtagagccggaggatatagactgttggtgtaacttaacgtcaacctgggtaacatatggcacctgtaatcaagctggagagcaccggcgagataaaaggtcggtagctctagcgccccacgtaggaatgggattagataccagaacacaaacttggatgagtgcggagggagcatggcgtcaagttgaaaaagtagaaacatgggcacttcgacatccaggattcactatactcgctttatttctagcgcattatataggaacatccctaactcaaaaagtagtcatatttatcttacttatgttagtaaccccaagcatgactatgagatgtgtaggggtaggtaaccgtgattttgtcgaaggattatcaggtgcaacatgggtagatgtcgtactagagcatggaggatgtgttacaactatggctaaaaacaaaccgacattagatatagaattacagaaaacagaggcaacgcaattggctacattgaggaaactatgcattgaaggaaaaataacgaatattacgacagatagcagatgcccaacgcaaggggaggctgtactgcctgaagaacaagatcaaaactatgtatgtaaacatacatatgtagatcgcggttggggaaacggatgtggactatttggaaaaggtagtctagtaacatgtgcaaaattccaatgcttagaaccaatcgagggcaaagtagtccaatatgaaaatttgaaatacaccgttataattacggtacacaccggcgatcagcaccaagttggcaacgaaacccaaggcgtaacagcggagattactccccaagcctctacaacggaagccatattgccagaatatgggacgctaggtctagaatgcagtcctagaacgggtctagatttcaatgaaatgatcctcctgaccatgaaaaacaaggcttggatggtccataggcaatggttctttgatctcccacttccttggacaagtggcgctaccactgaaacaccgacatggaatcgaaaagaactgctggtcacatttaaaaacgcacacgcaaagaaacaagaagtagtcgtgttgggtagtcaagaaggagcaatgcacacagctcttaccggcgctacagaaattcaaaattcgggcggcacctctatatttgcaggacatctaaaatgtaggctaaaaatggacaaactagagttaaaaggcatgtcgtatgccatgtgtacgaacacctttgttttaaagaaagaagtctcagaaacacaacatgggactatcctgatcaaagttgagtacaaaggcgaagacgtgccatgtaaaatccctttttcgactgaggacggccacggaaaagctcataacggaagactaataaccgcaaatccagttgtgacgaagaaagaagaacctgttaacattgaagccgaaccgcccttcggtgaatcaaatattgttattggcatcggagataatgcactcaaaataaattggtacaaaaagggatcaagcatcggtaaaatgttcgaggccacagcacgaggcgcacgcaggatggctatccttggagacacagcatgggatttcgggagtgtcggaggggttttgaactcattaggaaaaatggtacaccaaatatttggaagcgcctatactgcattattctcaggagtcagttgggtaatgaaaataggaatcggtgtgttattaacttggataggcttaaacagtaaaaatacatcaatgagcttcagttgcatagctatcggaataataactctttacctcggtgcggttgtacaggccgacatgggctgtgtgataaattggaaaggcaaagaattaaagtgcggaagtggtatttttgtaacgaacgaagtacatacatggacggaacaatacaagtttcaagccgattcaccgaaaaggcttgcaacagcgatagccggagcatgggaaaacggtgtatgtggtatccggtcgacaacccgtatggagaaccttttatggaaacaaattgcgaatgaactaaattacatcttgtgggaaaataatataaagttaaccgttgtcgttggtgacatcataggggtactagagcaagggaaaagaacactaactcctcagccaatggaactaaaatactcctggaaaacatgggggaaagctaaaattgtaacagcggaaactcaaaatagtagctttataatagatggtcccaacacgccagaatgcccttctgcgagtagagcatggaacgtgtgggaagtggaggactatggcttcggggttttcaccacaaacatctggttaaaattacgggaagtctatactcaactttgcgaccataggttaatgtcagctgctgtcaaagacgaacgtgccgttcatgcagatatgggatactggatagagtcacagaaaaacgggtcatggaagctcgaaaaagcatcgctgatagaagtgaagacctgcacttggccgaaaagccacaccctctggtccaatggtgttttagaatccgatatgataattccaaagagcctagcgggacctatatctcaacacaatcataggccggggtaccatacgcaaacagcaggaccatggcatttaggtaagctggagttagattttaactattgcgagggaactacagtggtaatcacggaaaattgcggaacgcggggcccgtcactccgcacaactacagtttctgggaaattaatacatgagtggtgttgtcgaagttgcacactaccaccactcagatacatgggagaagacggatgttggtatggtatggagatcagaccaattagtgagaaagaagaaaacatggtcaaaagtcttgtgtctgcaggaagcgggaaggtagataatttcacgatgggagtgctatgcctcgcaattctattcgaagaggtaatgagaggtaaatttggcaagaaacatatgatcgctggagtatttttcacgtttgtactactactctcgggtcaaatcacatggcgagatatggcccatacattaatcatgataggttcaaatgcatcagataggatgggtatgggggtaacatatctagcactaatagcaacattcaaaattcaaccgtttctagcgttgggcttctttctaaggaaactaacaagtcgggaaaacctcttgctcggagtgggtctagcaatggctacgactttacaattacctgaagatattgagcaaatggcaaatggaatagcgttaggattaatggccctcaaactaataacgcagtttgaaacatatcagctgtggacagcattgatctccctaacatgctctaatactattttcacattaactgtagcgtggagaacagccacattaattcttgcaggagtatcactcttaccagtatgtcaaagcagcagtatgcgtaaaaccgattggctacctatggcggtagccgcgatgggtgttcctccactgccattatttatatttagtttaaaggacacactaaagagacgaagttggccacttaatgagggcgtcatggcagttggcttagtaagcatacttgcgagttcgctccttaggaacgacgtacctatggcaggccctcttgtagcaggaggcctcctaattgcttgttatgtaataacaggtacgagcgccgacctgaccgtggaaaaagcagcagacatcacatgggaagaggaagcagagcaaacaggggtgtcacataatcttatgataacagtggatgacgacggaaccatgcgaattaaagacgacgaaacagaaaatatattaactgtcttgctcaaaaccgcactattgattgttagtggtatttttccatactcgatccccgccaccttactggtatggcatacgtggcaaaaacaaacccaaagaagcggagtactttgggatgttccatcgccaccagaaactcaaaaagcagaacttgaggaaggtgtttatcggattaaacaacaggggatttttgggaaaactcaagtcggtgtgggcgttcaaaaagagggagtattccatacgatgtggcatgtgaccagaggtgccgtcttaacatataacggcaagaggttagaaccaaactgggcatcagttaagaaagatttaataagttatggcggagggtggcggttaagtgcacaatggcaaaaaggggaagaagtacaagtaattgcaatagaacccggtaaaaaccccaaaaatttccaaacaatgcctgggacattccaaacaacaacaggtgaaattggagccatagcactggatttcaagcctggtacttcaggttcgccaataattaatcgcgagggaaaagtcgtaggactctacggaaatggagtagttaccaaaaatggtggctatgtatcgggaatagctcaaacaaacgcagaaccagatggtccaactccagaactcgaagaagaaatgttcaagaaacgaaacttaaccataatggatttacacccaggttcgggaaagacaagaaaatatttaccagcaatagtcagagaagctataaagcgcaggttacgtaccctaattctggctccaactagggtggtagcagcggaaatggaagaggctttaaaggggctacctattcgctatcagacaacagcgactaaaagcgaacatacgggccgagaaatcgtagacttgatgtgtcacgcaacgttcacgatgcgtttattatctcccgttagggtcccaaactataatctcataataatggacgaagctcactttacggatccggcttctattgccgcgagggggtacatttcaacaagggtcggcatgggagaggccgctgctatttttatgacagccacccctcccggtaccgcagacgcattcccacaatcaaatgcacccatacaagacgaggaaagagacataccggaacgatcctggaatagcggaaacgaatggataaccgactttgctggtaaaactgtatggtttgttccaagtattaaagccggtaacgacatagctaattgtttaaggaaaaacggcaagaaagtgattcaattatccagaaagaccttcgatacggagtaccagaagaccaagctaaatgattgggattttgtcgtaacgacagatataagtgaaatgggggcaaattttaaggcagacagagtcatagacccaagacgttgtttaaagcctgttatattaacagacggcccagaaagagtaatcttggccggaccaatgcccgttacggcggcatcggcagcccagcggaggggtagagtaggaaggaacccccaaaaagagaatgatcaatacattttcactggtcaaccattaaataatgacgaagaccatgctcattggaccgaggcaaaaatgttactggataatataaatacaccagaaggaattataccggctttattcgagccggagcgggaaaaatctgctgccattgatggcgaatatcgattaaaaggggagtcgaggaaaacgttcgtagaactaatgaggcgaggggatttgccagtttggttagctcacaaagtagcttctgaaggtattaaatataccgatcgaaagtggtgtttcgacggacaacgcaataatcagatcttagaggagaacatggacgttgaaatttggacaaaggaaggcgagaaaaagaaactacgaccaagatggcttgacgctcgaacgtattccgatcccctggcgttgaaagagtttaaagactttgcagcaggaaggaaatcaatagctctcgatctggtgactgaaataggaagagttccatcccatcttgctcacagaacccgtaatgcattagataaccttgtaatgcttcatacgtccgaacacggagggagagcttatcgacatgctgttgaggaacttccagaaactatggaaacattgcttcttctgggattaatgattttgctcaccggtggagccatgttatttctgataagtggtaaaggcatagggaaaacctcaatagggcttatatgcgtcatagcatcttcggggatgttatggatggccgaaatcccgcttcaatggatcgctagtgcaattgtacttgagttctttatgatggtactgttaataccagaacccgaaaaacagcgaaccccacaagataaccagttagcttacgtagtaatagggatactaacattagctgcgattattgccgcaaatgaaatgggattgctagaaacaacgaaacgtgatttagggatgtccaaagaaccaggagttgtgagccctacaagttatctggacgtcgacttacatcccgctagcgcctggacactgtatgcagttgcgacaactgtaattacaccaatgctacgccacactattgaaaactctactgcgaatgtcagcttggccgctattgcgaaccaagccgtagtgctcatgggcttggacaaagggtggcctataagtaaaatggatttaggagtccctttacttgcgttaggatgttattcacaagtgaatccactaaccctgacagcagcagtgctattattaataacccattatgccataataggtccaggcttgcaagcaaaagccacaagagaagctcaaaagagaactgcagcagggattatgaaaaaccccactgtggatgggataatgacaatagatcttgatccagttatttacgattcaaaatttgagaaacaacttggacaagtaatgttattggtcttatgtgcagtacaactcttattaatgaggacatcctgggccctttgcgaagccctcaccctagctaccgggccaataactacattatgggaagggtcacctggtaaattttggaataccaccatagcagtatccatggcaaacatattccgaggctcatatctagctggggctgggctcgccttctcaatcatgaagtcagtcggcactggcaagagaggaacaggtagtcaaggagaaacactgggcgagaagtggaagaagaaactaaatcaacttagtcgaaaagaatttgacctatacaagaaaagcgggatcacagaagtggacagaactgaagctaaagagggattaaagagaggcgagataactcatcatgcagtaagtcgtggttcggctaaacttcaatggttcgtggaacgaaacatggtaataccagaaggaagagtaatcgatcttggctgtggaagaggcggctggagttattattgtgcagggctaaagaaagttacagaagttagaggttacactaaaggcgggcctggacacgaggaacctgttcctatgtccacttatggatggaatatagtaaaattaatgtcgggaaaggatgtattctacctcccgcccgaaaaatgcgacacgctactatgtgacatcggagaaagttcacctagccctaccgtggaagaaagtcgtacaatcagggtattaaaaatggtagaaccgtggctcaaaaacaaccaattttgcattaaggtacttaatccttacatgccaacagtaattgaacatctggaaaggctacagcgtaaacatgggggaatgctagttaggaacccccttagtagaaattcaacacatgaaatgtattggatatctaatggaactgggaatatcgtagcatccgttaatatggtatcgagattgttgttaaataggtttactatgacacacaggcgtcctacaatagaaaaagatgtagacctaggagcaggcacaaggcacgtaaacgccgaacctgaaactcctaatatggacgtaataggagaaaggatcaaacgaatcaaagaggaacacaattccacttggcactatgatgacgaaaacccctataaaacttgggcttaccatggctcatatgaagtcaaggctaccggatctgcaagttctatgattaacggggtcgtaaagttattaacaaagccgtgggatgtagttcctatggtcacgcaaatggcaatgacagatacaacaccattcggtcaacagagggtatttaaagaaaaggtggacacaagaactccaaggagtatgccaggtactagacgggtgatgggaatcacagctgaatggctctggcgaacgctcggtcgtaataagaaacctcggttatgtactcgtgaagaatttacaaagaaagtaagaacaaacgcagctatgggtgcagttttcacggaagaaaaccagtgggacagcgccaaggcagcggtagaagatgaagatttctggaagttagttgatcgcgaaagagaactccataagttgggtaaatgtggtagttgtgtatataatatgatggggaaaagagagaagaaactaggtgagtttggaaaggccaaaggatctcgagcaatatggtatatgtggttaggcgctcggtaccttgaatttgaagcactaggtttcctaaatgaagatcattggttcagtagggaaaatagttactcaggagtggaaggtgaaggtttacacaaactgggatatattctaagggacatatcaaagataccaggaggagctatgtatgccgatgataccgcagggtgggatacccgaatcacagaagatgacctacacaatgaagaaaagataactcaacagatggatccagaacatagacagttggcaaatgctattttcaaacttacataccaaaacaaagtagtaaaagtccagcgacctacaccaaccggtaccgttatggatataatatcgagaaaagaccagagaggttctggacaggttggtacctacggactgaacacttttacaaatatggaggctcaactaataagacaaatggagggggaaggcgtgttgagtaaggcggatttagaaaatccccacttacctgagaagaaaatcacacagtggctcgaaacgaaaggtgttgaacgattgaaacggatggctatcagcggtgacgactgtgtagtcaaacctatagatgatagattcgctaatgctctacttgctttaaatgacatgggtaaagtcagaaaagatataccccaatggcaaccaagcaaaggatggcatgattggcagcaagtccctttttgctcacatcatttccacgaactaataatgaaggatgggagaaaattagtcgtcccctgtaggccccaagacgagttgatagggcgagccaggatctcacagggcgcgggttggagtctacgagagaccgcctgccttggaaaagcgtacgcacaaatgtggtccctaatgtattttcacagacgtgatttaagattagctagcaatgcaatatgctcagccgttccagtacattgggtacctacaagtcggacaacatggagtatccacgcacatcatcaatggatgacaacagaagacatgcttactgtatggaaccgcgtctggatagaagataatccctggatggaagataagacacctgttaccacttgggaaaacgtgccgtacctaggaaagcgagaagatcaatggtgtgggtctttaattggattaacaagtcgagctacttgggctcaaaatatacctaccgcaattcaacaagtgagatcccttatcggaaatgaagaatttctagattacatgccatcgatgaagcgattccgaaaagaagaagagtcggagggagctatatggtag

SEQ ID NO: 23250 - RNA, 9873 nt, synthetic construct
  misc_feature 1..9873: note = derived and/or modified CDS sequence (opt6) from DENV-3__KJ189263__SS-prME
  source 1..9873: mol_type = other RNA
acgagcttatgtcttatgatgatactgccagcagcgcttgcctttcatttaacatcccgagacggagaacctaggatgatcgtaggtaaaaatgaacgaggaaaaagtttattgtttaaaacagcttcaggaattaacatgtgcacactaatcgccatggatttgggagaaatgtgcgacgacacagtaacttacaaatgtcctcatataactgaggtagaaccagaggatattgattgctggtgtaatttaacgtcgacttgggtaacatatggaacatgcaatcaagcgggagagcataggagggataaaagatcggtggcactggccccgcatgtaggcatgggactggatacaaggacacaaacatggatgtccgctgaaggagcttggagacaagtagagaaagtagaaacatgggcactaagacatcctgggtttactattttggcattatttctagcccattatataggtacatctctaacgcaaaaagtagtaatctttatattactaatgttagtcactccctccatgactatgcgatgtgttggagtaggaaatagggacttcgtagaaggattgtcaggggcgacatgggttgatgtagttttagaacacggtggctgcgtgactacaatggccaaaaataaaccaaccctagacatagagctacagaaaactgaagctacacagcttgcaactctaagaaaattatgtatagaaggaaaaattactaatataacaactgactctagatgtccgacccaaggagaagctgtcttacctgaagaacaagaccagaattacgtatgcaaacacacctacgttgatcgaggatggggaaacgggtgcgggctatttggaaaaggtagtttagttacatgtgcgaaatttcaatgcctagaacctatagaaggaaaagttgtacagtatgagaatctcaaatatactgtaatcattacagttcataccggtgaccaacatcaggtcggtaacgagacacaaggtgtaacggcagagattactccgcaagcatcaacgactgaagctacattgcctgaatatggaaccctgggattagagtgttcaccgagaacaggcttagactttaatgaaatgattttactaacgatgaaaaacaaagcctggatggtgcacagacaatggtttttcgatttaccattaccctggacttcgggagcgacaacagaaacaccgacgtggaaccgcaaagagttactcgttaccttcaaaaacgcacatgccaagaaacaagaagtagtagtcctaggaagccaagaaggggcgatgcataccgcacttacgggggcgacagagatacaaaattcagggggaaccagtatcttcgcaggacatctcaaatgtaggctaaaaatggacaaattggaactgaaagggatgtcatacgccatgtgcacgaatacgtttgtcctcaagaaagaagtatctgaaacccaacatggcactgttctcataaaagtagaatataaaggtgaagatgtaccatgcaaaatacccttttcaacagaggatggacatggtaaagcacataacgggagattaataacagcgaatccagtagttaccaagaaagaagaaccggtaaatattgaagcagaacctccgtttggtgaaagcaatatagtaataggtattggagacaatgcattaaaaataaattggtacaagaaaggaagctctattggaaaaatgttcgaggcaacggcgcgaggagccagaaggatggccattctgggagatacagcgtgggactttggtagtgtgggaggcgtattaaactcgctggggaaaatggtacaccaaatatttggcagcgcatatactgctcttttcagcggagtatcctgggtaatgaaaattgggattggagttcttttaacctggataggacttaactcgaaaaatacctctatgtcattcagttgtatagcaatcggtattataacgttatatctaggagctgtcgtacaagctgatatgggatgcgtgattaactggaaaggtaaagaattgaaatgtggatctggaatattcgtaaccaatgaagtgcatacatggacagagcaatacaaattccaagccgatagtccgaaacgattagccaccgccatagctggagcgtgggagaatggggtctgtgggattcggtcaactacaagaatggaaaacctactgtggaaacaaatagcaaatgaattaaattatattctatgggaaaataatataaaactaaccgttgtggtgggggatataattggcgttttggaacaaggtaaaagaacacttaccccgcagcctatggaattaaaatactcctggaaaacttggggtaaagcaaaaatcgttactgccgagacccaaaattcaagtttcatcattgacggaccaaataccccggagtgcccttcggcatcaagggcctggaacgtgtgggaagtagaagactacggttttggtgtattcacgacgaacatatggttaagattaagagaagtgtatacacaattatgtgatcaccgcttgatgtcggccgcagtgaaagacgaaagagcagttcatgcggacatgggctactggatagagagtcagaaaaatggatcctggaaattagaaaaagcgtcgttaatagaagtaaaaacatgcacttggcctaaatcccacaccctttggtcaaatggagtactggaaagcgacatgatcattccaaaaagtttagcggggccgatttcacaacataatcatagacccggatatcacacacaaaccgctggaccatggcaccttggcaaacttgaactggattttaattactgcgaaggaactacagtagttattactgaaaattgcgggactcgaggtccctcacttcggacaaccactgttagcggaaaacttatccacgaatggtgttgtcgatcatgtacactacccccacttcgatacatgggagaggatggatgctggtatggaatggaaattagaccgatttcagagaaagaggaaaatatggtaaaaagtctagtttctgctggcagcggaaaagtcgataacttcacaatgggagtcctatgtttagctatcctattcgaagaagtgatgagaggtaagtttggtaagaaacacatgattgctggggtcttctttacttttgtacttttactatctggacaaataacctggcgtgatatggcccacacattgatcatgataggttcaaatgctagtgatagaatgggcatgggtgttacctatctcgcacttattgcaacatttaaaattcaaccattcttggcactaggcttctttttgagaaaacttacgagccgtgagaatcttctgttaggggtgggattggccatggcaactacgctacaactaccggaagatatagagcaaatggcgaatgggattgctcttggattaatggcactcaaactaatcactcagttcgaaatttatcaactatggacagcacttatatcacttacatgctcaaatacaatattcactctaacagtagcatggcggactgccaccctaatacttgcgggggttagcttactcccagtctgtcaaagttcctcgatgcgcaaaacggattggctaccaatggcagtcgcggcaatgggcgttcctccattacccttatttatctttagtctcaaagatacgctgaaacgtagaagctggccgctaaatgaaggcgttatggccgttggtctagtatcaattttagcctcttcgcttcttagaaacgacgtacctatggcaggaccgctagtggctgggggtctactaatagcatgctatgtgattacgggaacctcagcggatttaacagtagaaaaggcagctgatattacctgggaggaagaagcagaacaaactggcgtctcacacaacttaatgatcacagtcgatgacgatggtaccatgaggattaaagatgatgaaacagagaacattttaactgttttactcaaaactgccttgctaatagtaagtggcattttcccctactccataccagcaacgctcctagtgtggcacacgtggcaaaaacaaacacaacgttctggcgttctatgggacgtaccaagtccaccagaaacccagaaagcagaattagaagaaggagtgtacaggatcaaacagcagggcattttcgggaagactcaggtaggagtaggtgtgcaaaaggaaggagtattccacacaatgtggcacgtcacaagaggtgcagttctcacgtataatggtaaaaggctggaaccaaactgggcatccgtcaagaaagatctaatcagctatgggggaggttggcggctaagcactcagtggcagaaaggagaagaagtacaagttatagcagttgaaccaggcaaaaatcccaaaaactttcaaaccatgccaggaactttccagactacgacaggagaaattggggctatagctctcgattttaagcctggaacgagtggatctccaataataaatagggaaggtaaagtagtagggctatatgggaacggcgtagtgactaaaaatggaggatatgtttcaggaatagcacaaacgaacgcagaaccggatggtcctacaccagaattagaagaagagatgtttaagaaacgaaatttaacaattatggacctacaccctggatcaggtaagacaagaaaatatcttcctgctatagtacgtgaagctataaagagacggctacgtaccttaatattagcaccaacaagagtagttgctgctgaaatggaagaagccttaaagggactacccattcgataccaaactactgctacaaaatcagagcatacaggtagagaaattgttgatttaatgtgtcacgctacttttacaatgcggttactatcacccgtaagggtacctaattacaatttaataattatggatgaagctcatttcacggatccggcaagtatagctgcaagaggatatatcagtacacgagtgggaatgggagaagcagcagcaatatttatgacggcgacaccacctggtacagccgatgcgtttccgcagagcaatgcaccaatacaggacgaagaacgagacattcctgagcgatcgtggaactccggaaatgaatggataacagactttgcaggtaaaacggtgtggtttgtgccgagcattaaagcaggaaatgacattgcaaactgcctacggaaaaacggcaagaaagtcattcaattaagtagaaaaacttttgatacagaatatcagaaaacgaaattaaacgactgggatttcgtcgtaacaactgacatatcggaaatgggagcaaattttaaagcggatagagttattgacccccggcggtgtctcaaaccggttatcctaactgacgggcctgaaagggtcatattggcgggccccatgccagtcacggctgccagtgccgcccaaagaagaggtcgggtaggaagaaatccccaaaaagagaacgaccaatatatttttactggccaaccattgaacaatgatgaggaccatgctcactggacagaagcaaaaatgctattggataatataaacacgccagaagggataattcctgcattgtttgaaccggaacgcgaaaagagcgcagcgatcgacggggaatatagactaaaaggcgagtcgcgaaaaacgtttgtcgaattaatgcgaaggggagatcttccagtgtggttggcacataaggtcgccagtgagggaatcaaatacacagataggaagtggtgctttgacggacagcgaaataatcagatacttgaggaaaacatggatgttgaaatttggacaaaagagggtgagaaaaagaaattacgccctcggtggcttgacgccagaacgtatagtgaccctttggcgcttaaagaatttaaagatttcgccgcaggaaggaaaagtatagctcttgatcttgtgactgaaataggaagagtcccttcacatcttgcacaccgtactcgaaacgcattagataatcttgttatgctgcacacttccgagcatggaggtcgggcctaccgtcatgcagtcgaagagttgcctgaaacaatggaaactctactcctcctcggcctcatgattctattaactgggggagcaatgcttttcctgattagcgggaaagggatagggaaaacaagcatcggtttaatttgcgtcatcgcatcaagtgggatgttatggatggcagagattcccttacaatggatcgcgtccgctattgtactagagttctttatgatggtattattaatccctgaaccagaaaagcaacgtacgccacaagacaatcaattagcttatgtagtgattgggattttaacgttagctgctataattgctgcaaacgaaatgggtcttttagagacgacaaaacgagacctaggaatgagcaaggagccaggtgtcgtttcaccaacatcgtacttagatgtggacctacatcccgccagtgcgtggacactttacgctgttgctacaacagttataactcccatgctacgacatactatagaaaattccacggcaaatgtttccctagcggcaatcgccaatcaagctgttgttttaatgggactagataaaggatggcccatatccaaaatggacttaggagtaccactattagcattaggatgttacagtcaagttaatccgttgactctaacagcagcagtacttttattaataacccactatgctataataggcccaggattacaagcaaaagcaacaagagaagcccagaaacgtacagcagccggcataatgaaaaatccaacggttgatggtattatgaccatagacttagacccagttatttatgatagcaaattcgaaaaacagttgggtcaagttatgttattggttttgtgtgctgtgcaactactcctgatgcgaacaagctgggcgctatgcgaggcactaaccttggcaacaggtcctattaccacgctatgggaaggaagcccaggtaaattctggaatactacaattgctgtatccatggctaacatattcagagggtcatacttagctggagctggtctagcatttagcattatgaagtcagtaggaacaggaaaacgaggtacaggttcgcaaggagaaacacttggagagaaatggaagaagaaattaaatcaattaagtaggaaagagttcgacttatataagaaaagtgggattactgaggttgatagaactgaagctaaagaaggtcttaaaagaggagaaattactcatcatgcagtatcccgaggtagtgcaaaattacaatggttcgtagagagaaacatggtcataccagaaggacgagtaattgatctaggctgtggacgaggcggttggagttactactgtgctgggctcaagaaagtaaccgaagtacgaggttacacaaaaggaggtccaggccacgaggagcccgtaccaatgagtacttatggttggaatatagtcaaattaatgtcaggaaaagatgtattctacctcccacctgaaaaatgtgacacccttctttgcgacataggagaaagttcacctagtccaacggtggaagaatcacgcactattagagtgctcaaaatggtagaaccgtggctcaagaacaatcagttttgtataaaagtattaaatccatatatgccaactgttattgagcatctagaaagacttcagcgaaaacatggaggtatgctcgttcgcaatcctctctcaagaaatagtactcatgaaatgtactggatatctaacggaacaggaaatatagtagcatcagtaaacatggtatccagactacttttaaacagatttaccatgacccatcggagacctacaattgaaaaagatgtagacctaggcgcaggcacaagacatgtgaatgcagaaccggaaacgcctaatatggacgtaatcggcgagcgcataaaaagaataaaagaagaacataactcaacatggcattacgacgatgaaaatccatacaagacttgggcttatcatggaagctatgaagtaaaggcgacaggttcggcgtcgtcaatgataaatggtgttgtgaagttactaacaaaaccttgggatgtagtacctatggtcacccaaatggcgatgacggatactactccctttggtcaacaacgtgttttcaaggaaaaagttgacaccagaactccaaggtcaatgccggggacacgaagagttatgggcataactgcggaatggctatggagaactttagggagaaacaagaagccaagactttgcactcgagaagaatttaccaagaaagtccggacgaacgcggcaatgggtgcggtgttcacagaagagaaccaatgggactcagctaaagccgccgtagaagacgaagacttctggaagctagttgatagagaacgcgaactacataaactggggaaatgcggctcatgtgtttacaatatgatgggaaaacgagaaaagaaattaggagaatttggaaaggctaaaggaagtcgtgcaatatggtacatgtggttgggagcccgttatctagaatttgaagcattaggctttctcaatgaagaccactggttttcaagagaaaatagctattccggagtagaaggtgaagggttacataaactaggctatatcttacgtgatataagcaaaatacctggaggagcgatgtatgcagatgatactgcagggtgggataccagaataaccgaagatgatttacataatgaggagaaaataacgcaacagatggatccggaacaccgccaattagcaaacgcgatttttaagttgacgtatcagaacaaggttgtcaaagtacagaggcctactccaacagggacagtgatggatattatttcacgaaaagaccaaagaggctcaggacaggtgggaacttacggtcttaatacatttactaacatggaagctcagctcatacgtcagatggagggagagggagtattgtcaaaggctgacctagaaaacccacacttaccggaaaagaagattacgcaatggctcgagacaaaaggagtagaacgattaaaacgaatggcaatatcaggagatgattgcgtggtaaaacccattgatgataggtttgcgaacgcactactagctcttaacgatatgggaaaggtaagaaaagatattccccaatggcagcctagtaaaggttggcatgactggcaacaggtaccattttgcagccaccatttccatgaacttattatgaaagatggccgcaagttagtcgtgccgtgtcggccacaagatgagctcattggcagagcacgcataagtcaaggagcaggctggagcctccgagaaaccgcatgtctggggaaagcctatgcacaaatgtggagcttaatgtatttccatcgtcgtgacctgcggctggcctctaacgccatatgttcagcagtacccgtacactgggtaccaacatcgagaactacttggtcaatacacgcacatcaccaatggatgacgactgaagatatgctaacggtatggaacagggtctggatcgaagacaacccctggatggaagacaagacccccgtaacgacatgggagaacgtaccttatctaggtaaacgagaagatcaatggtgtggctcattaatagggttaaccagtagagcaacatgggctcaaaacattccaacagctatacaacaagtaaggagcttaatcggaaatgaggagtttttagattatatgccctcaatgaaaagatttcgtaaggaagaagagagcgaaggggcaatctggtaa

SEQ ID NO: 23251 - RNA, 9873 nt, synthetic construct
  misc_feature 1..9873: note = derived and/or modified CDS sequence (opt6) from DENV-3__KJ189265__SS-prME
  source 1..9873: mol_type = other RNA
acctcattatgcctcatgatgatcctaccggcagcactagcttttcatctcacatctagggatggagaacctaggatgattgtaggtaaaaacgaacggggtaaatcacttctgttcaaaacagcatcaggtattaatatgtgtactttaatagcaatggatcttggtgaaatgtgcgatgacacggttacatataaatgtcctcacattacagaagtcgaaccagaagacatagattgttggtgcaatctaacctcgacttgggttacatatggaacatgcaatcaagctggcgaacatcgtagggacaaacgtagtgtagccctagcaccacatgtggggatgggactggacacccgaacgcagacctggatgtctgcagaaggtgcttggagacaggtagaaaaagtcgaaacatgggcgctacgtcaccctggatttacgattcttgcattatttttggcacattatattggaacaagccttacacagaaagtagtaatttttatcttactaatgttagtaacacctagtatgaccatgcgatgtgtaggagttggaaatagagattttgtagaaggactatcgggagctacatgggtggacgtagtgttggaacatggaggatgtgtaactacaatggccaaaaacaaaccgacacttgatatagaattacagaaaactgaagcaacacaattagcaactttgcgcaaactctgcatagaaggcaaaataactaacattacaaccgactctcgatgcccaacacaaggggaagcggtcctacctgaagaacaagatcaaaactacgtttgtaaacacacttacgtagacagaggttgggggaacgggtgtggtctttttgggaaagggtccctcgtaacatgcgcaaaattccaatgtttagagccaatagaagggaaagtggtgcaatatgagaatttaaaatatacggtaataattacagtccacacgggtgatcaacatcaagttggaaatgaaacacaaggtgtcacagcagaaataacaccacaggcctccactacagaggctatcctaccggagtacggaacattgggactggaatgtagcccccggacaggattggactttaatgaaatgatattattaactatgaaaaataaagcatggatggtacatcggcaatggtttttcgacttaccgctgccttggacgtctggtgcaacgacagaaaccccaacttggaatagaaaagaattgcttgttacgtttaaaaacgcacacgcgaagaaacaagaagtagtagttttaggaagtcaagaaggagcaatgcataccgctctaactggagctacagaaatccagaactcaggaggaacttcaatcttcgcaggacacttgaaatgccggttaaagatggacaaactagaactgaaaggaatgagttatgccatgtgtaccaacacattcgtactaaagaaagaagtttcagaaacacaacatgggactatattaataaaagttgaatataaaggagaagatgtaccctgtaaaataccattctcgacggaagatggacatggaaaagctcataacggaaggctcatcacagccaacccggttgtaaccaagaaagaagaacctgtcaatatagaagcggagccaccatttggagaaagtaatatagtaataggcataggtgataacgctttaaaaattaactggtataagaaagggagcagcattggaaaaatgtttgaagcgaccgcaagaggagcacgaaggatggcgattttaggtgatacagcatgggactttggaagcgttggtggagtactaaattccttaggcaaaatggtacatcaaattttcggatctgcgtacacagctctgttctctggagtatcgtgggttatgaaaataggaataggtgtattgcttacttggattggtttaaatagtaagaatacaagtatgtctttcagttgtatcgcgataggaataataaccttatatctaggcgcagtggtacaggcagatatgggatgtgttataaactggaaaggaaaggaactaaagtgtgggagcggtatatttgtcacgaatgaagtacacacttggacagaacaatataaattccaagcagattcaccaaaaaggctagcaacagccatagccggcgcatgggagaacggagtttgtggaatccgttcaaccacaagaatggaaaatctactgtggaaacagattgccaatgaactcaattatatcctttgggaaaacaatataaagctaaccgtagtagtcggagatattataggggtcctggaacatggaaaaagaactctaactcctcaaccaatggagctaaaatatagttggaaaacctggggtaaggcaaaaatcgtaactgcagaaacacaaaattcaagttttatcattgacggaccaaatacaccagaatgtcctagcgcttcaagagcctggaatgtatgggaagttgaggactacggatttggcgttttcacaacgaatatctggctaaaactcagggaagtctacacacaactatgcgaccatcgactaatgagtgcagccgtaaaagacgaaagagcagttcacgcagatatgggatactggatagaatcacagaaaaacggatcatggaaattagaaaaagccagcttaatagaggtaaaaacatgtacatggccaaagtcacacactctgtggtcaaacggagttctggaatccgatatgatcataccaaaatcgctcgcgggaccaatttcacagcataaccatagaccgggatatcacacacaaaccgcaggaccatggcatctaggtaaacttgaattagattttaactattgtgaaggtactaccgttgtgataacagagaattgtggaacgagggggccaagcctacgtacaactactgtatctgggaaacttatacatgaatggtgctgtaggtcatgtaccttgcctcccttaaggtatatgggagaggatggatgctggtatgggatggaaattagaccaatcagtgagaaggaagagaatatggtaaaatcccttgtatctgctggctcaggtaaagtagataacttcacgatgggcgtcctttgcctagctatcctttttgaagaagtaatgagggggaaatttggcaagaaacacatgattgcaggagtgtttttcacctttgttctcctccttagtggtcagatcacatggcgggatatggctcacacgctaataatgataggttcaaatacatcggacagaatgggtatgggtgttacttatctagcattgatagctacatttaagattcaacctttcttagcgcttggcttctttttacgcaagttaacatcacgagaaaatcttctattgggggttggtctggcaatggctactacgttgcaactaccagaagatatagaacaaatggccaatggtatcgctcttgggcttatggcgctcaagctaataactcaattcgaaacatatcaattatggactgccttgatatcgctcacctgttctaatacaatattcacactaaccgttgcttggcgaacagcaacgttaatactcgcaggagtgagcttgttgcccgtttgtcaaagtagtagtatgagaaaaacggattggttacctatggctgtagccgctatgggggttcccccactcccgttgttcatcttttccctaaaggatactctaaaaaggagaagctggcctttaaatgagggcgtcatggcagtaggattagtatccatattggcaagtagtttattgaggaatgatgtgcctatggcaggccccttagtagcaggaggactgctgatcgcatgctatgtgataaccggaacaagtgctgacctaactgtagagaaagccgcgaatatcacatgggaagaagaagcagagcagactggtgttagccacaatcttatgattacagttgacgatgatggtactatgagaattaaagatgatgaaacggaaaacatattgacggtcttgttaaagacagccttattaatcgtaagtggcatatttccatattcgataccagcgacgttacttgtttggcacacatggcagaaacagacacagagatcgggtgtactctgggacgtcccatctccgcccgaaacacagaaggcagagctagaagagggcgtatacagaataaaacagcaagggatctttggaaaaactcaggttggagttggtgtacagaaagaaggagtatttcatacaatgtggcacgtaactaggggcgctgtattgacgtacaacggaaaacgattagaaccaaactgggcttcggttaagaaagacctaattagttacggcggaggatggagattaagtgcacaatggcaaaaaggagaagaagtacaagtcatcgcagttgaaccaggaaagaatcccaaaaacttccaaacaatgccaggcacattccagacaacaacgggcgaaataggagcaattgcactggattttaaacctgggacgagtggttctcctatcattaatcgtgaaggcaaggtggtaggtttgtatggaaacggcgtagtaactaaaaatggtggttatgtatcagggatagcacaaacaaatgccgaacccgacggaccgactcctgaattagaagaagagatgttcaagaagagaaatttgacgattatggatttacatccaggttcaggaaaaacgaggaagtacttgccagcaattgttagagaagccataaaacgaagactaaggacgcttattcttgcacctactcgagttgtcgcggctgaaatggaagaggctttaaaagggcttccaataagatatcaaaccacggccacgaaaagtgaacataccggacgtgagattgtagacttgatgtgtcatgccacgtttacaatgagactactgtcacctgtgagagtgcccaattacaatctcataattatggacgaagcacacttcacagaccccgcatcaatcgcggccagaggctacattagcactagagtcgggatgggagaagctgccgcaatttttatgacagccacacctccaggcacggctgacgcgttcccacaatcaaacgccccaattcaagacgaggaaagggacatcccagagcgcagttggaacagcggaaacgaatggattacggatttcgccgggaagacagtctggtttgtcccaagcatcaaggctggcaatgatatagccaactgcctcaggaaaaatggaaagaaagtcatacagttatcacgtaaaacattcgacactgagtatcagaaaacgaaattaaacgattgggattttgtagtaactacggatattagcgaaatgggagcaaacttcaaagctgatcgggtgatcgatccccgtcgttgtctcaaaccagtaatacttacagatggtccagaacgtgtgatcctagcaggcccaatgcctgtaacagcggcctccgcagctcagagaagaggacgagtgggaagaaatcctcaaaaggaaaacgaccaatatatttttaccggtcaacctttaaacaatgacgaggatcatgcacattggacagaagcaaaaatgctgcttgataatatcaacactcccgaagggatcatacccgcattattcgaaccagaacgtgaaaaatcggcggcaatagatggggagtatcggctcaagggagagtctagaaaaacattcgttgaacttatgcgaagaggggacttacctgtctggcttgcgcacaaagtcgcttcggaaggaataaagtacacagacagaaaatggtgtttcgacggacaaagaaataatcaaatcttagaagaaaatatggatgtcgaaatttggacaaaggaaggggaaaagaagaaacttcgtccgcgatggctcgacgcccgtacgtattcggatcccttggcacttaaggagtttaaggatttcgccgcaggaaggaaatcaatcgcactagatttggttactgagattggacgagtaccttcgcacttagcacacagaaccaggaatgcgctggacaatttagtcatgttgcacacaagtgagcatggaggtagagcataccgacacgcagtagaagaattaccggaaacaatggaaactttactattactaggtttaatgatactattaacaggaggggccatgctattcctgatctcaggaaaagggatagggaaaacaagcatcggactcatttgcgttattgcgagtagtggaatgctatggatggccgagatacctctacaatggattgccagcgcaatagtcttagaatttttcatgatggtactattaatacccgagcctgaaaaacaaagaaccccgcaagacaatcagttagcctacgtggtcataggtatattaactctagcagctatcatagctgcaaacgaaatggggcttttagagaccacaaaaagagaccttggcatgtcgaaagaacctggcgtagtgtcaccaacatcatacttggatgtagacttacacccagccagtgcatggacactttatgctgtcgcaactactgtaattaccccgatgcttcgacatactattgaaaattccactgccaatgttagtctagcagctatagctaatcaagcagtagtactcatgggattagataaaggttggccaatttcgaaaatggatcttggagttcctcttctggctctaggctgctacagtcaggttaacccgctcactttaactgcagctgtacttctattaataacacattatgcaattattggaccaggtttacaagccaaagccacacgagaagcacagaagcgtacggctgcaggaatcatgaaaaatccaaccgtcgatggaataatgacaattgatttagacccagtgatttacgattctaaattcgaaaaacaacttggacaagtaatgctattagtgctttgtgcggtccaacttttgctgatgagaacatcatgggctctctgtgaagcactaacgcttgctactggtccaatcactacgctctgggagggttcccctggaaagttttggaatactactattgccgtatcaatggctaacatattcaggggatcatatcttgccggggctggattagcattttctattatgaaatccgtggggaccggaaaacgaggaaccggtagccagggggaaaccttgggcgagaaatggaagaagaaactcaatcaattaagtagaaaagagttcgatctatacaaaaagtcaggcataactgaagtggaccggactgaggcaaaagagggcttaaaaagaggggaaataacacatcatgccgtatcaagagggagcgccaaattacaatggtttgtcgagcgaaatatggtaatacccgaaggcagagtcatagacttaggatgtggacgtggaggttggagctactattgtgctggtttgaagaaagtgactgaggtgaggggatatacaaaaggagggcccggacacgaagaaccagtaccaatgtctacttacggttggaatatcgttaaactcatgtccgggaaagatgtattttatctacctcccgaaaaatgcgacacattactttgtgatataggggagagtagcccatctccaacggtcgaagaaagcagaacaatcagagtgttaaagatggtcgaaccctggctcaaaaataaccaattttgtataaaagtactaaatccatacatgccaaccgtaatagagcatttagagcgactgcagagaaagcacggcggtatgttggtaaggaaccctctatctaggaacagcactcatgagatgtattggatttcaaacggtacaggaaatatagttgcgtcggtaaatatggtctcaagactactactaaaccgattcactatgacgcacagacgcccaacaattgaaaaagacgttgacttgggagcaggtacacgacatgtcaatgccgaaccagaaacaccgaacatggatgtgataggggaaaggataaaaaggataaaagaggagcataactctacgtggcactacgatgacgagaatccatataaaacgtgggcgtatcatggtagttacgaggtcaaggcaacaggttccgcgtcaagtatgattaatggggtcgttaaactgttaaccaagccctgggatgtagtgccaatggtaacgcaaatggccatgaccgatactacaccgtttggacaacagcgtgtttttaaggaaaaagttgacactcgtactccacgatccatgccaggaaccagacgagtaatgggaattactgcagagtggctatggcgcacattaggcaggaataagaaaccaagactatgtacaagagaggagttcaccaagaaagtgaggacaaacgcagcaatgggagcagtttttactgaagagaatcagtgggattccgctaaagcagccgtcgaagatgaagacttttggaagttagtggacagagaacgcgaacttcataagctaggcaaatgtggaagttgcgtgtacaatatgatgggtaagagagagaagaaattaggggagtttggaaaagcgaaaggtagccgagctatatggtatatgtggctaggtgctagatacttggagttcgaagctctaggctttctcaacgaggatcattggttttcacgcgagaactcatactctggtgtagaaggcgaaggattgcacaaactgggatatatacttagagatattagcaagattccaggtggcgctatgtatgcagatgacaccgcaggatgggatactaggataacagaagatgacttacacaatgaggagaaaattacccaacaaatggatcccgaacatcgtcaattagcaaatgcaatcttcaagttaacttatcaaaacaaggtggtcaaagtgcagcgtcctacccccaccggaacagtaatggacattatatcaaggaaagatcaaaggggctcagggcaggtaggaacatatggattaaacacttttacaaacatggaagcgcaacttatcagacagatggaaggagagggagtcctaagtaaggcagacctagagaacccacatctaccagagaagaaaattacccaatggttagaaaccaaaggagtagaaaggttaaaacgtatggccatatctggagacgattgtgtagtcaaaccgattgacgacaggtttgctaacgctttgttagcgctaaatgatatgggcaaggtgagaaaagatataccacaatggcagccaagtaaaggatggcatgactggcaacaagtccccttttgtagccaccatttccatgaattaataatgaaggatggtagaaagctagttgttccgtgtagaccccaagacgaactaataggcagagccagaatatcccaaggtgcaggatggagccttagagaaaccgcctgtcttggaaaggcttatgcacaaatgtggtctctaatgtacttccatcgtcgagatttgagattagcaagtaacgccatatgctccgctgtacctgtacattgggtaccaacctctagaacgacatggagtatacatgcccatcatcagtggatgactactgaggatatgttgacagtatggaatcgagtttggattgaagacaatccatggatggaagataaaacaccggttacaacctgggaaaacgtgccgtacctgggaaaaagggaagaccaatggtgtggctccttaatcggactaacatcccgagccacttgggcccaaaacattcctacagctatacaacaagtcaggagtctgatcggaaatgaagaatttctagattatatgcccagtatgaaaagatttcgaaaagaagaagaaagtgagggcgcaatttggtaa

SEQ ID NO: 23252 - RNA, 9873 nt, synthetic construct
  misc_feature 1..9873: note = derived and/or modified CDS sequence (opt6) from DENV-3__KJ189266__SS-prME
  source 1..9873: mol_type = other RNA
acttcactgtgtctaatgatgattctgccggcggctctagcctttcatttgacaagtcgagacggtgaacctcgaatgattgtaggcaaaaatgaacggggaaaaagtctcctgtttaaaactgctagcggtatcaatatgtgtacgttaatcgctatggacttgggagaaatgtgtgatgatactgttacatacaaatgtccacacataacagaagtagaaccagaggatatagattgttggtgcaatctgacaagtacatgggttacatacggaacctgtaaccaagcaggagaacatagaagggacaaacggagcgtcgcgctagccccacatgttggaatgggattggacacgcggacacaaacctggatgagcgccgaaggggcatggcgtcaagtagaaaaagtggaaacctgggccttgagacacccagggtttacaatcctcgctctttttcttgcgcactacatcggaacttcgctcactcagaaagtagttatatttattctgcttatgcttgttactccaagcatgacaatgcgatgcgttggagttgggaatagggattttgttgaaggtttatccggagcaacgtgggttgatgtagtcctagaacacggaggatgtgttacaaccatggctaaaaacaaaccaacccttgatattgaattacagaaaactgaggcaacacaattagcaacattaagaaaattatgtatagaagggaaaattactaatataacaacggatagtaggtgtccaactcaaggtgaggcagttctaccggaagaacaggatcaaaattatgtctgtaaacatacttatgtagatcgaggatggggtaacggatgtggacttttcggaaaaggtagcctagttacatgcgctaaatttcagtgtctagaaccaatagaagggaaagtagtacagtatgaaaatctcaaatatactgttattatcacagtccatactggtgatcagcatcaagtgggcaatgaaacacaaggagtcacggcggaaattactccacaagcctccactacggaagcaatacttcctgaatacggaactctcggtttagaatgcagtccaagaacgggactggattttaatgagatgattctactgacaatgaaaaataaggcttggatggtacaccgacagtggttctttgatctaccactaccttggacgtccggagcgacgaccgaaactccaacgtggaaccgaaaagaacttttagtcacttttaaaaatgcgcacgcaaagaaacaggaagtggttgtactaggctctcaagaaggtgcaatgcatacagctctgacaggtgctacggaaatacaaaatagtggaggaacatccatatttgcaggacacctcaaatgcagattaaaaatggataaactagagcttaaaggaatgtcttacgcgatgtgtacgaatacatttgttctcaagaaagaagttagtgaaacgcaacatggaacaatcttaattaaagtagaatataaaggagaagatgttccttgtaaaatacctttttcaacagaagacgggcacggtaaagctcacaatggtagactgattactgccaatccagtggttactaagaaagaagaacctgttaacatcgaagcagaaccaccatttggagagtcgaacatagtaatcggtataggcgataacgctcttaaaattaattggtacaagaaaggcagttcgataggtaaaatgttcgaggcgacagcaagaggagcgcgacgaatggctatactcggcgacaccgcctgggattttggaagcgtcggtggtgtcttgaacagcctggggaaaatggtacaccaaattttcggcagtgcatacacagcactattttcaggagttagttgggttatgaaaattggcataggggtactattaacatggatcggccttaattcgaaaaacacaagtatgtctttttcttgtattgcaataggaattattactttatatttaggagcagttgtccaagcagatatgggatgcgtaataaattggaaaggtaaagaattgaaatgcggatcaggaatctttgtaacaaatgaggtacacacatggaccgagcagtacaaattccaagcggactccccgaaacggttagcaactgctatagcaggagcatgggaaaatggtgtctgtggcataagaagcactacacggatggaaaaccttctctggaaacagattgctaacgaattaaactacatactttgggaaaacaatataaaactaactgtcgttgttggagatattataggagtactagaacaaggaaaacgtacactaacaccacaacctatggagcttaaatatagctggaaaacctggggaaaagcaaaaatagtcactgcagagacacaaaattcttcctttataatcgatggcccaaatacaccggagtgtccatctgcatcaagagcgtggaacgtttgggaagtagaagactatggatttggagtctttacaactaatatatggctcaagttgcgcgaagtttacacacaattgtgtgatcacagattaatgagtgctgctgtcaaagacgaacgtgctgttcacgccgatatgggctattggatagaatcgcagaaaaacggtagttggaaattagagaaagcgagcttgatcgaagtaaagacctgcacttggccaaaatctcatactttatggtctaacggcgtgctcgaatctgacatgattataccgaaatcattggcaggacccataagccaacataatcatcgcccaggatatcacacacaaacagcaggaccatggcacctcggtaaacttgagctggattttaattactgcgaaggaacaacggtcgttattacagaaaactgcggtacaagaggaccaagccttagaacaacgacagtatcaggaaagttaattcacgaatggtgttgtcgaagttgtacgctaccaccactacgatatatgggagaagacggttgttggtatggaatggaaattaggccaatatcagagaaagaagaaaatatggtaaaatccttagttagtgcaggttcaggcaaagtcgacaacttcacaatgggggttttatgtttagctatcctgtttgaagaagtaatgcgagggaaatttggaaagaaacacatgattgctggagtattcttcacattcgtccttctccttagcggtcaaatcacttggagggatatggctcacacactgattatgatcggatcaaacgcaagcgatcgtatgggaatgggagtgacgtacctagcattgattgcgacttttaaaattcagccttttctagcccttggcttctttctaagaaaactaacgagtcgtgaaaatctgttgttaggggtaggattagctatggcaacgactttacaactaccggaggacatcgagcaaatggccaatggtatagccctcgggttaatggcgctcaaattgattacacagttcgaaacgtatcaactttggaccgcgcttatttccttgacctgttcaaacacaatatttacccttaccgtggcttggcgaactgcgacattgatattagcaggagtttcattattaccagtttgccaatcttcctctatgagaaaaacggattggctacctatggctgtcgctgccatgggcgttccgccattgccactatttatattttcgctcaaagacacacttaaaagaagatcatggccattgaacgaaggtgtgatggcggtcggacttgtcagtatactggcttcatccctcttaagaaatgacgtaccaatggcaggaccccttgtggccggtggacttctaatagcgtgctatgtaattacaggaacctccgcagatttaactgtggaaaaagccgccgatataacatgggaagaagaagctgagcaaacaggagtaagccataatctaatgataacggtggatgacgacggtacaatgcggataaaagatgacgaaaccgagaatatactaacagtactcctaaaaacagcattgttaatagtatccgggatttttccatactcaatccccgcaacgctcttggtctggcatacctggcaaaaacagacacaaagatcaggtgtactatgggatgttccctctccacccgagactcaaaaagcagaactagaagagggcgtttacagaataaaacaacaaggaatattcggcaaaacacaagtcggagtcggagtacaaaaagaaggagtgttccatacgatgtggcatgtcacaagaggcgcagttttgacgtataatgggaaacggctcgaacccaactgggcatcagtcaagaaagatctcatttcctacggtggagggtggaggttaagtgcacaatggcaaaaaggcgaagaagtgcaagtaattgcaatagaacccgggaagaaccccaaaaatttccaggcgatgcccgggactttccaaaccacaactggtgaaattggtgccattgcactagatttcaagcctggcaccagtggcagtccaataataaatagagaagggaaagttgtaggcctatatggcaatggggttgtcactaagaacggcggatatgtatcgggtattgcgcaaaccaatgctgaaccagatggacctacacctgaactagaagaagaaatgttcaagaaacgtaacctaacaataatggatcttcaccctggcagtggtaaaacaagaaaatatctcccagcaatcgtccgtgaagcaataaaaaggagactgagaaccttaatactcgctcctactagggttgtcgcggcagaaatggaagaagcactaaaaggactaccgataaggtatcaaactacagcaacgaaatctgagcatacgggaagagaaattgtagatttaatgtgtcacgcaacattcactatgagactactgagtccggttagagtgcctaattataacttaataataatggacgaggcacactttaccgatcctgcgtcaatagctgcacgaggatatatttcgacaagagttggtatgggcgaagcagccgcaatatttatgaccgctacacctccagggaccgcagacgcctttccacagtccaacgcgccaatccaagatgaagaaagggatattccagaaaggtcgtggaactctggaaatgagtggattaccgatttcgccggaaaaacagtatggtttgtgcctagtataaaagctggaaacgacatcgcaaattgtttgaggaaaaacgggaaaaaggtaattcaattgtcgcgaaaaaccttcgatacagaatatcagaaaacgaaacttaatgattgggatttcgtagttacaactgatataagcgaaatgggtgcaaatttcaaagcagatcgggtcattgacccgagacgctgtctaaaaccagtgatactgacagacggacccgaaagagtcatactcgctggacccatgccagtcacagctgcttccgcagcacagcgacgtggacgagtaggccgcaatccgcagaaggaaaatgatcaatatatatttaccggacagccgttgaataatgatgaagaccacgcacactggaccgaagcaaaaatgctcctagataatataaatacaccagaagggatcattcctgctttatttgagccggaacgagagaaaagtgccgcaatagacggggaatatagattgaaaggagaatcaagaaagacattcgtcgaactaatgagaaggggagacctgcccgtctggctagcacataaggtggcatctgaaggcataaaatataccgacaggaaatggtgttttgatggtcaacgtaataaccagatattagaagaaaacatggacgtcgagatatggaccaaagaaggcgagaagaagaaattacgaccaagatggttggatgcgcggacatattccgatcctctggccctaaaggaatttaaggatttcgccgcaggccgtaagtccatcgcattggatctcgtgacagaaatcggaagagttccgtcacatctagcacacagaacgaggaatgctctggataatctagtaatgttacatacaagtgaacacggaggacgcgcctatagacacgccgttgaggagttaccagaaacgatggaaacactacttctattgggtctcatgatcttactaactggtggagcgatgttatttttgatttctggcaaaggaattggaaaaacctccatcggtctcatttgcgttatagcatcaagtggtatgctttggatggctgaaatacctctccaatggatagcttcggcaatagttctagagttctttatgatggtactgttaatacctgaaccagaaaaacaaagaaccccacaagataaccaattagcttacgttgtcataggtatattaacactcgcagccataatagcagcaaacgaaatgggactcctagaaacaaccaaacgagatttagggatgagcaaagagcctggagttgtatcaccgacaagctatcttgacgtagatttacatccagcatcagcatggaccctatacgcagttgcaacaacagtaatcaccccaatgctaagacatacgatcgaaaactcaacggccaatgtttcactggcagcaattgcaaaccaagctgtagtactaatgggtctagacaaaggctggcccattagcaaaatggacctgggagtgccgttgttagctttaggttgttattcgcaagtaaatccgttgacgttaacagcagcagtactattgcttattacacactatgcaattatcgggcctggattgcaagccaaagcaacccgcgaagcccagaaaagaacagccgcagggataatgaaaaatcctactgtcgacggtataatgacaatagatttggatcccgtaatttatgattcaaaatttgaaaagcaattaggccaagtaatgttacttgtcttatgcgctgtacaattattgctcatgcgaactagctgggcattgtgcgaagctctaacattagcaacaggacccatcactaccctttgggaaggctcacctggaaaattctggaatacaaccatagcagtatcaatggccaatatatttagaggaagctatttagctggagcgggtctggcgttcagcatcatgaaaagtgtgggaactggcaaaagaggtacgggttcacaaggagagaccctgggcgagaaatggaagaagaaactgaatcagttgtcaagaaaagagttcgacctctacaagaaatcaggaatcaccgaagtagatcgaaccgaagctaaagaaggcctaaaaagaggtgaaataacacatcacgcggtctcgagagggagtgcaaaactacaatggtttgtagaaagaaacatggtaataccagaaggtagagtaattgatctgggatgtgggagaggaggctggagttactactgcgcaggactgaagaaagtaacagaagtaaggggatatacgaaaggaggaccaggacatgaggaaccagtgccaatgagcacatatggatggaacatagtcaaattaatgtcggggaaagatgtcttctatctaccgccagaaaaatgcgataccttattatgtgatattggggaatcttccccgtcccccacggtggaggaatccagaactattagagtattaaaaatggttgaaccatggcttaagaataatcaattctgtataaaggtccttaatccatatatgccgaccgttatcgaacacttagaaaggctccaaagaaaacatggtggtatgcttgtaaggaacccacttagtagaaattcaacacatgaaatgtattggatatcaaacggtacaggaaatatagtagcaagtgtgaacatggtatcaagactcctactcaatcgttttactatgacccaccgaaggcctacgatagaaaaagatgtagatctcggagcaggcactcgccatgtaaatgcagagcccgaaacgcctaatatggacgtcattggagaaaggataaagaggattaaagaggaacacaacagcacatggcactatgacgacgagaacccatataaaacttgggcatatcacggatcatacgaagtcaaagcaacaggttcagctagtagcatgataaacggtgtggttaagttacttacaaagccttgggacgtagtaccgatggtgacccagatggcaatgacagacactacgccatttgggcaacaacgagtctttaaagaaaaagtagacacgagaaccccgaggagtatgcccggcacccgtagagtaatgggaattacagcagaatggttatggagaaccttgggaagaaataagaaacccagactttgcactagggaagagtttacaaagaaagtacgaaccaatgcggcaatgggtgctgtattcactgaagaaaaccagtgggattcagcaaaagcagccgtcgaagatgaggatttttggaagctggtcgacagagaacgggagctccacaaattaggaaaatgtggaagttgtgtctataatatgatgggaaagcgagagaagaaactgggcgagttcggtaaagcaaaaggctctagagctatatggtacatgtggctcggggctcgatacttagaatttgaggctttgggtttcttaaatgaagatcattggttcagtagagaaaactcctatagcggagtagaaggtgaaggattacacaaactggggtatatcttgagggatatttcaaaaataccaggaggcgccatgtacgcagacgacaccgcgggatgggatactagaataaccgaggatgatctacataacgaagagaaaataacccaacaaatggaccccgaacatcggcaacttgcgaacgccatattcaaactaacatatcaaaataaggtcgtaaaggttcaaaggccaacgccaacaggaaccgtcatggacattatctcacgaaaagatcaaagaggatcggggcaggtaggtacgtacggccttaacacgtttacgaacatggaagcccagctgattcgacagatggagggagaaggggtactaagtaaggcagatctagaaaaccctcatctcccagagaagaaaattacccagtggttagaaacaaagggtgttgagcgccttaaacgtatggcaatttctggagacgactgcgtggtaaaaccaatagatgatcgctttgcgaatgcattactagcactcaacgatatggggaaagtaagaaaagacatcccgcaatggcaaccttcaaaaggctggcatgactggcaacaggtacctttttgctcacaccactttcatgagctaattatgaaagatggaagaaagctggttgtgccatgcaggccacaagacgagctaattggcagagcaagaatttcacagggggcaggatggtcgctccgagagacagcatgtttaggaaaagcatatgcccaaatgtggagtctaatgtactttcacagaagagaccttcgcctagcttccaacgcaatctgtagtgcggtaccagtgcattgggtccctacatctcgtacgacttggagcatccacgcacatcaccaatggatgacaacagaggacatgctaaccgtatggaatagggtatggattgaagataatccttggatggaagacaaaacgccagtgacgacatgggaaaatgttccatatcttggaaaaagagaagatcagtggtgtggatcgctgataggtttaacatcccgagcaacttgggcacaaaacataccaacagctattcaacaagtaaggagccttattggaaacgaagaatttctagattacatgccgtcaatgaagagatttagaaaagaggaagagagcgagggtgcgatatggtaa

SEQ ID NO: 23253 - RNA, 9873 nt, synthetic construct
  misc_feature 1..9873: note = derived and/or modified CDS sequence (opt6) from DENV-3__KJ189268__SS-prME
  source 1..9873: mol_type = other RNA
acgtccttatgtctgatgatgatactccccgcggctttggcattccacttgacatcacgcgacggagaaccaagaatgatcgtcgggaaaaacgaacgaggaaaaagcctactttttaaaacggcttctggaataaacatgtgtacattaatagcaatggatctaggtgaaatgtgtgatgacaccgtaacatacaaatgtcctcatataactgaagtagaaccagaggatatcgattgttggtgcaatcttacaagtacatgggtgacttatgggacctgcaaccaagcaggggaacatcgaagagataaaagatctgttgctctagcgccacacgtcggtatgggtctagataccagaacacaaacatggatgtcggcagaaggggcatggcgacaagttgagaaagtcgaaacctgggctttacgtcatcctggattcacaattcttgcactatttttggcgcattatatcggaacaagtttaacacaaaaagtagtcatcttcatcctattaatgctagtgaccccgagtatgactatgagatgtgtcggtgtgggtaatagagattttgtagaaggtctcagcggagcaacgtgggtagatgtggtcttagagcatgggggatgcgttacaacaatggctaaaaacaaaccaactctagacatcgaactgcagaaaacagaagcgacacaattagccactttgagaaaactctgtatagaggggaaaataactaatataacaacagacagtcggtgtccgacccaaggtgaagccgtactaccagaagaacaagatcaaaactatgtatgtaaacatacttatgtggatagaggctggggcaacggatgtggtttgttcggtaaagggagtttagtgacctgtgccaaattccaatgtctagaaccgattgagggtaaagtggtacaatacgaaaacctcaaatacacagtaatcattacagtacacacgggcgatcaacaccaagtcgggaatgaaacacaaggagtgactgccgaaataacacctcaagcatcaacaacagaagcaacgctccctgagtatggaacgttaggtttggaatgctcaccaaggactggcttggattttaacgaaatgattcttctaactatgaaaaataaggcttggatggtccacagacaatggttctttgacctcccgctaccttggacctcaggagcgacgaccgagacacctacttggaatcgaaaagaattattagttacatttaaaaatgcacatgccaagaaacaagaggtagtagtactgggttcacaagaaggggccatgcatactgcacttacaggggctaccgaaattcagaactctggtgggacaagtatatttgctggccatttaaaatgtcgactaaaaatggataaacttgaattaaaggggatgtcatacgcaatgtgtacaaataccttcgttctaaagaaagaagtatccgaaacacaacatggaactatattgataaaagtggagtacaaaggagaggatgcgccgtgcaaaataccgttttcaaccgaagatggacacgggaaagcacataacgggagactgataacggctaaccctgttgtaactaagaaagaagaacctgtaaacatagaagcagagcctccctttggggaatcaaacatagttattggaataggagataacgcacttaaaataaactggtataagaaaggcagctcaattggaaaaatgtttgaagccactgcgcggggagcacgaaggatggcaattctaggagacactgcgtgggactttggttcagttggaggggtactgaacagtttgggtaaaatggttcatcaaatattcggatccgcctatacggctttgttttctggagtgagttgggtaatgaaaattggtatcggagtattgttaacatggataggtcttaacagcaaaaatacctctatgtcgttctcttgtattgcaataggcatcataacgttatacttgggagccgtcgttcaagcggatatgggttgcgtgattaactggaaaggtaaagaactgaaatgtggtagtggaatctttgttacaaatgaagtacatacatggaccgaacaatataaattccaagctgattcgcctaaaagattggcgacagcaattgccggtgcatgggaaaacggagtatgcggtatccgtagcacaacacgaatggagaacttactttggaaacaaatagctaacgaattgaactacatactctgggaaaacaatataaaacttaccgttgtcgtaggggatataatcggggtacttgaacaagggaaaaggacattaacgcctcaaccgatggaactaaaatattcttggaaaacatggggaaaagcaaaaatagtaaccgcagagacacaaaacagtagctttatcatcgatggtcccaatacacccgaatgcccctcagcatccagagcatggaatgtatgggaagtggaagattatggttttggcgtatttacaactaatatatggttacgattacgagaagtctacacacaattgtgtgatcatcgcctcatgtctgccgcggtgaaagatgagagagcagtacatgccgatatgggctactggatagagagtcagaaaaacgggtcatggaaactagagaaggcttctcttatcgaagttaaaacatgtacttggccaaaatcccatacattgtggtccaatggggtccttgaaagcgatatgattataccaaagagtctagcgggacctatatcacaacacaaccatagacctgggtatcatacgcaaactgccggaccctggcatcttggtaaattagaattagactttaactattgcgaaggaacaacagtggtaataactgaaaattgtggaacaaggggaccgtccttacggacaaccacggtttcaggtaaactaattcacgaatggtgttgtagatcttgcaccctccctccattaagatatatgggtgaagatggatgctggtatgggatggaaatacgcccaatcagtgaaaaagaagagaatatggtcaaatccctggtgtcggctggctcgggaaaagtagacaatttcacgatgggagtcctctgtctagccatccttttcgaagaggtcatgcgaggaaagttcggcaaaaagcatatgatagccggagtattctttaccttcgttcttttattgagcggacaaattacttggagagacatggcccacactttaatcatgataggttctaatgcttcggataggatgggaatgggcgtaacatatctagcattgatcgctaccttcaagatccagccatttttagcattagggttctttcttcggaaattaacgtcaagggaaaatctcttattgggagtcggactggcaatggcaacaactttacagctaccagaagatatagaacaaatggctaatgggatcgcgttaggcttgatggctttaaaattaattacgcagttcgagacgtatcagttatggacggcattaatatcgctcacctgttccaacaccatattcaccctaactgtagcgtggcgaacagcaacattaattctagccggtgtcagtctattaccagtctgtcagtcatcttcaatgcgaaaaactgattggctgcctatggcagtcgcagctatgggcgttcctccattgccactattcatattttcattaaaagacacattgaaacgaaggtcctggccattaaacgaaggagtcatggcagtcggcttagtcagtattctagcatcctctctattaaggaatgatgtgcctatggcaggaccgctagtggccggtggtctacttattgcttgttatgtcattacaggcacatcagctgacctaaccgtagaaaaagcagcggacataacctgggaagaagaagctgaacaaacaggagtatcgcacaaccttatgattacagttgatgacgacggaacgatgcgaattaaagacgatgaaactgagaatatactaacggtgctactaaaaacagcccttctcattgtaagtggaatttttccctatagcatacccgcgacattacttgtatggcatacctggcaaaagcaaacacaaaggagtggtgtcctatgggacgtaccctctcccccagaaacccagaaagcagaattagaagaaggagtatacagaataaagcaacaaggaattttcggcaagacccaggttggtgtaggggtgcaaaaagaaggtgtctttcacaccatgtggcatgtaacgaggggagctgtattgacatacaacggtaagcgtttagaaccaaactgggcttcggtgaagaaagatttgataagctatggagggggatggagactaagtacgcagtggcagaagggtgaagaagtgcaagttatagcagtagaacctggcaaaaatcccaaaaactttcaaactatgccgggaaccttccaaacaactacaggcgagataggtgcaatagcgctagacttcaaaccaggaacatctggatcacctattataaaccgtgaaggcaaagttgtgggactctatggcaatggggtggtgaccaaaaacgggggatatgtttcggggattgcacaaactaatgctgaaccagatgggcctacgccagaattagaggaagaaatgtttaagaaacgtaatttaaccataatggatctgcacccaggatctggcaaaactcgtaagtacttaccagcgatagtccgagaggcaataaaaagaaggctacgcactctaatcctagcgccaactagagtggtagctgccgaaatggaagaagcactaaaaggtctgccgataagatatcaaactacagctacaaaatctgaacacaccggaagagaaatagtcgatctaatgtgccacgctacatttacaatgcggcttctatccccagtgagagtccctaattacaacctaataattatggacgaagctcacttcacagaccccgcatcaattgccgcgagaggatatatatcgactagagtaggaatgggagaagctgcggcgatatttatgacggctacgccacccggaaccgcggatgcgtttccacagtcaaacgcgcccattcaagatgaagagagagatataccagagcgatcgtggaactcgggtaacgaatggattacggacttcgcagggaaaacagtatggttcgtaccctccattaaagcgggaaatgatattgctaattgtcttaggaaaaatggtaaaaaggtaattcaattgtcgagaaaaacatttgacaccgagtatcagaaaactaaattaaatgattgggacttcgttgtcacaacagatataagtgaaatgggcgctaactttaaagcagatagagtcatagaccctagaagatgcctcaaaccagttatacttactgacggccccgaacgagtaatccttgctggcccaatgccagtcacagctgcgagcgcagcacaaaggcgtggacgagtggggcgtaacccacagaaagaaaatgatcaatacatattcaccggccaaccacttaataatgacgaggaccatgcacactggacagaagccaagatgttactagataatataaacacacctgaaggtataattccagcattatttgaacccgagcgtgagaaaagcgcggcaatagacggtgagtacagactaaagggagaatcaaggaaaacttttgtggaattaatgcgtagaggtgacctgcccgtatggttggcacataaggtagcctctgagggaatcaagtatacagacagaaaatggtgttttgatggtcaaagaaataatcaaatattagaagaaaatatggatgttgaaatatggaccaaggagggggaaaagaagaagctaagaccaaggtggctagatgcaaggacctactccgatcctttagcactgaaagaatttaaggactttgctgcaggcagaaaaagcatagcattagacctagtaactgaaataggacgtgttccatctcatttagcacaccggactaaaaatgcattagataatctagtaatgctgcatacttcagaacacggcggccgggcatacagacatgcagtagaagaacttccagaaaccatggaaacgttgcttctattaggactaatgatcttattaacgggaggagcaatgctttttctaattagcggaaagggcataggaaaaacatctattggattgatttgtgtaattgcatcaagtggaatgttatggatggcagaaatacctctccagtggatcgcatcagctatagtgttagaatttttcatgatggtgcttcttatacctgaacccgaaaaacaacgaacgcctcaagacaatcaattagcctatgtggttattggcatattaacactcgctgctactatagccgcaaatgagatgggtctactagaaacgacaaagagagatttaggtatgagtaaagaacccggtgttgtgtcaccaacatcgtaccttgacgtagatttacatcctgcttcggcatggacattgtacgcagtggctacgacagttataaccccaatgctaaggcatacaatagaaaactctacagctaatgtatcactagcagcaattgcaaaccaagcggtagtactaatgggattagataaaggatggcccatttctaaaatggacttaggagtcccactacttgcgttaggatgctactcgcaagtaaacccacttacactgacagcagcggtattattactgataacacactatgcgataatcgggccaggtctacaggccaaagcaacaagagaagctcagaaaagaacagcggctggtattatgaaaaatccgacagtggatggtattatgacgattgacctggatcccgtcatctacgactcaaagtttgaaaaacaacttggccaggttatgctcttagttttgtgcgctgtacaattacttctcatgagaacaagttgggctttatgcgaagcgctaactttagcgacaggaccaatcaccacattgtgggaaggctcacctggaaaattttggaacaccacaattgctgtttcgatggctaatatattcagggggtcatatctagctggagctggactagccttttctataatgaaatcagttggcaccggaaaaagaggcactggatcccaaggtgaaaccttgggggagaaatggaagaagaaactaaaccaattgtcaagaaaagaatttgatctatataagaaatctgggattacagaagtggacagaacagaggcgaaagaagggttgaaaaggggagaaattactcatcatgcagtatcccgcggatcagcgaagctacaatggtttgtcgaaagaaatatggtaattccggaaggaagagtaatagatcttggatgcggcagaggaggctggagttactattgcgctgggttaaagaaggtaactgaagtccgaggatataccaaaggcggacccggtcatgaagaaccagtaccgatgtccacgtatggctggaatattgtaaagctcatgtcggggaaagatgtgttttatttacccccagagaaatgtgatacgctattatgcgatattggtgaaagcagtccctcaccaacagtggaggaatctcgtacgataagagttctaaagatggttgaaccctggttaaagaacaatcaattctgcataaaagtgcttaacccatacatgccgacagtaatcgaacacttagaaagactacagcgtaaacatggaggaatgctggtcagaaaccctttgagccgaaatagtacgcatgaaatgtactggatctcaaacggaactggcaatatagtcgccagtgtcaatatggtgtcgcgtttgctgttaaaccgcttcactatgacacatagaagaccgactatcgaaaaagatgtagaccttggggctggcactagacatgtaaatgcggaaccagagactcccaatatggacgttatcggggaaagaataaaaagaataaaagaggagcacaattccacctggcattacgatgatgaaaatccatataagacatgggcctatcacggaagttatgaggttaaagcaactggctcggcctcatctatgatcaacggggtggtaaaactattgacaaaaccctgggacgttgtcccaatggtcacgcagatggcaatgacggacacgactccgtttgggcaacaacgcgtgtttaaggaaaaagtggatacacgcaccccgagatcaatgccaggtactcgaagagtaatgggtattacggcagagtggttatggagaacactcggcaggaataagaaaccgaggctgtgcactagggaagaatttactaaaaaggtgcgcactaacgccgcaatgggagcggtgttcactgaggaaaatcaatgggatagtgctaaggcagcagttgaagacgaggatttctggaagctagttgatagagaaagagaactacataaactaggaaaatgcggctcatgtgtatacaatatgatgggaaagagggagaagaaactaggagagttcgggaaggctaaagggtctagggcaatatggtatatgtggctgggcgcacgttatctggaatttgaggcactaggatttttaaatgaagatcactggttcagccgtgaaaattcatactccggagttgaaggtgaaggacttcacaaactaggatatattcttagagatatatcaaaaatcccaggaggagcaatgtacgctgatgatactgcaggctgggatacaagaattaccgaggatgacctacataacgaagagaaaatcacccaacagatggatcctgaacataggcaactggcaaacgcaatcttcaaattaacttatcaaaataaagttgtaaaagtccaaaggccaacaccaacaggaactgtcatggatataatttcacggaaagaccaaagaggttcaggtcaggtcgggacttatggtttaaacacatttacaaatatggaagctcaattgataaggcaaatggaaggagaaggggtactaagtaaagcagatcttgaaaatccacacctaccggaaaagaaaataacccaatggttagagactaaaggagtcgaaaggttgaagagaatggcaataagtggcgacgactgtgtggttaaaccaatagacgataggtttgccaacgctcttttggcccttaatgatatgggtaaagtccgcaaagatataccccaatggcaaccgagcaaaggttggcacgattggcaacaggtaccattttgttctcatcatttccacgagctaattatgaaggacggcagaaagctcgtagtaccttgtcggccgcaggatgaattaattggccgcgcaagaatttcacagggtgccggttggagcctacgagaaactgcttgcctaggtaaagcgtatgctcaaatgtggtctctaatgtattttcaccgacgggacttgcgtctagcgtctaacgctatttgtagtgccgtacctgtacattgggttccaacatctagaacaacatggagcatccacgcacatcaccaatggatgacaacagaagatatgctaacagtttggaaccgcgtatggatagaagacaatccctggatggaggacaaaactccagttacaacatgggaggacgtaccatacttaggaaagcgtgaggaccaatggtgtgggagtctaataggtctgacttcaagggcgacatgggcccaaaacattcctactgcgatccaacaagtaagatcgctcattggtaacgaagaatttctggattatatgccatcaatgaaacgcttccgaaaagaagaggaaagcgaaggagctatatggtga

SEQ ID NO: 23254 - RNA, 9873 nt, synthetic construct
  misc_feature 1..9873: note = derived and/or modified CDS sequence (opt6) from DENV-3__KJ189271__SS-prME
  source 1..9873: mol_type = other RNA
acttcattgtgtctcatgatgattctcccagcggcattagcatttcatctcacaagtagagatggagaaccaagaatgatagtagggaaaaatgaaagagggaaatccctcctttttaaaacagcctcaggcataaatatgtgcacacttatcgcaatggatttaggcgaaatgtgtgatgataccgtaacgtataaatgtcctcatatcacggaagtggaaccagaagatattgattgctggtgtaatttaacgagcacatgggttacatatggtacttgcaatcaagcaggagagcacaggcgagataaaagaagtgtagcacttgcacctcatgtcggtatgggacttgatacccgaactcaaacttggatgtcggcagaaggagcctggcgtcaggtagaaaaagtcgagacatgggctttacgtcacccaggctttaccatcctggcattatttctggctcattacattggaacatcattaacgcagaaagttgtgatttttatactccttatgttggttacaccatccatgacaatgcgatgcgtgggagtaggtaatagagactttgtagagggattatcgggagcaacttgggtagatgtggtattggagcatgggggttgtgtcacgacaatggctaaaaataaaccaaccctagatatagagctgcagaaaactgaggcaacacaacttgccacgttacgaaaattgtgtatagaaggaaaaatcaccaatataactacagacagtagatgtccgacccagggtgaagcagtccttccagaagaacaagatcaaaattacgtatgtaaacatacatacgtagaccgtggttgggggaacggctgcgggctatttgggaaaggaagtctggtgacatgcgcaaaatttcaatgcctagagcccatagaaggtaaagttgtgcaatatgaaaatttaaaatatactgttataatcacagtgcacactggcgaccaacaccaagtcggaaatgaaactcagggtgtaacagccgaaataacgccacaggcctcaaccactgaagcaacgctacctgaatatgggactttaggattggaatgcagcccccggacagggcttgattttaatgaaatgatcttattaaccatgaaaaataaggcttggatggtccaccgccaatggttctttgatttacctctcccatggacatcaggagccactacagagacaccaacttggaatcgaaaagagcttctagtgacttttaaaaatgcgcatgccaagaaacaagaagttgttgtactaggatcccaagaaggagcgatgcatactgcgctaaccggagcaacagaaatccaaaattcaggtggtacgtcaatcttcgctggtcacctcaaatgtaggctcaaaatggataaactcgaactaaaaggcatgtcatatgcgatgtgtacaaatacttttgttcttaagaaagaagtatcagaaacacagcacggtacaatacttattaaagttgaatacaaaggagaagatgcgccctgcaaaattccattttcaactgaagacggtcacgggaaagcacacaacggccgtctaatcacggcaaatcccgtggtaactaagaaagaagaaccagttaatattgaagccgaaccaccatttggtgaaagtaacatagtaataggtatcggcgataacgcccttaaaataaactggtacaagaaaggatcaagcataggcaagatgtttgaggcaacggcaaggggtgcccgacgtatggctatacttggtgacacagcctgggattttggctctgttggcggtgtgttaaattctttagggaagatggtacaccaaatcttcggaagtgcttatacagctctattctccggagtatcctgggttatgaaaataggcataggcgtactattaacatggataggcttaaatagcaaaaacaccagtatgtcatttagttgcattgcaatcggaataattactttataccttggagcagtcgttcaggccgatatggggtgtgtaataaattggaaaggtaaagaattaaagtgtggaagcggaatttttgttactaatgaagttcatacgtggacagaacaatataaattccaagcagatagcccgaaacgactggcaacagctatagcaggagcttgggaaaatggagtgtgcggcattagatccacgacaaggatggaaaatctattatggaaacagatcgctaacgaactaaactatattttatgggaaaataatattaagctaacggtagtcgtgggcgatattataggggtactggaacaaggcaaaaggacactgacacctcaaccaatggaactgaaatactcatggaaaacatggggtaaagctaaaattgtaacagctgaaactcaaaactcgtcgtttataatagatggtccaaatacgcctgaatgtccttccgcttcaagagcttggaatgtttgggaggtagaagattacggattcggggtttttacaacgaatatctggttacgcctaagagaggtatatacgcagttgtgcgatcacagactgatgtcggcggccgtgaaagatgagagagccgtgcatgcagacatgggctattggatcgaaagtcagaaaaacggatcatggaaattagaaaaagccagtttgatagaagtaaaaacttgcacctggcccaaaagtcacactttatggtcgaacggagttctggaatctgatatgataatcccaaaaagtttagccggacctataagtcagcacaatcatagaccggggtaccatactcaaacagccggaccatggcatctcggcaaactagaattagactttaattattgtgaaggaaccacagttgtaataacagagaattgtggaactagaggaccgtctttaagaacaaccacagtctccggcaagctaatacacgagtggtgttgtagatcatgcacgttaccaccactaaggtatatgggagaagacggttgttggtacggcatggaaataaggccgataagtgaaaaggaggaaaatatggttaagagcttagtatcagctggttcaggaaaagtagacaacttcacgatgggcgttttatgcttagctatattgtttgaagaggtaatgcggggaaagctgggtaagaaacatatgatagcaggagtattctttacttttgtgctactacttagcggacaaataacatggcgagacatggcacatacactaataatgatcggaagcaacgctagcgatagaatgggaatgggggttacatacctcgctctcatcgctacttttaaaatacagccattcctagccctaggattctttctgcgtaaactaacctcccgagaaaatcttcttttaggtgttgggttagctatggcgacaactcttcaattaccagaagacattgagcaaatggcaaatggaattgctctaggactcatggcactcaaattaataacgcaattcgaaacttatcagttgtggacggcattaataagtcttacatgcagcaacacaatatttacattaaccgtagcatggagaactgcgaccctgatattagcaggcgtttccttattaccggtttgccagtcaagcagcatgagaaagactgattggctgcctatggctgtcgcagcaatgggtgttccacctctgccactttttatattttccctgaaagatactctaaaacgtaggtcttggccgctcaatgaaggcgtaatggcagttgggcttgtatccattttagcatcatctctcctcagaaatgacgtaccaatggcaggaccactggtcgcgggcggtctccttattgcatgctatgtgataactggcacaagtgctgatcttacagtcgaaaaagcagctgacatcacatgggaggaggaagccgaacagactggagtaagtcacaacttgatgattacggttgatgacgacggtacaatgaggataaaagatgacgagaccgaaaatatactcacagttctcctcaaaaccgctcttttaatagtttcgggtattttcccatactccatccctgctaccttattagtatggcacacatggcagaaacaaactcaaagatcgggcgtattgtgggacgttcccagcccaccggaaactcaaaaagcggaattagaagaaggagtatatcgtataaagcagcagggaatatttgggaaaactcaggtcggtgtgggggtacaaaaagagggagtttttcacacaatgtggcacgttacaagaggagctgtcctgacatataacggaaagagactagaaccgaattgggcatcagtaaagaaagacctcataagttacgggggcgggtggcgacttagcacacaatggcaaaaaggggaagaagttcaagtaatagcagttgaacccgggaaaaacccgaaaaattttcaaactatgccaggaacgttccagactacaacgggtgaaatcggcgctatagccttagactttaagccggggacaagtggtagcccaatcattaaccgggaaggaaaagtagttggactttatggcaatggtgtcgtgacgaaaaatggaggctatgtctctggcattgcgcaaaccaatgctgaaccggacggtcccacacccgaattagaagaagagatgtttaagaaacgaaaccttactataatggatttgcatccaggaagcggaaaaacacgaaaatatttacctgcaatagtgcgagaagccatcaagagaagactacgcactcttatattagctcccactcgggtagtagcggcagaaatggaagaggcactcaaaggacttcccataaggtatcagaccacagcaaccaagtcagagcatacaggtagagaaattgtcgacttaatgtgccacgcaacatttaccatgagattgttatctccggtaagagttccaaactacaatctaataataatggacgaggcgcattttacagatcctgcttctatagctgcacgtggttatatatctaccagagtaggaatgggcgaggccgcagctatatttatgacggccacacctccaggaacagctgacgcgtttcctcaaagcaacgcgccaattcaagatgaagaaagagacattccagaaagaagctggaactctggtaacgaatggatcaccgacttcgcaggaaagacagtatggtttgtccctagcataaaagctggcaacgacatcgctaattgcctcaggaaaaacggtaagaaagtaattcagctatctagaaaaaccttcgatacggaataccagaaaaccaaattaaacgactgggactttgttgtaaccacagatatcagcgaaatgggtgccaattttaaagccgatagagttatagatccgaggcggtgtcttaaacctgttatactaaccgacggaccagaaagagttatcctagcaggtcctatgccagtaactgcagcatcagccgcccaaaggcgaggccgtgtcggacgaaacccacaaaaagaaaatgaccaatatatttttacgggtcaaccactgaataacgatgaagaccacgctcattggacagaggccaaaatgttgctagacaatataaatacgccggaaggaattataccagctttattcgaaccagagagagagaaaagtgctgccatcgatggagagtaccgacttaagggggaatcaagaaaaaccttcgtagagcttatgcgtagaggagatttgccagtttggctagcacacaaagtagcaagtgaaggtattaagtacactgataggaaatggtgtttcgatggacagcgaaacaatcagatcctcgaagagaatatggatgtagaaatatggaccaaagaaggtgagaagaagaaactacggcccagatggctagacgcccgcacttactcagatccacttgcattaaaagaatttaaagattttgctgcaggtagaaagagtatcgcccttgacctagttaccgaaatcggacgtgtaccatcacatctagctcatcgtactaggaatgcactagacaacttggtaatgcttcatacatcagaacacgggggtagagcatatagacatgctgtggaggaacttcctgaaacgatggaaactctcttgctacttgggctcatgatattgttaacaggtggtgcgatgttgtttctaatttcaggtaaaggaataggaaagacctctatcggattgatatgcgttatcgctagcagtggaatgctatggatggcggagataccgttacaatggatagcctcagcaattgtattggagttctttatgatggttttgctcatccctgaacctgaaaaacaaaggactccccaagacaaccagttagcttatgtcgttattggcatcttaacattagctgctataatagcagcaaatgaaatgggattactagagactacgaaaagagatctcgggatgagtaaagaaccaggcgtcgtgtcaccaacatcttacctagacgtagacttacatccggcatcagcttggacattatacgctgtagcgaccactgtcattacgccaatgcttagacatacaatagagaatagtacggctaacgtatctcttgcagcgatcgccaaccaagctgttgtattgatgggactcgacaaaggttggcctatatcaaaaatggatttaggagtgcccctcctcgcgctgggttgttattctcaagtgaacccactgacacttactgctgcggtcttattgttgataacacattacgcaatcataggaccagggttacaagcaaaagcgacacgcgaggcacagaagaggacagccgcaggaataatgaagaatcccaccgtagatggaataatgactattgatttggaccctgtaatatacgactctaaatttgagaaacaactaggccaggtcatgctattagtactttgcgcagttcagttgctattgatgaggacttcatgggccttatgcgaagcactaacattagcgacaggtccgatcacaactctttgggaaggatcgccagggaaattctggaacactactattgcggtctcaatggcaaatatatttcgaggctcatatttagccggtgcaggtctcgcgttttcaattatgaagagtgttgggacaggtaaacgcggaactggctcacaaggggaaacacttggagaaaaatggaagaaaaagctgaatcaactatcgagaaaagaatttgatttatacaagaaaagcggtataacggaagttgaccgaacagaggctaaagaaggtctaaaaagaggagaaataacccatcatgctgtttcaagaggatcagccaaattacaatggttcgtagaacgaaatatggtaataccagaaggtagagtaattgaccttggatgcggcagaggcggttggagttactactgtgccggacttaagaaagttacagaagtgagaggttatacaaagggaggtcctggtcatgaagaacccgttccgatgtcaacttatggatggaacattgtgaaactcatgtcaggaaaagatgtattttacttacctccggaaaagtgtgatacccttctatgcgacattggtgaatctagtcctagccctacagttgaagaaagtcgaacgattcgggttctaaagatggtcgaaccctggctcaaaaataaccaattctgtattaaagtgctaaatccatacatgcctaccgtcatagaacacctggaacgactgcaaagaaagcatggtggcatgctcgttcgaaatccgttatcacgaaattcgacacacgaaatgtattggatttcaaatggtacaggtaacatcgtggccagcgtaaacatggtaagtaggttactgctgaatagatttacgatgactcatagaagacctacaattgaaaaagatgtggacctgggggcaggtactcgtcatgttaatgcagaacccgaaacaccgaatatggatgttataggagagagaataaaacgtattaaagaagaacataactcaacttggcattacgatgatgagaacccctacaagacttgggcctatcatggatcatacgaagtgaaagctaccggatctgcttctagcatgattaacggcgtggttaaactactaacaaaaccctgggacgtggttcctatggttacacaaatggctatgaccgatacaactccttttggtcaacaaagggtttttaaggagaaagtagatactagaacacctcgttctatgccaggaactcgaagagtaatgggaataacagcagaatggctttggagaacgctaggcagaaataagaaacccagattatgtacaagggaggagtttacaaagaaggtcaggacaaatgccgcaatgggagcagtgtttacagaagaaaaccagtgggattcagcaaaagctgctgttgaagatgaagacttttggaagttggtagatcgtgaaagagaattacataaattggggaaatgtggttcctgcgtgtataacatgatggggaaaagagagaagaaactaggcgaatttggaaaagccaaaggatcacgcgcaatctggtacatgtggctaggtgcaaggtatttggagtttgaagcattaggatttcttaatgaggaccattggttttcccgagagaatagctactcgggtgtagaaggagaagggctccataagctaggctatatactccgcgatatatcaaaaatacccggtggggcgatgtatgcagatgacactgcaggatgggacacacgaattacagaagacgacttgcataacgaagagaaaattacccaacagatggacccagaacatagacagctcgctaatgccattttcaaattaacgtaccaaaataaagtagttaaagtccaaaggcctacaccaacaggaaccgtaatggatataatatccagaaaagaccaaagagggtcgggccaggttggcacttatggtctaaacacgtttactaatatggaggcacaattgattcgacaaatggaaggcgaaggcgtattaagtaaagccgacctagaaaatccacacctcccggagaagaaaattactcaatggttagagacaaaaggagtggaacgactaaaacggatggccattagtggagatgattgtgtagttaaacctatagatgataggtttgccaatgctttactagctttaaatgatatgggcaaagtcagaaaagatataccacagtggcaaccctcgaaaggatggcacgactggcaacaagtaccattttgttctcatcatttccatgagttaatcatgaaagacggtaggaaattggttgtcccatgtaggcctcaggatgagctaataggacgcgcaagaatctcccagggcgccggatggtcgttacgagagacagcatgtcttggaaaagcatatgctcaaatgtggagtctgatgtatttccacagaagagaccttcgactagcctccaatgccatttgttcggccgtacctgtacattgggtccctacctcaagaaccacatggtcaatacacgcccatcaccagtggatgacgacagaagatatgttgactgtatggaatagagtatggattgaagataacccatggatggaagataagacccccgttaccacatgggaagacgtgccttatctgggcaaacgagaagatcaatggtgcggttcattaataggactgacatctcgagccacatgggctcaaaatatccctaccgctatacagcaggtccgttctttaattggtaatgaagaatttttggactatatgccaagcatgaagaggtttcgaaaggaggaagagtcagaaggtgcaatttggtag

SEQ ID NO: 23255 - RNA, 9873 nt, synthetic construct
  misc_feature 1..9873: note = derived and/or modified CDS sequence (opt6) from DENV-3__KJ189272__SS-prME
  source 1..9873: mol_type = other RNA
acgagtctatgccttatgatgattctacctgcggcactagcctttcatcttacgtctagagatggagaaccgagaatgattgtaggtaaaaacgaacgaggaaaaagtctcctatttaaaacagcttctgggataaacatgtgcacgttaattgccatggacttaggtgaaatgtgcgatgatacggttacttataaatgcccctacataacagaggtggagcccgaagacattgactgctggtgtaatttgacaagtacatgggttacatatggaacatgcaatcaagcaggagaacatcgtcgggataaacgaagcgttgccctcgccccacatgttggaatgggtcttgatacacgaacccagacatggatgtcggcagaaggggcctggcgacaagttgaaaaagtagagacatgggccttgcgccatcctggatttacaattctcgcattatttttagcacattacattggaacaagtttaacacagaaagttgtaatatttattttactaatgttagtaacaccctccatgactatgagatgcgttggagtaggaaatcgtgactttgttgagggtcttagtggtgcaacgtgggtcgacgtagtactcgaacatggaggctgtgtaaccacgatggcgaaaaataaaccgaccctagatatagagttacagaaaacagaagccacccagcttgccacattacgaaaactctgcattgaaggaaaaataactaacataacgacagactctcgatgtcctacacaaggtgaagcggtactccccgaagaacaagatcagaattacgtctgtaaacatacgtacgttgaccgcggttggggaaacggatgtggactgttcggaaaaggtagtcttgtcacatgcgcgaaattccaatgcttggaacccatagaaggcaaagtggtacagtatgaaaacttaaaatacacggtaataatcacggtacacaccggcgatcaacatcaagtaggtaacgaaacacagggtgtaacggccgaaataacaccacaggctagcactacagaagcaacactacccgaatatggaacgcttggactggaatgttcacctcgtaccggcttagacttcaatgaaatgatacttttgactatgaaaaataaagcatggatggtacataggcaatggttctttgaccttcctttgccgtggacgtccggcgccactactgaaactccaacatggaatagaaaagagctcttggttacttttaaaaatgcacatgctaagaaacaggaagtagttgtattaggcagccaagaaggcgcaatgcataccgcactcacaggtgccactgagatacagaatagtggcggcactagcatatttgctgggcatctgaaatgtaggttaaaaatggataaactagaactgaagggaatgagttacgctatgtgtacaaacacatttgtcttaaagaaagaagtgagtgaaacgcagcatggaacaattctaatcaaagtagaatataaaggggaggatgcaccgtgcaaaattcccttctcaacagaagacggacatggtaaggcacataatgggaggcttattactgcaaatccagttgttacaaagaaagaagaaccagtttccatcgaagccgaacctccattcggagaatctaatatcgtgatcggtattggggacaacgcacttaaaataaattggtataagaaaggaagttctattggaaaaatgttcgaagcaacggcgcgcggagctagaagaatggccatactgggagatactgcttgggactttggatcagtaggaggtgttttgaactccttaggaaaaatggtacaccaaattttcggatcagcatataccgccttattctctggtgtgtcatgggtaatgaagattggtattggagtattattgacatggattgggctaaattccaaaaatacttcaatgtcattcagctgcatagccataggaataattactttatatctaggagcagtcgtacaagcagatatgggatgtgtaattaattggaaaggaaaggaactcaaatgcggttcgggtattttcgttactaacgaagttcatacttggacagaacagtacaaattccaagccgactcaccaaaaaggttggcaactgccatagcgggcgcctgggaaaacggagtatgcggaataagatcaacaaccaggatggaaaacctattatggaaacagattgccaacgaattgaattatattctatgggaaaataacattaaattaacggttgttgtaggagacatcatcggagttctggaacaggggaaaaggacacttactccgcaacccatggaattaaaatatagttggaaaacatggggtaaagctaaaatagtcacggcagagacgcagaactcatcatttataatagacggaccaaacacccctgaatgtccgagtgctagtcgtgcttggaacgtctgggaagtagaagattatggcttcggtgtgttcactaccaatatatggctaagattaagagaagtatatacacagctgtgtgatcatcgtcttatgagcgcggcagtcaaagatgagagggcagtacatgccgacatgggatactggatagaatcgcagaaaaacggttcatggaaactcgaaaaagcctccctgattgaagtaaaaacctgcacatggccgaaatcacatacattatggagtaacggtgtcctcgaatcagatatgataataccaaaatctcttgcggggcccatttcacaacataaccatagaccggggtatcatactcaaactgcaggaccttggcacttaggaaagttagaactcgattttaattactgcgaaggaaccactgtcgtaataacagaaaattgcggaacgcgaggacctagtttaagaacgaccacggtgagcggtaaacttatacacgagtggtgttgccgcagttgtaccctgccccctcttagatacatgggtgaggacgggtgttggtatggtatggagattagacctatcagtgaaaaggaagaaaatatggtaaagtcacttgtctctgccggtagtggaaaagtggacaactttacaatgggtgtattgtgcctcgccatactttttgaagaagtaatgcgtggaaagttcggtaagaaacacatgattgctggagtattctttacattcgtattacttctatctggacaaataacctggcgggacatggcgcataccttaatcatgattggatcaaacgcatctgatagaatgggaatgggggttacctatttagctctgattgcaacatttaaaattcaaccattccttgcattgggattctttttgaggaagctaacatctagggaaaacttgctattaggagtggggttagctatggccacaacacttcaattaccagaagacatagaacaaatggccaacggcatagcattgggattaatggctttgaaactaataactcagttcgagacataccaattatggacagcgctgatttcgttgacttgcagcaacacaatttttactttaaccgttgcatggcggactgcaacactaatattagccggagtatcactgcttcccgtgtgccaatcatcaagtatgcggaaaactgattggttgcctatggcagttgcagcaatgggtgtccctcctttacctttatttatattttcattaaaagatactctcaaaagacgtagttggccactcaatgaaggagtaatggctgtggggttggtgtctattctcgcctcatcacttttaaggaatgacgtcccaatggcaggacctttagtagcgggaggattattgatagcatgttatgtcataacgggtacaagtgcagatctaacagtagaaaaggctgctgacataacgtgggaagaagaggctgaacaaacaggggtttcacacaatttgatgataacggtagatgacgatggaacaatgcggatcaaagatgacgaaacggaaaatattttgaccgtactcttaaagacggctttactaattgtatctggcatatttccatacagcataccagcgactttattagtttggcacacgtggcaaaaacaaacgcaacggagtggagtgctgtgggacgtcccttctccgcccgaaacgcagaaggcagaattggaagaaggtgtatatagaataaaacaacaagggatctttggtaaaacacaagtaggagtaggcgtacaaaaagagggagtatttcatacaatgtggcatgttaccagaggagccgttcttacctataacggaaaaagattagaaccaaattgggcatcagtcaagaaagatttaatatcatacggtgggggatggagactttccacacaatggcaaaaaggtgaggaggtacaagtcatagcagttgaacctggtaaaaaccctaaaaattttcaaacaatgccaggtacattccagactacaactggtgaaataggtgcaatagctttagattttaaaccaggtacaagtggaagccctattataaatagagaaggtaaggtggtcggtttatacggaaatggggtggttactaaaaatggaggttatgtatctgggatagctcaaaccaatgcagaacctgatgggcctaccccagaactagaagaggaaatgtttaagaaaagaaatctaactataatggatttacatcctggctcaggtaaaacaagaaaatatttgccagcgatagttagagaagcaataaagaggaggttacggacactaatacttgctccaacacgcgttgtagctgcagaaatggaagaggccttaaaaggcttgccaattcgttatcaaacgacagcaactaaaagtgagcataccgggagggagatagtagacctaatgtgtcacgccacttttactatgagacttcttagtccagtcagggtaccaaactacaatctaataatcatggacgaagctcacttcacagatccggcatcaattgctgcgcgaggatatatatccacacgcgtgggcatgggtgaagcagctgcgatattcatgaccgcgacgccaccgggaacagcagatgctttcccacagtcgaacgcaccaatacaggacgaggaacgtgatataccagaaagatcctggaacagtggaaatgaatggataacagactttgccggaaaaacagtttggtttgtgccaagtataaaagcaggtaatgatatcgcaaattgcttacgaaagaatggcaagaaagtaatacaattatcccggaaaacatttgatactgaataccagaaaactaaacttaatgattgggatttcgtggtaacaacagatatttcagagatgggtgctaattttaaagcggaccgagtgattgatccgagacgctgtctaaaacccgtaattcttacagatggaccagaacgagtaattttggcaggccccatgcctgtgacagcagcgtcagcagcacaacgcagggggagagttggaagaaacccccaaaaagaaaacgatcaatatatattcactggtcaaccactaaataatgatgaagaccatgcccattggactgaagcgaagatgttgctcgataacattaatacacctgagggaatcattccggccttatttgaaccggaaagggaaaaatcagccgctatcgatggggaatatagactcaagggagaaagccggaaaacgttcgtggaactcatgcgtagaggcgatttaccagtctggctcgctcacaaggttgcgtcagaaggtataaagtatacggataggaaatggtgttttgacggtcagcgaaataaccaaatcttagaagaaaatatggacgtggaaatttggacgaaggaaggggaaaagaaaaagctccgtccacgttggctagatgctaggacatatagcgatcctctcgccctaaaagaatttaaagatttcgccgctggaagaaagtctatagcgcttgatttggtcacggaaataggtagggtcccctcgcacttagcgcatcggacaagaaacgctttagataacttagttatgctacatacaagtgaacatggtggtagagcgtatcgtcatgcggttgaagagttgccagaaacaatggagaccctacttttacttgggttaatgatactattaactggcggtgcaatgttattcctaataagtggtaagggaattggaaaaacctctattggtttaatctgcgttatagcatcgagtggcatgctttggatggcggaaataccactccagtggatagcttcggcaattgtgttagagttctttatgatggtcctattaataccagaaccagaaaaacagaggactccgcaagacaaccaacttgcatacgtcgtaatcggaatcttaacattagcagcaataatcgccgctaatgaaatgggtttgcttgaaacaacaaaaagagatctgggaatgtcaaaagaaccgggtgtagtgagtccaacatcttatttagacgtcgatctacatccagcttctgcatggaccctgtatgctgtagccactaccgtcataacgccgatgcttcgacatactatagaaaacagcacagcgaacgtaagcctagcagcaatagcgaatcaagctgttgtcctaatgggacttgataaaggctggccaatcagtaaaatggatctcggcgtaccattacttgcattaggatgttatagtcaggtgaacccgttaactctaacagcggctgttctattgctgatcacgcactatgcgatcataggaccaggcttacaagctaaagctactcgagaagctcaaaaacgaacagctgccggcatcatgaaaaatccgaccgtagacggaataatgacaatagacctagatcccgttatttacgacagtaaatttgaaaagcaactgggccaagtaatgctgttagtgctctgtgcggttcagttattgctaatgaggacaagttgggcattatgtgaagcattgacactggcgacaggaccaataactacactatgggaaggatcaccagggaaattctggaacaccacaatagctgtatccatggcaaacatattccgaggatcttacttggcgggtgccggtttagcatttagcataatgaaatcagtggggacgggaaaaagaggaaccgggtcacaaggcgaaacactaggggagaaatggaaaaagaaattaaatcaactatcaagaaaggaatttgacttgtataagaaatcaggcattacagaggtcgaccgaacagaagcgaaagagggactcaaaaggggagaaatcacacaccacgcagtcagtcgaggatctgcaaaactacaatggttcgtcgagagaaacatggtcatacccgagggtcgagttatagacttaggatgtggcaggggagggtggtcgtactactgtgccggtttaaagaaagttactgaggttagaggttatacaaagggcggaccgggacatgaggagccagttccgatgtccacatatggttggaatatagtaaaactaatgagtggcaaggatgttttctatctgccacctgagaaatgtgacacactgttatgtgacattggggaatcttctccatcccctactgtggaggagtctagaactattagagtactcaaaatggttgagccttggctcaaaaataatcaattctgtattaaggtgttgaacccatatatgcctacagttattgaacacctagaacgattacaaagaaaacatggaggaatgttggtcaggaatccactaagcagaaattcgactcacgaaatgtattggattagcaacggtaccgggaacatagtagctagtgtaaatatggtaagtcgcctcttgttaaatcgttttacaatgacacatcgaagacctacgatagaaaaagatgtagatctaggagcgggaacgagacacgtaaacgcggaaccagaaacaccaaatatggacgttataggggagcgtataaaaaggattaaagaagaacacaattcaacttggcactatgacgatgaaaacccctataaaacttgggcataccacggcagttacgaagttaaagctactggaagcgccagctcaatgatcaatggggtagtaaaattgctaacgaaaccgtgggacgtagttccgatggtaactcaaatggcaatgactgatactacgccttttggccaacaaagggtgtttaaagagaaagttgacaccagaacacccaggtccatgcccgggaccagaagagtcatgggtattactgctgaatggctatggcgaacattaggacgaaataaaaagcccagattatgcactagagaagaatttaccaagaaagttcggaccaatgcagcaatgggtgccgtattcaccgaagaaaaccaatgggattcagcaaaagcagcggtagaagatgaagatttttggaaattggttgatcgagagcgagagttacacaaattaggaaaatgtggaagttgcgtttacaacatgatgggaaaaagagagaagaaactcggagagttcggaaaagcaaaaggaagcagggccatctggtatatgtggttgggggctaggtatcttgagtttgaagcactgggcttcttgaatgaagatcattggttttcgagagaaaatagctatagtggcgtggaaggggaaggactccataaactaggatatatattgcgagacataagcaaaattccagggggtgcaatgtatgccgacgacactgctggctgggatactcgcataacagaagatgatttgcataatgaagagaaaataacacagcagatggatcccgaacatcgacaattagctaacgcaatattcaaattgacttatcagaacaaagttgtgaaagtgcagaggccgacaccaactggcacagttatggacataattagtaggaaggatcaacgcggaagcggccaagtaggaacgtacggcttgaacacattcacaaacatggaagcccaactcataagacagatggaaggggaaggtgtattatctaaagctgacctcgagaacccgcatctaccggagaaaaagattacacaatggcttgaaactaaaggggttgaacgccttaaaagaatggcaatttctggggacgattgcgtggtaaagccgatagacgatagattcgctaatgcacttctagcccttaatgatatgggaaaagttagaaaggacattccccagtggcagccctcaaaaggttggcatgattggcagcaggtacctttttgctcacaccactttcatgagttaataatgaaagacggtagaaaattagtagttccgtgtcggccacaggatgagctcattgggcgggcaagaatatcacaaggtgctgggtggtcgctaagagaaactgcctgtttaggcaaagcgtacgcacagatgtggtctcttatgtattttcatcgacgagatctaagactcgcatccaatgctatatgcagcgctgtaccagttcactgggtgccaacgtcgcgtacgacatggtctatacatgctcatcatcaatggatgactacagaagatatgttaactgtctggaacagagtctggatcgaagataatccttggatggaggataaaacaccggttacgacatgggaagatgttccttatttagggaaacgagaagatcagtggtgtggatcactcataggactcacgtcaagagctacatgggcacaaaatatacctactgctattcaacaagtgagaagtttgataggtaacgaagagtttttggactatatgccaagcatgaaacgttttaggaaagaggaggaaagcgaaggagccatatggtaa

SEQ ID NO: 23256 - RNA, 9873 nt, synthetic construct
  misc_feature 1..9873: note = derived and/or modified CDS sequence (opt6) from DENV-3__KJ189273__SS-prME
  source 1..9873: mol_type = other RNA
acatctctatgtctaatgatgatcctacccgcggccttagcctttcacttaacatcccgcgatggtgaaccgagaatgattgtaggcaaaaatgaaagaggaaaaagtctactattcaaaaccgccagtgggattaacatgtgtacgctaattgcaatggatcttggtgaaatgtgcgatgacacagtcacatataaatgcccacacatcactgaagttgaaccggaagatattgattgttggtgtaatttaacatcaacatgggtgacatatggtacttgcaatcaggcgggtgaacatcgcagggataaaagatcagttgctttagcaccacatgtaggtatgggactggacacaagaacacaaacttggatgtctgccgaaggagcgtggagacaagtagagaaagttgaaacatgggccttacggcatcccggatttactatcctagcactctttctggcgcattatattggtacgtctttaactcaaaaagtagttatatttatcttgctcatgctagttacaccctcaatgaccatgagatgcgtcggagttggaaatagagatttcgttgaaggattgagtggagccacgtgggtagacgtggtactagaacacggtggttgcgtaacaacaatggccaaaaataaaccaacactggatattgaattacagaaaactgaggccacacaattagctactttaaggaaactctgcatagaaggaaaaataactaacattacaactgattctagatgtcccacgcaaggagaagcagtattgccagaagaacaagaccagaattacgtttgcaaacacacatatgtggatcgtggatggggaaacggatgtggactctttggaaaagggtcattagtaacgtgcgcaaaatttcaatgtctggagcctatagaaggtaaagttgttcaatacgaaaatctgaaatacacagtaatcataacggtacacactggtgatcaacatcaagttggcaatgagacgcaaggagtaactgcagagataacaccccaagcatcaacaacagaggttacgttacccgaatacggcacattgggactagagtgttctccaagaactgggcttgatttcaatgagatgatattgttaacgatgaaaaacaaagcatggatggtacaccgacaatggttctttgaccttccactgccatggaccagcggggcaaccactgaaacacctacatggaatcgtaaagaactacttgtaacattcaaaaacgcgcacgccaagaaacaagaagtagtcgtattaggctctcaagagggagccatgcacaccgcgcttacaggtgcaacagaaatacaaaattcagggggaacatcaatttttgctggacacttgaaatgccggcttaaaatggataaactagaacttaaaggtatgtcttatgcaatgtgtacaaatactttcgttttaaagaaagaagtaagtgagacccaacatggaacaatactcataaaagtagaatataaaggtgaagacgcaccatgcaaaattccctttagtaccgaagacggacacggaaaagcccacaacgggcgcctaataactgcaaatcccgtagtaactaagaaagaagaaccggtaaacatagaggctgaacctccgtttggggaatcaaacatcgtcattgggattggggacaacgccttgaaaataaactggtataaaaagggaagctcaataggtaaaatgttcgaagcgacggcgcgtggtgcaagaagaatggccatcctgggagacacagcgtgggatttcggaagtgttgggggagttctcaattccctgggtaaaatggtacatcaaattttcggtagcgcatatactgcactgttttccggagtttcttgggtgatgaaaattggtataggagtattacttacatggattggcttaaacagtaagaacacatctatgagcttctcctgcatagcaataggaatcataacattatatctaggagcagtcgtgcaagcagacatgggttgcgtcatcaattggaaaggtaaagagctaaagtgcggttcaggtatctttgtgactaatgaggttcacacttggacggaacaatataaattccaagcagattctcccaaacgacttgctacagcgattgccggggcttgggaaaatggcgtttgtgggatcaggtctacaacaagaatggagaacctactgtggaagcaaatcgcaaatgaacttaattatatactatgggaaaataatattaagctaacggttgttgttggtgatatcataggagtattggagcaaggcaaaagaactcttacgccccagcccatggagcttaaatactcatggaaaacgtgggggaaggccaagattgtaacagccgagacacagaatagttccttcataatagacggtcccaacacaccagagtgtccttctgcttcgcgcgcatggaatgtgtgggaagttgaagattatggattcggtgtgttcacaactaacatctggctgcgcctcagagaagtatatacacagttgtgtgaccatcgattaatgtcagcagcggtgaaggatgaaagagcagtccatgcagatatgggatattggatagaaagtcagaaaaatggatcttggaaactagagaaagcatctctaatagaagttaaaacatgtacatggccgaaatcgcatacattgtggagtaatggtgttcttgagagtgacatgatcatccccaaatcattggcaggtccaatcagccaacataatcacagacctggataccacacacagactgcaggaccgtggcacctaggcaaactcgaattagattttaattattgtgaaggtactaccgtagtgataacagaaaactgtggtacaagaggtccatcacttcggactacaaccgtcagtgggaaactgatacatgaatggtgttgtcgaagctgcactttaccacctttaagatatatgggagaggatggatgttggtacggtatggaaataagaccgatttccgaaaaagaagaaaacatggtgaaatcgttggtttcagctggttcaggtaaagtggataatttcacgatgggcgtcttatgccttgcaatcttattcgaagaagtgatgagaggaaaattcggtaaaaagcacatgattgcaggcgtcttctttacattcgtgcttttgttatctggacagataacatggcgtgacatggcacatacactaataatgataggtagtaatgctagtgacagaatgggcatgggggttacgtacttagcactaattgctacgttcaaaatacaaccatttctagccctgggattcttcttaaggaaattaacctctcgcgaaaatctactcctaggagtcggcctcgctatggcaacaacactccagttaccagaagacattgagcagatggcaaatggtatagcattaggactgatggcattaaaacttattactcaatttgaaatataccaactttggaccgctctgataagtttaacgtgttcgaacaccattttcacactcactgtagcttggagaacggctacacttatactcgcaggcgtatcactattacccgtttgccaaagtagctctatgcgtaagactgactggctaccaatggctgttgccgcgatgggcgtaccaccactccccctatttatattttcgttaaaagatacgttaaaacggaggagctggccattaaatgaaggtgttatggcagtaggtctagttagcattttagctagcagtttactaagaaacgacgtccctatggcaggaccattagtggcgggtggactactgatcgcctgctatgttatcactgggacatcagctgatttaaccgtagaaaaagctgctgacattacttgggaagaagaagcggaacaaactggagtctcgcataatttaatgatcaccgtagatgatgatggtaccatgagaataaaagacgatgaaaccgaaaacattcttactgttctactaaaaacagccttattaattgtgtcgggaatatttccatatagcataccggcgaccctcttagtttggcatacttggcaaaaacaaacacagcgatccggagtactatgggacgtaccaagtcccccggagacccaaaaagctgaattagaagagggtgtgtataggataaaacagcaaggtatattcggaaagacccaggtcggtgtaggagtacaaaaggaaggagtatttcatactatgtggcatgtgactagaggcgcggtcttaacatataacggcaaaagactagagcctaattgggcatcagtcaagaaagaccttatatcatacggaggcggctggagattgtctacccaatggcaaaaaggtgaggaagtccaggtcatagcagttgagcctggaaagaacccgaaaaatttccaaacaatgcccggaacttttcagacaacaactggcgaaattggtgcgattgctcttgattttaaaccgggaacaagtggaagtcccataattaacagagaaggtaaagttgtaggtctatatggaaacggagtagtcactaagaacggaggatatgtaagtgggattgctcaaacaaatgctgaaccagacggcccgactcctgaacttgaagaggagatgtttaagaaacgtaacctgaccataatggacttacacccagggagtggcaaaacaagaaagtatctaccggctatagtacgggaagcaataaaacggcgactccgtacattgattctcgctcctaccagagttgtagctgcggaaatggaagaagctctcaagggattaccaatccggtatcagacaacagccacaaaaagcgaacacactggacgagaaatagtagatctcatgtgtcacgcaacgtttacaatgcggttactttctccagttagagtgccaaattataacctaataataatggatgaggcgcatttcaccgatcccgcgagtatagcagctcgtggttacatctcaacaagagtaggcatgggcgaggctgcggcgatatttatgacagcaacaccgccaggtaccgcagatgcattccctcagtctaacgccccaatacaagatgaagaacgtgacataccagagagatcatggaactcaggcaatgagtggatcactgactttgcagggaagacagtttggtttgtaccatctataaaagcgggtaatgatatagcaaattgtctaaggaaaaatggtaagaaagtaatacagctctctcggaaaacattcgatacagagtatcagaaaactaaattgaatgactgggattttgtagtgacaacagacatatcagaaatgggagctaactttaaagcagacagagtaattgatcctagaagatgtcttaaacccgtaatattaactgatggtccagaacgggtgattctagctggtccaatgccagttacagccgcttcagccgcccaaaggagaggaagagtcgggaggaaccctcagaaggaaaatgatcaatatatttttacgggtcaaccactcaataacgatgaagatcacgcacattggacagaggcgaaaatgcttctagataacataaatacaccagaaggtataatcccagctctattcgaaccagaacgagaaaagagtgctgcaatagatggcgaatacagattaaagggagagtcgcggaaaacattcgtggaactaatgcgccgtggagacttaccggtatggttagcgcataaagtagccagtgagggtataaaatacacagatagaaaatggtgcttcgatggtcaacgaaacaaccaaatattagaggaaaacatggatgttgaaatctggactaaagaaggggagaaaaagaaactcagaccgagatggcttgacgcgcgtacttactcagatccgttagcattaaaagaatttaaagattttgcagctgggcgcaaatcaattgcgcttgatctggttactgaaataggacgagtaccaagtcatctagcgcatagaacaaggaatgcactggacaatctagtcatgttacacacgagtgagcacggaggcagagcctatcggcatgccgttgaagaactacctgagacaatggagacattattactattagggcttatgattctattgacaggtggagctatgctgttcctaattagtggaaaaggtattggaaaaacatcaattgggttgatatgcgttatagctagctcggggatgttatggatggctgaaatacccctacagtggattgcttcagcgatcgtcctcgagttctttatgatggttttgctcatccctgagccagaaaaacaaagaacaccacaggataaccaactggcatatgtagtaattggcattcttaccttagctgcaataattgcggcaaatgaaatgggcctacttgaaacgaccaagagggaccttggaatgtcaaaggaaccaggtgtagtatcaccaacgtcatacctagatgttgaccttcatcccgctagtgcttggaccctatacgcggtagctaccacagtcattacacctatgttaagacatacaatagaaaattctaccgcaaacgtgagtcttgcggctatagctaaccaagctgtcgtcctcatgggcttagataaaggatggcccatcagtaaaatggacctaggagttccactactggccttaggttgttattcacaagtaaacccattaactttaacagccgcggttttgcttttaataacgcattacgccattataggcccaggtttgcaggccaaagcaaccagagaggcacagaagcggaccgcagcaggaattatgaagaaccccacagtagatggaataatgactattgatttagatcctgtcatttatgactcgaaatttgagaaacaattgggacaagtaatgttactggttctgtgcgcggtacaattattactaatgcgtacttcatgggcgttgtgtgaggccttaacactcgcaacaggtcccataaccacgctatgggaagggtctcctggtaaattttggaatacgactatagctgtatcaatggccaatatttttcgcggttcttacttagccggggcaggactagctttttcaattatgaaaagcgtgggcactggaaaaagagggactggaagccagggtgaaacactcggtgagaagtggaagaagaaactgaatcaacttagcagaaaggaatttgatctatacaaaaagtcagggataaccgaagtagatagaacagaagcaaaagaagggttaaaaagaggcgaaatcactcaccacgcagtcagtcgaggttctgcaaagctccaatggtttgtagaaagaaacatggtaattccggaaggacgggtaattgatcttggatgcgggagaggaggttggtcttattactgcgctggcttaaagaaagtcactgaagttagagggtatacgaaagggggacctggtcacgaggaacctgtacctatgtccacttatggctggaacatagttaaattaatgtcaggaaaagacgtgttttatctacccccggaaaaatgtgacacattactctgtgatatcggagaatcaagtccaagcccaacagttgaagaaagtcggacgatacgggtactaaagatggtagagccatggctaaagaacaatcagttttgtattaaagttttaaacccatatatgccgaccgtaattgagcatctagaaaggctacaaagaaaacacggagggatgctcgtcaggaatcctctatcccgaaattcgacgcatgaaatgtactggatctcaaacggaacaggaaacatagtagcctcggtaaatatggtatcacggttgctcctaaatagatttacaatgacacacaggagaccgacaattgaaaaagatgtagaccttggagcaggaactaggcacgtcaatgcagaaccagagacacctaatatggatgtaataggtgaaagaattaaacgaataaaagaggaacacaacagcacttggcattatgatgatgaaaatccttataaaacatgggcatatcatggtagctatgaagttaaagcgacggggtcagcatcctcaatgataaatggagtcgtgaaacttcttacaaaaccctgggatgtagttcctatggtaactcaaatggctatgaccgatacaactccgtttggccaacagcgagtttttaaggaaaaagtagacacaagaacacctcgctcaatgcctggtactcgtagagtaatgggaattacagcagagtggctatggcgcacactaggtcgtaataagaaaccacgactatgcacgagagaagaatttacgaaaaaggtaagaacaaacgctgcaatgggtgcagtcttcactgaagaaaatcaatgggactcagcaaaagcggccgtagaggatgaggatttctggaaattagtcgaccgcgaaagggaactacataaattaggaaaatgtggtagctgtgtatacaacatgatgggcaaacgggagaagaaactaggtgaatttggaaaagccaaaggatccagagcaatttggtatatgtggctgggggcacgatacctagaatttgaagccttaggtttccttaacgaggaccactggtttagtcgagaaaacagctactcgggagtcgaaggtgaaggtttgcataagttaggatatattttaagagacatatcgaaaataccaggaggtgctatgtatgctgatgatacagccggttgggatacgcgaataacagaggatgatctccataatgaggagaaaataacacagcaaatggatccggagcatagacaacttgcaaacgcaatatttaagctaacctatcaaaacaaagtggtaaaagttcaacgtcccactcctacaggaacggtcatggacattataagtcggaaagatcagcgaggttccgggcaagtaggaacgtatggtttaaatacgttcacaaacatggaagcacaactgatccgtcaaatggagggggaaggagtattaagtaaagctgacctcgaaaatccccatctgccagagaagaaaattacacaatggttggagacaaaaggagttgaaagattaaaacggatggccatttcaggagatgattgtgtagtcaagccaatcgatgataggttcgccaatgctcttttagcgcttaacgatatgggtaaagtacgcaaagatataccacaatggcaaccatctaaagggtggcatgattggcaacaagtcccgttttgttcgcatcattttcacgaactcataatgaaagacggacgaaagttggtagtaccttgtcgtcctcaagatgaattaataggccgagcacgaattagccaaggcgccggatggtctctacgggaaacagcatgtttgggtaaagcctatgcccaaatgtggagtttaatgtactttcaccgacgggacttaaggttagcgagtaatgctatttgctctgccgtcccggtccattgggtcccaacaagtagaactacatggagtatacatgctcatcatcaatggatgacgactgaagatatgttaactgtatggaacagagtatggatagaagacaacccttggatggaagacaagaccccagtgactacgtgggaagatgtaccataccttggtaaaagagaagatcaatggtgcggtagcctaataggccttacctctagagcaacttgggcacagaacattccgaccgcaatacagcaagtaagaagcctaattggtaatgaagaatttcttgactatatgccatccatgaaaagattcaggaaagaagaagagtcagaaggagccatttggtag

SEQ ID NO: 23257 - RNA, 9873 nt, synthetic construct
  misc_feature 1..9873: note = derived and/or modified CDS sequence (opt6) from DENV-3__KJ189274__SS-prME
  source 1..9873: mol_type = other RNA
acgagtttatgtttgatgatgatattgccagctgccctggctttccatcttacaagtagagacggtgaaccaagaatgatcgtgggcaaaaatgaacgcggaaaatctttattattcaaaactgcatcaggcataaatatgtgcacactaatcgcaatggacctaggagaaatgtgcgatgacactgtcacgtataaatgtcctcatattaccgaagtagaacctgaagatatcgattgctggtgcaatctcacctctacgtgggttacttatgggacatgtaaccaagctggagaacatagacgggataaaagatcagtagcacttgctccacacgtagggatgggattagatactcggactcaaacttggatgtcagcagaaggtgcttggagacaagttgaaaaagtagaaacgtgggcactacgacacccaggatttacaattctagctctattcctggcccattatatcggcacaagtttaacacaaaaagttgttatatttatattactcatgctggtaactccatcaatgaccatgagatgtgtgggcgtggggaatagagattttgtagaaggtctgtctggggcaacgtgggtggatgtcgtattagaacatggaggatgcgtaacaacgatggctaaaaataaacctacgctcgacattgaactacagaaaacggaagcaacacaattagctacactccgaaaattatgtatagaaggtaaaataacaaatattacaaccgatagtagatgccccacgcagggagaagcagttctccctgaagaacaagaccaaaactatgtatgtaaacacacttatgtagatagagggtggggcaatgggtgcggcttgtttgggaaaggttctcttgttacatgtgcaaaatttcagtgtctagaacctatagaaggaaaagtagttcaatatgagaacctaaaatatacagtaattatcaccgtacacacaggtgatcaacatcaagtaggaaacgagacacagggagttacggcggaaattacaccacaagcaagtaccacagaagcgactttaccagagtacggcacattaggtttggaatgttcccctcgaaccggattggatttcaatgaaatgatcctactaactatgaaaaataaagcatggatggtacatagacagtggttctttgacctgccacttccgtggacaagtggtgcgactaccgaaactcctacttggaatcgcaaagaattactggtgacatttaaaaacgcacacgctaagaaacaagaagtagttgtattaggatcgcaggaaggtgcaatgcataccgctttaacaggagcgacagaaattcagaatagcggcggaacaagtattttcgctggacatcttaaatgcagactgaaaatggataaactagaattaaaaggaatgtcttacgccatgtgtactaacactttcgtgctaaagaaagaagtctccgaaacacaacacggaacaattttaatcaaagtggaatataaaggagaagacgccccttgtaagattcctttctcgactgaggatggccatggcaaagctcacaatggaagacttataacggcaaacccagtagttaccaagaaagaagaacccgtaaatatagaagcagaaccgccatttggtgagtctaacatcgtaattggtataggcgataacgcgctgaaaataaactggtacaaaaaggggagtagcattggaaaaatgttcgaggcaacagcccgcggtgcgcgaagaatggccatattaggagatacagcttgggactttggatctgttggtggcgtcttgaatagcttaggcaaaatggttcatcagattttcggtagtgcctatactgctctctttagcggagtatcctgggtaatgaaaataggaataggtgtattactaacatggattggattaaatagtaaaaatacctctatgtctttttcttgtatcgctataggcattataaccctatatctaggtgcagttgtacaagctgatatgggatgtgtaattaactggaaaggaaaagagctcaaatgtggcagcggtattttcgttacgaatgaagttcacacctggacggaacagtataaattccaagcagatagtccaaaaagattagcaactgcaatagccggtgcatgggaaaatggtgtttgtggtataagatcaactacaagaatggaaaatctattatggaaacagatcgccaacgagttaaattatattctatgggagaataatataaaattgacggtagttgtcggcgatattatcggagttttggaacagggaagaagaacactcacgccacaaccgatggaattaaaatattcttggaaaacatggggtaaggcaaaaatagtgactgcagaaacacaaaattccagtttcatcattgacgggccaaatacacctgaatgtccaagtgcctcacgtgcttggaacgtatgggaggtcgaggattatgggtttggtgtattcacaacaaatatatggttacgactacgggaagtctatactcagttatgcgatcacagactaatgagcgccgctgtaaaagacgaaagagctgttcacgccgatatgggatactggatagaaagccagaaaaatggatcatggaaattggaaaaagctagccttatagaagttaaaacatgtacttggcctaaatctcacactctctggtcaaatggtgtactagaaagtgatatgataatacccaagagcttagcaggacctattagtcaacataaccacagacctgggtatcatacacagacagcaggaccgtggcacctaggtaaacttgaacttgactttaactactgcgaaggcacgactgtagttatcactgaaaattgtggaaccagaggtccgtcgcttaggaccactaccgtcagcggcaaattaattcacgaatggtgctgtcgttcgtgcacacttccaccattaaggtacatgggtgaagatggctgctggtatggtatggagataaggccaatatctgaaaaagaagaaaacatggtaaaaagtcttgtaagtgcagggagcggtaaagtagataactttacgatgggagttttatgtttagcaatcttatttgaagaagttatgcgaggtaaatttggcaagaaacatatgattgcgggcgttttctttacttttgttctactgctatcgggacaaatcacatggcgggacatggcacatactcttataatgattggtagtaacgcttcagacagaatgggtatgggagtaacatatttagcactaattgcaacctttaaaattcaaccttttcttgctctgggatttttcttacgaaaactaacatcaagagaaaatttactgctcggagttggcctcgccatggcaacaacattacaattacccgaagacatagaacaaatggccaacggtattgcattagggcttatggccttaaaattaattacacaattcgaaatatatcaactatggaccgcattgatttccttaacatgttccaatacgatattcactctaacggtcgcgtggagaactgccactctcatactggccggagtctcattgcttcccgtgtgtcaatcaagttctatgcgaaaaacagactggttacccatggccgttgcagcaatgggggtgcccccactacccctttttattttcagtttaaaagatacgcttaaaagaagatcctggccactaaatgaaggtgttatggctgtgggtttagtgtcaattcttgcgagcagtctcctgcgcaatgacgttccgatggctggacctctagtcgctggcggactgttaatagcttgttatgttataactggaacgtcggctgatctgactgttgagaaagcagctgacataacttgggaagaagaggcggaacaaacgggagtatcacacaatttaatgataactgtggacgacgatggaacaatgaggatcaaagatgatgaaactgagaatatccttacagtattattaaaaactgcattactaattgtttccggaattttcccatatagtataccagcaacattattagtatggcatacctggcagaaacaaacccaaaggtcaggtgtactatgggatgtaccttcacctccagaaacgcagaaggctgagttagaagaaggagtttatcgtataaaacaacagggtatattcggcaagactcaagtaggtgtaggtgtacaaaaagaaggagtattccacacaatgtggcacgttacaagaggagctgtcctgacatacaacggtaaaaggctagaacccaattgggcatcggtcaaaaaggacctcataagttacgggggtggctggagactttcgacccaatggcagaaaggggaggaagtacaggttatagccgttgagccgggaaagaatcccaaaaattttcaaaccatgccaggtacgttccaaacgacaactggcgaaataggagctatagcattagactttaaaccaggcacaagtggttctccgatcatcaacagagaaggaaaagtagttggcttatacggaaacggagtagtcactaaaaatggcggatatgtgtcaggtatagcgcagaccaatgcagaaccagacggccccactcccgaattggaggaagaaatgtttaagaaaagaaacctaacaataatggatttacacccgggtagcggaaagacgagaaaatacttacccgcgatagttcgagaagccataaaaagaagattacgtacgttaatactcgctcccacacgagtggttgctgctgaaatggaagaagcattgaaaggattacccataaggtaccaaacaacagcaaccaaatcggaacacacgggcagagagatcgttgacttaatgtgccatgcaacttttacaatgcgattgttatctccagtaagggtacctaactataatttaataatcatggatgaggctcattttactgaccccgctagcattgctgcgcgcgggtatatctcaacaagagtagggatgggggaagcagccgctatattcatgaccgcgactcccccaggaacagctgacgcattcccgcagagtaacgcgcctatacaagacgaagaaagagatataccagaaaggagttggaatagtggtaacgagtggatcaccgattttgcaggaaaaaccgtatggtttgtaccgagtataaaagcgggaaatgatattgccaattgcctgaggaaaaatggcaagaaagttattcagctatctagaaagacatttgatactgaatatcaaaagaccaaactaaatgattgggactttgtagtaacaactgatatatcggaaatgggagcaaattttaaagcagatcgggtaatagacccacgtcgctgtttaaagccagtcatattaacagatgggccggaaagggttatacttgcaggccctatgcctgttactgcagccagtgctgctcagcgcaggggtagagtaggtagaaatccacaaaaggagaacgatcagtacatctttacagggcaacctttaaacaatgacgaagaccatgcacattggacggaagcaaaaatgttattagacaacattaacactccagaaggcatcatccctgcattatttgaaccagagagagagaaaagcgcagcaattgacggcgaatatagactaaaaggagaaagtaggaaaacattcgtagagctcatgaggcgtggggatctcccggtatggttagcgcataaagttgcgtcagagggaataaaatatacagaccgcaagtggtgcttcgatgggcagcggaacaatcagatattggaagagaacatggatgtagaaatatggacaaaagagggtgagaagaagaaactgcgtcctagatggttagatgcaagaacctacagtgaccccctagcacttaaagaatttaaagattttgccgctgggcgaaaatcaattgcacttgatctagtcactgaaattggacgtgtgccttcacatttagctcaccggactaggaacgcccttgacaacctcgtaatgcttcacacatcagaacatggaggacgtgcctacagacacgcagtcgaggaactacctgaaaccatggaaacgctactcttgctaggattaatgatactccttacagggggtgccatgctattcctaatcagtggaaaaggcataggtaagacgtcaataggtttgatttgcgtaatcgcatcttctggtatgttatggatggctgagataccactacaatggattgcgagtgctatagtactcgagttcttcatgatggttttactaatacccgaacctgagaagcaaaggactccacaagataaccaattagcttatgtagtgataggaattttaacattagcggcgataattgctgccaatgaaatgggtttactagagacaacaaaaagagacctgggaatgtcgaaggagccaggtgtcgtgagccccacatcttatttggatgtagacctccatcctgcgagcgcatggacattatatgcggtcgcaacaacggtaattacaccaatgcttaggcacacgatagaaaattctacggcaaatgtatctctagccgccatagcaaaccaggctgttgtcttaatgggactagataaagggtggccaataagcaagatggatctaggcgtaccgctattggcgttggggtgctatagccaagtaaaccctttgaccctcactgcagcggtattactattgattacgcactatgctataataggacccggtttacaggctaaagcgaccagggaggcacaaaagcgaactgcggctgggatcatgaaaaaccccaccgttgacggtattatgacgatagatttagaccccgtaatttacgacagcaaatttgagaagcagttagggcaagttatgctgctcgtcttatgtgccgtgcaattattattgatgagaacatcgtgggcgttgtgtgaagctctcactttggcaactgggcctattactaccctatgggaaggctcacctggaaaattttggaatacaacaatcgccgtatcaatggcaaatatatttagaggaagttatctcgccggtgcaggactagctttttcaattatgaaatcggtcggtactggcaaacgaggtaccggcagtcaaggcgaaacacttggcgaaaaatggaagaagaaattgaatcagctatcgagaaaggagttcgacctatacaagaaaagcggaatcacagaagtcgacagaacagaggctaaagaaggtctaaaacgcggagaaataacccaccacgctgttagccgcggaagtgctaaactgcaatggttcgtcgaacggaatatggttatacctgaagggagggtaatagatctcggttgtggaagaggcggctggagttattactgcgccggtttgaagaaagtaactgaggtacgaggctatacgaagggtggtccagggcacgaagaacctgttccaatgtcaacatacggctggaatattgtaaaactaatgagtgggaaagatgttttctatttaccaccagaaaagtgcgatactctactatgtgatataggagaatcatctccctcacccacggtagaagaaagtagaaccataagagtattgaaaatggtagagccttggctcaagaataatcaattttgtattaaagtgctaaacccttacatgccaacagtaattgaacatttagaaagacttcagcgtaagcatggaggaatgctggtgcgaaatcctttatcaagaaacagcacacacgagatgtactggatatcaaatggaacgggaaatatagtagcaagtgtaaatatggtgtctcgtctacttctgaatcgattcacaatgacccaccgtagaccaaccatagaaaaagacgtggacttgggtgcaggtacacggcacgttaatgcagagccggaaacacccaatatggacgtgataggcgaacgtattaaaagaatcagggaagaacacaactcaacctggcattatgatgacgaaaatccgtataaaacatgggcataccatggaagttatgaagtaaaagcaactggctcagcttcatccatgataaacggtgtggtaaaactattaactaagccatgggatgtggtaccaatggttacccagatggctatgactgacaccaccccgtttggacaacaacgtgtctttaaagaaaaagtagatactaggacacccagatccatgcctggcacacgtagagtaatgggtatcacagccgagtggctttggcgaacattgggaaggaacaagaaacccaggttgtgtactcgcgaagaatttactaagaaagtacgtacgaatgcagctatgggcgccgtttttactgaagagaatcagtgggatagcgctaaagcagcagtagaggatgaagacttttggaagttagtcgacagagaacgagaactacacaaacttggtaaatgtggatcatgtgtttacaatatgatgggtaaaagagagaagaaattaggggaatttggtaaagccaaagggagtcgagcaatatggtatatgtggctaggagctaggtatctcgagttcgaggcactcgggtttctaaacgaagaccactggttttcgagagaaaatagttactccggagtagagggcgaaggtctacataagttaggctatattttgagagatatcagcaaaatacctggcggcgcaatgtacgcagacgataccgcaggttgggatacaagaataactgaggatgatctgcataacgaagagaaaatcacgcaacaaatggacccggaacatagacaattagcaaacgcaattttcaaattgacttatcaaaataaagttgtcaaagtacagagaccgacgcccacaggcacggtaatggatatcatcagtcgtaaagatcaaagagggtccggacaggtaggcacatatggcttaaatacctttactaatatggaggcccagttaatccgacaaatggaaggtgaaggagttctcagtaaggctgatttggagaacccccatctaccggagaagaaaatcactcaatggctagaaactaaaggtgtagaaaggctcaaaagaatggctatatcgggagacgactgcgtagtaaaacctatagatgatcgctttgctaatgcattactagcactaaatgacatggggaaagtgagaaaagatattcctcaatggcaaccttcgaaaggatggcatgactggcaacaggtacctttctgcagccatcacttccatgagttaataatgaaagacggtaggaaactggtagttccttgtcgaccgcaagacgaactcataggacgtgcgagaatatcccaaggggcaggttggtctctaagagaaaccgcatgtttgggtaaagcatatgcacagatgtggtcgctgatgtactttcaccggagggatcttcgtttagcatctaacgcaatctgctcggctgtaccagtacattgggttccgacatccagaacaacttggtcaattcacgctcatcaccaatggatgacaacggaagatatgctaaccgtatggaacagggtatggatagaagataatccatggatggaagacaagactccagtaacgacatgggaggacgtaccgtatctcggtaaaagagaagaccagtggtgtgggtcactcatcggtcttacttctagggccacttgggcacaaaatataccgaccgcaatacaacaagttagaagtttaatcggaaatgaagaatttctagactatatgccatccatgaagagattccgaaaagaggaagaatcagagggagcaatttggtag

SEQ ID NO: 23258 - RNA, 9873 nt, synthetic construct
  misc_feature 1..9873: note = derived and/or modified CDS sequence (opt6) from DENV-3__KJ189275__SS-prME
  source 1..9873: mol_type = other RNA
acctctctgtgtcttatgatgatattgccagctgcactagccttccatcttacatcacgtgacggcgagcctcgaatgatcgttgggaagaatgaacgaggaaaatcccttttgtttaaaacagcatcggggataaacatgtgcacattaattgcaatggacctaggggagatgtgtgacgatacggtcacgtataagtgtccccatataacagaagtcgaacctgaagatatcgactgctggtgtaatctaacctcgacatgggttacttacggtacctgcaaccaagctggtgaacatcgaagagataaacgctccgtagcattagcacctcatgtaggcatgggactagatacaaggacacagacatggatgtccgccgaaggagcttggcgtcaggttgaaaaggttgaaacctgggcattgcgtcatcctggatttacgatactggcactatttttagcccactatatcggaacgagtttaacacagaaagtagtaatcttcattttattaatgctagtaactccaagtatgacgatgagatgtgttggggtgggcaatagagacttcgtggagggattatccggcgccacatgggtggatgttgtgcttgaacacgggggctgtgtgaccacgatggcgaaaaacaaaccaacattagatatagaattacaaaagactgaagcaacacaactggctacattaagaaagttatgcattgagggaaaaataaccaacataacaacagattcaaggtgcccaactcaaggcgaagcggtgctgccggaagagcaagatcaaaactatgtatgtaaacatacgtacgttgatagaggatggggaaatgggtgtggcctattcgggaaaggcagtctagtaacatgcgcaaaattccaatgtttggagccaatagaaggaaaagtagtgcaatatgaaaatctgaaatacacagtcattataacagtgcacacaggtgatcaacatcaagttggaaatgagacgcagggcgtaactgctgaaattacgccgcaagctagtacaacagaagcaacactacctgagtatggtacgttaggtttggagtgctcacctcgaactggcttagatttcaacgaaatgatattactgacgatgaagaataaagcttggatggtccaccgacagtggttctttgacctccccctaccatggacatcaggtgcaactacggagacacctacatggaaccgaaaagaactcttagttacttttaagaatgcgcacgcgaaaaaacaggaagttgtagttcttggttcacaagagggggcgatgcatacagctttgactggagccactgagatccaaaatagcggtggtacatctatattcgcagggcatctaaaatgtagactaaagatggataaacttgaactaaaaggaatgtcctacgccatgtgcactaacacattcgtattaaaaaaagaagtgtcggaaacgcaacacggtacaattctcataaaagttgaatacaaaggcgaggacgcaccgtgtaaaataccgttcagcactgaagacggacatggtaaggcacacaatggacgtttaataactgcgaaccccgtagtaacaaagaaagaagaaccggtgaatatagaagccgaaccgccatttggcgagtccaatatagtaattggaataggagataatgccctcaaaataaactggtataaaaaggggtctagcatcggaaagatgtttgaagccaccgccaggggggctagacgtatggcaatcttaggagatacagcatgggatttcggaagcgtcggaggagttctaaactccttagggaagatggtacatcaaatatttggatcagcatatactgctttgtttagcggcgtgtcttgggtaatgaaaattgggattggagtacttttgacgtggatagggttaaattctaaaaacacttcaatgagctttagctgtatagcaattggtatcataacattgtatttgggagctgttgtccaggcagacatggggtgtgtaattaactggaaggggaaagagcttaaatgcggtagcggaatatttgttacaaatgaagtacatacgtggacagagcagtacaagttccaggccgactcacccaagcgtctcgcaacagcaattgcgggagcatgggaaaatggggtctgtgggatcagatctacgacacgaatggagaatttactatggaaacaaattgccaacgaattaaactacattctatgggaaaataacataaaacttacagtggtagtaggtgatattataggagttttagaacagggcagacggactttaacaccacaaccaatggagctaaaatactcatggaaaacatggggcaaagcgaaaatcgttacagcagaaacgcaaaattccagctttattattgatggcccgaacactccagaatgtccttcagcgtcaagggcttggaacgtatgggaggtggaagattacggatttggcgtgtttaccaccaatatttggctgagactaagagaagtctacacccaattatgtgatcataggctaatgtccgccgcagtaaaagatgaacgcgcagtgcacgcagatatggggtattggatagagagccaaaaaaatggatcatggaaattagaaaaagcgagcttaatcgaggtaaaaacatgcacttggccaaaatctcatacactatggagtaatggtgtgctggaaagcgacatgataatacctaaatccctcgctggacccatctcgcaacataaccaccgtccaggttatcatacacagacggctggcccttggcatttgggaaagcttgaacttgattttaattattgtgaagggacaacagttgttataacagaaaattgtggaactcgcggcccatccttgaggactacaacggtgtcaggcaaactcatacatgaatggtgttgccggtcctgtacactacctcctctacgatacatgggcgaggatggatgctggtatggaatggaaattcgacccatttctgagaaagaagaaaatatggtgaagtcattagtaagcgcaggatcaggcaaggttgataactttacaatgggtgtcctttgcttagccatattgtttgaagaggtaatgagaggcaaattcgggaaaaaacatatgatcgctggtgtattttttactttcgttttgctgttaagtgggcaaataacctggagagacatggcacatactctaattatgataggatcaaatgcaagtgacagaatgggaatgggtgtaacatacctagctcttattgccacgtttaaaatacagccctttctcgctttgggtttctttctacgaaagttaacgtcaagagaaaatctactactcggagtaggtttagctatggccactactttacaactgccagaagatatcgaacaaatggccaatggaattgctttaggcttgatggcgctgaaactaatcacacaatttgaaacctatcaattatggaccgctctcatatccttaacttgtagcaacactatatttacgttaacggtagcatggcgaaccgcaacgcttatactggctggcgtgagtctattgcctgtttgccaaagttcatccatgcggaaaacagactggctaccgatggccgttgcggcaatgggtgtacccccattacccttatttattttttctttgaaggatacactaaagagacgtagttggccgctaaacgagggagtcatggcagtaggactagtttctatattggctagcagcttgttaaggaacgatgtacctatggcaggccccttagttgccggcggcttacttatagcatgttatgttattacaggcacttcagcggatctaactgttgagaaagcagcggatataacatgggaggaagaagcagaacaaactggtgtaagtcataacctgatgatcacggttgatgatgatggcactatgcgaattaaggacgacgaaacggaaaacatactaacggtacttttgaagacggctttattaattgtatcaggaatatttccatattcaatacctgcgacgcttctggtatggcatacatggcaaaaacaaacgcaacgaagcggtgtattatgggatgttccgtcaccaccagagactcaaaaagcagagctagaggagggtgtatacaggataaaacaacaagggatatttgggaagactcaggtaggcgtgggagttcaaaaggagggtgtgtttcataccatgtggcatgtaacaagaggggctgtactaacttacaatggtaaacgtctagaaccaaattgggcatcagtaaaaaaagacttaatatcttacggaggtggctggcgactgtcaacacaatggcaaaaaggagaagaagtacaggtaatcgcagtagagcctgggaaaaatccaaaaaatttccaaaccatgcctgggaccttccaaaccactacgggggaaattggagcaattgcactcgatttcaagccgggcactagtggatctcctatcattaatagagaaggtaaagttgttggattatacggtaatggagtagtgacaaaaaacggaggctatgtttctggaatagctcagaccaatgccgagccagacggaccaacacccgagcttgaagaggaaatgtttaaaaaaaggaacctcacaattatggacctgcatcccggctccggaaaaacacgaaaatatctcccagcaattgtccgagaagcaattaaaagaagactgcgaacattaatactggcccccaccagagttgtagcagctgagatggaagaggcattaaaaggcctaccaataagataccagacaacggccaccaaaagtgaacataccgggagagaaatcgtagatttaatgtgccatgcaacattcactatgcgattactaagcccagtccgtgtacccaattataatcttataataatggacgaagcacattttactgatcccgcatcaatagctgctagaggatatatcagtactagggtaggcatgggcgaagccgctgccatatttatgacagcgacaccccctgggacggccgacgcattcccccagtccaacgctcctattcaggacgaagagagagatataccagaaaggtcatggaattcaggtaatgaatggattacggattttgcggggaagaccgtatggtttgtcccgagtataaaagcgggaaacgacatagccaattgtctacgaaaaaacggaaagaaggtaatacaattaagcagaaaaacgtttgacaccgaataccagaaaaccaaacttaacgattgggactttgtggttacaacggacattagtgaaatgggagcgaattttaaagcagatagggtaatagatcctcggagatgtctaaaaccagtcattttaaccgacggtccggaacgtgtcatactcgcaggcccaatgccagtgacggccgcaagtgcagctcagcgacgaggtagggtgggtagaaatccgcaaaaagaaaatgaccagtacatatttacaggacagccactaaacaatgatgaagatcatgcacactggacagaggccaaaatgttactcgacaatataaacacacctgaaggaataatcccggctctgtttgaacctgaaagagaaaaatctgcagcaatagatggagaatataggctaaaaggtgaatcaagaaaaacctttgtagaactaatgagaagaggagatttacctgtctggttagcacacaaggtagctagtgaaggtattaagtacacagatcgaaagtggtgctttgacggtcaaagaaataaccaaatattggaagaaaacatggatgtagaaatctggacaaaggaaggcgaaaaaaagaaactaaggccacgctggttggatgctcgcacatacagtgacccgcttgccctcaaagaatttaaagattttgctgccggtagaaagagtatagcactagatttggttacagagataggtagagtgccatctcatttagcacacaggactagaaacgcattagacaatttagttatgttacatacaagtgagcacgggggcagagcatacagacacgcggtagaagaactccctgaaacaatggaaacattattattacttggtcttatgatacttttgaccggaggtgcgatgctctttttaataagtggaaaaggaattggcaagacgagcattggactaatatgcgtcatagctagctcgggaatgctatggatggcggaaataccgcttcaatggatcgcttcagcgatagtacttgagttttttatgatggtcttactaataccagagccagaaaagcagcgcacgccacaagacaaccaactggcatacgtggtaataggaatattaacgcttgcagcaataatagctgctaacgaaatgggtcttcttgagacgacaaaaagagacttaggcatgtcgaaagaaccaggagtcgtgagtccgacatcttatctagacgttgatttacatcctgccagcgcctggaccctttacgcggtagcaactaccgtcataaccccaatgcttcgccatactatcgaaaacagtaccgcaaatgtaagcctggctgcaatagccaaccaagctgtagttcttatgggactagacaagggttggcccatcagtaagatggatctcggagtgccactacttgcactgggctgttatagccaagtgaacccattaacattgactgctgccgttttattgttaataacacattatgctataatcggtccaggtctacaagctaaagccacacgagaggcacaaaaaagaaccgctgcaggcattatgaagaatccaactgtagatgggatcatgacgatagatcttgacccagtaatatacgactccaagtttgaaaaacagttaggtcaagttatgctattagtcctatgcgcagtacaactactcttaatgagaacttcctgggcactttgcgaagcgcttacacttgcaacaggaccaataacaacactatgggaagggtcgccagggaagttttggaacactacaattgcggtctcgatggcaaatatatttagaggatcctatctagccggagctggcttggcattctccattatgaaatcggtaggtacgggaaaaagggggacaggatcacaaggcgagacgctaggagaaaaatggaaaaaaaaattgaaccaattgtccaggaaagaatttgacttatacaagaaatccggcataacagaagtagatcgcacagaagcaaaggaaggtctaaaacgaggcgaaataacacaccatgcagtttccagaggatccgctaaattacaatggtttgtagagcgtaatatggtcatacctgaaggtagggtgatagacttgggctgcggccgaggagggtggagctattactgtgctggtttgaaaaaggtgaccgaagtacgagggtacactaaaggaggtcctgggcacgaagaaccagtacctatgagtacatatggatggaacatagtaaaactgatgtcggggaaagatgtattttatcttccgccagaaaaatgtgatacacttctgtgcgacattggagaaagcagcccaagtccaactgtagaagaatcgcgaactattagagtgctaaaaatggttgaaccttggttgaaaaacaaccagttttgcattaaagttctaaacccctatatgccaacggtaatcgaacatctagaacgactgcaaaggaaacacggtggaatgttagtaagaaaccctctaagccgcaatagtacccacgaaatgtactggataagtaatggaacaggaaatattgttgcatcggtcaacatggtatcgaggctcttattgaatcgattcaccatgactcaccgtagaccaaccatcgagaaagatgtagatttaggtgctggcacacgccacgtcaacgcagaacccgaaacccctaacatggatgttattggggaaaggattaaaagaattagagaagaacataattctacttggcactatgacgatgagaatccctataaaacatgggcttaccatggctcctacgaagtaaaggctactggatctgcatcaagtatgataaacggggtggtgaagttattgacaaaaccctgggatgttgttccaatggtgacgcaaatggcaatgacagatactaccccgtttggacaacagcgagtatttaaggaaaaagtagacacaagaactccaagatccatgccaggtacgagaagggttatgggtataacagcagaatggttgtggcgaaccctcggccgcaacaaaaaaccgagattgtgtacaagagaagagtttacaaaaaaagttcgaacgaatgcggcaatgggtgcagtgttcacagaagaaaatcagtgggacagtgcgaaagctgctgttgaagatgaagacttttggaaactcgtagacagagagagagaattacataaactgggcaaatgtggttcgtgcgtttacaatatgatgggtaaaagagaaaaaaagctaggagaattcgggaaagcgaaaggttcaagagctatctggtacatgtggctgggggcacgatacttagaattcgaggctttaggttttctgaatgaagatcactggttttctagggagaatagttactcaggcgtggaaggcgaaggtctccataagttgggatatatcctacgagatattagtaagatcccaggcggtgcaatgtatgcagatgacactgcgggatgggatacgagaataaccgaagatgatttacataacgaagagaagatcacgcaacagatggatcccgaacatagacaactagcaaacgcaatctttaaattgacttatcaaaacaaagttgtaaaagttcaaagaccaacaccaacaggaacggttatggacattatctcacgtaaagatcaaagaggttccggccaggtaggaacatacggcctaaatacatttacaaatatggaggcccaattaatacgccagatggagggtgagggggtattgtctaaagccgatcttgagaatccacatcttcctgaaaaaaagatcacgcaatggctcgaaacgaaaggagtcgaaagattgaaaaggatggccatatctggagatgattgcgtagtaaaaccgattgacgaccgatttgcaaacgcacttctggcgttgaatgatatggggaaagtccggaaggacattccgcaatggcaaccctcaaaaggttggcacgactggcaacaagtcccattttgtagtcatcatttccatgaattaattatgaaagatggtcgaaaattagtggtcccttgcaggccacaagatgaacttataggaagggctaggattagtcaaggcgctggttggagcctgagggaaacagcctgcctaggcaaagcctatgcccaaatgtggtcattgatgtatttccacagaagggacttgaggttggccagcaatgcgatttgttcagctgtaccagtgcactgggttccaacaagtcgaacaacgtggtcgatacacgctcaccaccaatggatgacaacagaggatatgttaacagtatggaatcgcgtctggattgaagataacccttggatggaggacaagacacccgttactacatgggaagatgtaccttacttaggtaaacgagaagatcaatggtgtggcagccttattggcctaacatcgcgagcaacatgggcacagaacatccctacagcaatccagcaagtaagatcgctaatcggtaacgaggaatttctcgattacatgccatccatgaaacgtttcagaaaggaagaagaatctgaaggcgcaatttggtaa

SEQ ID NO: 23259 - RNA, 9873 nt, synthetic construct
  misc_feature 1..9873: note = derived and/or modified CDS sequence (opt6) from DENV-3__KJ189276__SS-prME
  source 1..9873: mol_type = other RNA
acgtccttatgtttaatgatgatattgcctgctgctttggcttttcatttaacttctagggacggggaaccgagaatgatagtgggcaaaaatgaacgcgggaaaagcctactattcaagaccgctagcggaataaatatgtgtacattgattgctatggacttaggtgaaatgtgcgatgatactgtaacatataagtgtccacatatcactgaggttgagccagaggatatcgactgttggtgtaatttaacaagtacttgggtaacatatggaacctgtaatcaggcgggcgaacacagacgcgataagaggtcggtagctctagcaccccatgtaggaatgggtttggatacaaggacccaaacgtggatgtcagccgaaggagcgtggcgccaggtagaaaaggttgagacttgggccttacgacatcctggtttcacgatactcgctttgtttctggcacattatataggaacttcattaacacaaaaagtagtgatttttattctactcatgcttgtaacaccatctatgaccatgagatgtgttggtgttggaaatagagatttcgtggagggattaagcggagccacatgggttgatgttgtactagagcatggcggatgtgtcacaacaatggccaaaaataaaccaacacttgacatagagttgcaaaagactgaagctactcaattagccactctcagaaaactctgtatagaaggtaaaattactaatattaccacagatagtcgatgtccaacacagggtgaagctgtactgcctgaagaacaagatcagaattatgtatgtaaacacacatacgttgacaggggctggggtaatggctgtggcctattcggtaagggaagcttagttacttgcgctaagttccaatgtctagagcctatagaaggtaaggtcgttcaatatgagaacttaaaatatacagtaatcataaccgttcatacaggagaccagcatcaagtggggaacgaaacccaaggggtaactgcagaaattactcctcaagcatctactaccgaagccacattacccgaatatggaacgttagggttacagtgttccccaaggaccggcttagactttaatgaaatgatcctactaacaatgaaaaataaagcctggatggttcatcgacaatggttctttgacttacccctaccatggactagtggagcgaccagcgaaacaccaacctggaatcgaaaagaattattagtaactttcaagaatgcacatgcaaagaaacaagaagttgttgtactcggatcacaagaaggcgcgatgcatacagcactaacaggcgcaacggaaatacagaattcgggtggaacatcaatatttgctggacatctcaaatgtcgattaaaaatggacaaattagagttaaaagggatgtcctacgccatgtgtacaaatacttttgtcctaaaaaaggaagtatcagagacacaacacggtacgatccttattaaagtagaatataaaggcgaagatgcgccatgcaaaataccattcagtactgaggatggacatggaaaagcacataatggaagacttattactgccaacccagttgtgacaaaaaaggaggagccagtcaacatcgaagccgagccacctttcggagagagcaatattgtaattggcattggggataatgctttaaagataaactggtataaaaaagggagttccataggcaaaatgtttgaagctaccgcacgcggagccagaagaatggcaatactaggtgatacagcgtgggattttggatcggtaggaggcgtactgaactcgcttggcaaaatggtacaccagatcttcggaagtgcatatacagccttgttttctggtgtctcatgggtcatgaagataggtataggggtccttctaacatggattggattaaattcaaagaatacatcgatgagtttctcatgtatagccataggaataataacattatatttgggagctgtagtacaagcagacatgggctgtgtaattaattggaaaggaaaagagttaaaatgtggatctggtatctttgtcaccaacgaagtacacacgtggacagagcaatacaaatttcaagctgacagtcccaaacgtctcgcgacggcaattgctggcgcatgggagaacggagtctgtggaatcagaagtacaactagaatggaaaatcttctatggaagcagatagctaatgagctaaactatattttatgggaaaataatatcaagctaaccgttgtagtcggtgatattataggtgtactcgagcaagggaaacgaacattgacgccacagcctatggaattaaagtattcgtggaaaacatgggggaaagcaaaaattgtcacagccgagacacaaaatagttcgtttataattgatggaccaaacacgcccgagtgtccaagtgcttcaagggcctggaacgtatgggaagttgaggactatggttttggtgtattcacaacgaatatatggttgagactacgtgaagtttatacacaattgtgcgatcataggttgatgagcgctgctgtaaaagacgaaagggcagtacatgcggatatgggttactggatagagtcacagaagaatggatcatggaagcttgagaaggcaagtttaatcgaagtcaagacctgcacatggccaaaatcacacacgctatggagcaacggagtcctagaaagcgacatgataattccgaaaagtctagcaggaccaattagccaacacaatcacagaccagggtatcacacccaaactgccgggccctggcatctaggaaaattagaacttgatttcaactactgtgaaggcacgacggtcgtcataacagaaaattgtggtactcgcggtccctctctaaggacaacaacggtatctgggaaactaatacacgaatggtgttgcagaagttgtactcttcctccacttcggtatatgggagaagacggatgctggtacggaatggaaattaggccaatttcagaaaaagaagaaaatatggtcaaatccttagtctcggctgggagtggaaaagttgataattttactatgggagtattgtgccttgcaatattatttgaagaagtaatgaggggcaaattcggaaagaaacatatgatagctggcgtttttttcacctttgtcctgctcctttccggtcaaataacatggagggatatggcacataccttaataatgataggatcaaatgcgtctgatcgaatgggcatgggagtaacttacctcgcgctcattgctacattcaagattcaaccatttttagcattaggtttcttcctaagaaaattaacatctcgcgaaaatttacttttaggggtgggcctagccatggcaactactctacaattacctgaagatattgaacaaatggccaatggaattgcattaggattaatggccttaaaactaatcactcagttcgaaacttaccaattatggacagctttgatctcattaacatgctcaaacaccatcttcaccttgacggtagcatggaggacagctacattaatactagctggtgtgagccttctgcccgtgtgccaaagttcgtcaatgagaaaaacagattggcttcctatggctgtagcagctatgggggtcccacccctgcctctgttcatattctcattaaaagataccctaaaacgacgatcatggcccctaaacgaaggagttatggcagtaggattagtaagcatactcgcgtcctcgttattgcgaaacgatgtacccatggcaggaccgctagtagctggaggtttgctaattgcctgctacgttataacgggtacaagcgcagatcttacagtcgaaaaagctgcagatataacttgggaagaagaggcagagcaaaccggagtatcacacaatctaatgataacagttgatgacgatggtacaatgcgaattaaagatgacgagacagaaaacatcctaacggtgctgttaaaaactgctcttctaattgtttctggtatatttccctattcaatcccagctacgcttctagtatggcacacatggcagaaacaaacacagcgatccggtgtattatgggatgtaccatccccacccgagactcaaaaagcagaactggaagaaggcgtttataggataaaacagcaaggcatatttggaaaaactcaggtcggagtaggtgtgcaaaaagaaggtgtttttcacactatgtggcatgtgacacgtggagcagtccttacatacaatgggaaacgattagagccgaactgggcttccgtcaagaaagacttaatttcttatggaggcggttggagattaagtactcaatggcaaaaaggtgaagaggtacaagtcatagctgtcgaacctggtaaaaatcctaaaaattttcaaacaatgccagggactttccaaacaaccacgggcgaaataggcgcgatcgcccttgacttcaagccaggtacctccggttcaccaatcataaacagggaagggaaagtcgtggggctatatggaaacggagtggtaaccaaaaatggaggttatgtttccgggatagcacaaacaaatgcagaacctgacggcccaacgcccgagcttgaggaagagatgtttaaaaaaaggaacctaacaataatggacttgcacccaggttcagggaagacccggaagtacttaccagccatagtcagagaagccataaaaagacgactgcgaaccctaatattagccccaactcgggtagtcgcggcagagatggaagaagcgttaaaaggattgccgatcagatatcagactaccgctactaaaagtgaacatactggaagagaaatagtcgatctcatgtgccacgctacattcacaatgcgattgttaagtccagttagagtccccaactacaacttaattattatggatgaagcccattttactgacccagcctcgattgcagctcggggatacatcagtacacgggttggaatgggagaggcggcagccatatttatgacagcaactcccccagggacagctgatgcttttccacaatcaaatgctccgattcaagacgaagagcgagacataccagaaagaagttggaatagcggtaacgaatggataacggacttcgctggaaagacggtatggttcgtaccttcaattaaagcgggcaatgacatcgctaactgcttacgaaaaaatggaaaaaaagttattcaactttcacgaaagacatttgacactgaataccagaaaacaaagctcaacgactgggactttgttgttacaacagatataagtgaaatgggggcaaattttaaggctgaccgggtaatagacccgaggagatgtcttaaacctgtcatattaacggatggaccagaaagagtaattctagcaggtccaatgcctgtcacagcagcaagtgctgctcaacgcagaggaagggtcggacgaaatccgcagaaagaaaacgaccagtacattttcacaggtcagcccctcaacaacgatgaggatcacgcccattggacggaagcaaaaatgttacttgataatataaatacaccagaagggataataccggccctcttcgagccggagagggaaaaaagtgccgctatagatggggaatatcgcttgaagggcgaatcaagaaagacatttgtggaattaatgagacggggggatctccctgtatggcttgcgcataaagttgctagcgaaggaatcaaatacacagatcgaaaatggtgctttgatggtcaaagaaacaaccaaatactggaggaaaatatggacgttgaaatctggacaaaagaaggggaaaagaaaaaactgcggccacgttggctcgacgctcgaacatactctgacccattagccttaaaagaattcaaggattttgctgcgggtaggaaatctatagctctagaccttgttactgaaatcggaagggtaccatcacacctagcccacaggactagaaatgccctcgacaatctggtcatgcttcacactagcgaacacggtggacgtgcatatcgtcacgctgtagaagaacttccagaaactatggagactttgctcttacttggattaatgatattactaacaggtggagcaatgctttttttaatatctggtaaggggatcgggaaaacatcgataggccttatctgtgtcatcgcttcatccggtatgctttggatggcagaaataccgttacaatggatagcgtccgctatagtccttgagttttttatgatggtattgctgatacctgaaccagaaaaacaaagaacaccacaagacaaccaactagcatatgtagtaattggaatactaacacttgcagcaattatagccgcaaacgaaatggggctgctagaaacaacaaaaagagaccttggcatgagtaaggagcctggtgtcgtgtccccgacatcttatcttgacgtggacttacatccagcctcagcgtggaccctctatgcggttgcaaccacagttatcaccccaatgctgagacacacaatagaaaactcaacagctaacgtcagcttagctgccatagcaaatcaggcggtcgtcctaatgggactagataaaggatggccgatatcgaaaatggacctgggagtaccattgctggctctaggatgctatagtcaagtaaaccccctgacattaacagcagctgtgctcttactcataacacactatgcaatcataggacctggtttacaagcgaaagcaacgcgagaagcacaaaaaagaacagcagcgggcatcatgaaaaaccccaccgtggacggcataatgacgatagatttggatccagtaatatatgactcaaaatttgaaaagcaattgggtcaggtcatgctactagtgctctgtgctgtgcaacttttattaatgcgaacatcgtgggcgctttgtgaggctctaacccttgccacaggcccaataaccacactatgggaaggatcgccaggtaagttctggaacaccacaattgcagtatctatggcaaacatatttcgcggctcttatttagcaggtgctggcttagcattctcaatcatgaaatctgtcgggactggaaaacgaggaacaggctcgcagggagagacattaggagaaaagtggaaaaaaaagcttaatcaattatcacggaaagaatttgatctatacaaaaagagtggtataactgaggtagatcgtacagaagctaaggaaggccttaaaagaggagaaatcactcatcacgccgtttctagaggttcagcaaaattacaatggttcgtggaaagaaatatggtaattcccgaaggacgggtcatagacttaggatgtggaagaggcggttggtcttactattgcgcaggtctaaaaaaggtcacagaagtgagaggctatacaaagggaggacctggtcatgaagaacccgtacctatgtctacttatggatggaatatagttaaactaatgagtgggaaagatgtgttttacctacctccagagaaatgcgataccctcttatgcgacatcggggaatcatcaccaagtccgacagtcgaagaaagtaggaccataagagtcctgaaaatggtcgaaccttggttaaagaataatcaattttgtataaaagttctaaacccatacatgccaacggtaattgaacatctggagagattgcaacgaaaacatggggggatgttagtgagaaacccactttcaaggaattctacccacgagatgtattggataagtaacggaaccggaaatatagtggcatccgtcaacatggtaagcagacttctgttaaatagattcacgatgacgcataggcggccgaccatagagaaagacgttgacctaggagctggcactagacacgtcaatgctgaaccagaaacaccgaacatggatgtaataggagaaaggataaaaagaataaaagaagaacataacagtacatggcactatgacgatgagaatccatataaaacctgggcgtaccatggtagttatgaagtgaaagcaacaggttcagcttcaagcatgatcaatggagttgtaaaacttttaacgaaaccatgggacgtcgttccgatggtaacacaaatggcaatgactgatacaacaccttttggacagcaaagagtattcaaagagaaagttgatacccgaaccccgagatctatgccagggacgcgacgtgtcatgggtataactgcagagtggctatggagaactctggggagaaataagaaaccacgcttatgtacacgcgaagaatttacaaaaaaagttagaacaaatgcagctatgggtgcagtatttacagaagagaaccaatggaatagtgcaaaagccgccgttgaggacgaggatttttggaaattagtggatcgtgagagggaattacacaaactgggcaaatgcgggagttgcgtgtataatatgatgggcaaaagagaaaaaaaattaggggaatttgggaaagcaaaagggtctagggcaatctggtacatgtggttaggtgcaagatatctagaatttgaagctctaggctttttaaatgaagaccactggttctctcgagaaaactcttactccggagttgaaggcgagggattgcataagttaggatatatcctacgagatatttcgaagatacctggaggcgcaatgtatgcagacgacacagcaggatgggatactagaataactgaagatgatcttcataatgaggagaaaattacccaacaaatggacccggagcataggcgattagcgaatgcaatattcaaattaacttatcaaaacaaagtcgtcaaagtacagcggcctacaccaaccggaacagtaatggacattatctcccgaaaggatcagcgtggttcaggacaggttggaacatacggacttaacacattcactaacatggaggctcaacttattagacaaatggaaggagagggcgtccttagcaaggctgacttagagaacccacacctaccagaaaaaaaaatcacacagtggttagaaacaaaaggagttgaacgattaaaacgaatggcaatatctggagacgactgcgttgtaaagcctattgacgaccggttcgcaaatgctctattagcattaaatgatatgggaaaagtaagaaaggacatacctcaatggcaaccctcaaaaggatggcacgattggcagcaagtccctttttgctctcaccactttcacgaactaattatgaaggacgggaggaaattagtggttccgtgtcgaccacaagacgaattaattggcagggcgcgcatttcacaaggagcgggatggagcctccgagagactgcttgtctaggaaaagcatatgcacaaatgtggagtctaatgtactttcatagaagggatttgcgattagcatcgaacgctatatgcagtgcagtaccagtccattgggtgcccacaagcagaacaacatggagtattcacgcgcaccaccaatggatgactacagaagatatgctaacagtatggaaccgagtatggatagaagacaacccttggatggaagacaaaacgccagtaaccacatgggaagatgtcccgtacttagggaagagagaagatcaatggtgtggtagcctaataggattaaccagccgagcgacgtgggcccaaaacatcccaacagcaattcagcaagtcagatcactaattggaaatgaggagtttttagactacatgccaagtatgaaaagatttaggaaagaggaggaatccgagggagccatttggtag

SEQ ID NO: 23260 - RNA, 9873 nt, synthetic construct
  misc_feature 1..9873: note = derived and/or modified CDS sequence (opt6) from DENV-3__KJ189277__SS-prME
  source 1..9873: mol_type = other RNA
acttcattgtgtttaatgatgattttaccagcagcgttggcgttccatctaacaagcagagacggtgaaccgagaatgattgtaggcaaaaacgaaaggggaaaatctctactgtttaaaactgcatcagggattaatatgtgtacgttgatagcaatggatctaggagaaatgtgcgacgatactgtaacatataaatgtcctcacattactgaagtagaacccgaagatatcgattgttggtgtaatctcaccagtacttgggtaacatatgggacctgtaaccaagccggtgaacatcggagagataaacgatcagttgcgttagcacctcatgtaggtatgggtttggatacacgcactcaaacgtggatgtcagcagaaggagcgtggaggcaagtagaaaaagttgaaacatgggcattacgacacccgggattcacaatattagctttattcttagcgcattatatcggtacctctctaacgcaaaaagttgtgatcttcatattgctcatgctagttacacctagcatgacaatgagatgtgttggagtcggaaaccgagactttgttgaaggattaagcggcgccacgtgggtagacgtagtcctagaacacggtggttgtgtgacaacgatggccaaaaataaaccaactttagacatcgaattgcagaaaacagaagccacccaattggcaactttgcggaaactctgcatagaaggcaaaattacaaatattacaactgattctagatgtcccacgcaaggcgaagcggtgttaccggaagaacaggatcaaaactatgtttgcaaacatacatatgtagatcgaggatggggtaacggctgcgggttgttcgggaaaggctccctagtaacatgtgctaagtttcaatgtttagaaccgatagagggaaaagtggtgcaatacgaaaacctaaaatacacagttataataacagttcacacaggagatcaacatcaagtcggaaacgagacccaaggagttacggcagagattaccccgcaggcaagtacaacggaagcaacgctgccggaatatggtactctaggcctgcaatgctctccaaggactgggctagattttaatgaaatgattctactaacgatgaaaaataaagcatggatggtacatagacaatggttctttgacttacccttgccctggacatccggggctacctcagaaacccccacctggaacagaaaagagttattagttacttttaaaaatgcacatgcaaagaaacaagaggtagtagtgttaggttcacaagaaggggctatgcacacagcacttactggggccacagaaattcagaacagcggagggacgtcgattttcgcagggcacctaaaatgtagattgaaaatggataaacttgaattaaaaggcatgtcatacgctatgtgtacaaatactttcgtactcaagaaagaggtatctgagacgcaacacggaacaatattaataaaagtagaatacaagggcgaagatgcgccatgtaaaataccattttctactgaagatgggcatggtaaagcacataatggccgtctgatcaccgctaatcccgtggtaacgaagaaagaagaaccagtcaacatcgaagcggaaccaccttttggagaaagcaatatagtaataggaattggagataatgccctcaaaattaattggtataagaaagggtctagtattgggaaaatgtttgaagcaacagcacggggtgctcgtagaatggccattttaggagacaccgcatgggattttggatcagtaggaggagtgctcaattcactcggtaaaatggtacaccaaattttcgggtcagcatataccgcattattcagtggagtatcttgggtaatgaaaataggtattggagtgctactaacatggattggattaaacagcaagaatacttcaatgtcgttctcatgtattgcgataggcataataaccttatatttaggtgctgtcgtacaggcggacatgggctgtgttatcaactggaagggaaaagaactaaaatgtggaagcggcatatttgttacaaatgaggtgcatacatggactgaacagtataagtttcaggcagactctcccaaaaggttagcgacagcaatagcaggagcttgggaaaatggagtgtgcggcataagaagcacgacgcgtatggaaaatttactatggaagcaaatagcgaacgaactcaactacattttatgggaaaacaatataaaacttaccgttgtcgttggagacattataggagtattagaacagggaaagcgtaccttaacgcctcagccaatggaactcaagtattcgtggaaaacctggggaaaagccaaaatagtaaccgctgaaacacaaaacagcagtttcatcattgacggtccgaatactcccgagtgccccagtgcatcacgtgcctggaacgtttgggaagtcgaagactacggatttggcgtatttacgacaaacatatggctaagactaagggaggcttacacgcagttgtgcgatcacagattaatgagtgcagcggttaaagatgagagggcagtacatgccgatatggggtattggatagagagtcagaagaacgggtcttggaaactcgaaaaggcttcacttatagaagtaaaaacctgcacatggcccaagtcacatacattatggagcaacggagtactcgaatcagatatgataatacctaagagcttagcagggcctatatcacaacataaccatagacccggttaccacacacaaactgcaggtccgtggcatttaggcaaattagaattagacttcaactactgcgaggggacgacagttgtcataacagagaactgtggtaccaggggaccgtcactaagaacaactacagtttccggaaaacttatacacgagtggtgctgtagaagttgtacactaccaccattaagatacatgggagaagatggatgttggtacgggatggaaatccgacctatatctgaaaaagaagaaaacatggttaagagtttagttagtgccgggagcggcaaagtagataactttacgatgggagttttatgtttagcgatattattcgaagaagtgatgagagggaaatttggcaagaaacatatgatcgccggtgtattcttcacgttcgttttactactatccggtcagataacgtggagagatatggcacatactcttatcatgatcgggagtaatgcgtccgaccgtatgggaatgggtgtaacctatcttgcattaatcgcaacattcaaaatacagccatttttagcattaggattctttttaagaaaactaaccagccgagaaaatctattactaggagtagggctggcaatggccaccaccttacagttaccggaagatatagagcaaatggcaaatggaatagctctagggcttatggccttaaaactgatcacccaatttgagacatatcaattatggacagccctaatcagcttaacatgtagtaatacaatatttacactaacagtagcttggcgcacagcaacgctaatactagctggtgtaagcctacttccagtgtgccaatctagttcgatgaggaaaactgattggctaccaatggcagtcgctgctatgggagtcccgccgctaccattatttatattctcattgaaggatactctaaaaagaaggagctggccgcttaacgaaggcgtaatggcagtgggcttagttagtatcctagctagttctctgctaaggaatgacgtgccaatggccggaccgctagtcgctggaggtctacttatagcctgctacgtaatcaccggtacaagcgccgatcttaccgttgaaaaagcagctgacattacgtgggaggaagaagccgaacaaactggcgttagtcacaacctgatgattacagtagacgacgatggaacaatgagaataaaagatgatgagacggagaatatattaactgtcctacttaaaacagcgttattaatagtatcaggcatattcccatactctataccggcaaccctcttagtttggcacacatggcaaaaacaaacccaacgatcaggtgtgctgtgggatgtaccttcccctcctgagactcaaaaagcggaattagaagaaggtgtgtaccgcattaagcaacaaggaatatttggaaagactcaagtgggtgtaggtgtacagaaagaaggagtatttcacacaatgtggcatgtaaccagaggagctgtcctcacgtacaatggtaaaaggcttgaaccgaactgggcctctgtgaagaaggaccttatctcatatggtggaggatggagactaagtacgcaatggcaaaaaggagaggaagtccaggtgatagctgtagagccgggcaaaaatcccaaaaattttcaaaccatgccaggaacctttcaaacaactactggcgaaataggagcaattgcattggattttaaaccaggaacctccggctcaccaattataaatagagaaggaaaggtcgtagggttatacggaaatggtgtcgtcactaaaaacggtggatatgtaagcggaattgcccaaacaaacgcagaacccgatggaccgacgcctgagttagaagaggaaatgttcaagaagagaaatctgacaataatggatctacatccgggttcgggtaaaacacgaaaatacctacccgcaatcgtacgtgaagccattaagagaagacttagaaccttaatcctagctcctacccgggttgtagcagctgaaatggaggaagcattaaaagggcttccgataaggtaccaaacaacggctacaaagagtgaacatacaggccgagagatcgttgacctaatgtgtcacgctacttttaccatgcgcctattaagcccagttcgagttcccaattataacctaatcattatggacgaagctcattttaccgacccagccagtattgctgcgcgtggctatatctcaaccagggtaggaatgggtgaagcagctgctatatttatgacagcaacccctcctggcactgcagacgcgttcccacaaagcaatgcaccgatccaagacgaagaacgagatataccagaacgaagttggaactcaggaaatgaatggataacagactttgccggaaaaaccgtctggtttgttccgtctataaaagcaggaaatgatatcgccaattgtcttaggaaaaacggcaaaaaggttatacagttgtcaagaaagacctttgatactgaatatcagaaaacaaaattgaatgactgggatttcgtagtgacaaccgatatcagtgaaatgggagcaaactttaaggcagatcgagtaattgatccaagaagatgtttaaaaccggtgatattaacagacggacccgaaagagtcattctcgcaggtccaatgccggtgacagcagcttccgccgcgcagcgtcggggacgagtaggtagaaatcctcaaaaggaaaacgaccagtacattttcacaggacagccattaaacaacgacgaagatcatgctcattggaccgaagcaaagatgctattggataacataaatacgccagagggaataatccctgctttatttgaaccagaacgagagaaaagtgcggcaatagatggcgaatacaggttaaagggggaatctaggaaaacatttgttgaactaatgcggagaggggatcttccagtatggcttgcccacaaggttgcatctgagggcatcaaatataccgataggaaatggtgcttcgatggacaaagaaacaatcaaatactagaagaaaatatggatgtagaaatttggacaaaggaaggagaaaagaagaaactaaggccaaggtggctcgatgctcgaacctattcagatccgctagcgctaaaagaatttaaagactttgcagccgggcgcaaaagtatcgcactggatctggtcactgaaataggacgagtgccgagtcacttagcacaccgaactaggaatgccttggataatctggtgatgctacacacctcggagcacgggggacgagcctacagacatgccgtagaagagttaccagaaacaatggaaacgctattactactgggattaatgatattactgacaggaggtgcaatgcttttcctaatatccggaaaaggtataggaaaaacctcaataggtttaatatgtgttatcgctagttccggcatgttatggatggctgaaatcccgctacaatggattgcaagcgccatagttctagagttctttatgatggttctattaatccccgaacctgaaaaacaacgcacacctcaggacaaccagcttgcttacgtcgttattggaatattaactcttgctgcaattatcgcagctaatgaaatgggcctacttgaaaccacaaaacgagatttagggatgagtaaggaaccaggcgtcgtatctccaacttcttacttggatgttgatttacatccggcaagtgcctggacactatatgctgtggccactaccgtaattacgccgatgttaagacacacaattgaaaattctaccgcgaatgttagcttggcagccatcgccaaccaagccgtggtcctaatggggcttgataaaggatggccaatcagcaaaatggatttaggagtaccattattggcattgggatgttactcacaagtcaacccacttacgctgacagccgcagttcttcttctaattacacattatgcaattattggaccaggattgcaagcgaaggcgactagggaagcacaaaaacggacagcagcaggcattatgaagaacccaacggtggatggtataatgaccatcgacctagaccccgtaatttatgatagtaaattcgaaaaacaattgggtcaagtaatgctactggtcctttgtgctgtgcagctactcttaatgagaacatcatgggcactatgtgaggctttaacccttgcgaccggaccaataacaaccctttgggaaggaagcccaggaaagttttggaatacaactatagcagtcagtatggctaatatatttagagggtcatacctagcgggagctggattagctttttcgattatgaaatctgtgggtaccgggaaaagaggaacaggaagccaaggtgaaactctgggggagaagtggaagaagaaattaaatcaactcagccgaaaggaatttgacctgtataaaaagagtggaattacagaagtggaccgaaccgaggcaaaagaaggactgaaaaggggagagatcacacatcatgccgtttctagagggtcagcaaagctacagtggttcgtagagagaaacatggttatacccgaaggaagagtgatcgatctgggttgtggacgtggaggatggagttactattgcgctggactaaagaaagtcacagaggtgagaggatataccaagggaggcccaggtcatgaagaacctgttccaatgtcaacatacggatggaatatagtaaaattaatgtcagggaaagacgtattttatttgccacctgaaaaatgtgacactttactctgtgatatcggagaaagctcgccgagtccaaccgtagaggagtccagaacgatacgtgtattaaagatggtcgaaccttggctcaaaaataatcaattttgcataaaagtgctaaatccctatatgccaacggtaatagaacatttagaaagattacaaagaaaacatggagggatgttagtaaggaacccattatcgagaaattcgacacacgagatgtactggataagtaatggcacaggaaatattgtggcttctgtgaatatggtaagtaggttactactgaatcgcttcaccatgacccaccgacgaccaactatagaaaaggatgttgacttaggagcgggaacaagacacgtaaatgccgaaccagaaactcctaacatggacgtaataggtgaacggattaagagaatcaaagaagaacacaattcgacatggcactatgatgatgaaaatccttacaaaacgtgggcataccatgggagctacgaggtaaaagccactggtagcgcttcaagtatgatcaacggagtggtcaaactattaacgaaaccatgggacgtcgttccgatggtaacacagatggccatgacagacacgacaccattcggtcagcaacgtgtattcaaagagaaggtcgacaccaggactcctaggtcaatgccaggcacccgaagggtgatgggtatcaccgccgaatggttatggcgcacccttggtagaaataaaaagcctagactgtgtacacgagaagaatttactaagaaagtgaggacgaatgctgcaatgggagccgttttcacagaagaaaatcaatggaatagtgctaaggcagcggtggaggacgaagatttctggaaattagttgatcgggaacgtgagctacataaattgggcaaatgcggatcatgtgtgtacaacatgatgggcaaaagagagaagaaactgggcgagttcggcaaagcaaaggggtcccgtgctatatggtacatgtggctaggtgctaggtatctcgaatttgaagcgctaggatttttaaatgaagatcattggttctcaagagaaaactcgtatagtggagttgaaggagaaggattacacaagttagggtatatcttgagggatatatctaagataccaggaggagcaatgtatgcagatgacacagcaggctgggataccaggataactgaagacgatctacacaatgaagaaaagataacacaacaaatggatccagaacacagaagactggcaaatgctatattcaaactaacctatcaaaacaaagttgtaaaagtacaacggcctacgccaacaggaactgtgatggacataataagccggaaagatcaaagaggtagcggccaagttgggacgtacggattaaatacctttacaaatatggaagctcaacttataaggcagatggagggcgagggagtactcagtaaggcagacctggaaaatccgcatctaccggagaagaaaattacccaatggttggaaactaagggggtcgaaaggttgaaaagaatggcaatttccggggatgattgcgttgttaaacctattgatgacagatttgcgaatgccttacttgctttgaatgacatgggaaaggtaaggaaagacatcccacagtggcaaccatccaaaggatggcatgactggcaacaggtcccattttgctcacaccattttcatgaactgataatgaaggacgggaggaagttagtggtaccatgcagacctcaagatgagttgatagggcgagcgcgaataagtcaaggagcaggctggtcactacgtgagacagcatgcttgggaaaagcgtacgcgcaaatgtggtcactcatgtactttcacaggcgcgacttgagactcgccagtaatgcaatctgcagtgccgtacctgtgcactgggtcccaacctcgagaactacttggtctatccatgctcatcaccaatggatgaccacggaggacatgttaacagtttggaatcgcgtttggatagaagacaacccatggatggaagacaaaacccctgtgacaacatgggaggacgtaccatatttagggaagagagaagatcaatggtgcggaagtctgataggtctgacaagcagagcaacatgggctcaaaacataccaactgcaattcaacaagtgcgtagcttaatcggcaatgaggagtttctagactatatgcccagtatgaaaagattccgtaaggaagaagagtcagaaggagctatttggtga

SEQ ID NO: 23261 - RNA, 9873 nt, synthetic construct
  misc_feature 1..9873: note = derived and/or modified CDS sequence (opt6) from DENV-3__KJ189278__SS-prME
  source 1..9873: mol_type = other RNA
acctctttgtgtcttatgatgatactaccagctgctcttgcttttcatctaacatcacgtgatggggaaccccgaatgattgtaggcaaaaacgaaagaggaaaatcattactatttaaaaccgcttccggtacaaatatgtgtacgcttatagcaatggatttaggggaaatgtgtgatgacaccgttacatacaaatgccctcatattaccgaagtagaaccagaagatatagactgttggtgtaatctaacgtcaacgtgggtcacctatgggacctgcaatcaagcaggagaacataggcgagacaaaagaagtgtcgcgttagcgccacacgtcggaatgggattggacacacgaactcaaacgtggatgagtgctgaaggtgcttggaggcaagtcgaaaaagtcgaaacctgggctctcagacatccagggtttacaatacttgctctatttttagcgcactatatcgggacatcattgacacaaaaagtcgttatttttattttactgatgctagtaactccttcgatgactatgcgttgtgtgggagtgggtaaccgtgacttcgttgaaggactttcgggggcaacatgggtagatgtagtattggaacacggaggatgtgtcacaacaatggctaaaaacaaaccaacactcgatatagaattacagaaaacagaggccacgcaattagcaacactccgtaaactatgcattgaaggtaaaatcaccaacattacaaccgactcaagatgtccaacgcaaggtgaggcagtgctacccgaagaacaggatcaaaattacgtatgtaaacatacgtacgtagaccgtggatgggggaatggatgtgggctattcggaaaaggatcattagtaacgtgcgccaaattccaatgcctggaaccgatagaaggaaaagtagtacaatatgaaaatctaaaatacacagttataatcaccgtccacactggagatcaacatcaagtaggtaatgaaacgcaaggtgttacagcggaaatcactccccaggcaagtactacagaagcgaccctaccagaatacgggactctgggcttagaatgtagtcccagaaccggactagattttaatgaaatgatattattaacaatgaaaaataaggcttggatggtgcatcgacaatggtttttcgatctgccccttccatggacatctggtgccactacggaaacaccaacctggaatagaaaagagctcctagtcacatttaaaaatgcgcacgccaagaaacaagaagtagtggtgctcggaagtcaggaaggcgcaatgcatacagcattaactggagcaactgaaatccagaatagcggcggtaccagcatattcgcagggcatttaaaatgtaggttaaaaatggataaactcgaattgaaaggtatgagctatgctatgtgtacaaacactttcgtacttaagaaagaagtttccgagactcaacacggtacaatactgataaaagttgagtataaaggtgaggatgcgccatgtaagataccattttctacagaggatgggcatggtaaagcacataacggaagactgataacggcaaacccagtggtaacgaaaaaggaggagccagtaaatatcgaagccgaaccaccctttggtgaaagcaatattgtaatagggattggagacaacgcattaaaaattaattggtataaaaagggatcgagtataggtaaaatgtttgaagctacagctcgaggagctcgtaggatggctatactaggggacacagcatgggattttgggagcgtgggaggtgtcctcaactccctgggcaagatggtgcatcaaatattcggaagcgcctatacagcactttttagcggtgtatcttgggtcatgaaaatagggatcggcgtactactaacttggatcggcttaaactcgaaaaacacatctatgtcattctcatgtatagccattggaataatcacgttatatctaggagcagtagtacaagcagatatgggatgcgttatcaattggaagggcaaagagttaaagtgtggaagcggtatcttcgttacgaacgaagtccatacatggacagaacaatataaatttcaggccgactcaccaaaacggctagctacggctatcgctggtgcctgggagaatggcgtctgcggcataagaagcactacaaggatggaaaacctgttgtggaagcagattgcaaacgagttgaactatatactttgggaaaataacgtaaagttaacagtcgtagtcggagacataataggagtattggaacaaggaaaaaggacgcttacccctcaaccaatggagcttaaatattcctggaaaacatggggtaaagcaaagatagtaacagcagaaacacaaaattcatcatttatcattgacggtccgaatacgccagaatgtccaagcgcgagcagggcctggaatgtttgggaagtcgaagactacgggtttggtgtgtttactacaaacatatggctacgattgagagaagtgtatacgcaattatgtgatcatcgtttgatgagtgccgctgttaaagacgaaagggctgtacatgccgacatgggctactggatcgaatctcagaaaaatggcagttggaagctggagaaagctagtcttattgaagttaaaacatgcacatggccgaagtctcacacactttggtctaatggtgttctggaaagcgacatgataattcccaaaagcctagcaggacctatatcacaacataatcaccgaccaggttaccatactcagacagctggaccttggcatttaggtaagctagagctcgatttcaattactgcgaaggaacgactgtggttattactgaaaattgcggtacaagaggcccgtctctaagaacaaccacagtttcgggcaaactaattcatgagtggtgttgtagatcttgtactcttcccccgctaaggtatatgggagaggatggttgttggtacggaatggaaattcgccccatctccgagaaagaagaaaatatggttaaatccctggtctcagcgggaagtggtaaagttgataattttacaatgggcgtattatgtcttgccatcttgtttgaggaggttatgagagggaaattcggaaagaaacatatgattgcaggagtctttttcaccttcgttcttttattatcaggacaaattacatggagagacatggcacacacgcttatcatgattggatctaacgcaagtgataggatggggatgggcgtgacgtatttagcattaatagcaacttttaaaattcaacctttcttagcattaggcttctttctacgaaaacttacatccagggagaacttactgctaggcgttggtctcgctatggctactacattacaattaccagaagatatcgaacaaatggccaatgggattgcgttaggtttaatggctttgaagctaatcacgcaatttgaaacttatcaactctggactgctctaatctcgttaacttgtagtaacacgatattcacattaacagttgcatggaggactgccactcttatactagcgggcgtatcactcttaccagtatgtcaaagcagttctatgagaaaaactgactggcttcccatggctgtggcagccatgggcgtgccgcctttaccgttatttatatttagcctaaaagataccttaaagagaagatcttggcccttaaatgagggagtaatggcagtgggcctagttagtattttagcatcgagtctactccgtaacgacgtaccgatggctgggcctctcgtggcaggcggattactcattgcgtgttatgtcattactggaacatcagctgatctcacagtagaaaaagccgcagacataacatgggaagaagaagcagaacaaacgggggtatcccataatctgatgattacagtggatgatgatggcacgatgagaataaaagatgatgaaaccgaaaacattctaaccgtcctcctaaaaacagccttgcttatcgtatcaggaatttttccgtactcaataccggcgaccttattagtctggcatacgtggcaaaagcaaacacaaagatctggtgttttatgggatgtaccctcacccccggagacacaaaaagcagaattagaagaaggagtctatcgaatcaagcaacagggaatatttggaaaaactcaagttggcgtaggagtacagaaagagggtgtatttcacaccatgtggcacgttacacgcggagctgtgttaacatacaatggtaagagacttgaacctaattgggcgtcagttaagaaagatctaatttcatatggtgggggatggcggttaagtactcaatggcaaaaaggagaagaagtgcaggtaatagcagttgaaccaggtaaaaaccccaaaaactttcaaacgatgccaggaaccttccaaactaccactggagaaataggagcaattgcacttgactttaaacccggtacctccggatccccaataataaaccgagaaggtaaagttgttggtctatacggcaacggagtggtaacgaaaaacggtggatatgtgagtggaatagcgcaaactaatgcagagccagacggccctacacctgagctcgaagaagagatgttcaagaaaagaaatttgacaattatggacttacatcccggatcagggaagaccagaaaatatctcccggcaatagtacgagaagctattaaacgccggcttagaaccctaatattagcaccaacaagagtcgttgcagcagaaatggaagaagccctaaagggactcccgataagatatcaaacaacagcaactaagtcggaacacaccggaagagaaatcgttgacctaatgtgtcacgctacattcacaatgcgtctattgtcacctgtgagggttcccaactacaaccttataatcatggatgaagcccattttacagatccagctagtattgctgcgagaggttatatttctactagagtaggtatgggcgaggctgctgctatttttatgacggcgaccccaccagggaccgcagatgcgttcccacaatcaaatgcacccattcaagacgaagaaagagatattccagagcgttcatggaactccggaaacgaatggatcactgattttgcaggtaaaacagtttggttcgtacctagtataaaagcaggaaatgacattgcaaattgcctcaggaaaaatggcaagaaagtaatacagttatcacgcaagactttcgacaccgaataccagaaaacaaagctcaacgattgggacttcgtagtcacgacagatataagcgaaatgggagcaaatttcaaggcagatcgcgtcatagatccaagacgctgcttaaaacccgtaatattaactgatggacccgaaagagtaatcctagcagggcccatgcccgtgaccgcagcatccgctgctcaaagacgagggcgagtgggaagaaatccacaaaaggaaaatgatcaatatatttttacgggtcaacccttaaataatgacgaagaccatgctcactggacagaagcaaaaatgttacttgataacataaacacaccagaaggcatcatacctgctctatttgagcctgaaagagaaaaatccgccgcaatagacggagagtatcggctgaagggtgagagcaggaaaacctttgtagaactaatgcgaagaggcgatctaccagtgtggttagcgcacaaggtggcgtcagaaggtataaaatatactgacagaaagtggtgctttgatggccagagaaacaatcagatattggaagaaaacatggacgttgagatatggacaaaggaaggtgagaaaaagaaactaagaccacggtggctagatgccagaacgtactcagatccactggcattaaaagaatttaaagactttgcagccggcagaaaatctatcgcactcgacctcgtaacagaaataggtagagttcctagccatttagcgcaccgcacacgtaatgctctagataaccttgtcatgctgcatacaagtgagcatggagggagagcttacagacatgcagtagaagaacttccagaaacaatggaaaccttactactattgggactgatgatactcttaactggaggggctatgttgtttttaatatcagggaaagggattggaaaaaccagcataggattaatctgcgttatagcaagctcggggatgctatggatggctgaaattcctctccaatggatcgccagtgctattgtattagagttctttatgatggtactattgattccagaacccgagaaacaaaggacccctcaagataatcagctagcctacgtggtaattgggatcctcacattagctgctataatagccgcaaacgagatgggattactagaaacaacgaaacgagatctaggcatgagcaaagaaccgggagtagtaagtccgacatcatatttggatgtagatctacatccagcgtcggcatggacgctgtatgcggtagcaacaactgtcatcacgccaatgttaagacataccatagaaaattccacagccaatgtaagccttgctgctatagctaaccaagctgtcgtattaatgggattagataaaggatggccaattagtaagatggaccttggagtaccccttctcgctttaggctgctatagccaagttaacccactgacacttacagcagcggtacttttattgataactcactacgctataattggccccggattacaagcgaaagctacgcgtgaagcccagaaaagaaccgcagcgggaatcatgaaaaacccaacagtagacggcattatgactattgatctcgaccccgtcatatatgactccaaatttgagaaacagttaggacaagtaatgttgttagtgctctgcgccgtccaattattattaatgaggacgagttgggcattatgtgaagcattaacattggcaactggtccaattacaacactatgggaaggatcgccgggaaaattctggaacacaacaatagccgttagtatggctaatatcttcagaggttcgtacttagccggagcaggcttagcattcagtatcatgaaaagcgtaggaactggaaagagaggaactggatctcaaggcgaaactctaggagagaaatggaagaagaaactgaatcaattgtcgaggaaagaatttgatttatataagaaaagcggtatcacagaagtagacagaacagaagccaaggaagggttaaagagaggagagataactcatcacgcagttagtcgcggaagcgctaaacttcaatggtttgtcgaacgaaacatggttattcctgagggtcgagtgattgatctgggttgcggtcgcggcggctggtcttattattgcgcaggactcaagaaagtaacagaagtaagaggatatacgaaaggcggaccaggacacgaggaaccagtaccgatgtcaacatatgggtggaacatagttaaacttatgagtggtaaagatgttttctatttaccgccagaaaaatgtgatacattgctgtgcgacatcggcgagagctcacctagtccgacagttgaggagtccagaaccattagagtcttaaaaatggtagaaccgtggttgaagaacaaccaattttgcataaaagttttgaatccctacatgccaactgtgatagaacatctggaacgtttacagcgaaagcatgggggaatgttagttcggaatcctttaagtcggaactcgactcatgaaatgtactggattagcaatggtactggtaatattgtcgcaagtgtaaatatggtatcaagactactcctcaaccgtttcactatgacgcatagaagaccaacgattgaaaaagatgtagatctaggtgcaggcactcgacacgttaacgctgagcccgaaacaccaaacatggatgtcataggagaacggattaaacgcatcaaagaggaacataacagtacctggcattacgatgatgaaaatccatataaaacctgggcataccacggttcttatgaggtaaaagctaccgggagtgcaagttccatgataaatggggtagtaaaattattaactaagccatgggacgtagtaccaatggtaacacagatggccatgacagatacaactcctttcggtcaacagagggtattcaaggagaaagttgatactcgaacgccacgatcaatgcctggaacaaggcgtgttatgggaataacagcggagtggttatggaggactttggggcgaaataaaaagcctaggttatgcacgcgcgaagaatttaccaagaaagtgagaactaatgcggctatgggagctgtatttactgaagagaatcaatgggacagcgcaaaagctgcagtagaagatgaggacttttggaaattagtcgatcgcgaacgcgaacttcacaaactaggcaaatgcggctcatgcgtgtataatatgatgggcaaaagggagaagaaattaggggaatttggaaaggcaaaaggatccagagcaatctggtacatgtggctaggagcaagatacttagagttcgaagcgctgggttttctaaacgaagatcattggtttagtagagagaactcgtacagtggggtggaaggagagggattacataaacttggctacattcttagggatataagcaagattccaggaggtgctatgtatgcagatgatacagcaggatgggatacacgcatcacagaagacgatctacacaatgaggagaaaataacacagcaaatggatcccgaacaccggcaactagcaaacgctatttttaaattaacttatcaaaataaagtcgtaaaagtacaaagaccaaccccaacgggaacggtcatggatataatatctcgtaaagaccagagaggaagtggccaggtcggtacatatggattaaataccttcactaatatggaagcacaactaatcaggcagatggagggtgagggagtattgtcaaaagcggatctagaaaaccctcacttacctgaaaagaaaataacccaatggctagaaactaaaggtgtcgaaaggttgaagcgaatggctatctcaggtgatgattgtgtagttaaaccaatagatgataggttcgcaaatgcacttctggccttaaacgatatgggaaaagtccgaaaagatattccacagtggcagcccagtaaaggatggcatgactggcaacaagtgcctttttgttcacaccactttcatgaattaataatgaaagatggacgaaaattagtggtgccttgtagacctcaggatgaactcattggtagagcccgtatttctcagggtgccggctggagtttacgggaaacagcctgcctaggcaaggcatatgctcaaatgtggagtctaatgtatttccaccgaagagatctacgtttagcgtcaaacgcaatttgctcggcggtgccagttcattgggtaccgacaagcagaaccacatggtcaatacacgcgcatcatcagtggatgactactgaggatatgttaacagtatggaatcgtgtgtggatagaagataatccttggatggaagacaaaacccctgttaccacgtgggaagatgtcccatacctcggtaaaagagaggaccagtggtgtggttcattaatcggacttacatcacgcgctacttgggctcaaaacattcccactgcgatacaacaagtcagaagtttaataggaaacgaggaatttctagactatatgccttcgatgaagcgatttcgaaaagaagaggagtctgaaggtgcaatctggtag

SEQ ID NO: 23262 - RNA, 9873 nt, synthetic construct
  misc_feature 1..9873: note = derived and/or modified CDS sequence (opt6) from DENV-3__KJ189279__SS-prME
  source 1..9873: mol_type = other RNA
actagcttatgccttatgatgatactccctgcagctttggcattccacttaacaagtcgagatggagaaccgaggatgattgtggggaaaaatgaaagaggaaaatctttgctctttaaaacagctagcggaataaatatgtgcacattaatagcaatggatttaggggaaatgtgtgatgatactgtcacgtataaatgtccgcatattactgaagttgaacctgaggacatcgattgctggtgtaatttgacctcaacttgggttacatatggtacatgtaatcaagccggcgaacacagacgcgataaaagatctgtagcacttgcgcctcacgttggtatgggacttgatacacgaacccaaacgtggatgtccgcagaaggcgcttggagacaagttgaaaaagtagaaacatgggccctgagacacccaggattcacaattctggcattattcttagctcactatatcggaacgtcactgacacagaaagtagttatattcatattgttaatgctagtcacaccctcaatgacgatgagatgtgtgggagtggggaatagggactttgtcgagggactctccggagcaacgtgggttgatgtcgttttagagcacggagggtgcgtaacaacaatggcgaaaaacaaacccacattagacatagaacttcagaaaactgaggctacacaattagctacattaaggaaattgtgtatagagggaaaaatcacgaacatcaccacagatagtcgctgtccgacgcaaggagaagcagttcttccagaagaacaagaccaaaactatgtgtgcaaacatacttacgttgacaggggatggggcaatggctgtggcttattcggaaaaggtagcttagtcacttgtgccaaatttcaatgtttagaacctattgaaggaaaagtcgtacaatacgaaaatctaaaatatactgtcatcataacagtacacaccggagaccaacaccaagttggaaatgaaacccaaggagtaacagcggaaattactccgcaggcaagtacaacagaagtcactttaccagagtatgggacattggggctagaatgtagcccaagaacaggtttggacttcaacgaaatgatactgttaacaatgaaaaacaaagcctggatggtacacagacagtggtttttcgacttacctctgccttggacaagtggcgctaccacggaaacacctacatggaacagaaaagaactattagtgacttttaaaaatgcgcatgctaagaaacaagaagtagtggtcctaggttctcaagagggtgcgatgcacacagctctaacgggagcaaccgagatacaaaattctgggggaacatcaatattcgcaggtcacttaaaatgcagattgaaaatggacaaattagaactcaaaggaatgtcatatgcaatgtgtacaaataccttcgtattgaagaaagaagtatcagaaacacaacatggtacaatattgataaaagttgaatataaaggagaagacgccccgtgtaaaataccattctcaacagaagacgggcatggaaaagcacataacggcagactcattaccgcaaacccagtagtaactaagaaagaagaaccagtcaatatagaagctgaaccaccattcggagagagtaacatagtcataggaattggagataacgcacttaaaataaattggtacaagaaaggaagctccatcggaaaaatgtttgaagcaacagcaagaggagcccgcagaatggcaatattaggcgatacagcttgggactttggaagcgtgggaggggttttgaactcacttgggaaaatggtacaccaaattttcggaagcgcgtatactgctttatttagtggcgtttcgtgggtaatgaaaataggaataggagtgttactcacttggataggacttaacagcaaaaacacttccatgtcattctcctgtatcgccattggaataatcaccttataccttggggcagttgtgcaagctgatatgggatgcgttatcaactggaaaggtaaagaacttaaatgcggaagtgggatcttcgtaacaaatgaagtacatacctggacagaacagtataaatttcaggccgattcaccaaaaagactcgccactgctatagccggagcctgggagaatggagtatgtggcattagaagtacgacacgaatggaaaatctactttggaaacaaattgctaacgaattgaattatatcttatgggaaaacaatatcaaacttaccgtggtcgtcggggatatcattggagtcctagaacagggaaaacgcacgttaaccccacaaccaatggaactgaaatatagctggaaaacttggggtaaagcgaagatcgtaaccgcagaaactcaaaacagctcattcattatagacggaccaaacacccctgaatgtccgagtgcaagtagagcatggaatgtatgggaagtagaagattacggatttggagtctttacgacaaacatctggttaagattgcgagaagtgtatactcagttatgtgaccatcgattaatgtcagcagctataaaagatgagcgcgcagtacatgctgacatgggctattggatagagtcacagaaaaatggatcatggaaactagaaaaggcttctcttatagaagtgaaaacgtgtacctggcctaaaagtcataccttatggtccaatggggtgctcgaaagtgatatgataattccaaaatctctagcgggcccaattagccaacacaaccataggccaggatatcatacacaaacggcaggaccttggcacctaggaaaattagaactcgactttaattattgtgagggtacaaccgttgttattacagagaattgcggaacaaggggtccctctttgcgaactactaccgtaagtggtaaactaattcatgaatggtgttgccgctcatgtactcttccacccctccgatacatgggcgaagatggatgttggtatggtatggaaattcgtccaatatcagaaaaagaggaaaacatggtcaaatctctcgtaagcgctggatctggaaaagtagacaatttcaccatgggtgtcctatgtctagccattttattcgaagaagttatgcgggggaaattcggcaagaaacacatgattgctggagtatttttcactttcgtactgctactaagcggacaaataacgtggagagatatggcacatacattaattatgatcggatcaaacgccagcgatcgaatgggaatgggggttacatatctggcgctcatagcaacgttcaaaatccaacctttccttgcgctcggattctttcttagaaaactaacttcaagggagaatttattactgggggtagggttagccatggctacaacgctccaactgcctgaagatatcgagcaaatggcaaatggaatagctctcggtctgatggcactaaaactcatcactcaatttgaaacctatcagctgtggacagcattgattagtctaacatgttccaataccatttttactttgaccgtcgcttggcgtacggcgacactcatactagcgggtgtgtctctactccccgtatgccaatccagttccatgcggaaaaccgactggttaccgatggccgtggctgcaatgggagtaccacccttaccgttatttatattctcattaaaagataccctgaagaggagatcctggccgctaaatgagggggttatggccgttggtctggtaagtatacttgcaagttccttattaagaaatgacgtaccaatggctggaccccttgtagcgggaggtctgcttattgcatgctacgtgatcacagggaccagcgccgatctgacggtagaaaaagcagcggatattacatgggaagaggaagctgaacaaactggtgtttctcataatttaatgataaccgtagacgacgatggaacaatgcgcatcaaagatgatgaaaccgaaaacattttaacagtgttacttaaaacagctctcctaattgtatcaggaatctttccatatagtatcccagcgacattgttagtctggcatacttggcaaaagcagacccagcgtagtggggtcctatgggatgtcccgtcaccgccagagacacaaaaagctgaattagaggagggcgtataccgtataaagcaacaggggattttcggtaagacacaggtgggagtgggcgtgcaaaaggaaggcgtgtttcacaccatgtggcatgttacacgaggagctgtgcttacttataacggaaaacgacttgaaccaaactgggcttctgtgaagaaagatttaatatcatatggtggcggttggagactgtcaacacaatggcaaaaaggggaagaagtccaagtaattgcagtggaacctggcaagaatcctaagaatttccaaacgatgcctggaacttttcagacaactacaggtgaaataggtgcaattgctctggattttaaaccaggaacgagtggtagcccaataataaatagagaagggaaagttgtcggattgtacgggaatggggtagttactaaaaatggagggtatgtatcgggtatagctcaaacgaacgcggagcctgacgggccgacaccagaattagaagaagaaatgttcaagaaacgcaatctgaccataatggatttacatccgggtagtggtaaaacccgaaaatatttaccagccatagtcagagaagcaatcaaaagaagacttcgaacattaattttagcacccacaagagttgtagctgccgaaatggaggaagccctcaaaggtttaccaataagatatcaaacaaccgctaccaaaagtgaacatacagggcgggaaatcgtcgatctgatgtgtcatgcaacttttaccatgcgtctactaagtccagtaagagttcccaactacaacttaataatcatggacgaagctcactttacggatccagctagtatagctgcgcgcggatatatatcgacgcgcgtcgggatgggtgaagccgcagcaatattcatgactgctacaccgcctgggacagcggatgcatttcctcaaagcaacgctccaatacaagatgaagaacgggatataccagaaaggagctggaacagtggtaatgaatggataacagattttgcgggcaaaactgtctggttcgtcccatcaattaaagcaggaaacgacatagccaattgcttacgcaaaaacggcaagaaagtaatacaactttcaagaaaaacgttcgataccgaataccagaagaccaaactgaatgattgggacttcgtggtcactacagatatatctgagatgggggcaaatttcaaagcagacagggtcattgacccacggcgatgcctcaaaccagtaatcttaacagatggtccggagcgcgtcatattagccggtcccatgccggttactgctgccagcgccgcacaaaggaggggacgggtaggacgaaatccacaaaaagaaaacgatcaatacatattcaccggccagccattaaacaacgatgaagaccacgcgcattggacagaggcgaaaatgttattagacaatataaacacgccagaaggtattattcctgctttattcgaaccagagcgtgagaaatcagcagcaatcgatggcgaatataggctaaaaggagagtcacgtaaaaccttcgtagagctaatgagacgtggtgatctccccgtatggttggcacacaaagtggcatcagagggaataaaatatacagataggaagtggtgttttgatggacagcgtaacaaccaaatattagaagagaacatggacgtagaaatatggaccaaggaaggagaaaagaagaaactaagacctcgctggttagatgcacggacgtattcagacccgctcgccttgaaagaatttaaggattttgctgcaggaaggaaaagcatagcactcgacctagtaacagaaataggtcgcgtaccatctcacctagcccacaggacaagaaatgctttagataatttagttatgctccatacatcagaacacggaggaagggcttaccgacacgcagttgaggaactacctgaaacaatggaaacattactgttattggggttaatgatactattaactgggggcgcaatgctattcttaataagtggaaaaggtattgggaaaacaagcattggtctgatatgtgtaatagcaagttcagggatgttatggatggcggaaataccacttcagtggatagcaagcgctatcgttttagagttcttcatgatggtacttctaatacccgaaccggagaaacaacgaacaccccaggataatcaactagcatacgtagtaataggaattttaactctagcagccataatagcagcaaacgaaatgggtcttcttgaaaccacaaagagagaccttggaatgagtaaagagcctggggttgtcagtcctacatcttatcttgatgtcgatctccatcccgcgtccgcatggacactatatgcagtcgcaactacagttataactccgatgcttagacacaccatagaaaattcaacagctaatgttagcctagccgctatcgccaaccaagctgtagtcctgatggggcttgacaagggatggcccatttcgaaaatggatctaggggtccctctgctagcactaggatgttacagccaggtaaatcctcttacattaacggcagctgtattacttttaattacccattatgcgatcataggtcctggattacaagccaaagcaactcgcgaggcacaaaagcggactgccgctggtataatgaaaaatccaacggttgatgggataatgactatagacttagatccagtgatatatgattcaaaattcgaaaaacaactcggacaggtaatgttacttgtcctatgtgcagttcagctattactcatgcggacctcatgggccttatgtgaagcattgactttagcgacgggacctataactacgttatgggaggggagcccaggaaaattttggaatactacaattgcagtaagcatggcaaacattttcaggggatcctacctagcgggagcaggacttgctttcagcatcatgaaatccgttggaacgggtaaaagaggtacaggctcacaaggtgagactctgggtgagaaatggaagaagaaattaaatcaactcagtcgcaaggaatttgacttgtacaagaaatcgggaatcacagaagtcgatagaaccgaagcaaaagagggattaaagcgcggagaaattacgcatcacgccgtctctaggggcagcgccaaacttcaatggttcgtagagcgtaacatggtcattccagaaggccgagtgattgacctaggatgtggtaggggaggatggtcatattattgtgcagggctgaagaaagtaacagaagtgagaggttacactaagggcggtccaggtcatgaagaacccgtgccaatgagcacttatgggtggaacatagttaaactcatgtcaggaaaggacgtattttatcttccgccggaaaagtgtgacacactcttatgcgatataggcgagagtagcccaagtcccacagtagaggaaagtcggaccatacgagttttaaagatggtggaaccatggttaaagaataaccaattctgcatcaaagtattgaatccttacatgcctacggtaatagaacacttagagagactacaaagaaagcatggaggaatgttggtaaggaatcccttaagtagaaatagcacacacgaaatgtattggataagtaatggaacaggaaacattgttgcttcggttaacatggtctcccgcctacttctaaacagattcaccatgacgcatcgaaggccaaccattgaaaaagatgttgaccttggagcagggactagacatgttaacgctgaaccagaaactccaaacatggatgttataggtgaaaggattaaaaggattaaggaggagcacaactcgacatggcactatgacgacgagaacccttataagacttgggcttatcacggatcctatgaagtgaaagctacaggatcagcttcttccatgataaatggcgttgtcaaactactcacaaagccatgggacgtcgtaccaatggtaacacaaatggcaatgacagacacgacgccgtttggacaacaacgcgtttttaaagagaaagttgacacccgaacacccagatcaatgcccggcactagaagggtaatggggataacggccgagtggctgtggcgcaccttgggacggaataagaaaccaaggttatgcacaagagaagaatttactaagaaagtccggactaatgcagctatgggagcagtgtttacggaggaaaatcaatgggatagcgcgaaggcggctgtggaggacgaagatttttggaaactcgttgacagggaaagggaattacataagctagggaagtgcgggagttgcgtctataatatgatgggaaaaagagagaagaaattgggggagttcggaaaagcaaaagggtcacgtgcgatatggtatatgtggctaggagcacggtatctagagtttgaagccttagggtttttaaacgaagatcactggttcagtagagaaaattcttattcaggagtagaaggagaaggactgcataaactcggctatatattacgcgatatatccaaaatacccggcggagccatgtacgcagatgacacagcaggatgggatactcggattactgaagacgatctacataacgaagagaaaatcactcaacaaatggatcccgaacataggcaattggccaatgctatatttaagctaacataccaaaataaagtcgtcaaagtacaacgtcctactccaacaggcacagttatggatataatatcacgcaaggaccaaaggggttcaggacaagtaggtacatatgggctaaatacctttactaatatggaagcacagctcataaggcaaatggaaggggagggagtattatccaaagcggatttagaaaatcctcatctgcccgagaagaaaataacacaatggttggaaactaagggtgttgaaagactgaagaggatggcaatatccggtgatgactgtgtagtaaaacctatagatgacagatttgctaatgccctgctggcacttaacgatatgggtaaagtaagaaaagacattccacaatggcagccctccaaaggttggcacgactggcaacaagtaccattttgctcgcatcattttcacgaattaataatgaaagatgggcgaaagctcgtagttccctgcaggccacaagatgaattaataggacgagccagaataagtcagggagcgggttggagtttacgtgagaccgcatgcctgggaaaagcgtacgctcaaatgtggtcacttatgtacttccacaggagagacttgcgcttagctagcaatgcgatatgcagtgccgttcccgtgcattgggtccctacaagtcgcaccacgtggtccatacatgctcatcaccaatggatgactactgaagacatgttaactgtttggaaccgagtatggattgaagacaacccatggatggaagataaaacacccgttacgacatgggaagatgtcccgtatctaggaaaaagggaagaccaatggtgcggaagccttattggattaacgagcagggcaacttgggcacaaaacatccctaccgctattcaacaggttagatcacttatcggaaatgaagaatttttagattatatgccaagtatgaagcgttttcgtaaagaggaggaaagcgaaggagcaatatggtga

SEQ ID NO: 23263 - RNA, 9873 nt, synthetic construct
  misc_feature 1..9873: note = derived and/or modified CDS sequence (opt6) from DENV-3__KJ189280__SS-prME
  source 1..9873: mol_type = other RNA
acaagtttatgtctaatgatgattttaccggcagcattagcatttcatctaacgtcaagagatggagaacccagaatgatagtaggtaaaaatgaaagagggaaatcgttattatttaaaaccgcaagcggaattaatatgtgcacattgatcgctatggacttgggagagatgtgtgacgacacagtgacgtacaaatgcccccacataactgaagttgagccggaggatattgattgttggtgcaatttaacatccacatgggttacgtatgggacctgcaaccaagccggtgaacatcgaagagacaaaagatctgtagcacttgcaccgcatgtaggaatggggttagatacaagaacgcaaacttggatgagcgccgaaggggcatggagacaagtagaaaaagtcgaaacttgggcgttgaggcatccagggtttacaatactcgcgctgttcttagcccattatattggaacttcgctaacgcaaaaagtagtaatttttattttattaatgttagtgactccatcaatgacgatgaggtgcgtcggagtcggaaacagagactttgtggaaggcttaagcggtgctacatgggtagatgtggtattggaacatggaggatgtgtcactacaatggctaaaaacaaaccaacccttgacatcgaattacagaaaactgaggctacccaattggcaacgttacgaaaattgtgtattgaagggaaaataaccaatataacaacagattcaagatgcccaacgcaaggcgaagcagtgctaccggaagaacaagaccaaaattatgtatgcaaacatacatacgtagatagggggtggggaaatggctgtggtttattcggcaaagggagcttagtgacttgtgcaaaattccagtgcttagagccaattgaaggaaaagtagtgcaatatgagaatctaaaatatactgtaataattacagtccatacaggagaccaacatcaagtagggaatgaaactcaaggagtaaccgccgaaattactccgcaagctagcacaacagaagctacactgcccgaatacggtaccctaggactcgaatgtagtccgagaactggcttagactttaatgaaatgattctgctgaccatgaaaaacaaagcatggatggtacatagacaatggttctttgatttaccactaccgtggacgagtggagcaacaacagaaacgccgacatggaatcgaaaagaactattggtgacgtttaaaaatgcccacgctaagaaacaagaagttgtagttttagggtcccaagagggagcaatgcatactgctctcactggagccacagaaatccaaaattccggcggaacgtcgatttttgcgggtcaccttaaatgccgacttaaaatggataaattagaacttaaaggtatgagctacgctatgtgtacaaataccttcgtacttaagaaagaagttagtgaaacacaacacggtacaatccttataaaagttgagtataaaggtgaagatgcgccatgtaaaataccattcagcacagaagatggtcatggtaaagctcacaatgggcgactaataacagctaatcctgtcgttacaaagaaagaggagccggttaacattgaagccgaaccacctttcggagaaagtaacatagtcattggaataggtgacaatgccctaaaaatcaattggtacaagaaaggcagctcaattggtaaaatgttcgaagccacagcgagaggtgcgcgccgcatggcaattttaggtgatacagcatgggactttgggagcgtgggaggtgttctcaatagtttaggaaaaatggttcatcaaattttcggcagtgcctatacagccttattttcgggtgtatcatgggttatgaaaataggaataggtgtacttctaacttggatcggcctaaatagtaagaatacatctatgtctttttcatgtatcgcaataggtataattactttatacctaggcgcagttgttcaagcagacatgggatgcgtaattaactggaaaggtaaagagcttaaatgtggaagcggaatatttgtgacgaatgaggtccatacgtggacagagcagtataaattccaggcggatagccctaaaaggttagcaacggcaatcgcgggagcctgggagaacggtgtttgtggaattagatctactacaaggatggaaaatttactatggaaacaaatagcaaacgagctaaactatattctatgggaaaacaacatcaaacttactgtagtcgtgggtgacataattggcgtcttggaacagggaaaaagaacactcacaccccagccaatggagttaaaatactcatggaaaacatggggtaaggccaaaattgtcacagcagaaacacaaaatagttcctttataattgacggaccgaatacacccgagtgtccttcagcttcacgagcctggaatgtttgggaagtagaggactacggatttggagtattcactaccaacatttggctacggctacgagaagtctacacgcaactttgtgaccatcgcctaatgtcagcagcagttaaagatgagagggcagtccatgcagacatggggtactggatcgagagtcagaaaaatggttcatggaaactggaaaaagcgtcgctgatagaagtcaaaacgtgtacatggccaaaatcacatacactctggagtaacggggttctagaaagcgacatgattattcctaaaagcctagctggacccataagtcaacacaatcatcgacctggttaccatactcaaactgctggtccgtggcatctaggtaaacttgaattggacttcaattattgcgaagggaccacggttgtaataacggaaaattgtggaacacgaggtccatcattaagaaccacaacagtaagcggtaagctcatacacgaatggtgctgcagaagttgtacactacctccactccgttacatgggagaagacggctgttggtacggaatggaaattcgacccatatctgagaaagaggagaatatggttaaatctttagtgtctgctgggagcggaaaggttgataattttactatgggagtactgtgtttagcgatcctttttgaagaagttatgcgtgggaagttcggtaagaaacatatgatagccggtgtattctttaccttcgtactgctattatctggtcaaataacatggagagatatggcccatacactaattatgattggcagcaatgcgtccgatcgaatgggaatgggcgttacatatctggcactcattgcaacatttaaaatccaaccttttctcgcattagggttctttttaaggaaattaacttctcgagaaaacctcttacttggtgtgggattagcaatggcgacaacactacaattgccagaagatatagagcagatggcgaacggtattgctttaggcctaatggctttaaaactaataacgcaattcgagacttaccaattatggacagctctgataagcctaacatgcagtaatacaatcttcacgctgaccgttgcttggagaacagcaacattgatattagcaggagtaagccttttgcccgtgtgccagagttctagcatgcgtaaaaccgattggctgccaatggctgtggcagcgatgggcgtgccacccttacctttatttatattctctttaaaagatacattaaagcgaagatcgtggccactgaatgaaggagtgatggctgttggtctcgtaagtatacttgcctcctctctcttacgaaatgacgttcccatggctggtccactcgtggccggcggactgctaatagcttgctatgtaataaccggaacctcagcagacttaacagtagaaaaggctgctgatattacatgggaggaagaagcagaacaaacaggggtttctcacaatctcatgattacagttgatgacgatggaactatgaggattaaagatgatgaaacagaaaatatattaaccgtacttctaaaaaccgcgcttctaattgtctctggcatatttccatacagtataccagcaactctcctagtgtggcatacatggcaaaaacagactcaaagatcaggagttctatgggatgtaccttcaccaccggagacacaaaaagccgaactcgaagaaggggtttaccgtataaaacaacaaggtattttcggcaaaactcaagtaggcgtaggagtccagaaagagggggtctttcatacaatgtggcacgtaacgagaggagctgtgctaacgtacaatggaaaaaggctagaacctaattgggcttcagttaagaaagaccttattagttacggcggcgggtggagactttcgacccaatggcaaaagggagaggaggtacaggtaatagcagttgaaccaggtaaaaatcctaaaaatttccagaccatgccaggaacattccaaacaaccacgggagaaataggcgctatagcactagattttaaacccggcacttcaggaagccccataataaacagagaaggcaaggttgtaggcttatatggcaatggggtagtcaccaaaaatggtggatacgtctccggaatagcccaaaccaacgcagaacccgatggtccaacgccagagttagaggaggagatgtttaaaaagaggaaccttactattatggacctgcacccaggttctggaaaaacccgtaagtatctacccgccatagtgcgagaagctattaaacgaagattaagaacactgatattagcacctacaagggttgtcgctgctgaaatggaagaagcgttgaagggcttgccaataaggtaccaaacaacagcaactaagtccgagcatactggtcgagaaatagtggacctaatgtgccatgcaaccttcactatgagacttttatctcccgtaagagtcccaaattataacttaatcataatggacgaagcccatttcaccgatcccgcatcaattgcagcaagaggttatatatcaacaagagttggcatgggggaagctgcagcaatcttcatgacagcgactccaccaggaacagctgacgcctttcctcaaagcaatgctcccatacaagatgaagaacgtgacattccagaaaggtcatggaactccggaaatgaatggataacagattttgctggcaagacagtatggtttgtgccatcaataaaagcagggaatgatatagctaattgtctgaggaaaaacggcaagaaagttatacaattgagtagaaagacgttcgacacggaataccaaaagacaaaattaaacgattgggattttgttgttacgacggatattagcgaaatgggagccaatttcaaagctgatagagtaatcgatccaagacgctgtctaaaaccagtcatattaacggacggtcctgaaagagttatactggcagggcccatgcccgtcacagcagcaagcgccgcacaaagacggggacgagttggacgaaatccccagaaagaaaatgatcagtacatattcacaggtcagccactaaacaatgacgaggatcacgcccactggacagaagctaagatgttattggataatataaacactcctgaaggaataatacctgccttgttcgaacccgaacgagaaaaatcagccgcaatagatggagagtatagattaaaaggcgaatcgcggaaaacatttgtcgaattaatgaggcgaggtgatttgcctgtatggttagcacataaagtaagcagtgaaggaattaaatatacggacagaaagtggtgcttcgatgggcaacgtaataatcagatattagaagaaaacatggatgttgaaatatggacaaaggagggcgagaagaagaaacttaggccacgttggttagacgcacgtacctatagtgaccctctggcccttaaagaatttaaagattttgctgctggcagaaagagtattgcattggatcttgtaacggaaataggcagggtaccatcacatttagcacaccgaacacgtaacgcactagacaatcttgtaatgctacacacaagcgagcacggtggaagggcatataggcatgcggtagaggaacttccggaaacaatggaaacgcttttactcttaggtctgatgatattgttaacaggtggtgctatgctgttcttaatatcgggcaaaggaattggaaaaactagcataggacttatctgcgtcattgctagtagtgggatgctatggatggccgagatacccttacagtggatcgccagtgccatcgtactagaatttttcatgatggtactactaatacctgagcctgaaaagcaaagaacgccacaagataatcaactagcctacgtagttatcggaatactaactttggctgcaataattgcggcaaacgaaatgggattgttagaaaccacgaaaagggatctcggaatgtcaaaagaaccgggagtagtaagccctacttcttacctagatgtggaccttcatccagcatcagcgtggactttatatgcggtagcaaccacagttattacaccaatgctacgtcacacaatcgaaaattcgacagctaacgtgagtctagcagcaatagccaatcaagcagttgtcctaatggggttagataaaggatggccaataagtaagatggatcttggagtaccccttttggccttaggctgttattctcaggtcaatccactcactcttacagcagctgtactgttattgataacacactatgccataatcggtccaggcctacaagcaaaagcaacacgagaggcccaaaaacggactgctgctggaattatgaaaaatccaaccgtggatggaataatgaccatagacctcgaccccgtaatctacgacagcaaatttgaaaagcagctcggacaagtaatgctactcgtgttatgtgctgttcaactccttctaatgagaacatcatgggccttatgtgaagcattaacgttggcgacaggtccaataacaaccttatgggaaggatctcctggaaaattttggaatactaccattgcggtatcaatggctaatattttccgaggcagttatttagcaggagcaggactggccttttctataatgaaaagtgtgggaactggaaagcgaggtactgggtctcaaggggagacccttggagagaaatggaaaaagaagctgaatcaattatctaggaaagaatttgatctgtacaagaaatccgggataactgaggtggataggacagaggcgaaagaaggacttaagcgtggagaaataactcatcacgcagtaagcagaggttcggcaaaactgcaatggtttgtagaaagaaacatggttataccggaaggtcgggtaatcgatttaggatgtgggcggggaggctggtcttattattgcgctggattgaaaaaggtaacagaagtaagaggttatactaaaggaggaccgggccatgaagaaccagtgcctatgagtacgtacggctggaacatcgtaaaattgatgtcaggtaaagatgtattctatctccctcctgaaaaatgcgacacactattgtgcgatataggcgaaagctctcctagccctacggtagaagagagccgaactatcagagtcctgaaaatggtcgaaccatggttgaaaaacaaccagttttgtataaaagtcctcaatccatatatgcctaccgtaatagaacatcttgaaaggttacaacgaaaacatggcggcatgctggtgaggaatccactatcacgtaactccacacatgagatgtactggatatctaacggtacaggtaacatcgtagcatccgttaacatggtgagtaggttgttattaaatcgattcaccatgacacacagacgcccaacaattgaaaaagacgtagaccttggagctggaacacgacatgtcaacgctgagccggaaacgccgaatatggatgtaataggagaaagaattaagaggataaaagaggaacacaatagtacatggcactacgacgacgaaaatccatataaaacgtgggcctaccacggctcatacgaagtgaaggccacaggttctgcgtcatccatgataaatggagtagttaagctattaacaaaaccatgggatgtggtaccgatggttacacaaatggcaatgaccgatacaacaccttttggacagcaacgtgtgtttaaggaaaaagtagatactagaactccgcggtctatgccaggcacgcgaagagtgatgggcattacagcagagtggctatggagaaccttaggacgaaataaaaagcctcgcctatgcacaagagaggaatttaccaagaaagttaggactaacgctgcaatgggagcagtatttactgaagagaatcaatgggacagtgcaaaggccgctgtcgaagatgaagatttctggaagctagtcgatcgagaaagagaacttcataaactagggaaatgtggttcttgtgtttataatatgatggggaagagggaaaagaagctcggtgaatttggaaaagcaaaaggatccagagcaatatggtacatgtggctaggagcacgctacctcgagtttgaggcactcggatttttgaacgaagatcactggtttagccgagagaatagttattcaggagtagaaggcgaaggtttgcacaaactaggatacattctacgagatataagtaaaattccaggtggcgcaatgtacgcggacgatacggcaggatgggatacccgaatcacggaagacgatctccataatgaagaaaagattacccaacaaatggaccccgaacatcgccaattagcaaacgcaatattcaaattgacttaccaaaacaaggtagtaaaggtccaacggcctacacctacgggtaccgtaatggatatcatttcaagaaaagatcagcgcggaagcggtcaagtgggaacatatggattaaatacgtttacaaacatggaagctcaactaataaggcaaatggaaggagaaggggtactatccaaagcagatttggagaacccgcatctcccggagaagaaaataactcagtggctagaaactaaaggagtagagagattaaaaaggatggctatatcgggtgatgattgtgtagtcaaaccaattgacgatcgtttcgcaaacgctttactcgcattaaacgacatgggtaaagtcagaaaagatatacctcagtggcagccaagcaaaggttggcacgattggcaacaagtacctttttgtagtcatcattttcatgaactaattatgaaagacggtcgaaaactcgtggttccatgtagaccccaggatgaattaataggtagagcacgaatcagtcagggtgcgggttggtcactaagagaaactgcttgtttggggaaggcttacgcacaaatgtggtctttaatgtacttccatcgtcgtgatttacggctagccagtaatgcaatatgtagcgccgtaccggtacattgggtacccacatcacgaacaacatggagcatacacgcacatcatcagtggatgacaactgaagacatgttaacagtatggaatagggtatggattgaggataatccatggatggaagataaaacgccggtaaccacatgggaagacgtaccttatttggggaaacgagaagaccaatggtgcggatccttgataggtttaacgtctagagctacttgggctcaaaatataccaactgccatacagcaggtacggagtctcatcggtaatgaggaatttttagactatatgccctccatgaaaagatttcgtaaagaggaagaatcagaaggggctatatggtaa

SEQ ID NO: 23264 - RNA, 9873 nt, synthetic construct
  misc_feature 1..9873: note = derived and/or modified CDS sequence (opt6) from DENV-3__KJ189281__SS-prME
  source 1..9873: mol_type = other RNA
accagcctttgtttaatgatgatattaccagcagcattggcatttcatttaacttcgcgagacggtgaacctagaatgattgtgggcaaaaacgaacgaggaaaatctctcttatttaaaactgccagtggaataaatatgtgcaccttaattgcgatggacctcggtgaaatgtgtgatgatacggttacttataaatgtcctcatataacggaagtcgaaccagaagatattgattgttggtgcaaccttaccagtacttgggtcacttacggaacatgtaatcaagcgggagaacataggcgtgataaaagatcggtagctttagcaccccatgtaggaatggggctcgacacccgaacccagacatggatgtcggcagaaggtgcttggcgtcaggtagaaaaagttgaaacgtgggccttaagacaccccgggttcaccatattagcgttatttttagcacattatatcgggacaagtcttactcaaaaagtagtgatatttattcttttaatgctcgttaccccatcaatgacaatgagatgtgttggtgtagggaaccgcgatttcgttgaaggattaagtggtgcaacatgggtcgacgtggtactggaacacggaggatgtgtaactacgatggctaaaaataaacccactttagatatagagctgcagaaaacagaggcaacgcaacttgccacacttcgaaaactatgcatagaaggcaaaataaccaatataacaacggacagtcgatgtccaacacaaggagaagcagtactacctgaagaacaagaccaaaattatgtgtgtaaacatacttacgtagacagaggatggggaaacgggtgtggactattcgggaaaggtagcctagtgacatgcgctaaatttcaatgcttagaaccaatagaaggaaaagtagtacaatatgaaaacttgaaatatacagtaattataactgtccatacaggtgatcaacatcaagtaggtaacgagacgcagggagttaccgcagagattacaccgcaagcgtcaactacggaagcgacattgccggaatacggaactttaggacttgaatgttctccgagaacgggactagattttaatgaaatgattctacttacaatgaaaaacaaagcgtggatggtacatagacaatggttctttgatttaccgttaccatggacttcaggcgcgacaactgagacaccaacctggaatagaaaagaactattagtaactttcaaaaatgcgcatgccaagaaacaagaagtggttgtattaggaagccaagaaggagcaatgcatactgcactcacgggagctactgagatacaaaactccggtggaacaagcatctttgcgggacaccttaaatgccggttgaaaatggataaactcgagctaaaaggcatgtcgtacgccatgtgtacgaacacatttgtccttaaaaaggaagttagcgaaacccaacatggaaccatactcataaaagtagaatataagggtgaagacgcaccatgtaagatcccatttagtacggaagacgggcacggaaaagctcataatggaagacttataacggcgaacccggtagttacaaagaaagaagaacctgttaacatagaagcagaacctcccttcggagaaagtaacattgtaatagggattggagacaacgcattaaagattaattggtataagaaaggatcatcaattggaaaaatgtttgaagctactgcgaggggagcacgaaggatggccatcctcggcgatactgcttgggacttcgggtccgtaggaggagttttaaactccctcggaaagatggtacatcaaatatttgggtctgcgtacaccgctctattttctggggtctcatgggttatgaaaattggaattggggtattgttaacttggattggtttaaacagcaaaaatacgtcgatgagcttttcctgcatagcgatcggcattattaccttgtatttaggagcagttgtgcaggccgatatgggatgcgtcataaactggaaaggaaaagaactaaaatgtgggagtggcatttttgtcacaaatgaagttcatacatggacagaacaatataagtttcaagcggactcccccaaacgcctggcgacagccattgcaggcgcctgggagaatggggtatgtggcatcagatctacgactagaatggaaaatctactatggaaacagatcgccaatgagttaaattatatcttatgggaaaataatatcaagttgacagtggtagtaggagatataatcggggtcctagaacaaggtaaaaggacgctaacaccccaaccaatggagctaaaatacagttggaaaacctgggggaaagccaagatagtaactgcggaaacacaaaatagctcatttattatagatggaccaaatactcctgagtgcccttccgcttcaagagcatggaatgtgtgggaagtcgaagattacggatttggagtttttacaactaacatttggttgcgattacgcgaagtatacacccaactctgcgaccatcgactaatgagtgcagcagtgaaagatgaaagagctgtccatgccgacatgggatattggatcgaaagtcagaaaaatggttcatggaaactagagaaggcttcactgatagaggttaaaacgtgtacctggccaaagagtcatacgctatggtctaatggagtgcttgaatccgacatgattatcccaaaatccctagctggacctattagtcaacacaaccataggccgggataccacacacaaaccgcaggtccctggcatcttggcaaattggaactcgatttcaactactgtgaaggtactacggtcgttataacagagaattgcggaactcggggcccgtcactccgcacaacaactgttagtggcaaacttatacatgaatggtgttgccgatcatgtactttacctccgttaagatacatgggggaagacggatgttggtatggtatggaaataaggccaatctcggaaaaagaggaaaatatggtgaaatcattagtgagcgcgggatcaggcaaggtagataattttactatgggggttctgtgcttagccattctctttgaagaagttatgcgagggaaattcggcaagaaacacatgatcgcaggagtattctttacattcgtacttttattgtctgggcagataacgtggcgtgacatggctcatacattgattatgataggaagtaacgcaagtgatcgaatgggtatgggtgtaacatacttagcattaattgccaccttcaaaatacaaccattcttagtactaggcttctttttgagaaaactgaccagtcgtgaaaatttactcctaggtgtaggcttagctatggccacaactttacagttaccagaagacatcgaacagatggcaaatggcattgcactaggacttatggccttaaaactgattacccaattcgaaacgtaccagttatggaccgcgctaatttccctaacatgtagtaacacaatatttacactaactgtagcatggagaactgctacattgatacttgctggagtatccctactgcccgtctgtcaatcatctagtatgagaaaaaccgattggctaccaatggcagtagctgctatgggcgttccacctttgccactttttatattctcacttaaagacactctgaagcgaaggagctggccccttaacgaaggtgtgatggcagtaggtctagttagtatccttgcgagttctctgttgagaaacgacgtccccatggcaggaccgttagtagcgggaggattacttatagcatgttacgtaattacgggaacatcagcagatttaactgtagaaaaggccgcagatataacatgggaagaggaggctgagcagactggggttagtcataatttaatgatcaccgttgatgacgatggaacgatgagaattaaagacgatgaaaccgaaaacatactaacagtactattaaaaacggcactgctcattgtttcgggcatatttccttattctatccctgctacattactggtctggcacacttggcaaaaacaaacccaaagaagtggagtcctatgggatgttccttccccgccagagacacaaaaagcagaattggaagagggagtataccgtattaaacaacaaggtattttcggaaagactcaagttggagtaggtgtccaaaaagagggagtattccatacgatgtggcatgttactagaggggccgtgctaacgtataatggcaagagattagagcccaattgggcatcagtcaagaaagacttgatttcatatggtggcggttggagattatcaacacagtggcaaaaaggagaagaagtgcaggtcatagctgtagaaccagggaaaaacccaaagaattttcaaacgatgcccggtacattccaaacgacgacgggagagattggcgctattgctttagattttaagcctggtacatcaggatcgcctatcataaacagagaaggaaaggtggtgggattgtacgggaatggagtagtcaccaaaaacggtggatatgtgtcgggaatagcacaaactaacgctgaacctgacggacctacaccagaactggaggaagagatgtttaagaaacgaaatcttacaattatggatctccatccaggaagtggtaaaacaagaaagtatttaccagcgatagttcgagaggccatcaaacgccgcttaagaacgttaattttagccccaacacgcgtagtcgcggccgaaatggaagaagctctaaaaggattacctatccgctaccagacgacggcaacaaaatcagaacacacaggaagagaaatagtagacttgatgtgtcatgcaacattcacaatgcgtctgctatctccagtgcgagttccaaattataatttgatcataatggacgaagcccatttcacagacccagcctcaattgcggcaagagggtatatctccacaagggttggtatgggcgaagcagcggccatatttatgaccgccacaccaccaggcacagcagacgcttttccgcagtcaaatgcgccaatacaggatgaagaaagagacataccagagaggtcctggaacagcggaaacgaatggataacagacttcgcaggcaagactgtatggtttgtcccaagtataaaagctggcaatgacatagcaaattgtttaaggaaaaacggtaagaaagttatacaactaagcagaaaaacgtttgacactgagtatcagaaaactaagttgaatgattgggattttgtggtaactacagatataagtgaaatgggagctaatttcaaggctgaccgcgttattgacccaaggagatgtttgaagcctgtgatcctcacagacggtccagaaagagtaatcttggcaggtccaatgcccgtgactgcagccagcgcagctcaaaggagaggaagggttggaagaaaccctcaaaaggaaaacgatcaatatatcttcaccggccaaccattgaataatgacgaagatcatgctcactggacggaagcaaagatgttactggataacataaatacacctgagggaataatcccagccctgtttgaacccgaaagagagaaaagtgctgcaattgacggtgaatacagactgaaaggtgaatcacgaaaaacttttgtcgaattgatgaggcgaggagacttgccagtctggctggcacacaaagtcgcaagtgaaggaattaaatacacggatcgtaaatggtgctttgatggtcaacgtaacaatcaaattttagaggaaaacatggacgtagaaatttggacaaaagaaggagagaagaagaaattaagaccgaggtggctagatgcgcgaacctacagtgatcccttggcattaaaggaatttaaagattttgcggctgggcgcaaaagcatagccctggatctcgtaacagaaattggtcgagtaccatcccatcttgctcatcgtacacgaaacgctctggacaatctggtaatgctacatacaagtgaacatgggggaagggcttacagacatgctgtagaagagttaccagagactatggaaacgctattattactcggcttaatgattttacttactggaggtgcgatgctctttttaatatcaggaaagggaataggtaaaacctctattggcttaatttgtgtgatagcgtcaagcggtatgctatggatggcagaaataccacttcaatggatagcgagcgccatagtcctagaatttttcatgatggtgttgctaatacccgaacctgaaaaacaacgaaccccgcaggataatcaattggcttacgtcgttataggtatcctaaccttggcagcaattattgcagcgaatgagatgggattattggagactactaaaagagacttagggatgtcaaaagagccgggtgttgtaagccctacgtcttatttagatgtcgatctccatccagcatcagcatggacactctacgccgtggctactactgtaataacgcctatgttaagacacacaatagaaaactccaccgctaatgtgtcattggccgcaatcgctaatcaggcagtagtgctaatgggtttggataaaggttggccaatatcaaaaatggacttaggggtaccgttattagcattaggttgttacagtcaagtcaacccccttacactgactgctgcagtcctactattaattactcactatgctataataggacccggattacaagcaaaagctactagagaagcccagaaaagaactgcggcgggaatcatgaaaaatcccactgttgacggtataatgacgatagacttagatccagtgatatacgactcaaagtttgaaaaacaattaggccaagtcatgctattagtactttgcgctgttcaactactattaatgaggacgagttgggcattgtgcgaagcacttactttagccactggacctattacaactttatgggaagggagtcccggtaaattttggaatactacaatagcggttagtatggccaacatatttagaggtagctatctggccggtgcaggactggcattttctataatgaagtcagtcgggacgggaaaacgaggaactggctcgcaaggggaaacgttaggagaaaagtggaagaagaaactgaaccaattatctcgtaaagaatttgatctatataaaaagtcgggcattacagaggtcgacaggacagaagctaaagaaggtcttaaacgaggagaaataacacatcatgcagtttcacgtgggagtgcgaaattacagtggttcgttgaaagaaacatggtaatccccgaagggcgagttatagatttaggctgcggccggggtgggtggtcatactattgtgcgggactaaagaaagttactgaggtaagaggctacacaaaaggtggaccaggacacgaggaaccagtaccaatgtcaacgtacggatggaatattgtcaaacttatgtcaggaaaagatgtgttctatttgccacccgaaaaatgcgatactttgttatgcgatattggagaatcttccccttccccaactgttgaagaaagcagaaccattcgtgttcttaaaatggtggaaccatggctaaagaataaccaattttgtattaaagtgttaaatccttatatgcctacagttatcgaacatctggaaaggttacaacgaaaacatggtggaatgctggtccgtaaccctctatcacgcaattctactcatgagatgtactggatttccaatgggacagggaacatagtcgcctccgtaaatatggtaagcagactattactcaatagatttacaatgactcatcgacgaccgaccatagaaaaagatgttgatcttggggcaggaacaagacatgttaacgccgaacctgaaactccaaatatggatgttattggggaacgtatcaaacgtattaaagaggaacacaactctacatggcactatgacgacgaaaacccatataaaacatgggcatatcacggtagttacgaagtgaaggcgacgggatcagcttcttctatgataaacggagttgttaaacttttgactaaaccgtgggacgttgttcctatggtaactcaaatggcaatgacagataccaccccttttgggcagcaaagagtttttaaagaaaaagtggataccagaacaccgagaagtatgcctggcactcggagagtgatggggattactgcggagtggctatggcgaaccttaggtcgaaataagaaaccaagactgtgcacacgagaggaatttactaagaaagtgagaaccaacgccgccatgggtgcagtcttcacagaagaaaaccagtgggacagtgcgaaagccgcagtagaagatgaggatttttggaagttggtcgatcgcgaacgcgaattacataaattaggtaaatgtggaagttgcgtatataatatgatgggtaaacgagagaagaaactcggcgaatttgggaaggctaaaggatctagggcaatctggtatatgtggttaggtgctcgatatttggagtttgaagccctcggatttttgaacgaagaccactggttttcacgagaaaacagttattcgggtgtagaaggtgagggtttgcataaactaggatatatactacgtgatatatcgaaaatacctggaggagcgatgtacgccgatgacacagccggttgggatactcgaataacagaagacgacttacacaatgaagagaaaatcacacaacagatggatccagaacaccgacaattagcaaatgctatatttaaactaacatatcaaaataaagtagtaaaagtgcagcggccaacaccaaccggaacagtaatggatataataagcagaaaggaccaaagagggtcgggtcaggtaggcacatacggtctaaataccttcacgaacatggaagcacaactgatacgccaaatggaaggtgagggagttttgtcaaaagcggacctagaaaatcctcacttaccagagaagaagataacacaatggctcgaaaccaaaggagtagaaaggctcaaacgtatggctattagtggtgatgattgtgtagtcaaacccattgatgatcggtttgcaaatgcactgctcgcattaaatgatatggggaaggtacgaaaagatataccccaatggcagccatcaaaaggttggcatgactggcagcaagtccccttctgtagtcaccattttcacgaattgataatgaaagatggtcgtaaattagtcgtaccttgcagacctcaagacgaattgatcggccgagccagaatctctcagggagcaggatggtccctgcgcgaaaccgcgtgtctaggtaaggcttatgcacagatgtggtcgcttatgtattttcatcgaagagatttgcggcttgccagtaatgcaatttgctcagcagtccccgtgcattgggtacccacttcgagaacgacttggagtatccatgcacaccatcaatggatgactacagaagatatgttaacagtgtggaatcgagtgtggatcgaagacaatccttggatggaagataagacaccagtcacaacctgggaagatgttccatatctgggaaaacgcgaagaccaatggtgtggatcactaataggactaacaagtagggcgacttgggcacagaatattccaacagcaatacaacaggtacgatctctcataggtaacgaggagttcttagactatatgccatcaatgaaaagatttcgaaaggaagaagaaagcgaaggggcaatctggtga

SEQ ID NO: 23265 - RNA, 9873 nt, synthetic construct
  misc_feature 1..9873: note = derived and/or modified CDS sequence (opt6) from DENV-3__KJ189282__SS-prME
  source 1..9873: mol_type = other RNA
acgagcctttgcctaatgatgattttacctgccgctttagctttccacttaacatcacgagacggtgaaccgaggatgatagttggcaaaaatgaacgtggtaaaagtctattattcaaaacggcatccggaataaatatgtgcacgttaattgccatggatttgggagagatgtgcgatgacacggtcacatacaaatgtccgcatataaccgaagtggagccggaagatatagactgctggtgtaacctaaccagcacttgggtaacatacggcacctgtaatcaagcaggagaacacagaagagataaaagatctgtggctctggcaccacatgtaggaatgggattagatacgaggactcaaacatggatgtctgcagaaggagcttggagacaagtcgagaaagtagaaacgtgggcacttcggcatccaggatttactatattagcactatttttagcacactatataggaacttccttgacacaaaaagttgttatatttatactactcatgttagttaccccaagtatgactatgcggtgcgtgggggtcggaaatcgagactttgttgaaggcctaagtggcgctacttgggtagacgttgtcttagagcatggaggatgcgtaacgacaatggccaaaaataaacccaccctcgatattgaattacagaaaactgaggcaacacaactagccacactacgaaaactgtgtattgaaggaaaaataactaacattactaccgattcccggtgtccaacccaaggagaagcagtcttaccagaagaacaagatcaaaactatgtatgtaaacacacatatgtggacagaggttggggtaatggatgtggacttttcggtaaaggtagcctagttacttgtgctaaatttcaatgtctagaaccaatagaaggcaaagttgttcaatacgaaaacctaaaatacacggtgattataacagttcacacaggggaccaacaccaagtagggaatgaaacacaaggtgttaccgcagaaataactccacaagctagtacaactgaagctacgttacctgagtacggaactctgggcctagaatgttccccacgcacaggcctagattttaacgaaatgatattactgactatgaaaaataaggcttggatggtgcatcgtcaatggttctttgatttgccactaccatggacatctggagcaacaactgagactcctacttggaatagaaaagagttgttggtcacatttaagaacgctcatgctaaaaagcaagaggtagttgtacttggaagccaagaaggagctatgcatactgcattaactggagcgactgaaatccaaaattcaggagggaccagcatctttgcggggcacctgaaatgtcgattaaaaatggataaactcgaattaaaaggtatgtcgtatgctatgtgcactaatacttttgtgttgaagaaagaagtctcggaaacccaacatgggacaatattaataaaagttgaatataaaggagaagacgctccatgtaaaatcccttttagtactgaggacggacatggaaaagcccataatggtagactcataacagcaaatcctgtcgtcactaagaaagaggaaccagtaaacattgaagccgagccaccttttggagagagcaatattgtaataggaataggtgataatgcactaaaaataaactggtacaagaaaggatcttcgattggaaaaatgtttgaagcaacagctagaggtgcccgtagaatggctattttaggagatactgcttgggattttggctcagtgggaggagtattaaattcattgggaaaaatggtacatcaaatcttcggatcagcatatacagcattgtttagcggcgtaagctgggtaatgaaaattgggatcggggttctcttaacttggattggactaaactctaaaaacacatcgatgtcattctcatgcattgcgattggtataataacactatatctaggtgcagtagtacaggctgatatgggctgtgtaataaattggaaaggaaaggaactgaaatgtggctcaggtatatttgtcacaaacgaggttcacacatggacagaacagtacaaattccaagcagattcacccaaaagactagcgactgcgatcgcaggagcatgggaaaacggtgtatgtggcattcgtagcactacgcgtatggaaaatttattatggaagcagatcgcgaacgaattgaattatatcctatgggagaacaatatcaaacttacagtcgtagttggagatataataggcattcttgaacagggaaagcgaactttaacaccgcaaccgatggaattgaagtatagctggaaaacctggggaaaagcaaaaatagtgaccgcagagacacaaaacagcagttttataatagatggacccaacacaccagaatgtccaagcgcatcaagagcttggaatgtgtgggaagtcgaggattacggatttggagtatttacaacgaatatatggttgagattaagggaagcgtacacacaactatgcgatcacagactcatgagcgctgcagtaaaggatgagagagcagtgcatgcggatatgggatattggattgagtctcagaaaaatggctcttggaaattagaaaaagcaagcctaattgaagttaaaacatgtacgtggcccaaatctcatacactttggagcaacggggtactcgagtctgatatgattatacccaaatcattagcaggtccaatcagtcaacataatcacagaccaggctaccatacacaaacggccggtccttggcacttgggaaaactcgaactcgactttaactactgcgaaggaaccacagtagtaattactgagaactgcggaacgaggggtcctagcctgcgtactacaacagtaagcggtaaattaatacatgaatggtgttgtagatcatgtacactaccaccattaagatatatgggtgaagatggctgttggtatgggatggaaattcgtcccatatccgaaaaagaagagaatatggtaaaaagccttgtttcagcgggatcaggtaaagtcgacaactttactatgggggttctatgtttagctatcttatttgaagaagtaatgcgaggtaagtttggaaagaaacatatgatagcaggcgttttcttcacgtttgtacttttattgtcaggacaaattacttggagagatatggcgcatacattgatcatgataggatctaacgccagtgatagaatgggaatgggggtaacgtacctagcactaatagccacttttaaaatacaaccatttttggccctaggattctttctacgaaaattaacgagccgcgagaacttactacttggagtcggattagcaatggctacaacactacaattgccagaggatattgaacagatggcaaacggcatagcgttaggactaatggccctaaaactaataacacaattcgagacttatcaactatggacagcattaatcagtttaacttgttcgaacacaattttcaccctgacagtggcgtggagaacagcgacgctcattctagctggagtatcactacttccagtgtgccagtccagctctatgagaaaaaccgactggttgccaatggcagttgcagcaatgggagttccgcccctcccactatttatattctcattaaaagacacgcttaaaagacgatcgtggcctctcaatgaaggagtaatggccgtcggattggttagtatattagcgtcatctttattacgcaacgacgtacctatggcaggacctttagtagcgggtggcttactaatagcttgttatgtgataacaggaacatcagctgatctaactgttgagaaagcagctgatataacttgggaggaagaagcagagcagaccggagttagccataacttaatgataactgtcgacgacgatgggaccatgcgtattaaagacgacgagacggagaacatacttacggtattgctcaaaactgctctcttaatagttagtgggattttcccatactcaataccggcaaccctattagtgtggcatacttggcaaaaacaaacacaaaggtcaggagtattatgggacgtgccttcaccacccgagacgcagaaagcagagttggaagaaggcgtatacaggataaaacaacaaggaatatttggcaaaacacaagttggcgtgggggttcagaaagagggagtatttcacacaatgtggcatgtaacgaggggcgcagtcttaacttataacggtaaacgacttgaaccaaactgggctagcgttaagaaagatctaataagctacggaggaggatggagactatctacacaatggcaaaaaggcgaagaagtgcaagtgatagcagtcgaaccgggtaaaaatcccaaaaattttcagacaatgcctggtaccttccaaactacaaccggagaaattggtgctattgcattagactttaagcctggaacgtcaggaagtccaataattaatagggaagggaaagtagtagggttgtacggtaacggcgtagttaccaaaaatgggggttatgtaagcggtatcgcacaaacaaatgcagaaccagacggcccaaccccggaattagaagaagaaatgtttaagaaacggaatctaaccataatggatttacatccaggatccggaaagaccagaaaatatctgccagctattgtcagagaagcaattaagcgaaggctaagaactctaattctagcgccgacaagagtggtcgcggccgagatggaggaagctctcaaaggattaccaattcgctatcaaacaacagcaaccaaatcagaacatacgggacgagagattgtggatcttatgtgtcacgcaacttttaccatgcgactcttgagtcccgtgcgcgtaccaaactataacttaattataatggacgaagctcactttacagatccagctagtatagccgctcgaggatatatttcgacaagggtcggtatgggagaagcagctgcaatttttatgacagctactcctccaggtacagctgatgctttcccgcagagtaatgcgcccattcaggacgaagaaagagacatccccgagcgaagttggaactcaggaaacgaatggataacagattttgccggaaagacagtctggtttgttccttcaattaaagccggaaatgatatcgcaaattgtttaaggaaaaacggcaaaaaggttatccaattatcccgaaaaactttcgatacagaatatcagaaaacaaagttaaatgactgggacttcgtggtaacgaccgatatatctgaaatgggagcgaacttcaaggcagatagagttattgaccccagacgctgcctaaagccagtaattttaaccgatggcccagaaagagttattctagctggccccatgccggtcacagcagcaagtgccgcacaaagacgaggcagagtaggaagaaatcctcaaaaggaaaatgaccaatacattttcacaggtcagccattaaacaatgacgaagatcatgctcactggacagaggccaaaatgctgttagataatataaatactccagaaggcataatcccggctctatttgaaccagaaagagaaaaatctgctgcgatagatggagaatatcgtctcaaaggtgaaagccgaaaaacatttgtggaactcatgcgtcgtggtgatctgccagtgtggctagcacacaaagtcgcaagtgaaggtatcaaatacacggacagaaaatggtgtttcgatggtcaacgtaataatcaaatactagaagaaaacatggatgtagagatatggacaaaagaaggtgagaagaagaaactaagacctagatggttagatgctagaacctattccgatccattagcactgaaagaatttaaagattttgcagcaggaagaaagtctattgctctcgatttggtgactgaaattggccgagtgccaagccacctagctcatagaaccagaaacgctctagataatcttgtaatgttacatacgtccgagcatggcggtcgcgcctatagacatgctgttgaggaattaccggaaactatggaaacattattacttttaggtctcatgattttattaaccggaggagcgatgttgttcctcatatctggcaaagggataggtaagacaagtataggccttatttgcgttatagcaagttcaggaatgctatggatggcggagatacctttgcaatggatagcctcagcgatcgtattggaatttttcatgatggtattacttatacctgaaccagagaagcaaagaacacctcaggataatcaattggcttacgtagtcatcggcatattaactctggcggcgataatagctgcaaacgagatgggcttacttgagaccacgaaacgtgatcttgggatgagtaaggaaccgggagtagtgagccccaccagctacttagatgttgatcttcacccggcatctgcgtggactctatatgcggtagcaacaaccgtgataacgccaatgttacggcatacaattgaaaattctacagctaatgtaagtttagcggccatcgctaaccaggccgttgtactgatgggactagataaaggatggcctatttctaaaatggatttaggggtacccctcttagcacttgggtgttattcacaggtaaaccctctaacccttacagcagcagttttactactcattacccattatgcaatcatcggacccggactacaggcgaaagcgacgagggaggcacagaaaagaacagctgctggaataatgaagaatccaacagtcgacggtataatgacaatagaccttgatcctgtaatatacgatagtaagttcgaaaaacaactgggccaagtaatgcttctcgtgctctgtgcagttcagttgttactcatgagaacgtcgtgggcgttgtgcgaagccttaactttagcgacaggtccaatcacaacgctctgggagggaagtcccgggaaattttggaacaccacgatagctgtgtctatggctaacatatttagagggtcttatttagcaggcgctggactcgcattcagtataatgaaatcagtcgggacaggtaaaagaggaactggaagtcagggcgagacactcggcgaaaaatggaagaagaaattaaaccaactaagcaggaaagaatttgatctctacaaaaagtcaggaataaccgaagtggatcgtacagaagcaaaagaaggcttgaaaagaggagagattactcatcacgcagtctcaagagggtctgcaaaactgcagtggtttgtagaacgaaacatggtcatacctgaggggcgtgtaattgaccttgggtgtggccgcggaggatggtcctattattgtgcggggctcaagaaagtcacggaagtacggggatatacaaaaggtggcccaggacacgaggagcctgtcccgatgtcaacttacggttggaacattgttaaactaatgagtggaaaagatgtattttatttacctcctgaaaagtgcgacacacttttgtgtgacattggtgaatcgagcccttccccaaccgtagaagaatctagaactatccgagtcttaaagatggttgaaccttggctcaagaataaccaattctgtattaaagtgttaaatccctatatgcctaccgtcattgagcatttggaacgattgcaaagaaagcatggtggcatgctcgttcgaaatcctctaagtagaaactctacccatgaaatgtactggattagtaatggtacgggtaacatagttgcgtcagttaacatggtatcaagattactattaaatcgattcacaatgactcacagaagaccaactatagaaaaagacgtggaccttggtgcagggacgcgacacgtaaatgcagaaccagagacgcctaacatggatgttataggtgaaaggatcaaaagaataaaggaagaacataattccacctggcattatgatgatgaaaatccatacaaaacttgggcatatcacgggtcgtatgaagtcaaggcgactgggtcggcatcttctatgataaatggagtcgtcaaacttctaacaaaaccttgggatgtggttcccatggtcacacaaatggcaatgaccgatacgacacccttcggacagcaaagagtctttaaagaaaaagtggatacccgtacacctcgttcaatggcgggtacacgtagagtaatgggaataacagcagaatggctatggcggacgctcggtcgcaacaagaaaccgagattatgcactcgagaagaatttaccaaaaaggttcgtacaaacgctgcaatgggggccgtatttacggaggagaatcagtgggattctgcgaaagccgcggtagaagacgaagacttctggaaattagtggacagggaacgtgaactacataaactcggaaagtgcgggtcctgtgtctacaatatgatggggaaaagagagaagaaacttggcgaatttgggaaagcaaaaggaagtcgagctatatggtacatgtggcttggtgccaggtatctggaatttgaagcactagggttcttaaacgaggatcattggttttcacgtgaaaattcgtacagtggtgtagagggtgaaggccttcataaattaggttatatactaagggatatatcaaaaataccagggggagctatgtatgccgatgacacagcaggctgggatacgagaattacagaagatgatctgcataatgaggagaaaataacacaacaaatggatccggaacacagacaattagcaaatgctatcttcaaattaacatatcagaataaagtggtaaaagtacaaagacccactccaacaggaacagtaatggatattatctcccgcaaggatcaaagaggctcagggcaagtaggtacttacggattaaacaccttcacaaacatggaagcacagttaatcagacaaatggagggagaaggagtcttatcaaaggccgacctagaaaatccgcatctgcccgagaaaaagatcacacagtggttagaaacaaaaggtgttgaacggctaaaaagaatggctataagcggagacgattgcgtagtcaaacctattgatgataggtttgccaacgctctcctggcgctcaatgacatggggaaagttcgaaaagacatacctcagtggcaacctagtaaaggttggcatgattggcaacaagtccccttttgctcacaccatttccacgagttgataatgaaagacggacgaaagctagttgtcccctgcaggccacaagacgaactaataggcagagcaagaatttcccaaggagcaggatggtcacttcgagaaacggcctgtttagggaaggcttatgcacaaatgtggtccctgatgtatttccacagacgtgacctaagactagcatcaaacgcaatctgttctgcagtccccgtgcactgggtaccgacatctagaacaacgtggtcaatccatgcgcatcatcagtggatgacgactgaggatatgttgactgtttggaaccgtgtctggatcgaggataacccatggatggaagataaaactccagttacaacatgggaggatgtcccgtacttaggaaaaagggaggaccaatggtgcggcagcttgataggactaacttcaagagctacctgggcacagaatatacctacagccatacaacaagtacgaagtttaattggaaacgaagaatttttagattacatgccgtcaatgaaacggttccgtaaagaagaagaatcagaaggtgctatctggtga

SEQ ID NO: 23266 - RNA, 9873 nt, synthetic construct
  misc_feature 1..9873: note = derived and/or modified CDS sequence (opt6) from DENV-3__KJ189283__SS-prME
  source 1..9873: mol_type = other RNA
acttcattatgtctaatgatgatcctgcctgcagctctagcatttcatttaacttcaagggatggagaacctcgaatgatagtgggcaaaaatgaaagaggaaaaagtttattgttcaaaacagcgtcgggaatcaatatgtgcacattgatagcaatggacttaggagagatgtgtgacgatacggtaacatacaaatgtcctcatataacagaagtagagccagaagacattgactgctggtgtaatttgacatcaacgtgggtaacatatggtacttgtaatcaagccggtgaacataggcgggacaaacgctcagttgcattagcacctcatgtgggtatgggactggacactcggacccaaacatggatgtcggctgagggtgcatggcggcaagtagaaaaagtagaaacctgggcattaaggcatccaggttttacaatactagctctgtttttagcacattacattggaacttctctaacccaaaaagtagtaatattcattctattgatgctagttactccatcaatgactatgaggtgtgtcggagtgggaaatcgtgattttgtagaaggtctaagcggtgcgacatgggtcgatgtcgtcctagaacatggcggttgtgtaacaacaatggctaaaaataaacccacactcgatatcgaactacagaaaacagaagcaacgcaattggcaacactcagaaaattatgcatagagggcaaaatcaccaacattacaactgactcacgatgcccaacacaaggagaggcagtgctcccagaggaacaagatcaaaactacgtatgcaaacacacttacgtagaccgcgggtggggtaatggttgcggcttattcggtaaggggagcttagtaacctgtgcaaaatttcaatgtctagaaccaatcgagggaaaagtagtacaatatgagaatttaaaatatactgtaattataacggttcacacaggagaccaacaccaagttggtaacgagacacaaggagtaactgcagagattactccacaagcatctacaactgaagccacacttccagaatacggaacactgggattggaatgtagtccgcgaactggtttagacttcaacgagatgattcttcttactatgaaaaataaagcctggatggtacacagacagtggttctttgacctgccactgccttggacgagcggcgcgacgactgaaacaccaacctggaataggaaagagttattggtgacattcaaaaatgctcatgccaagaaacaggaagttgtggtattaggttctcaagagggtgctatgcacaccgcgctaaccggagcaacggaaattcaaaatagcggtggtacgtcaatttttgcaggccatttaaaatgtaggcttaaaatggacaaattagaactaaaaggtatgtcatacgcaatgtgcaccaatacatttgttcttaagaaagaggtttcggaaacacaacacgggaccatcttaataaaagtcgaatataaaggcgaggacgcaccatgtaaaataccatttagtaccgaagatggacatggaaaagcacataatggccggttaattaccgccaaccctgtagttaccaagaaagaagaaccagttaatatagaagcagagccaccatttggagaaagcaatatagtaataggtataggagataatgcactaaagattaattggtataagaaagggtcaagcattggaaaaatgtttgaagccacggctagaggtgcacggagaatggcaattttaggggatacagcgtgggactttggttcagtcggtggagtactcaatagcctaggaaaaatggtgcaccagatctttggttcagcatacacagcactattttcaggcgtatcttgggttatgaaaataggaattggcgtactactaacttggattggtttaaatagcaaaaatacctccatgtcattttcctgcattgcaataggaattataactctttatttaggggctgtagtgcaagcagacatgggttgtgtcataaattggaaggggaaagaactaaaatgcggcagcggaatatttgttaccaatgaggtacacacgtggactgaacaatacaaattccaagcagactctccgaaaagactagcgaccgctatagctggcgcctgggaaaatggagtttgcggaatccgcagcactactagaatggaaaatcttctctggaagcaaatcgccaatgaattaaattatatattgtgggaaaataatattaaattgacggtggtggttggtgacataatcggtgtgctagaacagggaaaaagaaccctaactccccaacctatggaactgaaatatagttggaaaacttggggcaaagcaaaaatagtgacagctgaaactcaaaattcttcatttataattgatggtccgaacacccctgaatgtccgagcgcttcacgagcatggaacgtctgggaggtggaagattatggttttggcgtgttcactacgaatatttggctaagacttcgtgaagtctacacacaactgtgcgaccataggctcatgtcggcagctgttaaggatgagagagccgtccacgctgacatgggttattggatcgaatcgcagaaaaacggaagctggaaattagagaaagcatctttgatagaggttaaaacatgtacatggccaaaatcacacacgttatggtcaaacggcgtactcgaaagtgatatgataataccgaaaagcctagcgggccccatatctcaacacaatcacaggccaggataccatactcaaactgcaggtccctggcatttaggcaaactagaacttgactttaattattgtgagggaacgacagtcgttataacagaaaattgtggcacccgaggacctagtctaagaaccacaactgtctcaggcaagctgatacatgaatggtgctgcagaagttgcacactgcccccgctacgatatatgggggaggacggttgttggtacggaatggaaatacgacccatctcggaaaaggaggaaaatatggtgaaatcacttgtaagtgcaggtagcggtaaagttgataactttaccatgggagtgttatgccttgcaatcctcttcgaagaagtaatgagagggaaattcggaaagaaacatatgatcgcgggtgttttctttacattcgttttgctactgtccggacaaattacgtggcgtgacatggcacacacgttaataatgattggatcgaatgcctctgatcgtatgggaatgggtgtaacgtatttagcattgatcgctacgtttaaaattcagccatttttagctttgggattctttctaagaaaactaacatcaagagaaaatttgctgttaggagtcggcttagcaatggccacaacactccagctacccgaggacatagaacaaatggcaaacggcatcgccctaggattaatggcactcaaattaattacacagttcgaaacttatcagctttggacggcgctaatatctttaacttgttcgaaaactatttttactctaacagttgcctggagaacggctactctgatcctagcaggcgtatcgctattaccggtttgtcagagcagttcgatgagaaaaactgattggctgcccatggcggtggcagcaatgggagtgccaccgttaccactttttatcttctccctaaaagacactctcaaaagaaggagctggccgttgaacgaaggtgtcatggcagtaggattagtatcgatactggcctcttcacttctaaggaacgacgttcccatggcgggaccgctagtggctggaggactgctaatagcatgttatgtcataacggggacaagtgcagacctaacagtagagaaagcagcagacataacctgggaagaagaagctgagcaaaccggagtatcacacaacttgatgattactgtggacgacgatggaacaatgagaatcaaagatgacgagactgaaaatatactaaccgtccttttgaaaacggcactgttaatagtgtccggaatattcccatattcaattccagcgaccctgttggtatggcatacctggcaaaaacaaacacaacgatctggtgtactttgggacgtaccatcgcccccggagacacaaaaagcagaacttgaagaaggagtttatcgaatcaaacagcaaggaatattcggcaaaacacaagtaggggtaggagttcaaaaagaaggtgtatttcacaccatgtggcatgtaaccagaggtgcagttctaacatataacgggaagaggctagagccgaactgggcatctgtcaagaaagatctaataagttatggaggcggttggcgattatcaacccagtggcaaaagggtgaggaagtgcaggttatagcagtagaacctggaaagaatcccaaaaatttccagacaatgccgggaacatttcaaacaactactggtgaaataggagctattgcgttggattttaaaccaggaacatccggatcacctataattaaccgagaaggtaaagtcgtgggactatatggcaatggcgttgttaccaaaaatgggggatacgtctccggtatagcacaaacaaatgcagagccggatggtcctacgccagaacttgaggaagagatgtttaagaaacgaaatttaactataatggatttacatccaggatcgggaaaaacaagaaaatatttaccagcgattgttcgcgaagcaattaaacgacgattacgtacactaatattagctccaacacgcgtcgttgccgctgaaatggaagaagcacttaaagggctacccataagatatcaaactactgccacgaaatccgaacataccggccgtgaaatagtagatttaatgtgccatgctacatttactatgcgtttactatcaccagttcgggttccaaactataacctaataattatggatgaagcacattttacagacccagcctcgatagcagcaagaggatacataagtactagagtaggaatgggagaagccgcagccatattcatgaccgcaactccaccaggaactgctgacgcattcccacaatcaaatgcaccaatccaagatgaagaacgggatattccagaacgttcgtggaactccgggaatgaatggatcactgatttcgcgggaaaaactgtatggttcgtccctagtattaaagccggtaacgacatagcgaactgtttgcgaaagaacggcaagaaagtaatacaactaagtagaaaaactttcgacacggaatatcagaaaacaaaactaaacgattgggattttgtcgttaccaccgacataagtgaaatgggcgcaaattttaaggctgatcgtgtaatagatcccagaaggtgcctcaaaccggtcatcctcacagatggtccagagagagttatattagcagggcccatgcccgtaacagcagcttcagcggcccagcggaggggccgtgtgggacgtaatccacaaaaagaaaatgaccaatatatctttactggtcaaccacttaataatgacgaagaccacgcacactggacggaggcaaaaatgctactagacaatatcaacaccccagaaggaataatcccagcacttttcgaacccgagcgagagaaaagtgctgccatagatggggaatatcgacttaaaggtgagtcaagaaaaacatttgtagaattaatgcgtcggggagatctaccagtctggctggcccacaaagtcgcatctgagggcataaagtatacggataggaaatggtgcttcgatggccaaaggaataaccaaatactagaggaaaatatggatgtcgaaatatggactaaggaaggagagaagaagaaattacgcccaagatggttagacgctagaacatacagcgatccactcgctcttaaagaatttaaagattttgcagccggtaggaaaagtatagccctagatctggtcactgaaatcgggagagtcccgagccacttagcacacagaacacgtaatgccctagataacctcgtgatgttgcacacgtcagaacatggtggaagggcttacagacacgctgtcgaagaattaccggaaacaatggagactctattactacttgggctaatgatactactcaccggaggtgcaatgctattcctaatatccggcaaaggaattggaaaaacgagtataggtttaatctgtgtaatagcttccagtggtatgttatggatggcagaaatacccttgcaatggatagcgtcggccattgtcctagagttctttatgatggtacttcttatacccgaacctgaaaaacaaagaaccccacaagacaatcaactcgcatatgtcgtaataggtatattaacactagccgctattatcgctgcaaacgaaatgggactcttagaaaccacaaaacgggacttagggatgagcaaagaaccaggggtagtttccccgacatcatacttggatgtagacctacacccagcgtcagcctggaccttatacgcagtggcaacaaccgtaataacgcccatgctacgacatacaatcgagaatagcacagctaatgtgagcttagcagcaatagcaaaccaagcagtagttctaatgggattagataaaggatggccaataagtaaaatggatctaggagttccattactagcactgggatgctactctcaagtgaacccactgactttaaccgctgcagtcttactattaataactcattacgcaatcatagggccaggattacaagctaaggcgacacgagaagcgcaaaagaggacagccgcgggaatcatgaaaaacccgacggttgacggaataatgactatagacttagatcctgtcatttatgatagtaaattcgaaaaacaactcggacaagttatgcttctagtgctgtgtgctgtacagttactgttaatgcgaacttcctgggccttatgtgaagctcttactttagctacgggacctatcacaacactttgggaaggcagcccaggaaaattctggaacacaacgatcgctgtgtcaatggctaacatattcaggggatcttatctagctggggcgggattagcattcagtattatgaagtccgtagggaccgggaaacgaggtactggaagtcaaggagagactcttggagaaaaatggaagaagaaattaaatcagttgtcaaggaaagagtttgatttatataagaaatcgggaataacagaagtagatcgtactgaggcaaaagaagggctcaaaagaggcgaaataacacatcatgcagtctctcgaggctctgccaaattacagtggtttgttgaacgtaacatggttatacctgaaggaagagtaatagacctaggctgtgggcggggcggctggagctactattgcgcaggacttaagaaagttacagaagtaagaggttacactaaaggagggccaggacacgaggaacctgtgcctatgtcaacttatggttggaacatcgtgaagctgatgtcaggaaaagacgtattttatctaccacccgaaaaatgcgatacgttactttgtgacataggggaatctagcccgtcaccaacagtggaggaatcgcggacgattcgtgtcttgaaaatggtagaaccatggctcaaaaataatcaattttgtataaaagtattgaacccgtatatgccaactgtaatagaacaccttgaaagacttcaacgtaaacacggaggtatgctcgtaagaaatccattaagtagaaatagtacacatgaaatgtactggatatctaatggaacaggaaatatagttgcctcagtgaatatggtatcccgactattacttaatagattcacaatgacacatagacgaccaacaattgaaaaggatgttgatttaggggcaggtacacgtcatgtcaatgcagagccagaaactcctaatatggatgttataggggagagaataaaacgaattaaagaggaacataacagcacctggcattacgatgatgaaaatccatataaaacttgggcataccatggaagctacgaagtaaaagcgacagggtccgcgagtagcatgatcaatggggtggtaaagttactcactaaaccatgggatgtagttcctatggtgacccaaatggcaatgacagacacaacaccgtttgggcaacagcgggtatttaaagaaaaagtagacacaaggacgccacgatcaatgccgggtacgaggcgcgtgatgggcataacagcagagtggttatggcgtactctgggccgcaataagaaacctagattatgtacaagagaagagtttactaaaaaggtgaggacaaacgcagcaatgggagctgtgtttacagaagagaatcaatgggacagcgcgaaggctgctgtagaggatgaagatttttggaaactcgtagatagggagagagaactccacaagttaggtaaatgtggtagctgtgtgtacaatatgatgggtaagagagagaagaaattaggtgaatttgggaaggcaaaaggatcacgtgccatttggtatatgtggctaggtgctagatacctggagttcgaagcccttggtttcttaaatgaggaccactggttttcaagggaaaacagctactcgggcgtcgaaggtgagggattgcacaaactaggatatatcttaagagatattagcaaaatacctggaggggcgatgtatgccgatgatacagctgggtgggataccagaataacagaggatgacttacacaatgaagagaagataacacaacaaatggatccagaacatcgacaactcgcaaacgcaatctttaaattgacatatcaaaacaaggtggtaaaagtacaacgccctacaccaacgggaaccgtgatggatattatatctcggaaagaccaacgaggttctggccaagtcggaacgtatgggttgaacacgtttacaaacatggaagcacaattaatacgtcaaatggaaggtgagggagtactatcaaaagctgacttggaaaacccacatttacctgagaagaaaatcacacaatggttagaaacgaagggtgttgaaagattaaaaaggatggcaatctctggcgatgactgcgttgtaaaacctatagacgatagatttgcaaatgctctactagctcttaatgatatgggaaaagtaagaaaagacataccccagtggcaacctagtaaaggatggcatgattggcagcaagtaccgttttgtagtcatcattttcacgaactcataatgaaagacggaagaaagctagtagtcccatgtcgtccacaagatgagctcataggcagagcgcgaatttcacaaggggcaggctggtccctacgcgaaacagcatgcctgggtaaagcgtacgcacagatgtggagtctaatgtactttcaccgcagagacctccgtttagcctcgaatgcaatttgtagtgctgtaccggtgcactgggttccgacttctagaaccacatggtcaatacatgctcatcaccaatggatgactacagaagatatgctcaccgtatggaatagagtttggatagaagacaatccatggatggaagataaaacaccggtaaccacatgggaagacgttccgtacttaggaaaaagagaggatcagtggtgtggaagtctaattgggttgacatcacgggcaacgtgggcacaaaatattttaaccgcgatacaacaagttcgttcattaattggaaacgaagagttccttgactatatgccatcgatgaagcgatttagaaaagaggaagaaagtgaaggagcaatttggtga

SEQ ID NO: 23267 - RNA, 9873 nt, synthetic construct
  misc_feature 1..9873: note = derived and/or modified CDS sequence (opt6) from DENV-3__KJ189284__SS-prME
  source 1..9873: mol_type = other RNA
acttccttatgtttaatgatgatcctacccgctgctctagcatttcaccttacttctagggacggagaaccgcgtatgatcgtaggtaaaaatgaaagaggaaaatcgcttcttttcaaaacggcttcaggaatcaatatgtgtacattaattgcaatggacctaggagaaatgtgtgacgatacagtaacgtataaatgtccacacattacagaagtggaaccagaagatatcgattgctggtgcaatttgacaagtacgtgggtaacttacggtacttgtaaccaagcaggcgaacacagaagggataaaagatctgtagctttagcaccgcacgtgggtatgggattagatacaagaacgcaaacatggatgtcagctgagggcgcatggagacaagtggaaaaagttgagacatgggcactgagacatccgggctttacaattctagcacttttcctagctcattatattggcacgagtttaacacaaaaagtagtaatatttattctacttatgttggtcacgccatcaatgactatgcgctgtgtgggggttggaaatagagacttcgtagaagggttgtctggtgcaacgtgggtcgatgttgtacttgaacatggtggatgtgtgaccacaatggctaaaaacaaaccaacattagatatagaattacagaaaactgaagctactcaacttgccactctgagaaaattgtgtattgaaggaaaaataaccaacataaccacagatagccgttgcccgactcaaggagaagcagtactcccagaagaacaagaccaaaactacgtgtgcaaacacacttatgtagatcgaggttggggaaacggatgcggactattcggaaaaggatctcttgttacatgtgcaaaatttcaatgtcttgaacctatagaaggcaaagttgtacaatacgaaaacctaaaatacactgtaataatcacggtccatacgggagaccaacatcaagtaggcaatgaaacccaaggggtaacagcagaaattacgccacaagcgtctacaactgaagtcacactcccggagtatggaacactgggattagagtgttctccccgtaccggactagattttaacgaaatgatcttactaacaatgaaaaataaagcgtggatggtccatcggcaatggttcttcgacctacccttgccatggacaagcggtgcaacaacggaaactcctacctggaaccgaaaagagttattagtaaccttcaaaaacgcgcacgccaagaaacaagaagtcgtcgtactaggaagccaagagggagcaatgcatacagctttgacgggagccacggaaatacaaaattccggaggtaccagcatctttgcaggacacttaaaatgcagattgaaaatggataaacttgagctaaagggcatgtcttacgctatgtgcaccaatacattcgtactaaagaaagaagtcagcgaaactcaacacgggaccatcctcattaaggttgagtacaaaggtgaagatgcaccctgcaagataccattttctactgaggatgggcatggaaaagctcataatggaagactaataactgccaatccagttgtaactaagaaagaagaaccagtcaacattgaggcagaaccgccctttggagaatccaatattgttatagggattggagataatgcattaaaaattaactggtacaagaaaggatcaagtattggtaaaatgttcgaagctacagcacgtggagcacgaaggatggcgatactaggtgatacagcctgggattttggtagcgttggtggagtcctgaatagtttgggaaagatggttcatcagatatttggatctgcctataccgccttgttctctggagtgtcatgggttatgaaaataggtataggtgtattgttaacctggatcgggctaaatagcaaaaatacaagtatgagtttctcatgtatagcgataggtataatcacactttatcttggtgcggtcgttcaagcagacatgggttgtgtcattaactggaagggaaaagaactcaagtgtggttcaggaatatttgtaacaaacgaggtgcatacttggactgaacaatataaatttcaagcagactcacctaaaagattagcgactgccattgcgggtgcgtgggaaaacggcgtgtgtggaatacgtagtactaccagaatggagaacctactttggaaacaaatagcgaacgaactaaactacatattgtgggaaaacaacattaaattgacagtagttgtaggtgatataataggggtattggaacagggaaaaagaactctaacaccgcaaccaatggaactaaaatattcatggaagacatgggggaaggcaaaaatagtgacagctgaaacccaaaactcatcttttatcatagatgggcccaacacacctgaatgtcccagtgcctcacgagcatggaacgtatgggaggtagaagattacgggtttggagtattcacaactaacatatggttaagacttcgagaagtctacacacaactctgtgatcaccgactaatgtctgctgctgtaaaagatgaacgagctgtccacgcagacatggggtattggatagaatcacagaaaaatggtagttggaaattggaaaaagcgtcgttaatagaggtaaaaacatgtacatggccaaagagccataccctatggtcgaacggagtgctcgaatcagatatgataattcctaagagcttagccggaccaatatctcagcataaccatagaccgggttaccacacacaaactgcaggtccatggcacttaggaaaattagagttagactttaactattgtgaagggactaccgttgttattacagagaattgcgggacacgaggtccatcattacggacaaccacagtatcaggaaagttaatacatgaatggtgttgtcgtagttgcactctccctcctctcagatatatgggcgaagacgggtgctggtatggaatggagatcagaccaatatcagaaaaagaagaaaacatggtcaaaagtctcgtgtcagcaggatctggtaaagttgataattttacaatgggagttctatgcctagcaatcctgtttgaagaagtcatgagaggtaaatttggcaagaaacatatgatcgcaggagttttcttcacattcgtcttgctactgtcaggtcagataacatggagagatatggcacataccttaataatgatagggtctaatgcaagcgatcgtatggggatgggtgtaacctacttagcattgattgcaacatttaagatacaaccattcctagcattaggatttttccttaggaagttaacatcgagagagaacctactcttgggggtaggtcttgcaatggcgaccacactccaactacctgaagatatagaacaaatggcaaacggaatagcactcggccttatggcattgaagctaataacacaatttgaaacataccaactatggactgcactaattagtctaacttgctccaataccatatttacattaacagtcgcatggcggacagctacattaatccttgctggagtatcccttctgccagtttgtcaatcatcatcaatgagaaaaacagactggctacctatggccgtagccgcaatgggagtaccgcctctacccttatttatattttcattaaaggatacattaaagcgaagaagttggcccctaaatgaaggagtgatggctgttggtttagtgagtatcctagcctcatcacttcttcggaacgatgttcctatggcgggacccttggttgcaggaggactcctaattgcctgttatgtgattacaggaaccagcgccgatttaacagtggagaaggcggctgacataacctgggaggaagaagctgagcaaactggagtgtctcacaatctaatgattacagtggatgacgacggaaccatgagaataaaagatgatgagacagagaatatactcacagtgttacttaaaacagccttactgattgtatctggcatctttccatactccattccggccaccttattggtatggcacacatggcagaaacaaacacaaaggagcggagtattatgggatgtacctagtcctccagaaactcaaaaagcggagttggaagaaggcgtatatcgaattaaacaacaaggtatatttggaaagactcaagttggagttggagtacaaaaagaaggagtgtttcatacaatgtggcatgttacaagaggcgcagtcttaacatacaacggaaaaaggcttgaacccaattgggcctccgtcaagaaagatttaatatcttacggaggtggctggaggttatcgacacagtggcagaaaggtgaggaggtgcaagttattgcagtagaaccagggaaaaaccccaaaaatttccaaaccatgccaggcacttttcaaactacaactggagagataggagctatagccttggacttcaagccgggaacctcggggtccccgatcataaatcgagaaggcaaagtcgtgggtttatacggaaacggcgttgtgactaaaaatggtggatatgtatccggaatcgcccaaacaaatgcggaacccgatggtccaacgccagagttagaagaagaaatgttcaagaaaagaaacctaactataatggacttacatccaggtagtggcaaaacacgtaaatatttaccagcaatcgtaagagaagctataaaacgacggcttagaacgctaatcctagcacctacaagggttgtagcagcagaaatggaggaagcattaaaaggccttccaatccgatatcaaacaacagctacaaaatctgagcatacaggtcgggaaatcgtagaccttatgtgtcacgcaacatttacaatgcgattactatctcccgtccgtgtcccaaattacaaccttataataatggatgaagcccatttcactgatccggcaagcatagcagcgaggggatacatatctactagggtcggaatgggggaagcggcagccatattcatgacagccacgccacccgggaccgctgatgcattcccacaatcgaacgcaccgatacaagatgaagaacgagacatccctgagcgatcttggaactcaggaaacgaatggataacagactttgccggtaaaacagtatggttcgtcccctccattaaggctggaaacgacatagcgaattgtttacgaaagaacggtaagaaagtcatccaactaagtcgaaaaacattcgatacagagtatcagaaaactaagttgaatgattgggatttcgttgttacaactgacatttctgaaatgggagcaaatttcaaggcggatagagtaatagaccccagaagatgtcttaaaccggtaatactgacagacggtccggaacgtgtcattctggccggtccgatgccagtcacagcggcatcggcagcacagagaagaggacgcgtagggcgcaatccccaaaaagaaaatgaccaatatatatttacaggtcaacccctaaataatgatgaggatcatgcgcactggactgaagcaaagatgctgttagacaatataaatactcccgaggggataatacctgcactctttgaaccagaacgcgagaaaagtgctgcgatcgacggagaataccgtctaaaaggagaaagccgtaagacctttgtagaattaatgagaaggggtgatttaccggtttggcttgctcataaagtagcatcagagggaattaaatatacagatagaaagtggtgctttgatggacaaagaaacaaccaaatccttgaagaaaatatggacgtagaaatctggacgaaagaaggagagaagaagaaactcaggccgagatggttagacgcaagaacatattctgatccgcttgctctaaaagaatttaaagacttcgccgccggaaggaaatccattgcgttagatcttgtgacagagataggcagagttccttctcatttagctcatagaacaagaaacgcccttgataatttggttatgttacatacgtcagaacacggagggagggcttacaggcacgcggttgaggaactacctgaaacgatggagaccctactattattaggccttatgatactccttacaggcggagcaatgttatttctcatatccggaaaaggcataggaaaaacatccattggattgatatgtgtaatcgcaagttctggaatgttatggatggcggaaatcccattacaatggatagcgagtgcaatcgttttggagttctttatgatggtgctattaataccagaacccgaaaaacaacggactccgcaagacaaccaattagcctatgtagtcattggaatcctaactttagctgctataatagctgcgaatgaaatgggcttactagagactacaaaacgtgaccttggcatgtcaaaagagcccggggtagtatccccaacaagttatctcgatgtcgacctacacccagcgtctgcgtggacgctttacgcagtagcaaccactgtgataactccaatgttgcgacacaccatcgaaaattctacggctaacgtgtccctagccgcaattgcaaatcaagctgtagtcttaatgggtttggacaagggctggcctatttccaaaatggacctaggagtaccactgttagctctaggctgttattctcaagttaatccattaaccttaacagcggctgtgcttctacttatcactcattacgccattattggcccgggccttcaagcgaaagccactcgagaagctcaaaagcgtactgcggcggggataatgaaaaatccaaccgtagatggtataatgactatagaccttgaccccgttatctatgatagcaaatttgaaaaacagttaggccaggtaatgttactggttctttgcgccgttcagcttctgctaatgagaacgtcgtgggctctatgcgaagctcttacacttgcaaccggcccaataacaacactttgggagggatctccaggaaagttttggaacacaaccatagctgtatcgatggctaatatatttagaggttcgtatttagcaggcgctggacttgcattttcaataatgaaatcagtgggaacagggaagcgaggaacaggttcacagggtgaaacacttggtgagaagtggaaaaagaaacttaatcaactgtccagaaaagaatttgatctttataagaaaagcggaataaccgaggtagatcgaactgaggctaaagaaggattaaaaagaggcgagataacacatcacgccgtaagtcgaggctccgcgaaactccaatggtttgtggagcgtaatatggtaatcccagaaggtagagtgatagacttaggatgtggacgagggggatggtcttattactgtgctggcctcaagaaagttaccgaggtcagaggatatacaaaagggggtccgggtcacgaggaacccgtacccatgtccacatacggatggaacatagtgaaactaatgtcgggcaaggacgttttctatctaccaccagagaagtgtgatacactgttgtgtgacattggtgagagcagcccatctcccacggtggaagaaagccgtactataagagtactcaaaatggtggagccatggttaaagaacaaccaattttgtataaaagtgctaaatccctatatgccaacggtcattgagcacctcgaacgattacaacgcaagcatggcggtatgttagttcgtaaccctttgagccgaaattctacacacgaaatgtactggataagtaatgggacaggtaacattgttgcatccgtcaatatggtcagtaggttactcttaaacagatttactatgacacatagacggccaactatagaaaaggacgtcgatcttggagctgggacgagacatgtaaacgcggaacctgagacccctaacatggatgtaatcggggagcgtatcaaacgtattaaagaagaacacaatagtacatggcactatgatgacgaaaatccatataaaacatgggcttaccacggaagttacgaagtcaaagcgacggggtcagccagtagtatgattaatggtgtagtaaaactattaacgaaaccttgggacgtcgttcctatggtcacacagatggctatgacggacacaaccccatttggacaacaaagagtatttaaagaaaaagtcgacaccagaacaccacggtctatgccaggaactcgaagagtgatggggattactgctgagtggctatggcgaactttaggaagaaacaagaaaccccgcctatgtaccagagaggaatttactaaaaaggtccggaccaatgccgcaatgggtgctgtattcacggaagagaaccaatgggatagcgccaaagccgcagtagaagacgaggacttttggaaacttgttgatagggaaagggaattacataagctgggaaagtgtggttcttgcgtttataatatgatgggaaaaagagagaagaaattgggcgaatttggaaaggcaaaaggatctagggcaatttggtacatgtggctcggtgcgagatacctagagttcgaggcacttggattcttaaatgaggatcattggttttcgcgtgaaaactcttacagtggggttgagggcgagggtctacataaactagggtatattcttcgagatattagcaaaatacctggaggagcaatgtacgccgatgacacagcaggctgggatacaagaattacggaagacgatctacataatgaagagaaaatcactcaacaaatggatccagaacaccgacaactagcgaacgccattttcaaacttacttatcagaacaaagtagttaaagtacagagacccacccccacgggaacagttatggacattatcagtcgtaaggatcaaagaggaagtggccaagtaggtacatatggccttaacacctttacgaatatggaggcgcagctcatccgccaaatggagggtgaaggcgtcctaagtaaggcagatttagagaatccacacttacctgagaagaaaatcacacaatggttagagacaaaaggggtagagagactgaaacgaatggcaatcagcggagatgattgcgtagtgaaacctatagacgatagattcgcaaacgcgctattagccttaaatgatatgggtaaagttagaaaagatatacctcagtggcaaccctctaagggatggcacgactggcaacaggtcccattttgcagccatcatttccatgaattaatcatgaaagatggcagaaagctagtagtaccttgtcgaccccaagatgagttaatcggtagagctcgtattagccaaggcgcaggatggtcattaagggagaccgcatgtctaggaaaagcatatgcacaaatgtggagcctaatgtactttcatcgtagagatttacgactagctagtaatgcaatatgcagtgcggtgcctgttcactgggtcccaacaagtcgaacgacatggagtattcacgctcatcatcaatggatgactacggaagatatgttgacagtatggaaccgtgtatggatagaagataatccttggatggaagacaaaacaccggtcactacctgggaagacgttccctatcttggaaaaagagaagaccagtggtgcggctcccttataggactcactagccgtgcaacgtgggcacaaaacatccctacggctattcagcaagtacggtcgttaatagggaacgaagaatttttggactacatgccaagtatgaaacgttttagaaaagaggaggaatcggagggagccatatggtag

SEQ ID NO: 23268 - RNA, 9873 nt, synthetic construct
  misc_feature 1..9873: note = derived and/or modified CDS sequence (opt6) from DENV-3__KJ189286__SS-prME
  source 1..9873: mol_type = other RNA
acgagtttttgcctgatgatgatattaccggcagcgttggcttttcacttaacttcacgcgacggagaaccgcgtatgattgtgggcaaaaatgaacgggggaaatcactcctttttaaaaccgcgtccggaattaatatgtgcacattgattgcaatggatttaggtgaaatgtgtgatgatacggtgacatataaatgtcctcacattaccgaggtcgaacctgaggatatagactgctggtgtaacttgactagcacatgggtcacctatggtacttgtaatcaggcaggagaacacagacgagataaacggtcagtggcattagcgcctcatgtaggaatgggtctagatacaagaactcagacatggatgagtgcagaaggagcatggagacaagtcgaaaaagttgagacctgggctttgcggcatccaggatttacaatattggcactctttctcgcacattacataggaaccagcctaactcaaaaagtagttatattcatattattaatgctcgtgacaccctcaatgacgatgaggtgtgttggggtcggaaatcgtgattttgtggaaggattatcaggggcaacttgggtagatgtagtattagagcatggaggttgtgtaaccacgatggccaaaaataaaccaacacttgatattgaattgcagaaaactgaagcaacccaactcgcaacacttaggaaactttgcatagaaggaaaaatcactaacattaccacagattcaagatgtccgacacaaggtgaagctgtgttacccgaagaacaagatcaaaactatgtatgtaaacacacatacgtggaccgcggatgggggaacgggtgtggattattcggaaaaggtagtctcgtgacgtgtgcaaaattccagtgtctagaaccaatagaaggtaaagtagttcagtacgaaaacttgaaatatacggttataataactgtacatacaggggaccaacatcaggttggaaatgaaactcaaggggttactgctgaaataacgccccaagcgtcaactacagaggcaacattgccagaatatggtacattgggtttggaatgtagtccaagaacaggacttgactttaatgaaatgatcctactaaccatgaaaaataaggcttggatggttcatagacaatggtttttcgatttgccattaccatggacaagtggagctactaccgagacacccacttggaacaggaaagaattattagtaacattcaaaaatgcacatgcgaagaaacaagaggtcgtagtactgggaagtcaagaaggcgcaatgcacactgcactcactggtgccactgagatacaaaattcaggcggcacatccatatttgcaggacatttgaaatgcaggcttaaaatggataaattagaattaaaagggatgtcatatgctatgtgcacaaatacattcgtactaaagaaggaagtaagtgaaactcaacatggaaccatattaataaaagttgagtacaagggagaagatgctccttgcaaaattcctttttcaaccgaggatggacatggtaaggcccataatggtcggctgattacagcaaatcccgtagtaacaaagaaggaagaaccagtaaatatagaagctgaaccaccatttggtgaaagtaacatagtaattggcattggggataacgctctaaagataaattggtataagaaaggatcctctatcggaaaaatgttcgaggctaccgcaagaggagctagacgaatggcaatattaggtgacacagcgtgggactttggcagtgtaggaggagttctaaacagcctagggaaaatggttcatcaaattttcggatcagcttacaccgcattattcagcggcgtgagttgggtaatgaaaattggtatcggcgtactattaacatggatcggacttaatagtaaaaacacatccatgagcttctcttgtattgcaattgggatcataacgttatacttaggagccgttgtacaggcagacatgggctgtgtgatcaattggaaaggaaaagaactcaaatgcgggagcggtatattcgtaactaatgaagtacacacttggacagaacaatataaattccaagccgattccccaaaaagactggcaacagcgattgcaggcgcctgggagaatggagtatgtggcattcgatctacaacgagaatggaaaatctcttgtggaagcaaatagcaaatgaattaaactatatcctgtgggaaaataatataaaactaacagtagtagtaggggacattattggtgtattagaacaaggaaagagaacattaacaccccaacctatggaactcaaatattcttggaaaacgtggggtaaagcaaaaatcgtaaccgcggaaacccaaaacagctcatttataatcgatggccctaacacgccggaatgtccttcagcgtcccgagcgtggaacgtatgggaagttgaagattacggcttcggtgtattcactacaaacatatggcttaggctgagggaagtatacacgcaactatgcgatcataggcttatgagtgctgccgtcaaggatgaaagagcagtacacgcagacatggggtactggattgaaagtcagaaaaatgggagttggaagttagaaaaggcctctctaattgaagtaaagacgtgcacatggccaaaaagtcataccctgtggagtaacggagtattagagtcagatatgattatacctaagagcctagccggaccgatcagtcaacataatcatagaccaggataccatacccaaactgcaggaccatggcatctaggaaaacttgaactcgatttcaactactgtgaaggtacaacagtggtcataacagaaaattgtgggacacgggggccgagtcttagaacaacgacggtatctggcaagctgatccatgagtggtgttgtagaagttgcactttgccaccattacgatatatgggtgaggatggatgttggtacggaatggagataagaccaatatcagagaaagaagagaatatggtcaaatcattagtcagtgctggatcaggtaaagtcgataattttactatgggtgtcctgtgtctggcgatcctattcgaggaagtaatgagaggcaaatttggcaagaaacatatgatagcgggtgtctttttcacattcgtccttctgttatctggacagatcacatggagagatatggcccatacactaataatgattgggtcaaacgcctcagataggatgggaatgggagtgacatacttagcattaattgccacgttcaaaattcagccgttcttagcactaggattctttcttaggaagctaacgagcagagagaacctgctcttaggggttggtttggctatggcaactactctccaattacctgaagatatagaacaaatggcaaatggaatagctctaggtctgatggcgctaaagctaatcacgcaatttgaaacctaccagctttggacagcactaatatcgctaacctgttcgaacaccatcttcactctgacagtcgcatggaggacagcaacgttaattcttgctggtgtgagcttactaccagtgtgtcagagttctagtatgaggaaaacagactggttgcctatggctgtagctgcaatgggtgttcctccgctaccactatttattttcaatctgaaggatacactgaaacgaagaagttggcctctaaatgaaggagtaatggcagttggtttagttagtatattagcttcatcgttattacgaaacgacgtcccaatggcagggcctcttgttgccggtggattgttaattgcatgttatgtcatcacagggacgagcgccgacctaactgtagaaaaggcagctgatatcacgtgggaagaagaagccgaacagacaggagtttcacacaaccttatgataaccgtagacgacgatggtacgatgagaattaaagatgatgagaccgaaaacattttgacagttctattgaaaacagctctattaatagtttcgggcatttttccatatagcatcccagccacattacttgtgtggcatacctggcaaaaacaaactcagcgttcaggtgttctatgggatgtaccgtctccgcctgaaacacagaaagccgaattagaagaaggcgtatacaggataaagcagcaaggcatatttggcaagacccaagttggagttggggttcaaaaagaaggtgtcttccatacgatgtggcatgtaactagaggagccgttctaacatataatggaaaacggctggagccaaattgggcatctgttaagaaagacctgattagttatggaggtggttggcgactatctacccaatggcaaaaaggtgaagaagtacaagtaatcgcggtcgaaccaggaaagaaccctaagaattttcaaactatgcctggaacgtttcaaacaaccactggcgaaataggtgctattgcgttagacttcaaacccggcaccagcgggagtccaattataaaccgggaaggaaaagttgtgggtttgtatggaaatggagttgtaactaaaaatggcggttatgtgtccggaatcgcacaaacaaatgcagaacctgacggaccaacgccggaattagaggaagagatgttcaagaagagaaatctaacgattatggatcttcatcccggtagcggcaaaacacggaaatatcttccagccattgtgagggaagccattaaaagaagattaagaaccttgatcttagcaccaacaagggtcgtcgcagctgagatggaagaagccctgaaaggtctaccgatacgttatcagacaactgccacgaaaagcgaacatactggtagagagatagtagatctcatgtgtcatgcaacatttactatgaggctcttaagccccgttagggttcctaattacaacctaatcattatggatgaagcgcattttacagaccctgcttctattgctgctagagggtacattagtacacgagtagggatgggggaagcagcagccatatttatgacagcaacaccaccagggacagctgatgcatttcctcaatcaaacgcacccatacaggatgaagaacgagatatacccgaaagatcatggaatagcggtaatgaatggattacggatttcgctggtaaaaccgtatggtttgtaccttcaatcaaagcaggtaatgatattgcaaattgtctacgtaagaatggtaagaaagtgatacaactaagtagaaaaacatttgacaccgaataccagaaaacaaaactaaatgattgggatttcgttgtgacaactgatataagtgaaatgggagctaactttaaggcggatcgagtaatcgacccacggcgctgcttgaaaccggtaatattaacagacggtccagagagagtaattttagccggaccaatgccagtaacagcagcaagtgcagcacaacggcgaggaagagtagggcgaaatccgcaaaaagagaatgatcaatatatatttacaggccagcctttaaataacgatgaggaccatgctcattggacagaagcgaagatgttgcttgacaatataaatacgccagaaggcataatacccgctctttttgaaccggaacgcgagaaaagtgcagcgatcgacggagaatacagacttaaaggtgaaagtcgcaaaacattcgtagaacttatgcgaagaggggatttaccagtctggcttgcccacaaggttgcatcagagggtatcaaatatacggatagaaaatggtgttttgatggacaaagaaataaccagatcctggaagagaacatggatgtagaaatatggacgaaggaaggagagaagaagaaattacgaccccggtggttagacgcaagaacgtactcggacccgttggccctcaaagaatttaaagattttgctgcaggtaggaaaagcatcgccctagatctagttacagaaatcggaagagtaccatcgcacttggctcacagaaccaggaatgcattggacaaccttgttatgctacacacttctgaacatggtggacgggcgtacaggcacgctgttgaagagttgccagaaactatggaaacgcttctattattgggtctaatgattctgttgactggaggcgctatgcttttcttaatcagtggaaagggaataggtaaaacatccatcggtctcatctgtgttatagcatcatcaggtatgttatggatggccgaaattcctttacagtggattgcatccgcaatagtccttgagttctttatgatggtacttctaataccggaacctgaaaaacagcgaacaccccaggacaaccagttagcctacgttgtgattggaatattgacactggcagcgattatagccgcaaatgaaatgggattactagaaaccactaagcgcgacctaggaatgagcaaagaacccggagtagtttcaccaacatcctatctggatgtagaccttcacccagcatcagcatggactttatatgcagtagcaacgacagtaataacaccgatgttaaggcacacaatagaaaactctaccgctaatgttagtcttgcagctatagcaaatcaggcggttgtattaatgggattggataaaggatggccaattagtaagatggatttgggggtacctcttctagcattgggatgttactcacaagttaatccgctaaccctaacggcggcagtgttgctattaataacacactacgcgattataggtcctgggctacaagctaaagcaactcgagaggcgcaaaagagaacagcagccggcattatgaaaaacccaaccgttgatggcataatgacaattgatttggatcctgtaatctatgattcaaaattcgaaaaacagctagggcaagtaatgcttcttgttctatgtgcagtccaattattgttgatgagaacatcgtgggccttatgtgaagcactcacactagctactggacccataaccactttatgggaaggtagcccaggaaaattttggaacaccactattgcagtgtctatggcaaatatattccggggttcctacctggctggagctgggttagccttttctatcatgaaatcggtcggcaccggtaaacgtggtacaggttcacaaggagaaaccctaggagaaaagtggaagaagaaattaaatcaattaagcaggaaagaatttgacctctataagaaatcaggtataactgaggtagaccgaacagaagctaaagaaggccttaaacgcggggagataacccaccatgcagtctcaagaggcagcgcaaaattacagtggttcgttgagcgcaatatggtaatccccgaaggaagagtgattgatcttggatgcggacgaggtggctggagctattattgcgcaggtctcaagaaggtaaccgaagtcagagggtatacaaaaggtggtccgggtcatgaggaacctgttcccatgtccacatatgggtggaacatagttaaattaatgtccggaaaagatgtcttctacctaccacccgaaaaatgcgatacactcctctgtgacatcggggaatcaagcccatcccctacagtcgaagagtcacgaacgattagggtcttaaagatggtagaaccatggctaaagaataaccaattttgtattaaagtattaaatccctacatgcctaccgtaatagaacatttggagagattgcagagaaaacacggaggcatgctagttagaaatccactcagccgaaactccacacacgaaatgtattggatcagcaatgggacaggtaacattgtggcgagtgtcaacatggtatcaagactgttgctgaatcgttttacaatgacacatcgacgacccaccatagaaaaggacgtagatctgggcgctggtacgcgccatgttaacgcagaaccggaaactcctaatatggacgtcataggggagcgaattaaaagaattaaggaagaacataactcaacttggcattatgatgatgaaaatccctataaaacatgggcttatcatggttcatatgaagttaaagcaactggatcggcttcaagtatgattaatggagttgtgaaactattaactaaaccatgggacgtggtgcccatggttactcaaatggcaatgacagatacaacaccatttggtcaacaaagagtatttaaagagaaagtagatacccgcactccaagatccatgccagggacacgtcgagttatgggtatcacagctgaatggctatggcgtacactcggaagaaataaaaagccaaggctttgcacacgcgaagagttcaccaagaaagtacgaaccaacgcagcgatgggcgccgtatttacggaggaaaatcaatgggatagcgcaaaagcagccgtagaagacgaagatttttggaaattagtagatagagagagggagctccataaattaggaaaatgtggctcatgcgtgtacaacatgatgggaaaaagagagaagaaactcggcgaatttggtaaagctaaaggatcacgagcaatttggtatatgtggttaggagcaagatatttggaatttgaggcattgggattccttaatgaagatcattggttttcaagagaaaattcttatagtggagttgagggcgaaggtttacataagctaggatatattttacgtgacattagtaaaattccagggggtgcgatgtacgcagacgacacagctggatgggatacaagaattacagaagatgacctacacaatgaagaaaagataactcaacagatggatccagaacacagacaacttgcgaacgcgatatttaagctcacatatcagaataaagtggtaaaagtacaaagacctactccgactggcactgttatggacattatcagtaggaaagatcagcgtggttctggccaagtgggaacatatggtttgaacactttcaccaatatggaggcccaactaataaggcaaatggaaggagaaggagtcttgtctaaggccgacctcgaaaacccacatttacctgagaagaaaataacacaatggttagaaactaagggggtagaaaggttaaagagaatggccattagtggagacgactgtgtcgtaaagcctatagatgaccgattcgccaacgcgttacttgcattaaacgacatggggaaagtcagaaaagacataccgcaatggcaaccttcaaaaggttggcacgattggcaacaagtcccattctgttctcaccatttccacgaattaataatgaaagacggacgtaagctggttgtaccatgtcgcccacaagatgagttaattggccgtgcaaggattagtcaaggagcaggatggagtctacgtgaaacagcatgtttaggtaaggcatatgctcaaatgtggtccctaatgtactttcaccggcgagaccttaggttagcaagcaacgcgatatgctcagcagtgcctgtgcattgggtacccacaagccgtacaacgtggtcaatccacgcgcatcaccaatggatgaccacagaagacatgttaacagtatggaaccgtgtatggattgaagacaatccatggatggaggataaaactccagtaacaacatgggaggatgtaccttacttgggtaaacgggaagatcagtggtgcggtagtctaataggattaacaagccgtgctacatgggcacaaaacatacccacagccatccaacaggtgcgaagccttataggtaatgaagagtttttagattatatgccctctatgaagcgatttcggaaggaagaggagtctgaaggagcgatctggtaa

SEQ ID NO: 23269 - RNA, 9873 nt, synthetic construct
  misc_feature 1..9873: note = derived and/or modified CDS sequence (opt6) from DENV-3__KJ189287__SS-prME
  source 1..9873: mol_type = other RNA
acttctctgtgcttgatgatgatactccccgcggcactagcatttcatctcacatcacgagacggagaaccacgtatgatagtcggtaaaaatgaaagaggaaaatcactattgtttaaaacagcttccggaatcaacatgtgtactcttatagctatggatctaggagaaatgtgcgatgacacagttacctataaatgtccacacattactgaagtcgaacctgaggatatagactgctggtgcaatttgacaagtacatgggtaacatatggaacttgtaaccaagctggggagcacaggcgagacaaacgctctgtggcacttgcaccacatgttgggatggggttagatacacgtactcaaacttggatgtcagctgaaggcgcctggcggcaagtagaaaaagtcgagacttgggccctaagacatccgggattcacaattttggctctatttcttgcacactacataggaacttcacttactcaaaaagtagtgatattcatattgttaatgctagtgactccgtccatgacaatgagatgtgtaggcgtaggtaatagagactttgtggaaggcctttccggcgcaacctgggtggacgtggtactagaacacggaggatgtgtaaccactatggcgaaaaataaaccaacgttagatattgaattacagaaaacagaagcgacacaattggctactttaaggaaactttgcatcgagggaaaaatcacaaatataaccacagactctagatgtccaacccaaggtgaagctgttttaccggaagaacaagatcaaaattacgtctgcaaacatacttacgtagatcgcgggtgggggaatggctgtgggttatttgggaaaggttccctagtgacgtgtgcaaaattccaatgtttagaaccaatcgaagggaaagtcgtccaatatgaaaatttaaaatacacagtaattataacagtacatacgggtgatcaacaccaagttggtaatgaaacacaaggagtaactgcagaaataacaccacaggcaagcaccacggaggcaacacttcccgagtatggcactttgggattagaatgttcgccaagaacaggcctagattttaatgagatgatacttttaacgatgaaaaacaaagcctggatggtgcatcgtcaatggttctttgacctcccgcttccatggacttctggggcaactacagagacgccaacctggaaccgaaaagaactattagtgacatttaaaaacgcgcacgctaagaaacaagaagttgtagtactagggtctcaagaaggcgcaatgcacacagctttaacaggagcaacggagatccaaaactctggaggaacctcaatttttgcaggtcaccttaaatgtagattaaaaatggataaattagaactaaaaggtatgtcatatgccatgtgtaccaatacattcgtactcaagaaagaagtctctgaaactcaacatggtacaatattaataaaagtggaatacaaaggagaagatgcaccgtgcaaaattcctttttcgacagaagacggtcatggaaaagcacataatggtaggcttataaccgctaacccagtcgtaactaagaaagaagaacccgtaaatatagaagcagaaccgccattcggtgaaagcaacatcgttatcggaataggagataacgctctaaaaataaactggtacaagaaaggatcttctattgggaaaatgtttgaagcaactgcaaggggcgcacgtcgaatggctattcttggagacactgcatgggattttggttcagtaggtggggttctaaatagtctaggaaagatggttcaccaaatatttggctccgcctacacagcattattcagtggcgtgtcctgggtaatgaaaattggtattggggtgcttctaacgtggataggactaaattcgaagaacacttccatgtctttctcatgtatagccattggaataataactttatacttaggagcagtagtgcaagctgacatgggttgtgtcattaactggaagggaaaagagcttaaatgtggaagcggaatatttgtgacaaatgaggtacatacatggaccgagcagtataaattccaagcagattcgcctaaaagattagcaacagcgatagccggtgcttgggaaaacggcgtctgtggaataaggtcaaccaccagaatggaaaatttactatggaaacaaatagcaaacgagctcaactacatattatgggaaaacaatattaaattaacagttgtagtgggggatatcattgggatattagagcaaggtaagcgaaccctaactccacaacccatggaactaaaatattcatggaagacgtggggaaaagcaaaaattgtcaccgcagaaacccaaaattcatcgtttattatagatggtcctaacacccccgaatgccccagcgcaagtagagcatggaatgtatgggaagtggaggactacgggttcggcgtattcaccacaaacatatggttaagactgcgagaagtctatacgcaactatgtgaccaccgtctaatgagtgctgccgttaaagacgaacgagcagtccatgcggatatgggatactggattgaatctcagaaaaatggatcctggaaacttgaaaaagcatcactaatcgaagtgaaaacttgtacgtggccaaaaagccatacattatggtctaacggcgtgcttgaatcggatatgattatccctaaaagtcttgctggaccgatctctcaacataatcatagaccaggttaccacactcaaaccgctgggccctggcacctaggcaaacttgaactagattttaattattgtgaaggtacgacagtggttattacagaaaactgtgggacacgaggaccatcacttagaaccactaccgttagtggaaaattaatacatgaatggtgttgtaggtcttgtacattaccccctttgaggtacatgggcgaggatggctgttggtatggaatggaaatccgaccaataagcgaaaaagaggagaacatggtaaaatcattagtttccgcgggaagtggaaaagtagataacttcaccatgggagttttatgcctagccatcttattcgaagaagtgatgaggggcaaatttggcaagaaacacatgatagcaggagttttctttacattcgtgttgttattaagcggacaaataacttggaggaacatggcacatacactgattatgatagggtcgaatgcatcagatcgaatgggaatgggagtaacctatctagcacttatagcaactttcaaaatacaaccttttctagtattagggttctttctgaggaaattaacatcaagagaaaacctcctattaggcgtgggtttggcaatggctacgacattgcaattacctgaagatattgagcaaatggcaaacggtatagcacttggactaatggcactcaaactaataacccaatttgaaacatatcaactatggacagcactcatatctctaacatgcagtaataccatattcacgctgactgtagcatggagaacagcaacattaatactcgccggtgtgtcattactacctgtatgtcaatcctcctcgatgaggaaaaccgactggttgccaatggctgtagcggcaatgggagtaccaccattacctctatttatattctctcttaaggatacgctaaaaagacgaagctggcctcttaatgaaggggtcatggcggtaggactcgtcagtatacttgcgtcctccttacttcgaaacgatgtacctatggccggcccactggtcgctggcgggctattaatagcatgttatgttattacaggaaccagcgcagatcttaccgttgaaaaagcagctgatataacttgggaagaagaagcggagcaaaccggagtttcccataatctcatgataacagtggacgatgatggaactatgcgtattaaagatgatgagacggagaacattctaactgttttattaaaaacagcactgctcatagtatccggtatattcccatatagtatccctgccactttattagtgtggcatacttggcaaaaacaaacgcagaggtccggcgtactctgggatgttccaagcccacctgaaacacaaaaggcggaactcgaagaaggcgtctatagaataaaacagcagggaatatttggaaaaacccaagtaggtgtaggggtacagaaagaaggagttttccacacaatgtggcatgttaccaggggtgctgtgttaacatacaatgggaaaagattagaaccaaattgggccagcgtcaagaaagacctcattagttatggaggaggatggcgattgtccactcagtggcaaaaaggagaagaagtacaggtaatcgcagtggaacccggtaaaaaccccaaaaattttcaaacaatgcctggtacatttcaaactactacaggagagattggcgcaatagctctagattttaaacctggaacaagtggttcaccgatcataaatagggaaggtaaggtcgtaggtctatacggaaacggagttgtgactaaaaacggaggatacgtgtcgggtatagcgcaaaccaatgctgaaccagacggacccacgccagagctggaggaagagatgtttaagaaacgtaatttgaccattatggatttacatcctggtagcgggaaaactcgcaagtatttacccgcgatcgttagagaagcaattaagagaagactgagaactttaatattagctcctactagagtagttgctgctgaaatggaagaggcactcaagggtctccccataagatatcaaactaccgcgactaagagtgagcacacaggccgagagattgttgatttgatgtgtcacgcgacatttactatgagactgctaagtcccgtacgggtacctaactacaatttgatcatcatggatgaagctcatttcactgatccagcatcaatagctgcgagaggatatataagtactcgcgttggaatgggtgaagcagctgcaatattcatgacagcgacaccacctggcacagctgatgcttttccacaatctaacgcaccgatacaggatgaagaacgagatatacccgaaagatcttggaacagtggcaatgaatggataacggacttcgctggaaagacagtatggtttgttcctagcattaaagccggaaatgatatagcgaattgtttgcggaagaatggcaagaaagttattcaattaagtcgaaaaacgttcgatacagaataccagaaaacaaaacttaatgattgggacttcgtcgtgacaacggatatatcggagatgggagcaaatttcaaagcagaccgagttatagatccacggcggtgtttgaagcctgtgatcctgaccgacggtcctgaaagagttatattggcagggccaatgccagttacggcagcaagcgcggcacaacgaagaggacgagtaggtagaaaccctcaaaaagaaaacgaccagtatatttttacaggacaaccgttgaacaatgacgaagatcacgcacattggacagaagcaaagatgcttcttgataatataaataccccagaaggaataatacccgcccttttcgaaccagagagagagaaaagtgctgcaatagatggagaatatcgactcaaaggtgaatccaggaagacattcgtagaacttatgaggcggggagacctgccggtttggttagcgcacaaagtcgcctcagaaggaataaagtacacggatcgaaaatggtgctttgatggtcagagaaataaccagattctggaggagaatatggatgtcgaaatatggacaaaagagggtgaaaagaaaaagttgagaccaagatggttggacgcacgaacatatagtgatcccctagcactaaaggagttcaaagatttcgctgcaggcagaaaatcaatagccctcgatttagtaacagaaataggccgcgtaccatctcatctagctcaccgtactagaaatgcactagataatttagttatgctgcatacaagtgaacatggaggacgtgcttacagacacgcggttgaagaacttccggaaacaatggaaacactactcttgttaggattaatgatacttttaactggaggagcaatgctatttttgatttccggaaaggggattggaaaaacgagcataggattgatctgcgtaatagcttcttcaggcatgctatggatggccgaaattccgttacaatggatagcctccgccatagtactcgaatttttcatgatggtactccttataccagagcccgaaaaacagagaacaccgcaagataatcaacttgcttatgtcgtaatcggcatcctaacattagcagcgatcattgcagcaaatgaaatgggactgctggaaacgactaaacgagacctaggaatgtcaaaggagccaggtgtagtatccccaaccagttatctagacgtagacttacacccagcgagcgcatggaccctgtacgcagtagccacaactgtgatcactccaatgctccgacacaccattgagaactccacagcaaacgtatcattagctgccattgctaaccaggctgtagtccttatgggtctagacaagggatggcctataagtaagatggatctaggagtaccgcttctagctttaggttgctacagccaagtaaatccgctgactctgacggcagcagtactactgttaataacccattatgcgatcataggaccaggtctacaagcaaaagcaacaagagaggcccaaaagaggacggcagcgggtatcatgaaaaacccgacagttgacggaattatgactattgatctagatccggttatatatgactcgaaatttgaaaaacagttgggacaggtcatgctactggtactatgtgccgttcaactgctcttaatgagaacctcctgggctttatgtgaggctttgacacttgcaacaggtcccataacgactttgtgggaaggatctccgggtaaattctggaacactaccatagcagtttccatggctaatatctttaggggctcgtacctggctggtgcaggactagccttttccataatgaaatctgttgggacgggcaaaagaggaacaggttcacaaggagagacattaggcgaaaaatggaagaagaaactgaaccaactttcaaggaaagagttcgatttatataagaaatcaggcatcacagaagtagatcggacggaagccaaagaagggttaaaaagaggggaaataacccaccatgcagtatcaaggggtagtgcaaaattgcaatggtttgtagagagaaatatggtaataccggagggaagggttatcgatttgggttgcggaagaggtggttggagctattattgtgcaggtctaaagaaagtcactgaggtgcgcggatacacgaaagggggaccaggccacgaagaacctgtgcctatgtcgacatacggatggaatatagttaaattaatgtccggcaaagatgtattttatctaccgcctgaaaagtgcgacactctactttgcgacatcggtgaatcctcacccagccctaccgtagaagaaagcaggacaattcgtgttcttaaaatggtagaaccctggctaaagaataaccaattttgtattaaggtgctaaatccctatatgccgactgttattgaacatctagaaaggcttcagcgaaagcatgggggaatgctagttaggaatccgttgtcaagaaactccacacacgaaatgtattggatatctaatggaactggaaacatcgttgcctccgtaaatatggtatcccgacttctcctcaacagatttacaatgactcatagacgcccaactatagaaaaagacgtagatctaggcgcaggaacgcggcacgttaatgctgaacctgaaacgcctaatatggatgtcataggtgaacgaataaagcgcataaaagaagaacacaatagtacatggcactatgatgatgaaaacccatacaaaacatgggcataccatggaagttatgaagtcaaagcaacaggaagtgcttcatcaatgataaacggtgttgttaaactattaaccaaaccatgggatgtcgtaccgatggttacacagatggcaatgaccgataccactccattcggacagcagcgggtatttaaagaaaaagttgatacacggacgccaaggtcaatggcaggtacaagacgagttatgggaattaccgctgaatggctttggagaactctcggcagaaacaagaaacctagattatgcacgagagaagagtttaccaagaaagtgcgaacaaacgcagccatgggcgccgttttcacggaagaaaaccagtgggacagcgctaaagctgctgtagaagacgaagatttttggaaactggttgatcgagaacgtgaacttcacaaattaggaaagtgcggatcttgtgtatataatatgatgggtaaaagagagaagaaattaggggaatttggaaaggctaaggggtcaagggccatttggtatatgtggttaggtgctcggtacttagagttcgaagctctaggattcttgaatgaagatcattggttttcgcgtgaaaacagttattcaggagttgagggagaaggtctacataaacttggctacattctaagagatatttccaaaataccaggaggagcgatgtatgccgacgatactgcaggttgggatacccgtatcacagaagacgatttacataatgaagagaaaataactcagcaaatggaccccgaacacagacaattggctaatgctatattcaagttaacttaccaaaataaagtcgtcaaagtacagcggccaacaccaacaggcacagtaatggatataatcagcagaaaggatcaacggggttccggccaggtggggacctacggactaaatacatttactaatatggaagctcaattaatacgtcaaatggaaggtgagggagtcctgtcgaaagcggatttagaaaaccctcatctaccagagaagaaaataacacaatggctggaaacaaagggcgtagaaagactgaaaagaatggcaatatccggggacgactgtgtggtaaaacctatagatgaccgatttgcaaacgctctactcgccttgaatgatatgggaaaagtacggaaagatataccgcaatggcagccctcaaagggctggcatgattggcaacaggtcccattttgttcccatcatttccatgaacttataatgaaagacgggaggaaacttgttgtcccatgtagaccgcaagatgaactaatcggacgagcacgcatctctcagggagcgggttggagtctacgggaaaccgcctgtttaggtaaagcctacgcccaaatgtggtcccttatgtacttccacagacgggacttgagattggcgtctaatgccatatgttctgctgtacccgtccattgggttccgacatcaagaactacatggtcaatccatgcccatcaccaatggatgacaacggaggacatgttgacagtttggaaccgagtctggatcgaagacaatccatggatggaagataagactccagtgactacatgggaagatgtaccgtatttaggcaaaagggaagatcaatggtgcggtagcttgattgggttaacatcgagggcaacatgggctcaaaatataccaacggccatccaacaagtaagaagtctaatcggaaatgaagagtttctcgactacatgccaagtatgaaacgatttaggaaagaagaagaatccgagggtgcaatatggtga

SEQ ID NO: 23270 - RNA, 9873 nt, synthetic construct
  misc_feature 1..9873: note = derived and/or modified CDS sequence (opt6) from DENV-3__KJ189288__SS-prME
  source 1..9873: mol_type = other RNA
acgtcgttatgcctaatgatgatattaccagcagctctagcatttcacctgacttctcgagatggtgaacccagaatgatagtaggcaaaaacgaacgagggaaaagcctattatttaaaacggctagtggtacaaatatgtgcaccttaattgctatggatttaggggaaatgtgtgatgacactgttacatacaaatgtcctcacataacagaagttgaacccgaagacatagattgctggtgtaatctgacaagcacatgggtcacttatggcacctgtaatcaagcaggagaacaccggcgtgataaaagatctgtagcactagctcctcacgtgggaatgggactggatacacgtacacaaacgtggatgtccgctgaaggggcgtggagacaagtcgaaaaagtagaaacatgggcactgcgacacccaggtttcacgatactcgccttgtttttggcccattatattggaaccagtttaacgcaaaaagtagtaatattcattttactcatgctcgtaacacctagcatgaccatgagatgcgttggagtaggaaacagggattttgtagaagggttatcaggtgctacatgggttgatgtggtattagaacacggtggatgtgtgacaaccatggccaaaaataaaccaacgttagatatcgaattacagaaaactgaagcaacacaattggccacattaaggaaactttgtatagagggaaaaataaccaatatcaccactgattcaagatgtcctacgcaaggagaagccgtgctcccagaagaacaagatcaaaattatgtgtgcaaacacacatatgttgaccgcggttggggaaatgggtgtgggttattcggaaaaggaagcctagtaacgtgtgcaaaatttcaatgcttagaaccaatagagggcaaaatggtacaatacgaaaatctaaaatatacagtaataataactgtacatacaggcgatcaacaccaagtaggtaacgaaacacaaggtgtcaccgcagagataacgcctcaagccagcaccacagaagctaccctacccgagtatggaacactaggattagaatgctcaccccgcaccggtttggattttaacgagatgattctactaacaatgaaaaacaaagcatggatggtccacagacaatggttctttgatctaccactaccgtggacaagcggagcaacaacagaaacacccacgtggaatagaaaggagctcctagtcaccttcaaaaatgcacacgcaaagaaacaggaagttgtcgtcttgggctcacaagaaggagcgatgcacaccgctctcacgggcgcgactgaaatacaaaattcgggagggacatcaatttttgcaggccatctaaaatgtcgcttgaaaatggacaaacttgagttaaaaggcatgtcatacgccatgtgtaccaatactttcgtgctcaagaaagaagtatcggagacacaacacggcaccatcttgattaaagttgagtacaaaggagaagatgccccgtgtaaaataccattctctactgaagacggacatgggaaagcccacaatggaaggttaatcacagctaatccagtagtaactaagaaggaggagccagtaaatatagaagcggagcctccattcggcgagtcgaatatagttataggaataggcgataatgcattgaagataaactggtataagaagggaagttctatcgggaaaatgttcgaagctacggcaagaggtgcgcgacggatggcaatcttaggagatactgcctgggacttcgggagtgtagggggagttctaaattccctaggcaaaatggtacaccagatattcggttcagcatataccgccctattctccggagtatcatgggttatgaaaataggaataggtgtcttattaacgtggatcggactcaacagcaaaaacacttcgatgtcattcagctgcatagcaattggtatcatcaccctatatctaggcgcagtcgtacaagcggatatgggctgcgtcattaactggaaaggtaaagagttaaaatgcggttcaggcatctttgtaaccaatgaggtacatacttggacagaacaatacaaatttcaagcagattctcctaaacgtctggcgactgccatcgcaggcgcttgggaaaacggtgtttgtgggatacgaagtaccacaagaatggaaaacttactctggaaacaaattgctaacgaacttaactacatattatgggaaaataatgtaaaattaacggtagttgtaggtgatatcattggtgttcttgaacaaggaaaacgcacgctaacaccacaacctatggaactaaaatattcttggaaaacatggggaaaagctaagatagtgactgcggagacacaaaactcatcctttattatcgatggtccaaatacacctgaatgcccgtcagcgtcacgcgcatggaacgtgtgggaagtagaagattacggcttcggcgtttttacaaccaatatttggcttaggttaagagaggcatatacgcaactctgtgaccatagacttatgagcgctgcagtaaaagacgaacgtgccgtacacgctgacatgggttattggattgaatctcagaaaaacggatcatggaaacttgagaaagctagcctcatagaggtaaagacttgtacttggccaaagtcacacacgctgtggtcaaacggagtcttagaaagcgatatgattattccaaaatctcttgcaggccctatctcgcaacacaatcataggcctggatatcatactcaaacagcaggcccttggcatttaggaaagctagaacttgactttaattattgcgaaggaaccactgtagtcatcacggagaactgcggtacaagggggcctagcttaagaacaactacagtaagcggtaaacttattcatgagtggtgttgtagaagttgtaccttgcctcctctcagatatatgggcgaagatgggtgttggtacggaatggaaataagacccataagtgaaaaagaggaaaatatggtgaaatctctagtcagtgctggttcaggaaaagtagataactttactatgggtgtattatgtttagcgatattatttgaagaagtgatgagaggaaaattcgggaaaaagcacatgattgctggagtattctttacatttgtgctcctactttctggacaaattacatggcgtgatatggctcatacgctgattatgataggatccaatgcatcggataggatggggatgggagtgacttatttagcattaatcgcaacatttaagattcagccatttctggccctaggattctttctaagaaaactaacaagtagggaaaatttactactgggtgtaggactcgctatggcaactacactacaattgccggaagacattgaacaaatggcgaatggtatagctctgggcctcatggcattaaaactaataacccaatttgaaacatatcagctctggacagcgttaatatcattaacttgttcaaacacgatattcacactaacagtcgcctggcgcactgcgacgctcattctagccggtgtttcattattgccagtgtgtcaatcaagcagtatgaggaaaactgattggcttccaatggcagttgctgcaatgggtgttccaccacttcccctcttcatattttccttaaaggatacgctgaaaaggagaagttggccactaaacgaaggtgtcatggctgttggattagtttcaatcttagcatcctcactattgagaaacgacgtgccgatggcaggacccttggttgccggcggtctactaattgcgtgctacgtcatcacaggaacaagtgctgatctgacggtagaaaaggctgccgacattacctgggaagaggaagctgaacaaactggagtatctcacaacctaatgataacggtcgacgacgacgggacaatgcgaataaaagacgatgaaacagaaaatatcttaaccgtactactaaaaactgctctgttgatagtcagtggaatcttcccctactctatcccggctacccttctagtatggcatacatggcaaaagcaaactcagaggtcaggggttctttgggatgtcccaagcccgccggaaacacaaaaggcagaattagaagaaggagtatatcgaatcaaacaacaaggaatatttggaaaaacccaagtgggcgttggggtccagaaagaaggagtgtttcacacaatgtggcatgtaacaagaggcgcggtattaacctataatggaaaaaggttggagcccaactgggcaagcgttaagaaagatttgatttcatacggtggaggatggcgcttatctacacagtggcaaaagggtgaagaggtccaagtaattgcagtcgagccaggcaaaaatcctaaaaatttccaaactatgcctggcacgtttcaaacaacgactggggaaataggtgccattgcattagatttcaaaccaggcaccagcggttcaccaatcataaaccgagaaggaaaagtcgttggattatacggaaatggagtcgtcaccaaaaacggcggttacgtatcgggtatagcacaaacaaacgctgaacccgacgggccaacaccagaattagaagaagaaatgtttaagaagaggaaccttacaattatggatttacaccccggttctggaaaaacaagaaaatatttaccagcaatagtaagggaagcaataaaacggagactcaggacattaatactagcgccaacacgagttgtcgcagctgaaatggaagaagcgcttaaaggacttccaatcagataccaaacaactgccaccaagagtgaacacacgggcagggaaatagtagatttaatgtgccatgcaacttttaccatgagattgctaagtcctgtccgagtacctaactataatctaatcataatggatgaggcccacttcacagacccagcatctatcgcagcgcgcggatacatcagtacccgagtaggtatgggcgaagcagcggcaattttcatgacagctaccccaccaggtacagccgatgcatttccgcaatctaatgcgccaattcaagatgaagaacgcgatataccagaacgaagttggaactcaggaaacgaatggattacagatttcgccggaaaaactgtctggtttgtaccatccattaaagcaggcaacgatattgccaattgtcttaggaaaaacggtaagaaagttatacagctaagccgtaagacattcgatactgaataccagaaaactaaattaaatgactgggactttgtggtcacaactgacatctcagaaatgggagcaaatttcaaagctgatagagtcattgatccaaggaggtgccttaagcccgtaattcttacagatggcccagaacgtgtaatactagctggccccatgccagtgacagcagctagcgcagctcaaagaagaggtagggttggacgtaacccgcagaaggaaaatgatcaatatatttttaccggacagccattgaataatgatgaagatcacgcgcattggacagaagccaaaatgttattagacaacataaatacaccagaaggcatcatacctgccttatttgaaccagaacgagaaaagtcagcagcaatagatggagaataccggctgaaaggagaaagccgcaagacattcgtcgagcttatgagacgcggagacctcccagtatggttagcgcataaagtagcatcagagggaataaaatatacagatcgcaaatggtgttttgatggacaaaggaacaaccaaatactagaggaaaatatggatgtagagatatggactaaagaaggcgagaagaagaaattacgaccgagatggctggatgcgcgaacctattctgatcctttagctttgaaggaatttaaagacttcgcagcagggagaaaaagtatagcactagatctcgtcacagaaatcggaagagtgccttcacacttggcgcacaggacgagaaacgcattagataacctcgtgatgcttcacacgtcagagcacggaggtagagcgtataggcatgctgttgaagaactaccggagacaatggaaacgcttttattgttgggattgatgattttgcttacagggggtgctatgctctttctaataagcggtaaaggtataggaaagacaagtattggccttatatgcgtaatagcctctagcggaatgctatggatggcagaaatacccctgcaatggattgcatctgccattgtactggaatttttcatgatggttctattggttccagaaccagaaaagcaacgtactccacaagataatcaacttgcttacgtggttattggtatacttacacttgcagccattatcgcagcaaacgagatgggtttgttggaaacaacaaaaagagatttaggtatgtctaaagagccgggtgttgtttcacctacaagctacctagatgttgaccttcacccggcgagcgcgtggacgctgtatgcagtagcgacgacggtcataacacctatgcttcgacatacaatagaaaactcgacagcaaacgtgagcttagccgctattgctaatcaggcggttgtcttaatgggtctagataagggatggccaatctcaaaaatggacctaggagtgccccttcttgcattgggttgctacagtcaagtgaacccacttaccttaactgctgctgtacttttattaataacccattatgctatcatcggaccgggactacaagcaaaagcaacccgagaagcacagaaaagaacagcagcaggaataatgaagaatccaacagtggatggtataatgacgattgatttagatccggtaatctacgattccaaatttgaaaagcagctagggcaagtaatgctgctagtattatgcgctgtgcaacttttactgatgcgtacttcatgggctttgtgcgaagctctaactttggcgacaggaccaattacgaccctgtgggaagggagtcctggtaaattttggaacacaacaatagcggtcagcatggcaaatatatttcgtggatcatatcttgccggcgcaggcttggcattctcgataatgaaaagtgtaggcaccgggaaaagaggaaccggttcacaaggagaaaccttgggagagaaatggaagaagaaacttaaccaactgtcaaggaaagagtttgatctctataagaaatcgggtataacagaagtggacagaacggaagcaaaagaaggtttgaaaagaggtgaaataactcatcatgctgtgagccgtggttcggccaagttacagtggttcgtagaaagaaatatggtgatccccgaggggcgggttatagatcttggatgcggacgcggaggatggagctattactgtgcgggcttgaagaaagtgactgaagttcgggggtacactaaaggcggtccgggtcatgaggaacctgtacctatgagcacatatgggtggaatatagtcaaactcatgagtgggaaagatgtattctaccttcctcccgaaaagtgcgatactctattgtgcgacataggtgaaagctctccaagtccaaccgtagaggaatcccgcacaattcgcgttttgaaaatggtagaaccttggcttaaaaataaccaattctgtataaaagttttaaatccgtatatgccaacagtcatagaacacttagaaagactgcaacgtaagcatggtggaatgctagtacgcaatcccttaagccggaacagtacacacgaaatgtactggatctcaaatggaacgggtaatatagtagcatcagtgaatatggtttcgagattgctactcaaccgtttcacgatgacacaccgacgacctaccatagagaaagatgtcgaccttggagctggaactcggcacgtaaatgcagaaccagaaacaccgaatatggacgtgattggcgaaagaattaagcgcataaaagaggaacacaactcgacgtggcactacgacgatgaaaatccatataaaacatgggcctatcatgggagctatgaagttaaggcaactgggtccgcatcgagtatgataaatggggtagttaaacttttaaccaaaccctgggacgttgttccaatggtaactcaaatggcaatgaccgatacaactccattcggacaacaaagagtgtttaaagaaaaagtcgacactagaaccccaagaagcatgccgggtaccagacgcgtgatggggataaccgcagagtggttatggagaaccttaggtagaaataagaaaccccgtctctgcacgagggaggagttcaccaagaaagtacggactaatgctgcgatgggtgccgtatttacagaagaaaaccagtgggacagcgccaaagcagccgtagaagatgaagatttttggaagctagtagacagagaacgagaattacacaaactcggaaagtgtggatcatgtgtctataatatgatgggtaagcgtgagaagaaacttggggaatttgggaaagctaaaggttccagggccatttggtacatgtggctcggggccagatacttagaatttgaagctctcggctttttgaatgaagaccactggttttcccgagaaaattcatatagcggagtcgaaggagagggtctacataaactgggttatatcttaagagacatatccaaaatcccgggcggtgctatgtatgctgatgacacagcaggatgggatacacgaataactgaggatgacctacataatgaagagaaaatcacacaacagatggacccggaacaccgtcaattagctaatgctatttttaaacttacataccaaaacaaagtagtcaaggtacaacgccctacaccaacagggaccgtaatggatattatctcgaggaaagatcaacgaggatctggccaagtaggcacatacgggctaaatacatttacgaacatggaagcacagttaataagacaaatggaaggggaaggggtactcagtaaggcggatttagaaaacccgcatctgccagagaagaaaataacacagtggctagaaacaaaaggggttgaaaggttgaaaagaatggcaatatctggtgatgattgcgtcgtgaaaccaattgatgacagatttgcaaatgcattactagcacttaatgatatggggaaagtaagaaaagacataccacaatggcaaccgagtaaaggctggcatgattggcaacaggttccgttttgttcccaccatttccatgagcttataatgaaagatggacgaaaacttgttgtaccttgcagaccccaagacgaactcattggtcgagctaggatatcacaaggtgctggatggagcttaagagaaaccgcttgcttgggaaaagcatacgctcaaatgtggagtctaatgtattttcatagaagggatctaagacttgcgagcaatgctatatgctcagccgtacccgtacattgggttccaactagcagaactacgtggagtatacatgcacatcaccaatggatgacaacagaagatatgctcaccgtttggaatagggtatggatagaagataatccgtggatggaagataagacacccgtcacaacgtgggaagacgtcccttatcttggaaaaagagaggatcagtggtgtggaagtctaattggcttaaccagtagggcgacgtgggcacaaaatattccaacggccattcaacaagtgagatcattaataggaaatgaggagtttctagattacatgcctagtatgaaaagatttaggaaagaagaggaatcagaaggggcaatatggtag

SEQ ID NO: 23271 - RNA, 9873 nt, synthetic construct
  misc_feature 1..9873: note = derived and/or modified CDS sequence (opt6) from DENV-3__KJ189289__SS-prME
  source 1..9873: mol_type = other RNA
acgtcactatgcctaatgatgatattgccagccgccctagcatttcatcttacatctcgagacggagaaccacgaatgattgtaggcaaaaatgaacgaggtaaatcacttctcttcaaaactgcgagcggaattaacatgtgtacgttaatagcaatggaccttggagaaatgtgtgacgatacagtcacatacaaatgcccacatataacagaagtagaaccagaagatattgattgttggtgtaatcttacaagcacttgggtaacgtacggtacttgtaatcaagcaggagaacaccggcgtgataaaagaagtgttgcattggctccacacgtaggaatggggctagacacacggacacaaacttggatgagcgcagagggggcatggcgacaagtcgaaaaagtcgaaacctgggcattacgccatcctggtttcacgatattagcactgttcttagcccattatattggaacctctctaactcaaaaagtcgtaatatttatactgctcatgttagtcactccatcgatgacgatgcgttgtgtaggtgttggaaaccgggacttcgtggaagggctatctggggcgacctgggttgacgtcgtattagaacacggtggttgtgttaccactatggccaaaaataaacccacattagacatcgagttgcagaaaacagaagccactcaactagcgacattgagaaaattatgtatagaaggtaaaatcacaaacatcacaacagactcaagatgtccaacacaaggagaagccgtacttccggaagaacaagatcagaactatgtctgtaaacatacctacgttgatcgaggatggggtaacggatgcggtttatttggaaaagggagcctggtaacatgtgctaaatttcaatgcttagagcctatcgaggggaaagttgtccagtacgagaatctaaaatacaccgtcataatcacggttcataccggagaccaacatcaagtaggaaacgaaacacaaggagttacagcagaaatcacccctcaggcgagcactacagaggctacattgccagaatacggaacactaggtctagagtgtagtccgagaacaggtctggattttaatgaaatgatattactcacaatgaaaaacaaagcatggatggtgcatcgacaatggtttttcgatttacccctaccatggacaagcggcgcaacaacggaaacgcccacttggaacagaaaagagctactggtgacattcaaaaatgctcacgcaaagaaacaagaagttgtggttttaggatcgcaggaaggagcaatgcacacagccttaacaggggcaaccgaaatacaaaactccgggggaacatccatattcgcgggacatttaaaatgccggttaaaaatggataaacttgaactaaaaggaatgagttacgccatgtgtacaaacacttttgtcttgaagaaagaagtatcagaaacgcagcatggaaccattctcataaaagtagaatataagggcgaagatgctccttgcaagataccctttagtactgaggacggacatggaaaggcccataatggcaggttgattaccgctaatccagtagtcaccaagaaagaggagcctgttaacatcgaagccgagcctcctttcggtgaatcaaacattgttataggcataggagataacgcactaaaaataaattggtataagaaaggtagcagcattggtaaaatgtttgaagctacggcacgaggtgctcgcaggatggccatattgggagatactgcatgggattttggttctgtaggaggagtacttaattcactgggcaaaatggttcaccaaatctttggttcagcgtatactgcattattttcgggcgtgagctgggttatgaaaattggtataggagtactcctcacatggattggattaaattctaaaaacacatctatgagtttttcgtgcattgctataggtataataacattgtatctcggtgcagtagtgcaagctgacatgggatgtgtaataaactggaagggcaaggagttaaaatgtggtagcggaatatttgtcacaaatgaagtacatacatggaccgaacaatataaattccaagctgattcgcctaaaaggcttgctacagcaatagcgggggcttgggaaaacggggtatgtggaataaggtctacaacgagaatggaaaatttactatggaaacaaatcgcaaacgaactgaactatatattgtgggaaaataatattaagttaacggttgtagtaggtgacactattggagtgttggaacagggaaaaagaactctaacgccccaaccgatggaactaaagtactcgtggaagacctggggaaaagcaaaaatagtgacggcagagacgcagaacagttcatttattatcgacgggccaaatacaccggagtgtccctcagcaagtcgagcctggaatgtatgggaagtggaagattatggtttcggagtattcactactaatatatggctgcgtttacgagaggtttacacccaactatgtgaccaccgtctgatgagtgcggcggtcaaagatgagcgtgctgtccatgccgacatgggctactggatcgaatcgcaaaagaacggatcatggaaactagagaaagcgagccttattgaagtgaaaacgtgtacatggcccaaatcccacactctgtggagtaacggagtactcgaaagtgacatgatcattccgaaaagtttagcaggaccaattagtcagcacaatcatcgtcctggatatcatacccagacagctggaccatggcacttaggaaaattggaactagatttcaattattgcgaaggcactacagtcgtgattacagaaaattgtggaacaaggggacctagtcttcgaactacaaccgtgtccggaaaacttatacatgaatggtgctgcagaagttgtaccttacctccgttacgctatatgggcgaggacggatgttggtatggtatggagattagaccaatttcagagaaagaggaaaatatggtgaaaagccttgtttccgcggggtcaggaaaggtggataacttcactatgggtgttctatgtttagcaatattattcgaggaggtaatgaggggaaaatttgggaaaaagcacatgatagctggagtattctttacatttgttcttctattgtcagggcaaataacatggagagatatggctcatacacttataatgattgggtcaaatgcttcagataggatgggaatgggagtaacctatcttgcgttaatcgcaacattcaaaatacaaccgttcctagctttaggtttctttctaagaaagctaacaagtagagaaaacttgctattaggagttggattggctatggcgacgacactacaactcccagaagatatagagcagatggcaaacgggatcgcacttggacttatggcactgaaactaattacacaatttgaaacatatcagttgtggacagcattgatctctctgacttgcagcaatacaatatttactttaacagtagcatggaggaccgctacacttatattagctggtgttagtttattaccagtttgtcaatcgagttctatgagaaagactgattggctacctatggccgtagccgcgatgggggttccgccactaccgcttttcatttttagcctgaaagatacacttaagagaagatcctggccgttaaatgagggcgtaatggcagtagggcttgtatccatcttagcttcaagcctactccgcaatgacgtacccatggctggtcccctggttgccggcgggcttctgatcgcatgctatgtaataacaggtactagcgcagatctaacagtagaaaaagcagctgacataacatgggaagaagaagcagagcaaacaggcgtatcccataacctcatgattacagtggatgatgacggaacaatgagaattaaagatgacgaaacagagaatatactgacagtattgctgaaaacagctttgctcattgtatctggtatctttccatattcaatccctgctacgttgctagtatggcatacatggcaaaaacaaacacaaagaagcggagtcttatgggatgttccttcacctcctgaaactcagaaagcagagttggaagaaggtgtgtacaggataaaacagcaaggaatttttggaaagacccaagtaggagtgggagtacaaaaggaaggcgtattccacacaatgtggcatgtcacgagaggagctgtactaacttacaatggaaaaagactcgaaccaaactgggcaagtgtgaagaaagatctgataagttacgggggtggttggcgcttatcaactcagtggcagaaaggtgaggaagtccaggtaatagccgtggaaccaggtaagaatcctaaaaattttcaaactatgccaggtacatttcaaaccacaacgggagaaataggagcaatagcactagattttaaacctggaacctccggatctccgataataaacagggaaggtaaggttgtaggattatacggaaatggagtagttaccaaaaatggcggatacgtctctggcatagcacaaactaacgctgaacccgacggacccacgcctgagttagaagaagaaatgttcaaaaagcgaaatcttaccatcatggatcttcatcctggctcaggtaaaacgagaaagtaccttccagctattgtaagggaggcaatcaagcgacgccttcgaacgttgatattagcacctacacgtgtagtagccgcagaaatggaagaagcactaaaaggattaccaataagatatcaaactacggccaccaaaagtgagcacacgggacgagaaattgtagatctgatgtgtcatgctacatttactatgagattattaagcccagtacgtgttccgaactacaacctgattatcatggatgaggcacatttcaccgatcctgcgtcaatagcagctcgaggttatatttccacacgagttggtatgggagaagctgctgcaatatttatgactgcaactccaccgggaacagcagatgctttcccacagtcgaacgctccgattcaggatgaagaaagagatataccagaaaggtcgtggaactctggcaatgagtggattacagattttgcaggaaagacggtatggtttgtcccatctataaaagcaggaaacgacatagcaaattgtttaaggaaaaatggcaagaaagtgatccaactatcacgaaaaacgtttgacactgagtatcagaaaacaaaattgaacgattgggattttgtggtaacgactgacatttctgaaatgggcgccaattttaaagcggatagggtcattgacccaagacgatgcctaaaaccagttatactaacagatggacctgagcgcgtaatcctagcgggacccatgcccgtcactgcagcgtctgcagcgcaacgccgcggaagggtaggccgaaacccacaaaaagaaaacgatcaatacatctttacgggacagcctttaaacaacgatgaagatcacgcacattggactgaggcgaaaatgttattagataacattaacactccggaaggtattatacctgccctatttgaacctgagcgtgaaaaatctgcagcaatagatggggaatacaggctaaagggcgagtctagaaaaacctttgtcgaattaatgcgaagaggagatctccccgtatggctcgctcataaagtagcgtcggaagggattaaatacacggatagaaaatggtgtttcgatgggcaacgaaataaccaaatactagaagaaaacatggacgtcgaaatctggaccaaagagggtgaaaagaagaaattaagaccacggtggctagacgcaagaacgtattctgatcccctagccctaaaagagttcaaggactttgccgcgggtcggaaatcaatagctttagatctcgttacggaaattggccgtgttccctcacatctagcacaccgaacaagaaacgctcttgataatttggtcatgctacacacaagcgagcacgggggtagagcatatcgacatgcagtagaagaactgccagagacaatggaaacactattactactaggactaatgatactactaaccggaggagctatgttatttttaatatcggggaaaggaataggcaaaacatctattggcttaatatgcgtcatcgctagttccggcatgttgtggatggcggaaattcctctacaatggattgccagcgctatagttttagagtttttcatgatggtcctattaatcccagaaccagaaaagcaaaggacaccacaagataatcaactagcttatgtagttataggtatattaacgttagcggcaatcatagcggcaaatgaaatgggtcttctagaaacaaccaaaagagacctaggaatgagtaaagagcccggagtggtttccagtacttcttatttagatgtggatttgcatcctgcctctgcctggactttgtatgccgtagcgaccacagttatcacgcctatgctacgacacaccattgaaaattcaacggccaatgtatctctggctgcaattgcaaaccaagcagttgttttaatgggcctagacaaagggtggcctatatctaaaatggatttaggcgtaccacttctagcattaggatgttactcccaggtaaacccacttacattaaccgctgctgtgctactattaataacacattacgcaataataggaccaggtctacaagctaaagcaactagggaagctcagaaaaggacagccgctggtatcatgaaaaaccctacagtcgatggcataatgacgattgacttagacccagtaatttacgacagcaagtttgaaaagcaacttggtcaagtaatgttgctagtactatgcgcagtacaactactactgatgagaacgtcgtgggcactatgcgaagctctaacattggctaccggacctataacaacattgtgggagggctcgccaggtaagttttggaacaccacaatcgctgtaagcatggccaatatattcagaggatcatatttggctggtgccggtctagcctttagtataatgaagagtgtaggaacgggtaaaaggggaactggttcgcagggggaaactctaggcgaaaaatggaagaagaaattaaatcaattgtcacgtaaagagttcgatctctacaaaaagagtgggattaccgaggttgatcgtacagaggccaaggaaggattaaagagaggagaaataacgcatcacgcagtgtcccgaggcagtgcaaaactacaatggttcgtcgaacgtaatatggttattccagaaggaagagtgatagatcttggctgtgggagaggagggtggtcctattactgtgctgggctaaagaaggtaactgaggtccgtggctacactaaaggtggacctggtcatgaagaaccggtaccaatgtcgacttacggttggaacatagtaaagctaatgtccggaaaagatgtattctatctaccaccggagaaatgtgacacattactttgtgacatcggcgaaagttccccctccccgactgtagaggaatcaagaactatcagagtcttaaaaatggtcgagccatggctcaagaacaatcaattttgcataaaggtccttaatccatatatgcccactgtaatcgagcacttagaaagactacaacgaaagcatggaggaatgcttgtacgtaatccactatctcgtaatagcactcacgagatgtattggatatcaaacggcacaggaaacatagttgcatcagttaacatggtctccagactgctactaaataggttcacgatgacccacagaagacctactatagaaaaagatgtagatctgggggctggcacccgacacgttaacgccgaaccggagactccaaacatggatgttattggagaaagaataaaacgaattaaggaagaacacaactcaacatggcactatgacgatgagaatccatataagacatgggcttatcatggatcatatgaagtcaaagcgacaggcagtgctagtagcatgataaatggtgtggtgaaattattgaccaaaccatgggacgtagtaccaatggtaacgcaaatggcaatgacagataccacaccttttggtcaacaacgtgtctttaaagagaaagttgacactagaacgccacgttccatgccaggcacacgacgtgtcatggggataaccgcggaatggctgtggcgtacacttggacggaataaaaagccgcgattatgtactcgagaagaatttacgaaaaaggtgcgaacaaacgctgcgatgggagcagtgttcacggaagagaatcaatgggattcagcaaagacggcggtggaggatgaagatttttggaagttagtagaccgcgaaagagaactgcacaaactaggaaaatgtggcagctgtgtgtataatatgatgggaaaacgtgagaagaaattaggggaatttggcaaagcaaaaggcagtcgagcaatttggtatatgtggctcggggcaagatacttggagttcgaagcactagggtttcttaatgaagatcactggttttccagagaaaattcatatagtggagtagagggggaaggccttcacaaacttggatatatactaagagatatttctaaaattccagggggtgctatgtatgctgatgatacagctggctgggacacgcgtatcaccgaagacgatttacataatgaggagaaaattactcaacaaatggatccagagcaccggcaactcgcaaatgcaatatttaaattgacatatcaaaataaagtagtaaaggttcaaaggccaactccaaccggcacggttatggacattattagcagaaaagatcagaggggcagtggacaagtaggaacttacggccttaatacatttacaaatatggaagcacagctaatcaggcaaatggaaggtgaaggggttttatcaaaagcggatcttgaaaacccacaccttcctgagaagaaaataacacaatggttggaaacaaaaggtgttgaaagattaaaacgaatggctatatcaggtgatgattgcgtggtaaaacccattgatgatcgatttgcgaacgctctactggctctaaacgatatgggcaaagttcgtaaagatataccacagtggcaaccatctaaaggatggcacgattggcaacaagtaccgttttgttctcatcactttcatgagctcatcatgaaagatggcaggaagctagttgtgccttgccgtccccaggacgaactcataggcagagctcgaatttctcaaggagcaggttggtcattacgggaaacagcgtgccttggtaaagcgtatgcacagatgtggagtctgatgtacttccatcggagggatctaaggctagctagcaatgccatttgcagtgcagtgcctgttcactgggtacctacatcaagaactacctggtccatccatgcacaccaccaatggatgacaactgaggatatgttaaccgtctggaaccgtgtatggattgaggataacccatggatggaggacaagaccccagtgaccacttgggaagatgttccttatttaggcaaaagagaagaccaatggtgcggcagcttaataggattgacgagcagagccacatgggcgcaaaatataccaacagcaattcaacaagtaaggagtcttataggaaatgaagagtttctcgattacatgccctctatgaaaagatttagaaaggaagaagaaagtgaaggggccatatggtaa

SEQ ID NO: 23272 - RNA, 9873 nt, synthetic construct
  misc_feature 1..9873: note = derived and/or modified CDS sequence (opt6) from DENV-3__KJ189290__SS-prME
  source 1..9873: mol_type = other RNA
acgtccttatgtcttatgatgatactacctgcagctctcgcattccacttgacaagcagggatggagaacccaggatgatcgtaggtaaaaatgaaagagggaaatcattgttatttaaaaccgctagcggaataaatatgtgcactctaatcgcaatggacctcggcgaaatgtgtgatgataccgttacatataaatgcccacacataacagaagtagaacctgaagatatagattgttggtgcaatctaacaagcacatgggtaacatacggtacatgcaatcaagctggtgaacatagaagggataaaagatctgtagctttagcaccccatgtgggaatgggcttggacacacgaacacaaacctggatgtcagcagaaggtgcttggcgacaagtagaaaaagttgaaacttgggctttgcgacatccaggctttacaatactcgctttatttctagctcattatatagggacatctctcacacaaaaagtggtaatctttatattactgatgttggtaacaccatcaatgaccatgagatgtgtgggggttggcaacagagattttgtcgagggtttatctggcgcaacttgggtagatgtcgttctagaacatggaggatgtgtcacaacgatggccaaaaataaaccaacacttgatatagaactacagaaaacagaggcgacacaactggctactctcagaaaactctgcatagagggcaaaattactaatataacgacagatagccgctgccctacacaaggagaggcagtattgcccgaggaacaagatcaaaactacgtatgtaaacacacgtacgtcgatagaggatggggaaacggatgcggattattcggaaaaggtagtttagtaacttgcgctaaatttcaatgtttagaacctattgaaggaaaagttgtccaatacgagaaccttaaatatactgttataataacagttcacactggagatcaacatcaggttggaaacgaaacacaaggggttacagccgaaataacaccccaggcttccacgactgaagcaaccctgccagaatatggaactcttggtttagaatgttctcctagaaccgggcttgattttaatgaaatgatactacttacgatgaaaaacaaggcttggatggttcatagacaatggttctttgatcttccgttaccttggacaagtggtgctactacagagactcccacttggaatcgtaaagaattattggttactttcaaaaatgcacacgccaagaaacaagaagttgtggtattaggctcacaagaaggtgctatgcacacggcactcaccggagctacagagatacaaaacagtggaggaaccagtatatttgcaggacacttaaaatgtcgattaaaaatggataaattggaattaaaagggatgagttacgcaatgtgtacgaacacatttgtactaaagaaagaagtctcagaaacccaacatggaactatattaattaaagttgaatataaaggagaagatgccccatgcaaaataccgttttcaacagaagatggtcacggaaaagcacataatggaagattgataacggccaatcctgtagtaacgaagaaagaggaacccgttaatattgaagcagagccaccgtttggcgaaagtaatatcgtgatcggcataggggacaatgctttgaaaataaattggtacaagaaaggatcctcgatcggcaaaatgtttgaagctacagcacgaggggcaaggcgaatggcgattcttggtgacaccgcatgggactttggatcggtaggaggtgtgttaaacagcctaggtaaaatggtacaccaaatattcggatcagcctacacggcactatttagcggtgtaagttgggtgatgaaaataggcatcggagtgttgctaacttggataggattaaatagtaaaaatacctctatgtcattttcatgcatagcaataggtataattacactatacttaggtgcagtcgttcaagcagatatggggtgtgtcatcaattggaaaggaaaagaactaaaatgtggtagcggtatcttcgtaactaacgaagtacatacatggaccgaacaatacaaatttcaagcagactcaccaaagagacttgcgacagctatagcgggagcatgggagaacggtgtgtgtgggataaggtcaacaaccagaatggaaaacttgctatggaagcaaatcgctaatgaattaaactatatattatgggaaaataacataaagctaactgttgttgtaggagatataataggtgtgttggaacaaggaaaaaggactctaacaccacaaccaatggaattaaagtactcttggaaaacctggggaaaggcaaaaatagttaccgccgaaacacagaatagttcctttataattgatggcccaaatactccggaatgcccgtctgcatcacgagcgtggaatgtatgggaagttgaagactatggttttggagtgtttacgaccaacatttggttacgccttcgtgaagtatacacgcaactatgcgatcatcggctgatgtcagctgcagtaaaagatgaacgagcggtccacgctgacatgggttactggatcgaaagccagaaaaatgggtcctggaagctggaaaaagcgtcgctcatagaagtgaagacatgtacatggcccaaatctcacacgttatggtcaaacggagttttagaatcagatatgattattccaaagtccttagctggcccaatctctcagcacaatcatcgtccaggataccacacacaaacagctggtccgtggcacttaggtaaactagagttagattttaactactgtgaaggaacaactgtagttataaccgaaaattgcggtacaagaggtccatctctacgaactacaacagtttctggcaaactaatacatgaatggtgttgcagaagttgtacactcccacccttacgttacatgggagaagacggctgttggtacggcatggaaataaggccaattagcgagaaggaagagaatatggtaaaatctttagtcagtgcaggcagtggtaaagtagataattttacgatgggcgttttgtgtcttgcgattctattcgaagaagttatgagaggtaaattcggcaaaaagcatatgatagcaggggtcttcttcacgtttgttctactactatcaggtcaaataacatggagaaacatggcacataccttaataatgattggctctaatgcatcagaccgtatggggatgggcgtaacctatctcgccttaattgcaacatttaagattcagccgtttctagccctaggatttttccttagaaaattgacttcacgagaaaatcttcttctaggtgtaggcctggcaatggctactactcttcaactaccagaggatattgaacagatggccaacggtatagcactaggattgatggcgttgaaactaataacccagttcgaaacctatcaactctggacggcacttatctctctaacatgtagcaacacaatttttacacttactgtagcttggcgaacagcaacactaattcttgcgggcgtttcattgctaccggtatgccaaagcagtagtatgagaaaaacagattggctacccatggcagtggcagccatgggagtacccccattgcctttattcatattttcgctgaaagatacattgaaaaggcgttcctggcccctcaatgagggtgtaatggcagtgggattagtaagtattctagcatcgtcattgcttagaaacgacgtacccatggcaggacctttagtagcaggaggactgctaatagcatgttatgttattacagggacctccgccgatctaaccgtcgagaaagccgctgacatcacatgggaggaagaagcggaacagactggtgtatcacacaatctaatgataacagttgatgatgatgggacaatgcgtataaaggatgatgagactgagaatatcctcacagttcttctaaaaacagcattgctcatagtaagcggaatttttccgtattcaattcctgcaacactactggtctggcatacatggcaaaaacagacccaaaggagtggcgtattatgggatgtaccaagccctccagagactcagaaggcggaacttgaggagggtgtgtacagaattaaacagcaaggaatctttggtaaaacgcaagttggagtaggagttcaaaaagaaggtgttttccatacaatgtggcacgtaaccagaggagccgtactcacatacaatggaaaaagactggaacctaactgggcaagtgtgaagaaagatctcattagctacggaggtgggtggaggctatcaacccaatggcaaaaaggggaagaggtacaggttattgcagtggaacctggtaagaaccccaaaaatttccagacaatgccaggaacctttcaaacaacgaccggtgagataggggccatagcactggatttcaaacccggaacatcaggatcaccgataataaaccgcgaaggaaaagttgttgggttatatggaaatggcgtagtaactaaaaacggtgggtatgtaagtggaatcgcgcagacaaatgccgaaccggatggccccacaccagagctagaggaagagatgttcaagaaacgtaatctcactataatggatttacacccaggtagcgggaagaccaggaaatatttaccggccatagtacgcgaggcaatcaagcggcgactaagaactctgatattagccccaactagggttgtagctgctgaaatggaagaagccttaaaaggcctaccaataagataccaaactacagcgaccaaaagtgagcatactggtagagaaatagttgacttgatgtgccacgccacgttcaccatgagacttttgagtccagttcgtgtaccaaactataacctgataatcatggacgaagcccatttcaccgacccagcatcgatagcagcccgtggttacatctctacaagggttggaatgggagaggcggcagcaatttttatgacggcgacaccgcccggaactgcggacgcattcccacaatccaatgcgccaatacaagacgaagagagagatatacccgaaaggtcatggaactccggtaatgaatggataacagattttgcaggaaaaacagtatggtttgttccaagtattaaggctggaaacgacatagccaattgtctgaggaaaaatggcaagaaagtaattcaactatctagaaaaacctttgacacagaataccagaaaactaaactcaatgactgggatttcgtagtcactaccgacatatcagaaatgggagccaatttcaaagccgatcgagttatcgatccaagacggtgcctaaaaccggtcattctaacagatggtccagaacgagtgatattagccggaccgatgccagttacggcggcgagcgctgcacaaagacgagggagagtgggcagaaaccctcaaaaagagaatgatcaatatatattcaccggacaacccttgaacaatgatgaagatcatgcacattggacggaggcgaaaatgcttttagataatattaatactcctgaaggcatcatccccgcacttttcgaaccagaacgggaaaagtcggccgcaattgacggcgaatatcggttaaaaggagagtctcgcaaaacatttgttgagctaatgagacgaggtgacttacccgtttggttagctcataaagtggctagtgaaggaattaaatacactgatagaaaatggtgtttcgacgggcaaagaaacaaccagatactagaagaaaatatggatgtggagatatggacgaaggaaggtgagaagaagaaattacgacctcgatggttagacgcacgaacgtattcagatccactggccctaaaagagttcaaggattttgcagcgggacgcaagtcaattgccttagatctagtgacagaaataggcagagtgccgagtcatcttgctcatcgcactagaaatgctttagataatctagtaatgctacatacctcagagcacgggggtagagcttataggcatgcagtagaagaactgcctgaaacgatggaaacacttcttcttcttggactgatgatactcctaacaggaggggcgatgttatttttgataagtggtaagggaatcggaaaaacgtcaatcggtttaatatgcgtcattgctagttcaggtatgctttggatggcagaaatcccgttgcaatggattgctagcgctatagtattagagttcttcatgatggtccttctaatacctgaaccggagaaacaaaggactccacaagataatcaactggcgtatgtagtaatagggatcctcacccttgcagcaataatagcagcgaatgaaatgggactattagaaactacaaaaagggatctcggaatgtcgaaggagcctggggtcgtgtcacctacctcatatttagatgtggatttacatccagcatctgcttggacactatatgcagtagcaactacagtaattacaccaatgctgagacatacaatagagaatagtactgcaaatgtctccctagcagccatagccaaccaggcggtagtgctcatgggactcgataaagggtggcctattagtaaaatggatctaggagttccattactagctctgggatgttacagccaagtaaacccgcttacattgacagcagcagtactattattaataacgcattatgcaataatcggccctggactccaagcaaaagcaacgagagaggcacagaaaagaaccgcagcaggtataatgaaaaatccaactgtggatggcatcatgaccatagatctcgatccggtaatctatgacagcaaatttgaaaagcaattgggacaagtaatgttgctggttctatgcgcagttcaactgttattaatgagaacaagttgggctttgtgtgaggcactcacgttggccacaggccccataacgacattatgggaaggctcaccggggaaattctggaacacaacaatagcggtctctatggccaatattttcagaggaagctatttagctggagcgggtttagcattttcaataatgaaaagtgttggcactggaaaaagaggtactggatcacaaggagaaacactaggagaaaaatggaagaagaaattaaaccaactatcccggaaagaatttgatctctacaaaagatctggtattacagaggtagaccgcaccgaagcgaaagaaggactgaagcgaggtgaaatcacgcaccacgcggtttcacgtgggagtgcgaagctacaatggttcgttgaaagaaatatggtaattccagagggcagagttatcgatttaggatgtggaaggggtgggtggagttattactgtgcgggcttaaagaaagttacagaagtgagagggtatactaaaggaggtcctggacacgaagaacctgtaccaatgtcgacatacggctggaatattgtaaaattaatgagcggcaaggatgtattttaccttcccccagagaaatgcgacaccctactgtgcgacattggcgaaagttcaccatcaccgacagttgaggaatccagaacgataagggttttaaagatggtcgaaccatggctcaaaaataatcaattttgcattaaggtattaaatccctatatgcctacagttatagagcacttagaaagattgcaaagaaaacatggaggtatgctggtcagaaatccgctctcaaggaactccacacacgaaatgtattggatctctaatggcacaggcaacatcgttgcttcagtcaacatggtgagtagactcctacttaatcggttcaccatgacacatcggagaccgactatagaaaaagatgttgatttaggtgctggcacccggcacgtcaatgcagagcccgaaactcccaatatggacgtaataggtgaaaggattaaaagaattaaagaggaacacaattcgacgtggcattatgacgaagaaaatccttacaaaacttgggcctatcacgggtcatacgaggtgaaggcaaccggatcggcaagtagcatgattaatggggtagtgaaattattaactaaaccttgggatgtagtgccaatggtaacacagatggcgatgaccgatacaacaccattcggtcagcagagagtatttaaagaaaaggttgatactcgaacaccacgttcaatgcccggcacaagacgcgtaatgggaataactgcagaatggctatggagaactctagggagaaacaaaaagccaagattatgtactagagaggaatttacgaaaaaggttagaacaaacgcagcaatgggagctgtatttactgaagaaaaccagtgggatagtgcaaaagccgcggtggaggacgaagatttttggaaactcgtcgacagagaaagagaactacataagctcggcaagtgtgggagctgtgtgtacaacatgatgggcaaaagagagaagaaactaggagagttcggtaaagctaaaggaagcagagcaatatggtatatgtggctgggtgcacgttatttagagttcgaagctctaggattcttaaatgaagatcattggttctccagagaaaattcttactcaggggtcgagggagaaggactacataaactggggtatatcctaagggacatctccaaaattccaggaggagcaatgtatgcagacgatacagcaggatgggacacgagaatcacagaagatgaccttcacaacgaagagaaaattacgcaacagatggatccagaacatagacaactagcaaatgctatctttaaactaacttatcaaaacaaagtagtaaaagtgcaaagaccaactccaactggcaccgtaatggatattataagtcgaaaagatcaacgaggtagtggccaggtgggtacttacggcctgaatacatttactaatatggaagcacaattgattaggcaaatggaaggtgaaggagtactttcgaaagccgacttagagaacccacatttacctgagaagaaaataacacaatggttagagacaaaaggagttgaaagattaaagcgaatggcaatcagtggggatgactgtgttgtaaaacctatagacgacaggtttgcaaatgcgctactagcactaaacgacatgggaaaagttcgaaaggatattccccaatggcaaccatcaaaaggatggcatgactggcagcaagttccattttgttcccaccactttcatgaactgattatgaaagatggtcgaaaattggtggtgccatgcaggcctcaagatgaactcattggcagagcaaggattagccaaggggctggctggtcgttgcgagagacagcgtgtttaggaaaagcctatgcacaaatgtggtcattaatgtattttcaccggcgagatcttagattggcaagtaacgctatatgctccgcagtaccggttcattgggtcccaacatctagaacaacttggagcattcatgctcatcaccaatggatgacgacagaagacatgcttacagtttggaaccgcgtgtggatagaagacaatccctggatggaagataaaactccagtgacgacatgggaagacgtaccctacttaggaaaacgagaagaccagtggtgtggaagcctaataggattaacatctagagcaacatgggcccagaacatcccaacagcaatacagcaggtccgatccctcataggtaatgaagagtttttagactacatgccgagcatgaagcgatttcggaaagaagaagaaagtgaaggtgcaatatggtaa

SEQ ID NO: 23273 - RNA, 9873 nt, synthetic construct
  misc_feature 1..9873: note = derived and/or modified CDS sequence (opt6) from DENV-3__KJ189291__SS-prME
  source 1..9873: mol_type = other RNA
acatcactatgcctaatgatgatattgccagcagctttagcattccatttaacaagtagagacggagaaccacgaatgattgtaggtaaaaacgaacggggaaaatcactattatttaaaactgcaagtggaataaatatgtgtactctaatagcgatggatcttggcgaaatgtgcgatgatactgtaacatacaaatgcccacatataacagaagtagaaccagaggacattgactgctggtgcaacctaacatctacgtgggtaacctacggaacctgtaaccaagcaggagaacatcgacgagacaaacggtcagtggcattagcaccacacgtgggtatgggactcgatacgagaactcaaacttggatgagtgctgaaggtgcttggagacaagtagaaaaagtcgaaacatgggctttacgacatcccggttttacaatactcgctctattcctcgcacattacatcggtacatcactaacacaaaaagtagtgatttttatattgttaatgttagtaacaccgtccatgacaatgagatgtgtaggagtaggcaaccgagacttcgtagaaggactttccggcgcgacttgggtagacgtagtgcttgaacacgggggttgcgtaactacaatggccaaaaataaaccaaccctagatattgaattacagaaaacggaagctactcaactagcaaccctccgaaaactatgtatagaaggcaaaattacaaatattacaacagattcacgatgtccgacgcagggagaagctgttcttcctgaagaacaggatcaaaattacgtatgtaaacacacatatgtagatagaggttggggaaacggatgtggattattcggaaaaggaagtttggtgacatgcgctaaatttcaatgtcttgaacctattgaaggaaaagtagtacagtacgagaacctaaaatacacggtaattataacagttcataccggggatcaacaccaagtaggaaacgaaacacaaggggtaactgcagaaattacacctcaagcaagtaccacagaggccacactacccgaatatggcacattaggcttagaatgcagtccaaggacgggtctagactttaacgaaatgatattactaaccatgaaaaacaaagcatggatggtacacagacaatggttctttgatttacctttaccatggacaagtggagctactacagaaaccccaacctggaatcgaaaagagctattagtcactttcaaaaatgcccacgccaagaaacaagaagtagtggtcttaggttcccaagaaggtgcaatgcataccgcactaacaggtgccacggagattcaaaattcgggcggaacatctatattcgcaggtcacttgaaatgtcgtctaaaaatggacaaactagaactaaaaggcatgtcatacgcaatgtgtactaacacattcgtactgaagaaagaggtatccgagactcagcacgggacaatcttaataaaagtggaatataaaggtgaagatgcgccctgcaaaattccattctcaacagaagacggccatggcaaagcgcataacggtagacttattacggccaacccggtagtaactaagaaagaagaaccagttaatatagaggccgaaccaccctttggggaaagcaatattgtgatcggaataggggataatgcattaaaaattaattggtataagaaaggaagttcaatcggcaaaatgttcgaagcaacagcccgtggtgcccgaaggatggcaatactaggggatactgcatgggacttcggctctgtaggtggtgtactgaatagcttaggaaaaatggttcaccagatatttggtagcgcgtacacagcattattttctggcgtatcatgggttatgaaaataggcatcggcgttctattaacttggattggactgaactcgaagaacacatctatgtcgttctcatgcatagccattggaattatcaccttgtatcttggggcagttgtacaagcagacatgggatgcgttataaattggaaaggaaaagaactcaaatgtggttcggggatatttgtgacgaatgaagtacacacatggacagaacaatataaatttcaagcagacagtccaaaacgactcgcaacagctattgcaggagcttgggaaaatggagtctgtggaataagatccactacaaggatggaaaaccttctatggaaacagatagctaatgagttaaactacattttatgggagaataatattaaattgacggtcgtagttggggatattataggggttctagaacaaggtaaacgcacattaacacctcaaccaatggaattgaaatactcatggaaaacttggggcaaggcaaaaatcgttactgctgagacgcaaaattcttccttcataatagacggtcctaacacaccagaatgcccgagcgcgtcgagggcctggaatgtatgggaagtggaagattatggcttcggagttttcacgacaaacatatggttgcggctcagggaggtgtatacgcaattatgtgatcatcgcttgatgtcggccgcagtaaaagacgaacgagctgtgcacgcagatatggggtattggatagaatcacagaaaaacgggagttggaaattagaaaaagctagtttaatagaggtcaaaacatgcacctggccaaaatcgcacacgttatggagtaatggagtactagaatcggatatgattataccaaaatcactggctggaccaattagtcaacataatcaccgtccaggatatcacacgcaaacagccggaccatggcacttagggaagctggaacttgattttaactattgtgaagggacaacggtagtgatcacagaaaattgtggtactcgaggaccatctttacgaactactacggttagcggtaaactgatacacgaatggtgttgtagaagttgtaccctacccccgttacggtatatgggggaagatggatgctggtacggtatggaaatcagaccaatatcggaaaaagaggaaaatatggtcaagagcctagtcagtgcagggagcggaaaagtagacaatttcaccatgggagtactatgccttgcaatactctttgaagaagtaatgagaggtaaatttggtaagaaacatatgattgctggagtattctttacatttgtgctgttacttagtggccaaataacttggaggaacatggcacacaccctaattatgattggaagtaatgcaagtgatagaatgggcatgggcgtcacatacttggcattaatagcaacgtttaaaatccaacctttcttagccctcggattctttttaagaaaactaaccagtagggagaatctactgttaggagtaggcctcgcaatggcgactactttacagctaccggaggatattgaacagatggcgaacggaattgctctgggtttgatggcgttaaaacttattactcaattcgagacatatcaactgtggacagctcttataagcctgacatgttcaaacacgatatttacactgaccgtagcgtggaggacagcaacactgatattagcaggcgtatctcttttgcccgtttgtcagagttcgagtatgagaaagacagattggcttccaatggcagtagccgctatgggtgttccacctcttcctttattcatattttcgctaaaagataccttaaaacgtcgatcgtggccactgaacgagggcgtgatggcggtagggttagttagcatattagccagttccctattacgaaacgacgtacctatggctggccctttagttgcgggagggttgttaatcgcatgttatgtaattaccgggacgagcgcagacttaaccgtagagaaggcggcagacataacctgggaggaagaagccgaacaaacaggagtaagtcataatctcatgataactgtggatgacgatggaaccatgagaataaaagacgacgaaaccgagaatatactcacagtattactaaaaacagctctattaatagtaagtgggatatttccatatagtataccagctacacttctagtgtggcacacttggcagaagcaaacgcaacgttcaggtgtattatgggacgtgccgagtcctccagagacgcaaaaagcagaactagaggaaggcgtgtatagaatcaagcagcaaggcatttttggaaaaacgcaagtaggagtgggtgttcaaaaagagggggtattccacacaatgtggcatgtgacaagaggagcagtcctgacgtataacggtaaacggctcgaacccaactgggcatctgtaaagaaagacctaattagttatggaggcggatggcgattgtcaactcaatggcaaaaaggagaggaagttcaagttattgctgtggaacctggcaaaaatcccaaaaacttccaaacaatgcctgggacattccagacaactacgggagaaattggagcgatcgcattagacttcaaaccaggcacatcaggatcgccgatcataaatagagaaggtaaagtagttggtctatacggtaacggcgtagtgacgaaaaacggaggttacgtaagcggcatagctcaaacgaatgctgaacctgatggacccaccccggaattagaagaagaaatgtttaagaaacgaaatttgactataatggacttacatcctggcagcgggaaaacacgtaaatatttaccggcgatagtaagagaggcaattaaaagacgactacgaacactgatactagctcccacaagagtcgtagctgcggaaatggaagaagcacttaaaggactccccattcgctatcaaaccactgcgacaaagtcagaacacacgggtcgagagatagttgatctaatgtgtcatgcaacattcactatgcgactactttcccctgtcagagtcccgaattataatctaatcataatggacgaggcacacttcacagaccctgcttctattgctgcaagaggatacatatcaacacgggtcggtatgggggaagctgctgcaatttttatgacagctactcccccaggaacagcagatgcatttccacaaagcaacgcacctattcaagacgaggagagagacataccagaaagaagctggaatagtggtaacgaatggataaccgattttgcagggaaaactgtctggtttgtcccatctataaaagcaggcaacgatatagctaattgcttaaggaaaaatggtaagaaagtaatacagttgtcaagaaaaacgtttgatactgaatatcagaaaactaaactgaatgactgggacttcgtcgtaacaactgatatctccgagatgggagcgaacttcaaagcggatagagtgattgacccgcggcgctgtctgaaacccgtaatactcaccgatggtccggagagggttatcttagcaggaccaatgcctgtaactgcggcatctgcagcacaaaggagaggtcgtgtgggacgaaatccacagaaagagaatgaccagtatatatttacaggacaaccattaaataacgatgaagatcacgcacattggactgaggctaaaatgctcctcgacaatatcaataccccagaaggtataatccctgcgttgttcgaaccggagcgagaaaaatcagcagcaatagatggagagtacagattaaaaggagaatcaaggaaaacatttgttgaattaatgagacgtggcgatctgcccgtgtggctggcacacaaagtcgctagtgaaggtataaaatacacagacaggaaatggtgttttgacggccaacgtaataatcaaattctagaggaaaatatggatgtagaaatatggacaaaagagggagagaagaagaaattacgaccgcgctggttagacgctagaacctattcggatccgttagctttaaaggaatttaaagatttcgcagcgggcaggaagagtatagctttggacttagtaacagagattggaagagtcccatcccatttggcccatcgtacccgaaacgcattagataacctggtaatgttacatacttcggagcacggaggaagggcatacagacatgccgtggaagaattacctgaaacaatggaaaccctattattgctaggtcttatgattcttttgacaggtggggcgatgctctttctcatatcaggaaaaggcataggaaaaacatccataggactcatttgcgtcattgcatcaagtggaatgctatggatggccgagattccactccagtggattgcttcagctatagtcttagaatttttcatgatggtactgttaatccctgaaccagagaaacaaagaacaccccaagacaatcagttggcttatgtagtaataggcatccttacgctagctgcgataattgctgcaaatgaaatgggactactagaaacaacaaaacgtgatctcggcatgtcaaaagagccaggagttgtcagcccaacctcgtatcttgatgttgatttgcatcccgcaagtgcctggactttatacgcagtagcgacaactgtcatcacacccatgctcagacatacaatagaaaatagtacagcaaacgtcagcctcgccgcaatagcaaatcaagcggtagtattgatgggcctagataaaggatggccaatatcaaaaatggatctaggtgttccgctgttagcactcggttgctactcacaggttaatcccttaacactaacggcagcagtgttgttactaataacacattacgcaattattggacctggactacaagccaaagctacaagagaggcacagaaaagaaccgcggcaggcataatgaaaaacccaacggtggatgggattatgacgattgacctagacccagtaatatatgactccaaattcgaaaaacaattagggcaggtaatgctattagtattatgtgcagtccagctattgcttatgcgtacctcatgggcactttgtgaggcattaaccctagcaacaggacctattacaaccctatgggaaggatccccaggaaaattctggaacacgactatagctgtaagcatggccaatatattcagaggttcatacttagcaggagccggattagccttttcaatcatgaaaagcgtcgggaccggcaagagaggtactggcagccaaggcgaaacattaggcgagaaatggaagaagaaattaaaccaactctctcgcaaagaatttgatctgtataaaagatccggtattaccgaagtagatcgcaccgaagcaaaagagggattgaaaagaggagagataacacatcacgcagtaagcaggggcagtgccaaattgcagtggttcgtagaaagaaatatggtgatacctgaaggcagagtaatagatttaggatgcggcagagggggctggtcctattattgcgcggggctcaagaaagtaacggaagttagagggtacactaaaggcggtcctggacatgaagaaccggttccaatgtcaacatacgggtggaacattgtgaaacttatgtcaggtaaggacgtattttatctaccgccagaaaagtgtgacacattactatgcgacattggtgaatcaagcccttcgccaaccgtagaagaatcaagaacgatccgtgtacttaagatggttgagccatggctgaaaaataaccagttctgtatcaaagtacttaatccctatatgcccacagtcattgaacacttggaaaggcttcaaagaaaacatggcggaatgctagttagaaatccactatccagaaacagcacacatgaaatgtactggatttcaaatggtactggtaatattgtagcttcagtcaacatggtatcaagattgcttttgaatcggttcactatgactcatagaaggccaacaatagaaaaagacgtagatcttggagcgggcacacgacatgttaatgcagaacctgagacccccaacatggacgtaatcggcgaacgcataaaacgcattaaagaagaacacaatagtacatggcattacgacgaggaaaatccttacaaaacatgggcatatcatgggtcatatgaggttaaagcaactggatcggcatcaagcatgattaacggggtagtaaaattactgacaaaaccgtgggacgtagttcctatggtaacacaaatggctatgacagacacaacgccttttggtcaacagcgggtattcaaagaaaaagtagataccagaacaccaagaagtatgccaggcactagaagagttatgggaattactgcagagtggctatggcgtacattgggaagaaataagaaaccacgtctatgtaccagagaagaatttacaaagaaagtaagaactaacgcagcaatgggagccgtcttcacagaagaaaatcagtgggactcagccaaagcagcagtcgaagatgaggacttctggaaactcgtagacagggaacgagaactccataagttagggaagtgcggctcatgtgtatataatatgatgggaaaaagagagaagaaactaggagaatttggcaaggcgaaaggttcacgtgctatatggtatatgtggttaggcgcaagatatctcgagttcgaagcgttaggattcctcaatgaagaccattggttcagcagagaaaattcttattcgggagttgagggtgaaggactacacaaactggggtatattcttcgagatatatctaaaatccccggaggagccatgtatgcggacgatacagcgggatgggatactaggataaccgaggatgatctgcacaacgaagagaaaatcacacaacaaatggatcctgaacatcgacagttagctaatgcaatctttaaattgacttaccagaacaaagtcgttaaggtgcaaagacccactccaactggtactgttatggatattataagcagaaaggaccaacggggaagcggacaggtaggcacatatggcctaaatacgttcacaaatatggaagcgcagctcatacgtcaaatggaaggtgaaggtgttctatccaaggcagatctagaaaatcctcatctcccggagaagaaaattactcagtggctagaaacaaaaggagtggaacgattaaaacgcatggcaatatccggtgatgactgtgtggttaaaccaattgatgatagattcgcgaatgctctccttgcgttaaacgacatgggcaaagttcgtaaggatataccacaatggcaaccatcgaaagggtggcacgactggcaacaagtccctttctgttctcatcatttccatgaactaataatgaaggacggacgcaagctagtagtaccatgtagaccccaagacgaactaattgggagagcaagaatatctcaaggtgcaggttggtcgctacgagaaacagcttgcttggggaaagcatacgcacaaatgtggacattgatgtatttccacaggagagacctaagattagcaagcaatgcaatttgcagtgccgttccagtccattgggtaccaacttcaaggaccacatggagtatacatgctcaccaccaatggatgacaacagaagacatgctgacagtgtggaaccgtgtttggatagaagataatccgtggatggaggacaagacacctgttacaacatgggaagacgttccatatcttggtaaaagagaggatcagtggtgcggtagcctaatcggcttaacctctcgcgcgacctgggcacaaaacatcccgacagccattcaacaagttcgatcattaataggtaatgaagagtttcttgactacatgccatcaatgaagcggtttagaaaagaagaagagagcgaaggcgctatctggtaa

SEQ ID NO: 23274 - RNA, 9873 nt, synthetic construct
  misc_feature 1..9873: note = derived and/or modified CDS sequence (opt6) from DENV-3__KJ189292__SS-prME
  source 1..9873: mol_type = other RNA
acatccctatgcctaatgatgatactacctgcagcactggcttttcatttaaccagtagagacggtgaaccaagaatgatcgttggtaaaaacgaaagaggaaaatccctcctgtttaaaaccgcttcgggaataaacatgtgcacattaatagctatggacctcggagaaatgtgtgacgataccgttacatataaatgtcctcacattactgaggcagaaccggaagatattgattgctggtgtaatctcacgagcacttgggttacctatggaacttgcaaccaagcaggggaacacagaagagacaaacgttctgtggcactagcaccacacgtaggtatgggcctggatacgcggacacaaacatggatgagtgcagaaggggcttggagacaagtagaaaaagtagagacatgggcactacgacaccccggttttacaatactcgcgctatttttagcgcattatattggtacaagcctaacacaaaaagttgttatatttatcttactaatgctagtcactccttcgatgacaatgagatgtgtaggcgtaggtaacagagattttgtagagggtctttcgggcgcgacttgggttgatgtggtactagaacacggaggatgcgtgacgacgatggccaaaaataaaccaactttagacattgagttacagaaaactgaggctacccaactggcaactctacgaaaactctgcatagaaggaaaaattacgaatattactactgatagtcgctgcccaacccaaggggaagcagtcctgccagaagaacaagatcaaaattatgtatgcaaacatacttacgtcgatagaggttggggaaatggttgtgggttatttggaaaaggctcattagtaacatgtgcgaaatttcaatgtttagagcccattgagggtaaagttgtacaatatgaaaatctaaaatatacagtaataatcacagtccatactggtgaccaacatcaagtgggaaatgagacgcaaggtgttacagcagaaattaccccacaggcatcaacaacagaagcaaccctaccggaatacgggacacttggcttagagtgttcaccacggacagggctagattttaatgaaatgatattgcttactatgaaaaacaaagcctggatggtccaccgccaatggttctttgatttaccactaccatggacatcgggagctactacagaaacaccaacttggaatcgtaaagaacttttggttacttttaaaaatgcccatgccaagaaacaagaagtcgtagtcttaggaagccaagaaggagcaatgcataccgcacttaccggagcaaccgaaatccaaaatagcggagggacatctatttttgctggacacctaaaatgtcggttaaaaatggataaattagagctaaaaggaatgagttatgcaatgtgcactaatacctttgtattaaagaaagaagtatcagagacacaacatggtacaatcttgataaaagtggaatacaaaggggaagacgctccgtgtaaaattccgtttagcacagaagacggccatggtaaagcccataatggtagacttatcaccgcgaatcctgtggtaaccaagaaagaggagccagttaatatagaggccgagccacccttcggtgaatctaatattatgataggtattggagataatgccctaaaaataaattggtacaagaaaggctcgagtatcggaaaaatgtttgaagcgacggcaagaggtgcacgccgaatggcaattctcggggacacagcgtgggattttggttcagtaggtggagtgctaaacagtttagggaaaatggtgcaccaaatatttggctctgcttataccgcattattttcgggagttagctgggtgatgaaaattggaattggagttttactaacttggatcggtttaaactcaaagaatacgagcatgtcattttcttgcatcgcaatagggatcattacactgtacttgggcgctgtagtacaagcagatatgggttgcataataaattggaaaggaaaagaacttaaatgcggttcgggcatttttgtgacaaatgaggtacatacttggacagaacaatacaaatttcaagcggatagcccaaaaaggctagcaacagcgatagcaggagcttgggagaacggcgtatgtggaattaggagtacaacaaggatggaaaatctattatggaagcaaatagcgaatgaattaaattatatactttgggaaaataatataaagctgactgtggtagtcggagatataataggcgtactagaacaggggaaaagaactctaactccgcaaccaatggaattgaaatactcgtggaaaacatggggaaaagctaaaatagtaactgcagaaacacaaaactctagcttcatcatagatgggcccaataccccagaatgtccaagcgcaagtcgggcgtggaacgtatgggaagttgaggattacggatttggtgtcttcaccacaaatatatggctacgattacgtgaagtttacactcagctatgtgaccaccgcctaatgagcgcagcggtaaaagacgagagagcagtccacgctgacatgggttactggattgaatcccagaaaaatggatcgtggaaactcgaaaaggccagcctgattgaggtgaaaacgtgtacatggccgaaatcccatacactatggagtaatggggtattagaatcggatatgataatcccaaagagcttagctggtcccattagccagcacaatcatcgtccaggataccacacccaaaccgcaggaccctggcacctcggcaagctcgaacttgatttcaattactgtgaggggacaacggtcgtcatcacggaaaattgtggaaccagaggaccaagtttacgaactacaactgtcagtggtaagctcatacacgaatggtgttgtagatcttgcactttaccacctctaagatatatgggtgaggatggatgttggtacggtatggaaattagacccataagcgaaaaggaagaaaatatggttaagtcgctcgtatctgcaggatcagggaaagttgataacttcaccatgggagtattatgtctagccattctctttgaagaagttatgagaggtaaattcggtaaaaagcacatgatcgcgggagtcttctttacattcgtgctattattatctgggcaaatcacttggagagatatggcacatacactcatcatgataggttcgaacgcatctgaccgcatgggcatgggagtaacttacttagctcttatagccacttttaaaatacaaccctttttagcgttagggttctttcttcggaaattaacttccagagaaaatcttcttctcggtgttgggttggcaatggcaacaactttacagctaccagaggatatagaacaaatggctaatggtatagctctaggtctaatggccctaaaactaataacacaatttgaaacttatcaattatggacggcgcttatctccctaacgtgcagcaacactatttttactttgacagttgcgtggaggactgcaacattaatattggcgggagtatctttgttaccagtttgccagtcaagtagcatgcggaaaacagattggttgcccatggccgtggcagcgatgggtgtacccccgttacctctttttattttcagcttaaaagatactttaaaaagacgctcgtggccattaaatgagggtgttatggctgtgggcttagtctccatattagcttcaagtttattacgaaacgatgttccaatggcgggccccttagtcgccggtgggcttttaatcgcatgttatgtgataaccggtacgagtgcagacttaacggtagaaaaggcagcggatataacatgggaggaagaagcggagcaaacaggggtaagtcataatctaatgattacggtggacgatgatggaacgatgagaattaaagatgacgagacggaaaatatactaacagttttactaaaaacagcgcttctaatagtaagcggtatttttccttacagcatacctgcaacattactcgtatggcatacatggcaaaagcaaacacaacggtcaggtgtactatgggacgttccctcaccacccgagacacagaaagcagaactagaggaaggtgtctataggataaaacaacaaggtatctttggaaaaacacaggtgggtgtgggtgtacaaaaagaaggagttttccacacaatgtggcatgtaaccagaggtgcagtcttaacatataacggtaaaaggcttgagccaaactgggccagtgtcaagaaagaccttatctcatacgggggcggttggcgacttagcacacaatggcaaaaaggagaagaagtacaggtaatagctgttgaaccaggcaagaaccccaaaaattttcaaacaataccgggaacttttcagacaaccaccggtgaaataggtgctatagcactagactttaagccaggcacctctggatcaccaataattaatagggagggaaaagtggtaggactgtatggcaacggagtggttactaagaacggaggttatgtatctggtatcgcacaaacaaacgctgaaccagatggttcaacaccagagttagaagaggaaatgttcaagaaaagaaacttaacgattatggacctacatccaggctcaggcaagacccgtaagtatttaccagctattgtaagagaagctataaaaagacggttaagaactctaatcttagcaccaaccagagtagtagcagcagagatggaagaggcactaaaaggtttgcctatacgataccaaaccacggctacaaaatctgaacatacgggcagagaaatcgttgacttgatgtgtcacgcaacatttacgatgcgtttattaagtcctgtaagggtacctaactataacttgataataatggatgaagcacatttcactgacccagcgagtatagcagccagaggctacatatccactagagtaggaatgggtgaggcagcagctatattcatgaccgctactccacctggtacagcagacgcattcccacaatcaaacgcgcctatacaagatgaggaacgagacatcccagaaagatcgtggaactcgggaaatgaatggataacggattttgcaggaaaaaccgtatggtttgttccaagtataaaagctggtaacgatattgcaaattgtctacgtaagaatggaaagaaagtaatacagttgagcagaaaaacttttgacacagaatatcagaaaaccaaactgaatgattgggatttcgtcgtaacgacagatatttccgaaatgggtgcgaatttcaaagccgatagggtaattgatcccagacgatgtttgaaaccagtaattctgacagacggacctgaaagggtaatactagccggacctatgcccgtgacagttgcatcggcggcacaaagacgagggcgagtgggcaggaatccacaaaaagaaaacgaccaatatattttcacaggtcaaccattaaataatgatgaagaccatgctcattggacagaagctaagatgttgttggataatataaacactccggaaggaattatccctgccctgttcgagccagagcgagaaaaatctgccgcaatagacggtgaataccgtttaaagggtgagagtagaaagactttcgtagaattaatgagaagaggtgacctgcccgtgtggctggctcataaagtggcttcggagggaataaaatacaccgacagaaaatggtgttttgacggtcaacgaaacaaccaaattctagaggagaatatggatgtggaaatttggactaaggaaggagagaagaagaaacttcgcccgagatggttagacgctagaacatactcagaccccctggcacttaaagaatttaaggactttgctgcaggtaggaaatcaatagctttagatctagtaacagagatcggaagagtaccaagccatctagcacaccgaactagaaatgcacttgacaacttggtgatgctgcatacaagcgaacatggagggagagcatacaggcatgcagtcgaagaactaccggagactatggaaactctactcctcttaggattgatgatactattaactggaggagcaatgttgttcttaatatcaggcaaagggataggaaagacgtcaataggattaatttgcgtcatcgcgtccagcggaatgttatggatggccgagataccgctccaatggatcgcatcagctattgtcctagagttctttatgatggtattactgataccggaaccggaaaagcaacgaacaccacaagataaccaattagcctacgttgtaataggcattctaaccctagcagccataatagctgcaaatgaaatggggcttctggaaacgacgaagagggatctagggatgtcgaaagaacctggggtagtatcgccaacatcttacttggatgtggatctccaccctgcgtctgcctggacactttatgcggttgccacaacggttattacccctatgctaagacatacaattgaaaacagtactgcaaatgtttcactagcggcgatagcaaatcaagcggttgttctcatgggtttggataaagggtggcccatttccaaaatggatctgggcgtaccattactggctctagggtgctacagtcaggtcaatccactaactttgactgcagcggtcttactactaattactcattacgctattattggaccaggtctccaagctaaagcgactcgtgaagcgcagaaaagaacggcagcaggtattatgaaaaaccccacagtggacggaatcatgaccattgatttggatcctgttatatatgactcaaaatttgaaaagcagttagggcaagtgatgctattagtgctatgcgcagttcaattgttactcatgaggacgtcttgggcattatgtgaagcattaacccttgcaacaggccctataactactctatgggaaggatcgcccggaaaattttggaatacgaccatagctgtatcaatggcaaacattttccgagggtcatatctagcaggagcaggcttggcattttctattatgaagagtgtcggaacgggaaaaaggggaacgggaagtcaaggcgaaacgctaggggaaaaatggaagaaaaagttaaaccagttatcccgtaaagaatttgatttgtataagaaatcaggtatcacggaggtagatcggacagaggccaaagaaggcttaaaaagaggtgaaataacacatcacgcagtctcaagaggttcagcaaagttacagtggtttgttgaaagaaacatggttattccagaaggtcgcgtaattgacttaggatgcggccgtggaggatggtcatattattgtgcaggacttaagaaagttacagaagtccgtggatacaccaaaggaggacctggacacgaagaacctgtccctatgtcaacttatggctggaatatagtgaagttgatgtctggtaaggacgtattctacttgcctccggagaaatgtgatacattactttgtgatataggagaatcctccccttcaccaacagtagaagaaagtcgaacaataagggtacttaagatggtagaaccgtggcttaaaaataaccagttttgcattaaagttttaaatccttacatgccaaccgtcatcgaacatctagaaagactacagagaaagcatggaggaatgttggtaagaaatccactaagccgtaattcaacacatgagatgtattggatctctaacggaacaggaaatatcgtggccagcgtcaatatggtatcgagactactattaaataggttcaccatgactcatagaagacctacgattgagaaagatgtagatttaggcgccggaacccgtcatgtaaacgccgaaccagaaacacccaatatggatgtaattggagaacgaataaagcgaatcaaagaggaacataattctacctggcactatgacgatgaaaacccgtataaaacctgggcctaccatgggtcctatgaggtcaaagccactggatctgcatcttcgatgataaatggtgtagtaaaactactaaccaagccgtgggacgttgtaccaatggttactcaaatggctatgaccgacacaacaccgtttggacaacagagagtattcaaagagaaggtagacaccagaacgccaaggtccatgccaggaactcgaagagtgatgggtataacagcggaatggctgtggcgaacgctaggacgtaataagaaaccgaggctatgcacaagagaagaatttaccaagaaagttcgtacaaacgccgcgatgggagctgtatttacggaggagaatcagtgggacagcgctaaggcggcagtagaagatgaggacttttggaaactcgttgatcgtgaacgagaactacacaaactaggaaaatgcgggtcgtgcgtatataatatgatgggcaaaagagagaagaaattaggtgaatttggaaaagctaaaggatctagagccatatggtacatgtggttaggagcgcgatatcttgaatttgaagcattgggctttctgaacgaagatcattggttctctagagaaaattcctatagtggagttgagggagaaggattacacaagctaggatatattttgagagatatatcaaagattcctggaggtgcaatgtacgcggacgatacagcaggatgggacacccgcatcacagaagatgacctccacaacgaagagaaaattacacaacaaatggatccagaacaccgacaattagcaaatgcaatatttaaactaacttatcaaaataaggtagtaaaggttcagagaccgacccctacgggcacagtgatggacataatctctcgaaaagaccaacgtggttccggtcaagtagggacatatggtttaaatacatttacaaatatggaagtacaattaattcgtcaaatggaaggtgaaggagtgctatctaaagctgacctggaaaacccacatttacctgagaagaaaatcacacagtggttagaaacaaaaggggtcgagcggcttaaacgcatggcgattagcggtgacgattgtgttgttaaacctattgatgacaggttcgctaatgcattgcttgcactaaatgacatgggcaagataagaaaggacattccacaatggcaaccctctaaagggtggcacgactggcagcaagtaccattttgcagccatcacttccacgaattaatcatgaaagatgggaggaagctggtcgtaccgtgccgcccacaagacgaactaataggtcgcgcaaggattagtcagggagcgggttggtcgttgcgggagaccgcctgcctgggaaaggcatacgcacaaatgtggagtttaatgtacttccacagacgtgacttgagactagcaagcaatgctatatgcagtgcagtacctgtacattgggtgccaacgtcaagaacgacctggagcattcacgctcatcatcaatggatgacaacagaagacatgcttaccgtttggaaccgagtctggattgaagacaatccctggatggaagacaagactccagtcaccacttgggaagatgtcccttaccttgggaagagggaagatcaatggtgtggatcattaataggactaacctctagagccacctgggcacagaatataccaacagctattcaacaggtacgaagtttaatcggtaatgaagaatttctggattatatgcctagtatgaaaagattcagaaaagaagaagaatcagaaggcgctatttggtaa

SEQ ID NO: 23275 - RNA, 9873 nt, synthetic construct
  misc_feature 1..9873: note = derived and/or modified CDS sequence (opt6) from DENV-3__KJ189293__SS-prME
  source 1..9873: mol_type = other RNA
acgagcttgtgcttaatgatgatattaccagcagcacttgcattccatcttaccagtagagacggagaaccacggatgatcgtaggcaaaaacgaaagaggaaaaagtttattattcaaaacagcatctggtataaatatgtgcaccctcatagcaatggatttgggagaaatgtgtgacgatactgttacatacaaatgtccacatataacggaagtagaaccagaagatatcgactgctggtgcaatttaacctctacttgggtcacatatggaacttgtaaccaagctggagaacatcgaagagataaacgatcggttgcgcttgctccgcacgtaggtatgggattagatacaagaacacaaacgtggatgtcagcagaaggagcgtggcgacaagtggagaaagtcgaaacatgggcattaagacacccaggatttacgatactagctctttttctagcacattatattggaaccagtctcacacaaaaagtagtaattttcatattactaatgctagtgacaccatcaatgacaatgagatgcgtaggagtgggaaaccgcgacttcgttgaaggtttgtcaggagccacttgggtagatgtcgtgttagagcatgggggatgcgtgacaacaatggctaaaaacaaacccacgctcgacatcgaattacagaaaaccgaagctactcaattagccacactacgcaaattgtgcatcgaaggaaaaattacgaacataaccactgatagccgttgtcccacacaaggtgaagcagtcctgccagaggaacaagatcagaattatgtatgtaaacatacttatgtggataggggatgggggaacggttgtggattatttggaaaaggttcattagtgacatgtgcaaaatttcagtgtttggagccaatagaaggaaaagttgtacaatacgagaatctaaaatatacagtaataataacggtccatacaggagatcaacatcaagtcggtaatgaaacacagggagtaacagccgagataacaccgcaggctagtacaacggaagcaacactcccagagtatgggacattaggattggagtgttcgccacgtacaggactagacttcaacgaaatgatattgttaacaatgaaaaataaagcatggatggtacatcgccaatggttcttcgatctacccctgccatggacaagcggagccacaaccgagacacctacctggaatagaaaagaattattggtaactttcaaaaacgcccacgccaagaaacaggaagtggtagtccttggtagccaagaaggagccatgcatactgcactaacgggagctaccgaaatacaaaactcgggcggcacatcgatatttgccggccatttaaaatgcagattaaaaatggacaaacttgaattaaaagggatgtcttatgccatgtgtacaaacacattcgtgcttaagaaagaagtaagtgaaacacaacacggcaccattttaataaaagtagaatacaaaggagaggacgcgccttgtaaaatcccctttagtacagaagatggacatggaaaagcccacaatggtaggcttattacagccaatccagtggtcacaaagaaagaagaacctgtcaacatcgaagcagaaccaccgtttggagaatcgaatatcgtaattggaatcggagataacgcactcaaaataaactggtacaagaaagggtcttcaataggaaaaatgtttgaagctacggcccggggagcgcgtcgtatggcaatactaggtgacacagcgtgggacttcggaagcgtaggaggtgtacttaacagtctcggaaaaatggtccaccagatattcgggtctgcctacacggcactattttcaggtgtatcctgggtgatgaaaatagggattggtgtactattaacatggataggcttgaacagcaaaaatacgagtatgtctttctcttgcatagcaataggtataatcactctatacctaggtgcagtagtacaggctgacatgggatgcgtaattaactggaaaggaaaagaactcaaatgtgggtcaggaattttcgtcacaaacgaagttcacacctggactgagcagtacaaatttcaagccgatagcccaaaaaggctcgcgacagcaattgccggtgcgtgggagaatggtgtttgcggtatacggtccacaaccagaatggaaaatctactctggaaacagatagcaaacgagcttaattacattctatgggaaaataatataaaactaactgtagtagtaggggacattattggcgttcttgaacaaggaaaacggactcttacaccacaacctatggaattaaaatattcctggaagacgtggggaaaagccaagatcgtaacagctgaaacacagaatagttcgtttataatcgatggtccgaataccccggagtgcccatctgcatcacgagcctggaacgtttgggaagtagaggactatggatttggagtatttacaacaaatatttggctacggttacgcgaagtttatacacagttatgcgatcatcgtcttatgtccgcagcagtaaaagatgaaagagcagtacatgcagatatgggatattggatagaatcacaaaagaacggttcttggaaactggaaaaagcgagtctaatcgaggtaaaaacttgtacgtggcctaaatctcacaccttatggtctaatggcgtactggaatctgacatgataattcccaaaagtcttgcaggcccaataagccaacataatcacagacccggataccatacccaaacagccgggccatggcatctcggaaaacttgaactcgacttcaactattgcgaaggaacaaccgttgttataacagaaaactgtggcacaagaggacccagtttacgtacaaccacagtctcaggaaaacttatccatgaatggtgctgcagaagctgtacacttccgccattacgatacatgggggaggatggctgttggtacggaatggaaataaggccaatcagtgagaaagaggaaaacatggtaaaatcattggtatccgccggctcgggaaaagttgataactttactatgggagttctttgcctagcaatattatttgaagaggttatgagaggaaagttcggcaagaaacatatgattgcaggcgtatttttcacattcgtgttattattatctgggcagataacctggagagacatggcccataccttaatcatgatcggaagtaacgcaagtgatagaatgggcatgggggtgacatacttagctttaattgcaacatttaaaatacaaccgttcctagctctagggttctttctcagaaaactcacatcacgtgaaaatcttctcttaggagtcggacttgcaatggctacaactttacaattacctgaggacatagagcagatggcaaatggaatagcgcttggattgatggcactaaagctaatcacgcaatttgagacatatcagttatggaccgcgctaattagtctcacctgttccaataccatctttacactaacggtggcatggagaactgccacattaattctggctggagtaagcctacttcctgtttgccaatcatcatccatgagaaaaacagattggctaccaatggcagtcgctgccatgggagtgccgccacttcctttatttatattttctttaaaagacactctgaaacgacgttcctggcctctaaacgagggagtgatggcagtaggattggtaagcattttggcatcatcactgttaagaaatgacgttcctatggctggcccattggtagccgggggtttacttatagcttgttacgtaattacaggaacaagcgcagatcttacagttgaaaaagcagccgatattacctgggaagaagaagctgaacagactggagtaagtcataacttaatgattactgttgatgatgatggaactatgagaataaaagatgatgaaacagaaaatatactaacagtcttattaaaaacagctttactaatcgtttccggtatttttccttacagcatacctgccaccctattagtatggcacacatggcaaaaacaaacccagcgaagtggcgtattatgggacgtgccttcacctcctgaaactcaaaaagcagagctagaggaaggagtgtatcgtatcaaacaacaaggaatttttggtaaaacacaggttggtgtaggagtacaaaaggaaggtgtctttcatactatgtggcacgtcacaagaggcgctgtcctcacgtacaatggaaaacggttagaaccaaactgggcaagtgttaagaaagacttgatatcttatggtggaggatggcgactaagcactcagtggcaaaaaggcgaagaggtgcaagtaatagctgtcgaaccaggtaaaaatcccaaaaattttcaaacgatgccgggcacattccagacaaccacaggcgaaattggtgctattgcattagacttcaaaccagggacaagtggatcaccgataataaatcgagaaggtaaggtcgtaggtctctatggaaatggagtagtcaccaaaaatggaggttacgtatcaggcattgcacaaacaaacgcagaaccagacgggccgaccccggagctggaagaagagatgtttaagaaacgtaatcttacaattatggacctacatcccggaagcggtaagacccgaaaatacttacccgccatagttcgtgaggccatcaaaaggagattgcgaaccttaattctggcaccaactagagttgtagcagctgaaatggaggaagctctaaagggtttacccatccgataccaaacgaccgcaacaaagtcagaacatacggggagagaaattgtagatctcatgtgccatgcaactttcacgatgagactactctcaccagttcgggttcccaactacaatttaatcataatggatgaagcgcactttactgatcctgcctccatagcagccagaggatatatatctactagagtaggtatgggtgaagcggcggctatttttatgacggcaacaccacccgggacggccgacgcatttccacaatcaaacgctcctattcaagacgaagaacgcgatatcccagaacgatcatggaactcaggaaatgaatggataaccgactttgcaggtaaaaccgtatggtttgtcccctctataaaagctggaaatgacattgcgaactgcttaaggaaaaacgggaagaaagtcatacaattgtcaaggaaaacatttgacacagaataccagaaaacaaaattaaacgactgggacttcgtcgttacaacggatatcagtgagatgggagctaacttcaaagcggatcgtgtcatcgatccccgaaggtgccttaaaccggttatcttaacggacggaccagaaagagtgatcctggctggaccaatgccggtgacagcagcttctgctgctcaacgacgaggacgtgtagggagaaatcctcaaaaagaaaatgatcaatatatttttaccggtcagcctttaaataatgatgaggatcacgcacattggactgaagcaaaaatgttactcgataatataaatacgccagaaggaataattccagcactattcgaacctgaacgtgaaaaatctgctgcgattgatggagaatatcgcctcaaaggagaaagcaggaagacattcgtggagctaatgagaagaggtgaccttcccgtatggctcgcacacaaagtcgccagcgaaggcatcaaatacactgaccgaaagtggtgtttcgatgggcagagaaacaatcaaattttggaagaaaatatggatgttgaaatctggactaaggaaggggagaagaagaaactgcggcctagatggctggacgcgcggacgtactccgatccgttagccctcaaagaatttaaagacttcgccgcaggccgtaaatcaatagcattagatctcgttacagaaattggtagagttccttctcatctagcacatcgcacccgaaacgcgttggacaaccttgtaatgctccacacatcagaacatggaggtagggcatatagacacgctgtagaagagttgcctgaaacaatggaaactttgcttttgcttggattgatgatcttattaactggcggtgctatgctttttcttatatcgggaaaaggaatcggtaaaacctctataggtttgatttgtgtcatagcttcgtcgggaatgttatggatggcggagatacccctacaatggattgcatctgcgatcgtgctcgagttctttatgatggttttattgattcctgaacctgaaaaacagagaacccctcaggacaaccaattagcatatgttgtaattggaatactgacacttgcagctatcatcgctgcaaatgaaatgggattattggaaacaaccaaacgagatttaggaatgtcaaaggagcccggagttgtttcacccacctcctacctagatgtagatttacatccagcgtctgcatggacattatacgctgtagccacaacggttattaccccaatgttacgacatacaatagaaaattctacagccaatgttagtctagctgcaatcgctaaccaagcagtcgttttgatgggattagataaaggatggcctataagtaaaatggacttgggcgtcccactattagcactaggatgctactcgcaagtaaaccctcttacactaacagcagctgtactattgcttatcactcactatgctattatcggcccaggcctacaggcgaaagccacaagggaagctcagaaaaggacagcggctggcataatgaaaaaccccacggttgatggtattatgaccattgatcttgatccggtaatatacgactccaaattcgagaaacaactaggacaagttatgttacttgttctatgcgccgtacaattattgttgatgaggaccagttgggctttgtgtgaggcgctgacgttagccacaggaccaatcaccacactgtgggaaggaagtccaggaaaattttggaacacgactatagccgtttccatggcaaatatttttcgaggaagttacctagcgggagcaggacttgcatttagcatcatgaaatcagtaggcactgggaaacgagggacaggatcacaaggggagacactaggtgaaaaatggaagaagaaactaaatcaactctcaaggaaggagttcgatctatataagaaaagtggcataaccgaagtagatcgcacagaagcaaaagaaggtctcaaaagaggggaaataactcatcatgcagttagtcgaggatctgcaaaactgcaatggttcgtagaacgaaatatggtaattccagaaggaagggtaattgatctaggctgcggacgaggtggctggtcctattactgtgctggcctaaagaaagtaacagaagtgaggggatacacaaaaggaggacccggtcacgaagaaccggtaccgatgtctacttatggctggaatatagtaaaactaatgtctggaaaagacgtcttttacctcccaccagaaaaatgcgacacattgttatgcgatattggggaaagttcaccatccccaactgttgaagagagccgcactataagagtactcaagatggtagaaccatggcttaaaaacaatcaattttgtataaaagttttaaatccttacatgcctacggttatcgagcacttagaacggctacaacgaaaacatgggggaatgttagttcgaaacccactaagccgaaatagtacccacgaaatgtactggatttctaatggtacgggcaacatagtagcttctgtcaacatggttagtcgtttgttacttaacaggtttacgatgacacatagacgaccgacgattgagaaagatgttgatctaggcgctggcacacgccatgtgaatgctgagcccgaaaccccaaatatggatgttataggcgaacgcattaaaagaattaaagaggaacacaattcgacatggcattacgacgacgaaaatccatacaaaacatgggcttatcacggttcctatgaagtaaaagccacaggatcagcaagttccatgataaatggagtcgttaaactactcacaaagccctgggatgtggttccgatggtaacccaaatggcaatgacagacacaactccattcggacaacaacgcgtatttaaagaaaaggtcgacacacgtacgccacgatcgatgccaggaacgagaagggtaatgggcatcacagcggaatggttatggaggacattgggcagaaacaagaaaccacgtctctgcactcgggaagagttcacaaagaaggtccggacaaacgcagcgatgggcgcagtctttacagaagagaatcaatgggatagtgcaaaagcggcagtagaagatgaagatttttggaaactggtcgatcgggagcgggaattacataaactgggtaaatgcggttcctgtgtctataatatgatgggaaaaagggagaagaaattaggtgagttcggtaaagctaaagggagcagagcgatctggtacatgtggctcggagccaggtatttagagttcgaggcattaggtttcttaaatgaagaccattggtttagccgagaaaactcatactctggagttgaaggagagggcttacacaaattagggtatatactacgggacatctcaaaaattcccgggggagccatgtatgcagacgacaccgcagggtgggacacacgtataacagaagatgacttacacaacgaggagaaaattacacagcaaatggacccagaacacagacaacttgctaatgccatatttaaattaacttatcaaaacaaagtagtaaaggttcaacgtcctacacctactggcaccgttatggacattatatcccgtaaagaccaacgtggatcaggacaagtagggacatatgggttaaatacctttacaaatatggaagcacagttaattcgacaaatggagggcgaaggagtcctcagcaaagctgacttggaaaatccgcacttgcccgagaagaaaatcacgcaatggctcgaaacgaaaggggttgaacgcctcaaacgtatggcaatcagtggagatgactgtgttgtaaaacctatagatgacagattcgcaaatgcactactcgccctaaatgacatgggtaaagtaagaaaagatattccacaatggcaaccgagcaaaggatggcatgattggcaacaagtccctttctgttcgcatcactttcacgaactaataatgaaagatggcagaaaattggtggtgccctgtcgaccgcaagatgagttgattgggagagcgagaatttcacaaggcgcagggtggagtttaagagagactgcttgtttaggtaaagcatatgcgcaaatgtggtcattaatgtacttccatcgtcgggatttgcgcttagcatctaatgctatatgtagcgcggtccccgtacattgggtaccaacaagtaggacgacatggtcgattcatgcacaccatcaatggatgacaacagaagatatgctaaccgtgtggaatcgcgtatggatagaagataatccgtggatggaggacaaaacgccagtcacaacctgggaagatgtcccatatctcggaaaacgtgaggatcagtggtgtggatcgttgatcggcctcacatcccgagcaacatgggcgcaaaatataccaacagcaattcaacaagttcgatcattaatcggaaacgaagagttcctcgattacatgccatcaatgaaaagatttagaaaagaagaggaaagtgaaggggccatttggtga

SEQ ID NO: 23276 - RNA, 9873 nt, synthetic construct
  misc_feature 1..9873: note = derived and/or modified CDS sequence (opt6) from DENV-3__KJ189294__SS-prME
  source 1..9873: mol_type = other RNA
acttccctttgcttaatgatgatcctacccgcggcattagcgtttcacctgacttcacgtgatggagaaccacgtatgattgtcggtaaaaatgaaaggggaaaatctctactgttcaaaactgcctctggtataaatatgtgtaccttaatagcaatggacctgggagaaatgtgcgacgacactgttacttataaatgcccgcatataacggaagtcgaaccagaagacattgactgttggtgcaatcttacaagtacgtgggtaacttacggaacctgtaatcaagccggagaacatcgtagagataaaaggtctgtagcactcgcgccacatgttgggatgggtttagacacacgaacacaaacttggatgtctgcagaaggagcatggcgtcaagtggaaaaagtagaaacgtgggcactcagacatcctggatttactatcctggccctatttttagcacattatattgggaccagtttgacgcaaaaagttgtcatatttattcttttaatgttggtaacaccatcgatgacaatgcgatgcgtaggagtagggaatagagatttcgtcgaaggcctatcaggtgctacgtgggtcgacgtagtccttgaacatggcggatgtgtaactacaatggctaaaaataaaccaactctcgacatcgaattacagaaaaccgaagccacgcaactagcgacattgcggaaattatgcatagaaggaaaaattacaaacatcactacagattcacgctgccccacccaaggcgaggcagtcttacctgaagaacaagatcaaaactatgtatgcaaacatacatatgtagataggggatggggcaatggctgcggcctatttggaaaaggaagtctggttacttgcgctaaatttcaatgtttagaaccaatcgaaggaaaagttgtccaatacgaaaacttgaaatacacagtgatcataaccgtccatacgggagatcaacatcaagtaggtaatgaaacacaaggagtaactgctgaaatcactccgcaagccagtactacagaggctacactaccagaatatggaacccttggcctagaatgtagccctcgaactggcctcgacttcaacgaaatgatcctcctcacaatgaaaaataaggcatggatggtgcataggcaatggtttttcgacttgcctctaccttggacatctggagcaacgactgaaacaccaacttggaatagaaaagaactgctagtgacattcaaaaatgcccatgctaagaaacaagaagttgtagtattaggctcgcaagaaggagctatgcacacagctctaacaggcgcaacggaaatacaaaattctggaggtacgtcaatctttgcgggtcacttgaaatgtagattaaaaatggataaattagagttaaaaggtatgtcgtatgcgatgtgtactaatacgttcgtcctgaagaaagaagtttctgaaacacaacatgggacaatcctcataaaagtagaatacaaaggtgaagatgcaccctgcaaaataccattttcaacagaagatggtcacggaaaagcccataatggcagattaataacagccaaccccgtcgtcaccaaaaaggaagaaccagtgaatatagaagccgaacccccatttggggaatcaaacatagtaattggaatcggcgacaacgccctaaaaataaattggtacaagaaaggatcatctatcggaaaaatgtttgaggctacagcaagaggtgcacgccgcatggcaatcttgggagacaccgcgtgggactttgggagtgtcggcggagtacttaacagtctagggaagatggtgcatcaaatatttgggagtgcgtatacagcattgttttcaggagtttcttgggtcatgaaaattgggataggcgtattactcacatggattggactcaattctaaaaatacttctatgagcttcagttgcatagccattggaattataacattatatctaggagcagttgtacaagccgatatgggctgtgttatcaactggaaaggtaaagaattgaaatgtggtagtggtatattcgtcactaatgaagtacatacctggacagaacaatacaagtttcaagcggacagtcccaaacggttagccacagctattgccggcgcatgggagaatggtgtttgtggaataagaagtacaacaagaatggaaaacctactttggaaacaaatcgcaaatgaactaaattatatcctctgggaaaataacataaaattaacagtagtcgtaggagatataattggaattttagaacaaggaaagcgcacactaacgccacaacccatggaactgaaatacagttggaagacgtggggaaaagctaaaatagttactgccgagacacaaaattctagctttataattgacgggcctaatacgccagagtgtccatcagccagccgcgcatggaacgtttgggaagttgaggactacggcttcggagtatttacaacaaatatatggcttagattgcgagaagtctatacgcaattatgcgatcacaggctaatgtcggcagctgtaaaagacgagagagctgtccatgcagacatgggatactggatcgagtcacagaaaaatggttcatggaaactagaaaaggcttcattaatagaagtgaagacttgtacttggcctaaatctcacactctctggtcgaatggtgttctagaaagtgacatgatcatccctaaatcattagctggcccaatatcacagcataaccacagaccaggctatcatacacagacggctggtccatggcacctaggcaaactcgaattggacttcaactactgcgaaggcacaacggtagtaatcacggaaaactgcgggacaagaggtccgagtttgagaacaacgactgtgtcagggaagctcattcatgaatggtgttgtcgtagttgcaccctacctccactgcgatatatgggtgaggatggatgttggtacggtatggagatacgaccaataagcgaaaaagaggagaatatggttaagagtctcgtatcagctggatccggcaaagttgataatttcactatgggagtattatgcctcgcaatattgtttgaggaagtaatgaggggcaaatttgggaagaaacatatgatagctggagtatttttcacctttgtcctgcttctcagcggacaaattacgtggcgtgatatggcccatactttaattatgataggtagcaatgcaagcgataggatggggatgggtgttacatacttagcactaatagcaacgtttaaaatccaacccttcctcgcattaggattctttttacgtaaactaacgagcagggagaacctattattgggggtgggactagcgatggcgactaccctgcaactacccgaagatatagagcagatggcgaatggaatcgctcttggcttaatggccctgaaactaataacccaattcgagacctatcaattatggaccgcattaatatctttaacatgctcgaatactatctttacgctaaccgttgcatggagaacagccacattaattttagccggggtttcattacttcccgtttgccaatcttccagtatgaggaaaacagattggttaccaatggcagtagcggcgatgggagtaccacctctacctctattcattttctctctaaaagacacactaaaacgaagatcctggccacttaatgaaggggtaatggcggtgggtcttgtatctatacttgcatcaagtttattgagaaatgacgttcctatggcggggcctttggtcgccgggggattattaatagcctgttatgtaattacagggacatccgcagacttaaccgtagagaaagccgcagatataacatgggaagaggaagctgaacagacaggggtttcccacaatttgatgataactgtagatgacgacggtacaatgagaatcaaagatgatgaaacagagaatatattaacagtattactgaagacggcacttttaatcgtatcgggaatctttccttactcgattcctgcaacactattagtttggcatacttggcaaaaacaaactcaacgcagtggagtattatgggatgtcccctcgccacccgaaacccaaaaagcagaactagaagaaggtgtgtacaggatcaaacaacaaggaatttttggaaaaactcaagtcggagtaggagtacaaaaagaaggagtcttccatactatgtggcatgttactcgtggtgctgttttaacatataatggcaaacgcctagaacctaattgggcttcggtgaagaaagatctgatttcatacgggggaggctggagactatctacacaatggcaaaagggtgaagaagttcaagttatcgcggtcgaacctggcaaaaatccgaagaattttcagacgatgcctggcacatttcaaaccactaccggagagataggagccatagcacttgacttcaaaccaggcacatcaggctctccgataataaacagagaaggcaaggtcgtgggactgtatggaaatggtgtagttacgaaaaacggtgggtatgtcagtggaattgcccaaactaacgcagaaccagatggcccgacacctgagctcgaagaagagatgtttaaaaagagaaacttaaccataatggatttacatccaggctcgggaaaaacgagaaaatatctacctgccatcgttcgtgaggcaattaaacgaagactacggaccttgatattagcacctacccgagtagtagcggcagaaatggaggaagcattaaaaggtctaccaataaggtatcaaaccacggccacgaaatcagaacatacaggaagggaaatagttgaccttatgtgccatgcaactttcacaatgagattgctttcccctgtacgtgtacccaattataaccttataattatggatgaggcgcattttacagacccagcctcaatcgcagctcgaggatatattagtacaagggtgggtatgggtgaagcagcagccatctttatgacggcaactcctccgggaacagcagatgcatttccccaatcaaacgcgcctattcaggatgaagaaagggacattccggaacggagttggaactcaggaaatgaatggattacagattttgcaggaaaaacggtatggttcgtaccgtcaataaaagctggaaatgatatcgccaactgcttgcggaagaacggcaagaaagtcattcaactttccagaaagacatttgatacggaatatcagaagaccaaacttaacgactgggatttcgttgtaactaccgacatatccgaaatgggcgctaatttcaaagcagacagggtcatagaccctcgacgttgtcttaaaccggtaatattaactgatgggccagaaagagtaattttagctggtcctatgccagtaaccgcggcatcagccgcccaacgtagaggtcgagtaggtaggaaccctcaaaaagaaaacgatcaatacatatttacaggccaacctctaaacaatgatgaagatcacgcccattggaccgaagccaagatgctgttagataatattaatactccagaaggaattataccagctcttttcgagccagaacgcgagaaatcagcggccatagatggagaatatcgtctaaaaggagagtctaggaaaactttcgtcgaattaatgcgcagaggcgatttacctgtttggctagctcataaagtcgcaagcgagggaattaaatatacagacagaaaatggtgttttgacggacaacgcaacaatcaaatactagaagaaaatatggacgtggagatatggactaaggaaggagaaaagaagaaacttaggccaagatggctggatgctagaacttactcagatccactcgcactaaaggagttcaaagactttgcggcaggaaggaagtcaatcgcactagatttggtgacagaaataggacgcgttccctcacatctcgcccataggacaaggaatgccctggataatctagtaatgctgcacacatcggaacatggaggtcgagcataccgtcacgcagtcgaggagttaccggagacaatggagacacttctcttattaggacttatgatccttttaaccggcggcgcaatgcttttcctcatatccggaaaaggaattggaaagacatccattggtcttatctgcgtaattgcatctagcggtatgctatggatggcggaaataccactacagtggattgcgtctgctatagttttggagttctttatgatggtgctattaattccggagcccgagaaacaacggacaccccaagataaccaactagcatatgttgttataggtatcttaacgttagcagctataatcgcagccaacgaaatgggattgctagagactacaaaaagggatttaggtatgagtaaggaaccaggtgtcgtatcgcctacatcatatctagacgtcgatctgcacccagcttctgcatggacactctatgctgtagcgacaactgtcataacaccgatgcttagacatacgattgaaaacagcactgccaatgtctcgttagcggcgatcgccaatcaagctgtagtcctaatggggttggataaagggtggcccataagcaaaatggacttaggagtacccttgttagcacttgggtgctactctcaggtgaatccattaacgttaacagcagcagtccttcttctgataacacattatgctataataggaccaggattacaagcgaaagccactagagaagcgcaaaagcgtactgcagcaggcataatgaaaaaccctacagtggacggaataatgacaatcgacttggatcccgtaatctatgacagcaaatttgaaaaacagttagggcaagttatgctcttagtactttgtgctgtacaactcctactgatgcgaacaagttgggcactgtgcgaagcgttaacattagccacaggaccaattactacgttatgggaaggatcaccaggaaaattttggaatacaacaattgctgtttcgatggcaaatatttttcggggaagttatttagcgggagctggattggcttttagtatcatgaagtcagtggggactggcaagagaggaactgggtcacaaggagaaaccttgggtgaaaaatggaagaagaaattgaatcagcttagccgtaaagaatttgacttatataagaaatctggaataaccgaggtagatagaacggaagcaaaagaagggctaaaaagaggtgaaataacccatcatgctgttagccggggatcagctaaacttcaatggttcgtggaaaggaacatggtgataccggaaggtcgcgtaatcgatctaggatgtggacgagggggttggagttattactgtgcaggactgaagaaagtaacagaggtacgaggatacaccaaaggaggtccaggtcacgaagaaccagtcccaatgagtacttatggctggaatattgtaaaacttatgtccggaaaggacgtattttatttaccgcctgagaagtgtgatacccttctctgtgatataggcgaatctagtccatccccaactgttgaagaaagtagaacaatacgagttctcaagatggttgaaccatggttgaaaaataaccaattttgtataaaagtactaaacccatatatgcctacagtgatagaacacttggaaagattacaaagaaaacatggtggaatgttagtaagaaaccctttaagtcgaaattcaacacatgaaatgtattggatatctaatggaacaggtaacatagtggctagtgtcaatatggtatcaagacttttacttaatagatttacaatgactcacagaagaccaactatagaaaaggacgtagatttaggagcaggaacgcgacacgtaaacgcagaacctgaaactccaaatatggatgtgatcggagaaaggataaaacgaatcaaggaggagcataattccacgtggcactacgatgatgaaaacccctacaaaacttgggcgtaccatggtagctacgaagtaaaagcaacaggctcagcgagttcaatgatcaatggagtcgtaaaattactcactaaaccgtgggacgttgtccccatggtgacccaaatggctatgaccgatactacgccctttggccaacaaagagttttcaaagagaaagtagatacgaggacgccaaggtctatgccaggcacgcgaagggttatgggaattactgcagaatggttatggcgaaccttaggtagaaataagaaaccaaggctctgtacgagggaagaatttaccaaaaaggtaagaacaaacgcagccatgggcgccgtttttacggaagaaaaccaatgggacagcgcgaaagccgcagtagaagacgaagatttttggaaattggtagacagagaacgggaactgcacaaattagggaaatgtgggtcatgtgtatacaacatgatgggaaaaagagagaagaaattaggcgagtttggaaaagcaaaaggaagcagggccatatggtatatgtggctgggtgctcgctacctagagttcgaagcgttagggttcctgaatgaagaccactggttttcacgggaaaactcatattccggtgtagaaggagaaggactacataaactcggatacattctgagagatatttcaaaaattccagggggagctatgtatgctgatgacactgcaggttgggatactagaataaccgaagatgatcttcataacgaagagaaaattacccagcaaatggatcccgaacatagacaattggcaaatgcaatatttaagctaacgtatcaaaacaaagtagtcaaagtacaaaggccaactccgacagggactgtaatggatattatatctagaaaagaccaacgtgggagcggacaggtcggaacatatggattaaatacttttaccaacatggaggctcaactaattcggcaaatggaaggagaaggcgtcttgtcgaaagcggatttggaaaatccgcacttaccagagaagaaaatcacgcaatggttagaaacaaaaggtgtagaacgattaaagcgaatggccatatctggagacgattgcgtagttaaaccaatcgatgatagattcgcaaacgctctattagccctgaacgatatgggaaaagtccgaaaggacattccccagtggcaaccaagcaaagggtggcatgactggcaacaagtccctttctgttcccaccactttcatgaattaattatgaaagatggacgaaaattagtagtgccatgcaggccgcaggacgaactcattggtcgagctcgtattagccagggggcgggatggtctttaagggaaactgcttgcctaggtaaggcttatgcacaaatgtggtctctaatgtactttcatcgacgtgatcttagacttgccagcaacgcgatatgcagcgctgtaccggtccattgggtgccaacaagtagaactacttggagtatacatgcccatcaccagtggatgacaacagaagacatgttaactgtgtggaatcgagtttggatagaagacaacccatggatggaggacaagacaccagtaacaacatgggaggacgtaccataccttggcaaacgcgaagaccagtggtgcggttctctaataggtctaacatcgagggctacctgggcacagaatatacctaccgctatacaacaggtaagatcgttaataggaaatgaagaatttttagactacatgcctagtatgaagcgtttccggaaagaagaagaatcggaaggagccatatggtag

SEQ ID NO: 23277 - RNA, 9873 nt, synthetic construct
  misc_feature 1..9873: note = derived and/or modified CDS sequence (opt6) from DENV-3__KJ189295__SS-prME
  source 1..9873: mol_type = other RNA
acaagcctctgcttgatgatgattcttcctgcggcactcgcgttccacttaaccagcagagatggagaaccgagaatgatcgtagggaaaaatgaaaggggaaaatcacttctcttcaaaacggcatcgggaatcaatatgtgtacattaatagcgatggatttaggagaaatgtgtgatgacacagtgacctacaaatgtcctcatataacggaagttgaacctgaagatatagattgctggtgcaatttaacgtctacctgggtaacctatggaacttgtaatcaggcaggagaacatagacgcgataaaagaagtgtggcattagcacctcacgtcggaatgggactcgataccaggacgcagacctggatgagtgcagaaggagcgtggaggcaagtcgaaaaagttgaaacttgggctctaagacacccaggattcacgatattagctctattcctagcacactacattggaacaagcctgacccagaaagtggtaatatttatcttgcttatgttagtgacgccttcgatgacgatgcgttgtgtcggagtaggaaatcgagacttcgtagagggactaagcggtgccacttgggttgacgttgttttagagcacgggggctgcgttaccaccatggccaaaaacaaaccaacactcgatatcgaactacagaaaaccgaagctacacaattagcaacgctaaggaaactttgcattgaggggaaaatcacaaacattacaaccgattccagatgtccgacccaaggcgaagcagtattacccgaggagcaagaccaaaattatgtatgtaaacatacatatgtcgaccgtggctggggaaacggatgcggcctcttcggtaaaggcagcttagtaacatgtgcaaaattccaatgtcttgagccaatcgaaggcaaagtggtgcaatatgagaacttgaaatacaccgtcattataacagtgcatactggagaccaacaccaagttggaaatgagacccagggagtaacagcagagattacaccccaagcgtcaacaacagaggcgacgcttccagaatacggaaccctaggcttagaatgctcacctagaactggtttagactttaatgaaatgatactacttactatgaaaaacaaagcctggatggtacatcggcagtggtttttcgatctcccactaccatggacatcaggggctacaacagaaaccccgacttggaatcgtaaagaattacttgtaactttcaaaaatgctcacgctaagaaacaggaagttgtagtccttgggtcacaagaaggggcaatgcacactgctttaactggtgctacagagatccagaactccggaggcacctctattttcgcgggtcatttaaaatgtagactaaaaatggacaaattagaattgaaaggaatgagctacgctatgtgtacaaatacctttgtgcttaagaaagaagtatctgagactcaacatgggactattctaatcaaagtagagtataaaggtgaagacgctccttgtaaaatcccattcagtacggaagatggacacggcaaagcgcacaacggtcgtttaattacagctaatccagtagttaccaagaaagaagaacctgtcaatatagaagcggaaccaccttttggagaaagtaacattgttatcggaattggggacaatgcattgaaaataaactggtataagaaaggctccagcataggaaaaatgttcgaagctacagcacgaggagcaagacgtatggctatactaggagatacagcatgggactttggatctgtagggggagttctaaacagtctgggtaaaatggttcatcaaatattcggtagcgcttatactgcattattctccggagtatcatgggtcatgaaaattggtatcggcgtattgctaacatggattggcctgaatagtaaaaacacgtctatgagttttagttgtattgcaataggtattatcactctctatttaggtgctgtggttcaggccgacatgggatgtgttattaactggaaagggaaagagttaaaatgtggaagtggaatttttgtaacaaatgaggtacacacctggacagaacagtataaattccaagcagattctcccaaaagattagctaccgccatagctggagcatgggaaaatggcgtatgcggcataagatcaacaacacgtatggagaatctcctatggaaacaaatagcaaacgagttaaattacatactatgggaaaataacataaaattaaccgtagtcgtcggtgatataattggggtacttgagcaaggaaaacgaacacttacacctcagcctatggagcttaaatattcctggaagacatggggtaaagcaaaaatagttacagcagagacacaaaactccagttttataatagatggtcccaatacaccagaatgtcctagcgcaagtagggcgtggaacgtctgggaggtggaagattacggatttggcgtatttactacaaatatatggctgcgtttaagagaagtttacacgcagttgtgcgatcacaggttgatgagtgctgcagtaaaagacgagcgtgcggtacatgcggatatgggatactggattgaaagtcaaaagaatggaagttggaagttagaaaaagcatcgctcatcgaagtcaagacatgcacttggccaaaatcacatactctttggtcaaatggagtattagaatcggacatgataattcctaaatcgttagcaggcccgatttcgcaacacaaccatcgacccggatatcacacacaaaccgcgggcccatggcatttgggaaaattagaattagattttaattattgtgagggaactacggtagtaataacagagaactgcggtactagaggaccgagtttgagaacaactaccgtgtcggggaaattaattcatgaatggtgttgtaggtcatgtaccttacctccgttaagatatatgggagaagatggttgttggtatggaatggaaatacgtccaatctcagaaaaagaagaaaatatggtaaaaagtctggtcagtgcgggttccggaaaggttgataacttcacaatgggagtattatgcttggctatcttgtttgaggaagtaatgagaggaaaattcggcaagaaacatatgattgccggtgtattcttcacatttgttctactgctttctggacagataacatggcgagatatggcacatacactaattatgataggaagtaatgcatctgatcgaatgggaatgggagttacatatctagcattgattgctacatttaaaattcaacccttccttgcactgggattctttttgagaaagttgaccagtagagagaacttattattaggagtaggcttggcaatggcgaccacattacaattacccgaagacatcgagcaaatggcaaacggcattgcattaggactaatggcgcttaaattaattacacagtttgaaacttatcaactctggactgcgctaatttctctcacgtgctcaaatactatattcaccctaacagttgcttggagaacagcgactttgatactcgcaggcgtaagtctattaccggtctgccaaagcagttctatgagaaagactgattggcttccaatggccgttgctgcaatgggagtgcccccattaccactgtttatctttagtttgaaagacactctaaagagaagatcttggcctttgaatgagggtgtaatggcagtaggcttggtctcgatattggcttcttccttactgagaaacgatgtacccatggcagggccactcgtggctggaggccttttaattgcatgctacgtaatcacgggaacatcagccgatttaacggtagagaaggcagctgacatcacgtgggaagaagaagcagaacaaacaggtgtgtctcacaatcttatgattactgttgatgatgacggtaccatgcgtataaaagacgacgaaactgaaaatatccttactgtattactaaaaaccgccttattaattgtatctggtatatttccgtatagcataccggccaccttgctagtatggcatacttggcagaagcaaactcaaaggagcggtgtgttatgggatgttccgagccctccagaaacacaaaaagcggaactagaagagggggtgtatagaatcaaacaacaaggtatattcggtaaaacacaagtaggcgtcggagtgcaaaaggaaggtgtctttcacacaatgtggcacgttacaagaggagcggtattaacttataatgggaaaaggcttgaaccaaactgggcatctgtgaagaaagacttaattagctatggtgggggatggagattatccacgcaatggcaaaaaggagaagaagtacaagtaatagcagtagaacccgggaagaatcctaagaattttcaaacaatgccaggaacattccaaacaacaaccggtgagataggtgcgatagcacttgacttcaagccaggcactagcggaagtcctataatcaacagagagggaaaggtagttggactttacggcaatggagtggtgactaaaaacggcgggtacgtatcaggcatagctcaaacaaacgcggaaccagacggccctacgccggaactagaagaagaaatgttcaagaaacggaatttaacaataatggatcttcaccccgggagcggaaaaactcgcaaatacttaccagcaatagtaagggaagctataaaaaggaggctcagaactctgatactagctcctactcgagttgttgcagcagaaatggaggaggctttgaaaggactaccgattcgatatcagacaactgcaacaaagtcggaacacacaggccgagaaatagttgatctaatgtgtcacgctactttcacaatgagactattatctccggtgagagtccccaactacaatcttataatcatggatgaagctcattttactgacccggcaagcatcgcagcaagaggctatatctcaacaagagtcggtatgggagaagccgccgctatttttatgaccgctaccccacccggcactgcagatgcatttccacagagtaatgcgcccattcaggatgaggaacgagacattccagaaaggtcctggaactcaggtaatgaatggatcacagacttcgcaggaaagacagtttggttcgtaccgtcaattaaagcgggtaatgacatagcaaactgcttaagaaagaatggaaagaaagttatacagttgtcccgtaaaaccttcgatacggaatatcaaaagacaaaacttaacgattgggattttgtagtgacgacagatataagcgagatgggcgcaaacttcaaggctgacagggttatagacccccgaagatgtttaaaaccagtgatcctcacagacggcccagagagggttattttggctggtcccatgccagtaactgcagcatcagcggcacaaaggagaggaagagttggtagaaacccgcaaaaagaaaatgaccagtatatattcacgggacaacctctaaacaacgatgaagatcatgcacactggacagaagccaagatgctattagacaacataaacacgccggaaggtataatccccgcgttatttgaaccagaaagagaaaaatctgcggcaatagatggcgaatataggctgaaaggagagtcaagaaagacatttgtagaactgatgcgtagaggagatctacccgtatggctagcccataaagttgctagtgaaggaatcaaatacacagatcgaaaatggtgtttcgacggacaaaggaacaaccaaattcttgaagaaaacatggacgtagaaatttggacaaaagaaggggagaagaagaaattacgtcctagatggctggacgctagaacctattcggatcccttggctttgaaagaatttaaggacttcgctgcagggaggaagtcaatagccttggatctagtaacggaaataggaagggtcccatcacacctagcgcatcgcactcgtaatgcattagataacctagtaatgttacacacttctgagcatggcggcagagcatatcggcatgcggtagaagaactacccgaaacgatggaaacactacttttattaggattgatgatacttctaacaggcggtgcaatgttgtttctaattagcggtaaaggcattgggaaaacaagtataggactcatatgtgtcattgcgagctcgggcatgttatggatggcggagatacctttgcaatggatagcttcagcaattgtactagaatttttcatgatggtgctactcatcccagaaccagaaaagcagagaacaccacaggataaccaactcgcgtatgtggtgataggtattttaacactagcagcaatcatagcagctaatgaaatgggtctgctagaaacaacaaaacgggacttgggtatgtctaaggaaccaggcgtggtctcgcctacgagttatttagacgttgatttacaccctgcgagtgcatggaccctatatgctgtcgccactactgtaataacaccaatgttaagacatacaattgaaaacagcacagctaatgtgtccttagctgccattgcgaatcaagccgtagtgctcatgggactggacaaggggtggcctatctcaaaaatggacctaggcgtgccactacttgcattaggttgttattcccaagttaatccattaacgcttacagcagcggtactcctgttaataacacactacgccataatagggccaggattacaagcgaaagctacaagagaggcacaaaagaggactgctgcaggaattatgaagaatccaaccgtagatggaattatgacaatcgacctcgatccggtcatctatgactctaaattcgaaaaacaactaggccaagtgatgcttctcgttctatgtgcggttcagctcctactaatgcgaacttcttgggctctctgtgaagctctaacgcttgccaccggtccaatcacaacactctgggaggggagccctggtaaattttggaacacaacaatagctgtatcaatggctaacatattcagggggagttatctcgcaggagcaggattagcattttcaataatgaaaagtgttggaacaggtaaacgtggaactggaagccagggagaaactctaggcgaaaaatggaagaagaaattaaatcaactatctcgaaaagaatttgacctatacaagaaatctggcatcactgaagtagacaggacagaagccaaagaaggacttaagaggggcgaaataactcatcatgctgtaagcagaggctctgccaaattacaatggtttgtggaaagaaatatggtaattccagaaggccgagtaatagatttaggttgcggtcgtggtggttggagttactattgtgcaggactaaagaaagtgactgaagtaagggggtatacaaaaggcggaccaggacacgaagaaccagtccctatgtcaacatacggatggaacatagttaaacttatgagtggcaaagacgtcttctacttaccgcctgaaaaatgcgatacactactatgtgacataggtgaatcatcaccttcccccacagttgaagaaagtagaacaattagagttttaaagatggttgaaccttggctaaagaataatcaattctgtataaaagttttaaacccttatatgccaacagtaatagaacatcttgaaaggctacagagaaaacatggtggtatgctagtaagaaaccctctgagtagaaactcaacgcacgaaatgtattggatatctaatgggaccggcaatatagtagcaagtgtgaatatggtaagtagattgttattaaaccgattcacgatgacacatcgtcgtcccacaattgaaaaagatgtagatttaggtgcaggaactagacatgtcaacgcagaaccggaaacaccaaatatggacgtaataggggaaagaataaaaagaattaaagaagaacataattcgacttggcattatgacgacgaaaatccctataaaacctgggcgtaccatggttcttatgaggttaaggcgaccggttctgcatcatcaatgatcaatggagtagtcaagctcctaaccaagccttgggatgtcgttccaatggtaacacaaatggcaatgacagatacaacacctttcgggcagcagagagtctttaaggaaaaggtagacacgcgaacccctagaagtatgcctgggacaagacgtgtcatgggaatcacggcagaatggctttggcgtacattgggacgtaataagaaaccacgactatgtactagggaagagtttactaagaaagtcagaacgaacgcagctatgggagcagtattcacagaggagaaccaatgggactccgcaaaagctgccgttgaagatgaagatttttggaaattggtagacagagaaagagaattacataagctgggaaagtgtgggtcctgtgtgtataacatgatgggtaaaagagagaagaaactaggggaatttggcaaagctaagggaagcagagctatatggtacatgtggctcggtgctagatacttagaatttgaagcactagggtttcttaatgaagaccactggtttagcagagaaaactcatattcaggagttgaaggtgagggtctacataaactaggttacatattaagagacatttcaaaaattccgggaggggcgatgtatgcagatgatactgcagggtgggacactcgcatcacagaggacgacttgcataatgaagagaaaataacacaacagatggaccccgaacatcgacaattagcaaacgcaatctttaaactcacataccaaaataaagttgtcaaggttcaaagaccgactccaacagggacagtcatggacataatatctcgtaaagatcagcgggggagtggtcaagttggaacgtacggacttaatacatttacaaacatggaggcacaactaattcgacaaatggaaggagagggcgtgttgctcaaagctgaccttgaaaatccacacttaccagagaagaaaataacacaatggttggaaacaaaaggcgtagaaaggcttaaaaggatggccatctcaggagacgactgtgtagttaagccaatagacgacaggtttgcaaatgcactgcttgcactaaacgatatggggaaggttaggaaagacataccacaatggcaaccttcaaaaggctggcatgattggcaacaagtacctttctgctcccatcattttcatgaactcattatgaaagacggacggaaattggtcgtgccgtgccgcccacaagatgaattaattggtagggcccgaatatcccaaggggcaggttggagtctaagagagacagcctgtctgggtaaagcctatgcgcaaatgtggtcactaatgtactttcatagacgggatttaaggcttgcatctaatgcaatttgcagcgctgtccctgttcattgggtaccaacgtcaagaactacctggagcattcatgcccatcaccaatggatgaccactgaagatatgctaacggtatggaatagggtttggatcgaagacaacccgtggatggaagatagaacacctgtaactacgtgggaagacgtaccatatctgggtaaaagggaagaccaatggtgcggttctttaataggtctaaccagtcgtgcgacgtgggcccaaaatatacccacagctatacaacaagttagaagtttgattggcaatgaagaatttctagactacatgccatcaatgaaacggtttcgcaaagaggaggagtcggagggcgcaatatggtaa

SEQ ID NO: 23278 - RNA, 9873 nt, synthetic construct
  misc_feature 1..9873: note = derived and/or modified CDS sequence (opt6) from DENV-3__KJ189297__SS-prME
  source 1..9873: mol_type = other RNA
acttctttatgccttatgatgattttgcctgcagctttggcatttcatttgacatcacgtgatggagaaccaagaatgatagtagggaaaaatgaacgtggtaaatcattgttattcaaaaccgcaagcggaatcaatatgtgtacattaatagcaatggatctgggtgaaatgtgcgacgatactgtaacctacaaatgtccccatatcaccgaagttgaaccggaggatatagattgttggtgtaatttaacgagtacatgggtaacgtacggtacttgcaatcaagccggtgagcatagaagagataaacgaagtgttgcgcttgcacctcatgtaggaatgggtctcgatacaagaacgcaaacttggatgagcgctgagggagcttggcgacaagtggaaaaagttgaaacatgggctctccgacatcctggattcactatcctagctctcttcttggcacactatattggtacctcacttactcaaaaagtagttatcttcattcttttaatgctagtcacaccgtccatgacgatgcggtgcgttggagtaggcaatagggattttgtcgaaggactatccggtgctacttgggttgacgtagtcttagaacatggagggtgtgtcacaactatggctaaaaataaaccgacattagatatcgagctacagaaaactgaggcaacgcaactagcaacattaagaaaactgtgtatcgaaggtaaaataaccaatatcacaacagatagtcgctgtccaactcaaggtgaagcagttctgccagaggaacaagaccaaaattacgtttgcaaacacacatacgttgaccgtggatgggggaacggatgtgggctatttggaaaagggtcactcgttacttgtgccaaattccaatgcctcgaaccaatagagggtaaagtcgttcaatacgaaaacctaaaatatacggtcattataactgtgcatactggagaccaacatcaagtaggtaacgaaacacaaggagtgaccgcagagattacaccacaagcatcaaccactgaagcaactttacctgaatacggtactttgggcttagaatgttcacccagaactggtctcgactttaatgagatgatacttcttaccatgaaaaacaaagcctggatggttcatagacaatggttcttcgatctgcctttaccttggacaagtggggcaacaacggaaactccaacatggaataggaaagaacttcttgtaacgtttaaaaatgcacatgccaagaaacaagaagtcgtagtactcggctcacaagagggtgccatgcacaccgcattaacaggtgcaacggagatacaaaattccggtgggactagcatttttgctgggcatctaaaatgtagactaaaaatggacaaactggaactaaaaggcatgtcttatgcgatgtgtactaacacatttgtattaaagaaagaagtttcagaaacacaacatggtaccattttaataaaagtagagtataaaggggaagatgcgccatgcaaaattccatttagcacagaagatggccacggtaaagcacataacggacgtttaatcacagccaatccagtcgtcactaagaaagaggaacctgtaaacattgaagcggagccacccttcggagaatcgaatattgttattggaatcggcgacaacgctctcaaaataaactggtataaaaaggggagctcaattggaaagatgtttgaagcaacagctagaggggccagaagaatggctattcttggagataccgcctgggacttcggatcggtgggaggcgtgctaaacagcttaggcaagatggttcaccaaatctttggaagcgcttataccgcactattttctggagtaagttgggttatgaaaattgggattggagtcttactaacttggataggactaaattctaaaaatacctcaatgtctttcagttgtatagcgatcggaattattacattgtatctgggagccgtggtccaggcggatatgggctgtgtgattaattggaaagggaaagaactcaaatgcggttctggtattttcgtaacaaacgaagtacatacatggaccgaacaatataaatttcaagcggactcgcctaagcggttagccactgcgatagcaggagcctgggaaaacggtgtttgcggaataaggagtactaccagaatggaaaacctattatggaaacagatagccaacgagttgaattacattctctgggagaataatattaaattaacagtagtagtaggtgatattataggggtattggaacaaggtaaaagaactctaactccccagcctatggagctaaaatatagttggaaaacatggggaaaagctaaaatagtcacggcagaaacgcaaaacagctcctttataatagacggtcccaacacacccgaatgtccaagtgcatcaagagcttggaatgtgtgggaagttgaagactacgggtttggcgtatttactacgaatatttggctacgactgcgagaagtatatacacagctttgtgatcaccgattaatgtcagcggctgttaaagatgaacgagcggttcacgcggacatgggctattggatcgagtcacagaaaaatggcagctggaaactagaaaaagcctcattaatcgaggtaaaaacctgtacatggccaaaaagtcatacgttatggagtaatggcgtactagagtcggacatgataatcccaaaatccttggcaggccccatctcacaacataatcatagaccaggatatcacacacaaactgcaggtccatggcatttaggtaagttagagttagacttcaactactgtgaaggcaccaccgtcgtaataacggagaattgtggtacaagaggaccaagtctccggaccaccactgtatcaggaaagttaatccacgaatggtgttgtaggtcctgtacattgcctccattgagatacatgggagaggacggttgttggtacggtatggagatccgtccaataagtgaaaaagaggaaaacatggtgaagagtctagtcagcgctggcagtggaaaagttgataacttcacaatgggtgtactatgcttagccatactcttcgaagaggtgatgaggggtaaattcggcaagaaacacatgattgctggagtattctttacattcgtgctactgctaagtggacagatcacttggcgagacatggctcatacactaatcatgattgggagcaacgcaagcgatcggatgggaatgggagtgacttatctagcgttgattgctactttcaaaattcagcccttcttggcactgggattctttctaagaaaactaacttcaagagaaaatcttttattaggagtaggattggcaatggcaacaacgctacaattgccagaggacatagagcagatggccaatggtattgccctaggactgatggcactaaaattgataacacaatttgagacttatcaactttggaccgccttaataagtttaacctgttcaaatacgatatttactttaacagtcgcatggagaacggccaccttaattttagctggggtcagtttattacctgtatgtcagtcttcttccatgaggaagactgattggctcccgatggccgtggcagctatgggagtaccaccgctacctctatttatattctccctaaaggacacactgaagcgaaggtcatggccccttaacgagggggtcatggcagttggactcgtgtccatacttgcaagctcattacttcgaaatgatgtaccaatggctggaccacttgtggcaggagggctgttgattgcttgctatgtaatcactggaactagcgcagacttaacagtagagaaagcagctgacattacttgggaagaggaagcggaacaaaccggggtaagtcacaatttgatgattactgtagacgacgatggaacaatgaggataaaagatgacgagacagagaacatactaacagtgctattaaagacagccttattgatagtctccggaatatttccgtatagtatccccgcaacactacttgtctggcacacatggcaaaaacaaacacagagaagcggagttttatgggatgttccgtcaccaccagaaacacagaaagcagagttggaagaaggcgtctatagaataaagcaacaagggatattcggaaaaacccaggttggcgttggcgtacagaaggaaggagtttttcataccatgtggcacgtaactagaggtgccgtcctcacatacaatggaaagaggttagaacctaattgggcatctgtcaagaaagacctaatttcttacggcggagggtggcgcttaagtactcaatggcagaagggagaagaagtacaagtaattgccgtggaaccgggtaaaaaccctaaaaatttccaaactatgccaggaacatttcagacaacaacgggagagattggtgcgatagctctcgatttcaaacccgggacatctggaagtcccattattaacagagaaggaaaagtagtaggattgtacggaaatggcgtagtaaccaaaaacgggggctatgtatcgggaatagctcaaacgaacgcagaaccagacggtcctacccccgaactggaagaggaaatgtttaagaaacggaatcttacaattatggatctacaccccggaagtggcaaaactcgtaagtatctgcctgctatagtacgagaggcaataaaacgaagactgcgtacccttattttggctcctacacgtgtggtagcggctgaaatggaagaggccttaaaaggtttaccaataaggtatcaaaccactgcaactaagtcagaacatacagggagggaaatagttgatctaatgtgtcatgcgacgtttacaatgcgccttctttcaccagtcagagtacccaattacaacctaattattatggatgaagcgcattttacggatcctgcatcaatagcggcgcgaggatatatttccactagggtaggaatgggtgaggcagcggcaatcttcatgacagctactccacccggaacggcagacgcgtttcctcaatcaaatgcgccgatacaagatgaagaacgagacatcccagaaaggtcatggaactccggcaacgaatggatcaccgatttcgcaggtaaaacggtatggtttgttcccagtataaaagcgggaaacgacattgcaaattgtctaaggaaaaatgggaagaaagtaattcaactctcgcgaaagacattcgatactgaataccaaaagacaaaactaaatgactgggatttcgtagtaactacagatatttcagagatgggagcgaatttcaaagcagaccgtgttattgacccaaggagatgtctaaaaccagttattttaacagatgggcccgaaagagtaatactggccggtcctatgccggtaactgcggcatcggctgctcaaaggagaggaagagtaggtcgaaaccctcaaaaagaaaatgatcaatatattttcacagggcaacccctaaataatgacgaggatcacgcacactggactgaggcaaaaatgcttctagacaatataaatactccggaaggaatcataccagcgctatttgaaccagaacgagaaaaatctgctgccatcgacggcgaatatcgtctgaaaggtgaatcacgaaaaacttttgttgaactaatgcgcagaggagatctgccagtctggctagcccataaagtagcctcggagggaataaaatacactgaccgaaagtggtgttttgacgggcaaagaaacaatcaaatcctagaagaaaacatggatgttgagatttggactaaagagggggagaagaagaaactaagaccaagatggctggacgcaagaacctattcagatcctttagctcttaaggagtttaaagacttcgcagcggggagaaaaagcattgcacttgacctggtaacagagatagggcgagtcccctcgcatctcgcacatagaaccaggaatgcactagataacttagtgatgttacatacaagtgaacacggaggccgagcttatagacatgctgtggaagaactgccggaaactatggaaacattattactcctaggtttaatgatattattaaccggaggagctatgttatttctaatatctggaaaaggaatcggtaagacttcgattggtctaatttgcgtaatagcatcctctggtatgttatggatggctgaaatccctttacaatggatagcaagtgccatcgtcctggaatttttcatgatggttttattgataccagaaccagaaaagcagagaacaccacaggacaatcagttggcatatgttgtaattggcatattaactctcgcagctataatagccgccaatgaaatgggcttactggaaaccactaaaagagacttaggaatgtcgaaagaaccaggagtggtaagcccaacatcttatttagatgtcgacttgcacccagcatcggcatggaccctttacgcagtagctactacagttattacaccaatgctaagacacacgattgaaaacagtacagctaacgttagtctcgctgcaatagcaaatcaggcggtagtactcatgggactagataagggctggccaatatccaagatggatctaggtgtgccactgctagcgctaggatgctactcacaagtaaaccccctaactctaacagcggcagtgttactccttataacgcattatgcaataataggcccaggtctccaagccaaagccaccagagaagcacaaaagcgaaccgcagcagggataatgaaaaatccaacagtggacggtattatgacgatagacttggacccagtaatttacgactcaaaattcgaaaaacaattagggcaagtaatgttacttgtactgtgcgcggttcagctgttactcatgaggacatcatgggccctctgcgaggctttaacgttagctaccggtccaataactacactttgggaagggtcacccggcaagttttggaacactactatagcggtgagtatggcaaatatatttagaggttcttacttagcaggagcaggcctcgccttttctatcatgaaatcggtaggcactggaaagaggggaaccggctctcaaggggaaactcttggcgaaaagtggaagaagaaattaaatcaactaagccgtaaagagtttgatttgtataagaaatctggtataacagaagttgataggacagaagctaaagaagggcttaaaagaggtgaaataacgcatcacgcagtttctagaggatcggccaaactccagtggtttgtggaacgaaatatggtcattccagaaggaagagtaatagatctaggttgtggaagaggtggttggagttattactgtgctgggttaaagaaggtcacagaagtaaggggttacactaaaggaggccctggacacgaagaaccagttccaatgtcaacatatggttggaatatagtaaagctcatgtcaggcaaagatgtcttctaccttccgcctgagaaatgtgatactttactgtgtgatataggtgaatctagccctagtcccactgttgaagaatcacggactataagagtcttaaaaatggttgaaccatggttgaaaaataaccagttttgcataaaggtgctaaatccctacatgcccacggtgatcgagcacctagaaagattacaaagaaagcatggaggtatgctggtaagaaatccattatcaagaaatagtactcatgagatgtactggataagcaacggtaccggaaatattgttgccagcgtaaatatggtttctaggctactattaaacaggtttactatgacgcaccgaagacccacaatcgaaaaggatgtcgacttaggtgccggaacaagacatgtaaatgcggaaccggagacaccaaatatggatgtaattggtgaacgaataaaacgaataaaggaagaacataattccacttggcattacgacgacgaaaatccgtataaaacgtgggcataccacggatcctatgaagttaaagcgacggggtccgccagctccatgatcaatggggtagtaaaattattgactaaaccatgggatgtggtacccatggtaacacagatggctatgacagatacaacgccctttggccaacaacgcgttttcaaggaaaaagttgatacgcgtacaccccgatctatgcccgggacccggagagtaatggggattactgcagaatggttatggaggacgctcggccggaacaagaaaccaagactatgtacgcgagaagaatttactaagaaggtccgaacgaatgcagccatgggagcagtattcactgaagagaatcaatgggattcggcaaaggcagcagtagaagatgaagatttttggaaacttgtagatcgagagcgcgaactgcataaattaggaaagtgcggttcatgtgtatacaatatgatgggaaaacgtgagaagaaattaggtgagtttggaaaggctaagggttcacgagctatctggtacatgtggttaggagctcgttatctggagttcgaagccttaggatttttaaatgaagatcattggttctcacgtgaaaactcctactcaggagttgaaggtgaaggtctccacaaactagggtacatattaagggatatatctcaaatcccaggcggagctatgtacgccgatgacacagcgggctgggatacacgaattactgaagacgatctacataatgaggagaaaattactcagcagatggacccggaacatagacaattagcgaacgctatatttaaactaacttaccagaataaagtagtaaaagtacaaagacccacaccaacaggtacagtgatggatataatttcaagaaaagaccaacgtggaagcggacaggtagggacttatggcctcaatacttttacgaacatggaagcacaactaataagacaaatggagggagaaggggtactatctaaagctgacctcgaaaaccctcatctaccagagaagaaaatcacgcaatggctagaaacaaaaggagtcgaacgcttaaaacggatggctataagtggagacgattgcgtagtcaaacccatagatgatcgttttgcaaatgcactacttgctcttaacgacatgggaaaagtaagaaaagacataccacagtggcaaccttcaaaaggatggcacgactggcaacaagtaccattttgttctcatcattttcatgaattaataatgaaagacggacgaaagctagtggttccttgtcgcccacaagatgagctaattggtagagcccgcataagtcaaggggctggttggtcattaagagagaccgcttgcttagggaaagcctacgcacaaatgtggtcattaatgtactttcatagaagggaccttcgattggcctcaaacgctatatgtagcgctgtcccagtccattgggtgccgacttcgagaacaacgtggtctatacatgctcatcatcaatggatgacaacagaggatatgctaacggtgtggaaccgcgtatggatagaggacaacccatggatggaagacaaaacacccgtcactacgtgggaagatgtcccatatcttggcaaacgagaagatcaatggtgtggatcgctgataggattaacatcaagagcaacatgggcacaaaatataccaacggcaatacagcaagtgagatcattaattggaaatgaggaatttttagattatatgccgtctatgaaaagattcagaaaagaagaagagtcagaaggtgcgatctggtga

SEQ ID NO: 23279 - RNA, 9873 nt, synthetic construct
  misc_feature 1..9873: note = derived and/or modified CDS sequence (opt6) from DENV-3__KJ189298__SS-prME
  source 1..9873: mol_type = other RNA
acttcgttatgcttaatgatgatactgcctgcagcgttagcctttcacttgacaagccgtgatggagaaccacgaatgattgttggtaaaaatgaacgtggaaaaagtttacttttcaaaacagcaagcggtattaacatgtgcacattaatagctatggacttaggtgaaatgtgtgatgacactgtgacttataaatgcccgcacattacagaagtggaaccagaagacattgattgttggtgtaacttaacaagcacctgggtaacatatggaacttgcaatcaagcgggagaacacaggcgggataaaaggagtgttgcattagctcctcacgtaggtatgggtttagatacaaggacgcaaacatggatgtccgctgagggagcgtggaggcaagtagaaaaagtggaaacctgggcacttagacacccaggtttcacaattttggcgttatttttagcgcattatataggtacttcacttacgcaaaaagttgttatctttattctgctaatgcttgttacaccatctatgactatgagatgtgttggagtagggaatagagactttgtcgaaggactatcaggtgctacttgggtagacgtagtgctagaacatgggggatgcgtgaccaccatggctaaaaataaacctaccctagacattgaacttcagaaaacagaagctactcaattagcaactttacgtaagctatgtatcgaaggaaaaataacaaatattacaaccgattcacgttgccctactcaaggagaggcggtactaccagaagaacaagatcaaaattatgtgtgtaaacacacatacgtagatagaggatggggaaatggatgtggcttatttggtaaaggatctttggttacgtgtgctaagttccaatgtttagagccaatagaaggtaaggttgtacaatatgaaaacttgaaatatacggttataattacggtccatactggcgatcaacatcaagttggtaacgaaacgcaaggagtcacagctgagattaccccacaagcaagtacaacagaagcgacactacctgagtacggtactcttggtttggagtgttcaccgcgtacgggcttagactttaacgaaatgattctattaacgatgaaaaacaaggcatggatggtgcatagacaatggttctttgatttaccattaccctggacaagcggtgcaacgacggaaactccaacatggaatcgaaaagagctattagtaacttttaaaaatgcccacgcgaaaaagcaagaagttgtggtcttaggttcacaagaaggtgcgatgcatacagcgttgacgggagcaacggaaatacaaaattcaggaggcacgtctatatttgccggtcatttgaaatgtcgcctaaaaatggacaaactagagttgaagggaatgtcgtacgctatgtgtaccaacacttttgtgctaaagaaagaagtatcagaaacacaacatggcacaatattgataaaagtagaatataaaggagaggacgcaccatgcaaaatcccattttctactgaagacggtcatggtaaagcgcacaatggcagattaatcaccgcaaacccggtcgtcaccaagaaagaagaacccgttaatatagaagctgagccaccttttggagaatcaaacattgttataggtataggagataacgcgctaaagataaactggtacaagaaaggatcatctatcggcaaaatgtttgaagccactgcgcggggcgcacgacgcatggccattctaggtgataccgcatgggattttggaagcgtcggaggcgtgctaaatagcttaggaaaaatggtccaccaaatcttcggatcagcatatactgcgctattttcaggagtttcatgggtaatgaagataggaataggagttttattaacatggatagggcttaatagtaaaaatactagcatgagttttagctgcatagccataggaattattacgctgtatctgggtgcggtagttcaggcagatatgggttgcgtaatcaactggaaaggcaaagaattgaaatgtggaagtggcatatttgtaactaacgaggtccacacttggactgaacagtataaatttcaagctgatagcccgaaaaggctcgcaactgcaatcgccggagcatgggaaaatggagtttgtggcatacgatcaactacacgaatggaaaatctactctggaagcagattgcaaacgagttaaactatattttatgggaaaataacattaaactaactgtagttgtaggcgacataatcggagtattggaacaaggtaaaagaacgctaactccacaacccatggaactgaagtattcatggaagacttggggaaaggcgaaaattgtcaccgcggaaacacaaaatagctcgtttataattgacggccccaatacacccgagtgcccaagcgcgtcgcgggcatggaacgtatgggaggtagaagactatggatttggtgtgtttacaacaaatatatggctaagacttagagaagtatacacacaactgtgcgatcatcggctaatgagcgctgcagtgaaggatgaacgagctgttcatgctgatatgggatattggattgaaagccagaaaaatggcagttggaaattagagaaagccagcttgatagaggttaaaacatgtacttggccaaaaagtcatactttatggagtaatggtgtactggagagtgacatgatcataccaaagagtttagctgggccaataagtcagcacaatcacagacctggataccacacacaaactgcaggcccctggcacctaggtaaactagagctagacttcaactattgtgaaggtactacagtagtaataacagaaaactgtggaacgagaggaccctcattacgtacaactacagtatctggcaaacttattcacgaatggtgttgtcgtagctgtacattacctcctttaaggtatatgggagaggatggttgttggtacggaatggagatcagacctataagtgagaaagaagaaaacatggtaaagtcgttagtatcggccgggagtggcaaggtggacaacttcacaatgggggtactatgccttgcaatattatttgaagaagtcatgcgaggcaaattcggcaagaaacatatgatcgctggggtattctttacgtttgttctactcctttcggggcaaattacatggcgaaatatggctcacaccttaatcatgattggaagtaatgcatctgaccggatgggaatgggggtaacttatttggctttaattgcaacctttaaaatacaaccatttcttgcactcgggttctttctaagaaaattgacgagtcgagaaaacttattactaggggttggtttagctatggcaaccactttgcaactgcctgaagacattgagcaaatggccaatggtatcgctcttggcctaatggctttaaaactaataacacagtttgaaacatatcaattatggactgcgctaataagtctaacatgtagcaacacaatatttaccctaacagtagcttggagaactgcaacacttatattagcgggcgtcagcttactacccgtgtgccaaagcagtagcatgcgaaaaactgattggctacctatggccgtagctgcgatgggagtacctccattacccctttttatattttcattgaaagatacgttgaagagacgatcatggcctctgaatgagggtgtaatggccgttggattagtaagtatactagcttcgtcgctcctacgcaacgatgtgccaatggcaggtccattagtagctggtggcctcttgatcgcctgttacgtcataacgggtacttcagcagacttaacggttgagaaagccgcagatataacatgggaggaggaggcagaacaaactggcgttagtcacaatttaatgattacagtagacgacgacgggaccatgcggataaaagatgatgaaacagaaaatatcttaacagtactcctaaaaacggcacttttaatagtttccggtatatttccttactctatcccagcaacactattagtatggcatacttggcaaaaacagactcaacgttctggagtattatgggatgttccatcacctcccgaaacccagaaagcagagctagaagagggcgtatatcggatcaaacaacaaggcatattcggcaagactcaagtaggagtcggagtacaaaaagagggagtattccatactatgtggcacgtaaccaggggtgccgtcttgacttataatgggaaacgcctagaaccaaattgggccagtgtaaagaaagaccttattagctacggcggtggatggcgattatcaactcaatggcaaaaaggagaagaagtacaagttatagctgttgaacctgggaaaaatcctaagaacttccaaaccatgccagggacatttcaaacgaccaccggcgaaattggtgcaattgccttagatttcaagcccggaacctcgggtagtccaatcattaatcgagaaggaaaggtcgtaggattatatggcaatggagtagtaaccaaaaatggaggctatgtaagtggtattgcacagactaacgctgagccagacggaccgacacccgaactggaagaagaaatgtttaagaaacgaaatcttacaataatggatttacaccccggtagtggcaaaactcgtaaatacctacctgcaatcgtaagagaagctattaaaagaaggttacgaacgttgatattagcaccaacccgtgtagtagccgcggaaatggaggaagccctaaagggattaccaatcaggtaccaaacaacagctacaaaaagcgaacatacagggagagagatagtagacttaatgtgtcatgcaacgttcaccatgagattattgtcacccgtccgcgtcccaaattataatctgattataatggatgaggcgcacttcacagatcctgccagtattgccgcacgagggtacatttccactagggtaggtatgggggaagccgcagcaatcttcatgactgcaacgccaccaggtacagcagatgccttcccacagagtaatgcaccaatacaggacgaggagcgagatattccagaaaggtcatggaactcgggcaatgaatggataacagactttgccggtaagacggtttggttcgtcccttcgataaaagcagggaatgatatcgcaaactgtcttcgaaagaatggcaaaaaggttattcaacttagcaggaaaacgtttgacacagagtatcaaaagactaaactcaatgattgggattttgttgtaacaaccgacatcagtgaaatgggtgccaattttaaagcagacagagtgatagaccctcgaaggtgccttaagcctgtgatactaactgacggacccgagagggttatattagccggacctatgccagtaactgctgcttcagcggcgcaaaggcgaggaagagtgggccgtaatccgcaaaaagaaaacgatcagtatatatttacgggtcagccactaaataatgacgaggatcatgctcactggaccgaagccaagatgctactagacaatattaataccccagaaggaattattccagcattgtttgaaccggaacgagaaaaatctgccgctattgacggggaatacaggttaaaaggagaatcaagaaaaacttttgtagaactgatgagaagaggtgatttaccagtgtggttggcccataaggttgcgtcagaagggatcaagtatactgatagaaaatggtgctttgatggtcaacgaaataaccaaatactcgaagagaatatggacgtagaaatatggacgaaagaaggcgagaagaagaaactaagacctagatggttagatgctcgaacatatagcgaccctctagcactaaaagagtttaaagacttcgctgcaggaagaaaatctatagctttggatctggtgacagagatagggagggtgccttcacatttagctcacaggacacgaaatgcactagacaatttagtcatgctccatacatccgagcatggaggcagagcttaccgtcatgcagttgaagaattacctgaaactatggaaaccttgcttttgctaggattgatgatcctactaactgggggagctatgttatttctgattagcggaaaagggataggcaaaacaagtatagggttaatatgcgtaatagcttcatctgggatgctatggatggccgaaattcccttacaatggatagcttctgccatagtacttgagttctttatgatggtcttgttaatacctgaacctgaaaaacaaaggacaccccaagacaatcaattagcttatgtagttattggaatactcacattggctgcgatcatagcagcaaacgaaatgggtttgcttgaaacaacaaaacgagacttaggaatgtcaaaagaaccaggagtagtaagcccaacttcgtatttggacgtagatttacacccggcttccgcttggacactatacgcagtagctacaaccgttataacacccatgctaagacatacaatagaaaactcaacagcgaacgtatcactcgcagcaatagcaaatcaagccgtcgtactcatgggacttgataaaggttggccaataagtaaaatggatttaggtgtgccgttgttagcattaggctgttattcacaagtaaatcctttaactcttacagccgcagtgcttctacttattacacattatgctattattggaccaggcctccaggccaaagcaactcgggaggcccagaaaagaactgcagccggaataatgaaaaaccccacagtagacggcattatgacaatagatctagatccagtaatatacgacagtaaatttgaaaaacaattgggccaagtaatgttgttagtgctgtgcgcggtccaactgctcttaatgagaacaagttgggcactatgcgaagctcttacgttagccacaggtcctatcacgacgctttgggaaggaagtccgggcaaattctggaatacaaccattgcagtaagtatggcaaacatttttcgaggaagttatttagctggagcgggactagcgttttcgattatgaaatcagtgggaaccggaaaacgaggaacggggagtcaaggcgaaactctaggtgaaaaatggaaaaagaaacttaaccagctaagccgcaaagagtttgacttgtacaagaaaagcggaataacagaagtggatagaaccgaggcgaaagaaggtcttaaaagaggggaaattactcaccacgctgtaagcagaggtagtgcaaaactacaatggtttgtggaacgtaacatggtcatacctgaagggagagtaatagatctcggctgtgggcgaggtggatggagttactattgcgccggactaaagaaagtcaccgaagttagaggctacacaaaaggcggcccgggtcacgaagaaccggttcctatgtctacatatggttggaatatagtaaagttaatgtccgggaaagacgtgttctatcttccaccagaaaagtgtgacacattactatgtgatatcggtgaaagctccccaagcccgacagtggaagaaagtaggactatacgagtgcttaaaatggttgagccatggcttaagaataatcaattctgcattaaggtactaaatccatacatgcccactgttattgaacatctagaaagattacaacgaaagcatggaggaatgctagtacgaaatccattatccagaaactctacgcacgagatgtattggatatcaaacggaacaggtaatattgttgcaagcgttaatatggtcagtagactgctgctgaatcgcttcacaatgactcatcgtaggccaacaatcgaaaaagatgtagacctaggtgcgggaaccagacatgttaatgcagaacctgagacgcctaatatggacgtcattggagaacgcataaaaagaattaaagaagaacataattctacatggcattatgatgaagaaaacccttacaaaacatgggcctatcacggatcttatgaggttaaagctaccgggagtgcgtccagtatgattaatggcgttgttaaacttcttacaaaaccatgggatgtcgttccgatggtaactcagatggcaatgaccgatacaactccatttggtcaacaacgcgtttttaaagaaaaagtcgataccagaactccgagatccatgcctggaacacgaagagttatgggaatcacagccgaatggttatggcgaacccttggcaggaataagaaacctcgcctttgtactagagaggaatttacgaagaaagtcagaactaatgctgcaatgggtgcagtcttcacagaagaaaatcaatgggattcagccaaagcagcggtcgaggatgaagacttttggaaattagtagatagagaacgcgaattacataaactgggtaaatgcgggagctgtgtatacaacatgatgggaaagcgagaaaagaagttgggggagttcggaaaggctaagggtagcagagcaatatggtatatgtggcttggcgcacggtatctggaatttgaagcactgggctttctaaacgaagatcactggttttcaagagaaaattcatattcgggagtcgaaggagaaggtttacataaattaggatatatattacgggacatttctaaaattccagggggtgcaatgtatgcggatgataccgccgggtgggataccagaatcacggaggacgatctgcataatgaagagaaaataacccaacaaatggatccagaacatagacaactagcgaacgcgatttttaaactcacgtaccaaaacaaagtcgttaaagtacaaagacctactccaaccggtacagttatggatattatcagcaggaaggaccaaaggggtagtggccaagtcggaacatacggattgaatactttcacaaacatggaagcccagttaattcgtcaaatggagggagaaggcgtgttgtcgaaagcagacctggagaatccccacctacccgagaagaaaataacacaatggttagaaactaaaggtgtagagcggttaaagcgcatggcaattagtggagacgactgtgtagtaaaaccaattgatgatcgatttgccaatgcacttcttgcgttgaatgacatgggaaaagttcgcaaagacatccctcagtggcaaccatcaaaaggatggcatgattggcaacaagttcctttttgctcacaccacttccatgagttgataatgaaagatggcagaaagctagtcgttccttgccgaccccaagacgaattgattggcagagcacgcatatcacaaggagctggttggtccttacgagaaaccgcttgtctaggaaaggcctatgcacaaatgtggtccttgatgtatttccacagaagggatcttagacttgctagtaatgctatttgctctgcagttccagtacattgggtgcccacgtctcggactacatggagtattcacgctcaccatcaatggatgacaacagaagatatgttaaccgtgtggaatagggtatggatagaggacaatccatggatggaagataagactccagttactacctgggaagatgtgccctacctaggtaaacgcgaagatcaatggtgtggtagtttgataggattgacatcaagagcaacatgggcacaaaacataccgacagccatacaacaagttaggagtttgattggaaatgaagaatttctagactacatgccatcaatgaaaagatttcgcaaggaggaggaatcagaaggagccatatggtaa

SEQ ID NO: 23280 - RNA, 9873 nt, synthetic construct
  misc_feature 1..9873: note = derived and/or modified CDS sequence (opt6) from DENV-3__KJ189301__SS-prME
  source 1..9873: mol_type = other RNA
acgtcattgtgtttaatgatgatccttccagccgcattagcattccacttgacgagtcgagacggggagccacgaatgatagtagggaaaaacgaaagagggaaatcattattatttaaaacagcttctggaacaaacatgtgcactttgatcgcaatggatctaggagaaatgtgtgacgatacggtaacatataaatgtccacatataactgaagtggaaccagaggacattgactgttggtgtaacctaacttctacttgggttacatacggaacatgtaatcaagccggtgagcatcggagagataaaagaagcgtagccttggcacctcacgttggtatgggattagatacccggacccaaacttggatgagtgcagagggtgcatggagacaagtagaaaaagttgaaacgtgggcacttagacatccaggatttacaattttggctctatttcttgctcactatattggtacatccttgacacaaaaagtggtaatttttatccttttaatgcttgttaccccttccatgacaatgcgatgtgtgggagttggaaacagagactttgtagagggactttcaggagcaacctgggtagacgttgtattagaacacggtggatgcgtaactacaatggcgaaaaataaaccgactttggacattgagctacagaaaacagaagcgacacaactagctacattacgaaaattatgtatagaaggaaaaataacaaatataacgactgattccagatgcccgactcaaggggaagcagtactacctgaagaacaagaccaaaattacgtttgcaaacatacttatgtagaccgagggtggggaaacgggtgtgggctatttgggaaaggctcacttgttacctgcgcgaaatttcaatgtcttgaaccaattgaaggcaaagtagtgcagtacgaaaatctcaaatatactgtaataattactgtacatacaggcgatcaacaccaagtagggaatgagacccagggagttacagccgaaataacgccccaagcctctacaacagaagccacattgcccgaatatgggacccttggattagaatgttccccaagaacaggactcgactttaacgaaatgatcttactaactatgaaaaataaagcgtggatggtacacagacaatggttctttgacctgcccctaccatggacttccggggccacaacagagacacctacatggaataggaaagaactattagtaacattcaaaaatgcacatgctaagaaacaagaggtggtcgttttgggtagtcaagaaggcgctatgcataccgcgctgaccggagccaccgagattcaaaacagcggaggaacctccatattcgcaggacacctgaaatgcaggcttaaaatggacaaacttgaacttaaaggaatgtcctacgccatgtgtacaaatacgttcgtgttgaagaaagaagtatctgagacccaacatggaacaatactgataaaagtcgaatataaaggagaagatgccccatgtaagataccatttagcactgaagatggtcatggaaaagcgcataatggtagactgatcactgcaaatcccgtagttactaagaaagaagaaccagttaacattgaggcagaacctccttttggggagtctaatatagtgataggcataggagacaatgccttgaaaatcaactggtataaaaagggctcgagtatagggaaaatgtttgaagcaacagcaagaggggcacgtcgtatggcaatattgggtgatactgcatgggattttggttcggttggtggtgtactaaattcattaggaaaaatggtacatcaaatcttcggaagcgcttacacggcgttatttagcggggtttcgtgggtgatgaagataggtataggagtattacttacttggataggcctaaacagcaaaaatacaagcatgtcttttagctgcatagcaatcggaattataacgttatatttaggggcggttgtacaagccgatatgggatgcgtgatcaattggaagggcaaagagttaaagtgtggaagcgggatatttgtaacaaatgaagtgcatacatggactgaacaatacaaattccaagcggattcaccaaaacgactcgcaactgcaatagctggagcttgggaaaacggggtctgcggaataaggtcaactactagaatggaaaatttactatggaaacagattgcaaatgagttaaattatatactttgggaaaataatgtaaaactcacagtcgtagtcggggatattataggagttcttgaaaggggcaaacgaacactcacgccgcagcctatggagttaaagtattcatggaaaacgtggggcaaagcaaaaatagttacagcagaaacacaaaactcctcatttataatcgacgggccgaatacccccgaatgtccatccgcatctcgagcgtggaacgtatgggaagtagaagattatgggtttggtgtcttcacgacaaacatctggctgcgtctaagagaggcatacacgcaactatgtgatcatagactaatgagtgcagcagttaaggacgaacgtgctgtgcatgcggatatgggttactggattgagagtcagaaaaatggatcctggaaattagaaaaggccagcctcattgaagtaaagacttgtacgtggccaaaatcacatacactatggtccaacggcgtcctcgaatcagacatgataataccaaaatctttagcaggccctatatcgcaacataaccatagacctggttaccacacgcagaccgccggtccgtggcatctaggaaaacttgaattggattttaactattgtgaaggaactacagttgtgatcacggagaattgcggaacaagaggcccaagtttacgaacaactacagtctcaggaaaactaatacatgaatggtgttgtagaagctgcacacttccacctctgagatatatgggtgaagacggttgttggtatggtatggaaatacggcctataagtgaaaaagaggaaaacatggttaaatcactcgtgtccgctggctcagggaaagttgacaattttacaatgggcgtcctgtgtttagctatactgttcgaagaagttatgcgtggtaaattcggcaagaaacacatgatagcaggggtattctttacttttgttttgctactctccggacaaataacatggcgagatatggctcacacactaatcatgataggttcaaacgctagtgatagaatgggaatgggggtaacgtaccttgcattaattgcgacgttcaaaatacaaccatttctagcgctaggattctttctaaggaaattgacatcccgagaaaatctgctgctcggagtggggctagcaatggctacaacactacaactcccagaagacattgagcaaatggctaacggtatcgctctaggcttaatggcgctcaaattaataacacagtttgagacatatcagctttggaccgctctcatctctctcacttgcagcaatacaatatttactctgacagttgcatggcgaaccgcaactttaatcctcgcaggcgtttctctgttgccagtgtgtcaatcttcgagtatgaggaaaacagattggctgccaatggcagtagcagccatgggggtaccgccactcccacttttcatcttcagcctcaaagatacattaaagagacgatcttggccactaaacgagggagtcatggctgttggcctagttagtattcttgcatccagtctacttagaaatgacgtccctatggcggggcctctcgtcgcaggcggcttgctaattgcctgctatgtaattaccggaacaagtgctgacctaacggtagaaaaagcagcagatattacgtgggaagaagaagctgaacaaacgggagttagtcataatttaatgataactgtagatgatgatggaactatgcggattaaagatgacgaaaccgaaaatatactaaccgtgctactaaagactgcactattaattgtctccgggattttcccgtactcgatcccagcaacattgttagtctggcacacgtggcaaaaacaaacccaaaggtcaggagtcttgtgggatgtaccaagcccaccggaaactcagaaagcggagctcgaagaaggagtgtatagaatcaaacaacagggcatattcgggaaaactcaagttggtgtgggtgttcaaaaggaaggagttttccatacaatgtggcacgttacaagaggcgctgtattaacttataatggcaaaagactggagccaaattgggccagtgtcaagaaagacttaataagttacggagggggatggcgactcagcacgcaatggcaaaaaggagaagaagtacaagtgatagcagtagaaccaggcaaaaatcctaaaaattttcaaacaatgccaggaacattccaaacgacaacgggagagattggagcgattgcattagattttaaaccgggaacatcaggatcaccaataatcaatcgtgagggcaaagtagttggattatacggaaacggcgtagtcaccaaaaatgggggatatgtttccggaattgcccagactaacgccgaacctgatgggccaacaccagaattagaagaagaaatgtttaagaaacggaacttaacaattatggacttgcatcccggctcaggtaaaaccaggaaatacttaccagccatagtcagagaggcgataaaaagaaggttgaggactctaatcctagctccaacccgggtagttgcagcagaaatggaagaggcactaaagggattgccgataaggtatcaaaccactgcgacgaagtctgaacataccgggagagaaatcgttgacttaatgtgtcacgcaacatttacaatgcgattgctatcaccggtcagagtaccaaattataatttgataattatggatgaagcccactttacagatccggcttccattgcagccagaggatatatcagcactcgagttggaatgggggaagcagcagctatttttatgactgctacccctccaggtaccgcagatgcatttcctcaatccaacgctccaatacaggatgaagaaagggatattccagaaagatcctggaactcgggcaatgaatggatcacagatttcgcaggaaaaacagtatggtttgtgccaagtatcaaagctgggaacgatattgccaactgcttgcgcaagaatgggaagaaagttattcaattaagtaggaaaactttcgatactgaataccagaaaacaaaattaaatgactgggattttgtagtaaccacggatatatcggaaatgggcgctaattttaaagcagacagggtcatagacccccggaggtgtttaaaacccgtaatactaactgatggtccagagagggtcatactggcaggaccaatgccggtaacagcagcttcagctgcgcagcgacgaggtagagtaggtagaaatccacaaaaagagaacgaccaatacatattcacaggacaaccgcttaataatgatgaagatcacgcacattggactgaagcaaagatgctgttagacaatattaatacacccgaaggcataattcccgctttatttgagcccgaacgtgaaaaatcagcagcaatagatggagaatacagattaaaaggcgagtctcggaaaacgtttgttgagctgatgcgaagaggagatctcccggtatggcttgcacataaggttgcaagtgaaggcataaaatacactgatagaaagtggtgcttcgatggacaaagaaataatcaaatattagaagagaacatggatgttgaaatctggactaaggaaggagagaaaaagaaattgaggcctcgctggctagatgctagaacttattcggatccactggcactgaaagaatttaaagatttcgcagccggtaggaaatctatagcactggacctagtaaccgaaatagggagagtgccttctcacctcgcccatagaacacggaatgcactagataatttagtcatgcttcacacaagtgaacacggcggccgcgcatacagacacgcagttgaagaattaccggaaaccatggaaacgctactactgttgggcctaatgatattgctaacgggaggtgcaatgctgtttctgatcagcggaaaaggtataggtaaaacatcaatagggttgatatgtgtgatagcatcgtccggaatgctttggatggctgaaataccattacagtggatagctagtgccatagtgttggaatttttcatgatggtcctcttagttccggaaccagaaaaacaaaggacaccccaagataaccaactcgcttatgtcgtcattggcatcctaacattagctgccataatagctgctaatgaaatgggtttactcgagactaccaagcgcgatttaggaatgtcaaaggaacccggagtcgtcagtccaacatcttacttagatgttgatctacatccagcgtccgcttggacactctatgcggtagcaaccacggtcattacaccaatgctgcgacatactatagaaaatagtacagcgaatgtgagtttggcggccatcgccaatcaggctgtagttcttatgggcctagataagggatggcctatatcaaagatggacctaggggttccattactggctttaggctgctattctcaggtcaatcccttaacactgaccgctgcagttttactacttataacacactacgcgataattggccctggccttcaagcgaaggctacaagagaggcgcagaaaaggactgcagcgggaatcatgaagaatccgactgttgatgggataatgaccatagacttagacccagttatatatgacagcaaattcgaaaaacaattgggccaagttatgctacttgtgctttgcgccgtacaattattgctaatgagaacgtcgtgggccctatgtgaagcgttaacgctagccactggtccgataacaacactatgggaaggttcgccaggcaagttttggaacactacaatcgcagtatcaatggcaaacattttcagaggatcgtacctagctggcgctggactagcatttagtataatgaaatctgtagggacgggaaaacgaggaacagggagtcaaggagaaacgttaggcgaaaaatggaagaagaaactgaaccagctctcgcgtaaagaatttgatttatataagaaatctggcataaccgaagttgatcgaactgaagctaaagaagggctaaagagaggtgaaattacgcatcatgccgttagccgaggaagtgctaaattacaatggtttgtagaacgcaacatggtaatccccgaaggacgagttatagatttaggttgcggaagaggaggttggagttattattgtgctggactaaagaaagttaccgaggttcggggatacaccaaaggaggaccaggtcacgaagaaccagtaccaatgtccacttatggctggaacattgttaagctgatgtccggtaaggatgtattttatttaccaccagagaaatgcgacactttgttatgtgacataggtgaaagtagcccttcgcctacagtggaggaaagtaggacaataagggtattaaaaatggtagagccttggcttaagaataatcaattttgcatcaaagtactaaatccatacatgccaacagtcatcgaacatcttgagaggttacaacgaaaacatgggggtatgttagttaggaacccgctcagccgaaattctacgcacgaaatgtattggatatcaaatggaacaggcaatattgtagccagtgtaaatatggtatcccgattactattaaatagattcactatgacacatagacggcccaccatcgaaaaagatgtagatctaggagccggaacccgtcacgtaaatgcggaaccagaaacgccaaatatggacgtaataggtgaaagaataaaacgaataaaagaagaacacaattctacttggcattatgatgatgagaatccatataaaacgtgggcgtatcacggaagctatgaggtaaaagccactgggagtgcttccagcatgattaacggcgttgtaaaactattaacaaagccctgggacgtggtccctatggtgacccaaatggcgatgactgatacaacacctttcggtcagcaacgagtcttcaaagaaaaagttgacacgcgaacgccgagaagcatgccaggcacaagacgggtaatgggaataaccgccgaatggctctggagaacattaggaagaaacaagaaaccacgtctttgtacgagagaagaatttacaaagaaagtgcgaacaaatgcggcaatgggggccgtatttactgaagaaaaccagtgggatagcgctaaggcagcagtagaagacgaggacttttggaagctagttgacagagaacgggagctacataaactcggtaaatgtggaagctgcgtttataatatgatgggaaaaagagaaaagaaactaggggagttcggtaaagcaaaaggctccagggcaatttggtatatgtggttaggggcccgatacctagaatttgaggctctaggctttttgaacgaagaccactggttctccagagagaactcgtatagcggcgtcgaaggtgagggcttgcataaactaggatatatattacgagatatctccaaaatccctggtggggccatgtatgctgacgacaccgctggctgggatacgcgaattacggaagacgatttacacaacgaagaaaagatcacgcaacagatggaccccgagcatcggcagttagccaacgcaatatttaagttgacgtatcagaataaagtagtgaaagttcaacggccgacacctacaggtacggtaatggacattatatcccgtaaggatcaacgcgggagcggacaggtcggaacatatggtctaaatacgtttacaaatatggaggctcaacttatacgacaaatggaaggagaaggagtcctatcaaaagcggatctagaaaaccctcatcttcccgagaagaaaatcacgcaatggttagagactaaaggtgtcgaaaggttaaagcgaatggccatttcaggagacgactgcgtagtaaagccaatcgacgacaggtttgccaacgctttattagccttaaatgatatgggaaaagtccgaaaagatatcccgcaatggcagcctagcaaaggatggcacgactggcaacaagttccattttgcagtcatcacttccacgaactcatcatgaaagacggtcgaaagttagtcgtaccttgcaggccgcaagacgaactaataggtagagctagaattagtcaaggggctggttggagcctgagagaaacagcgtgtctcgggaaagcatatgcacaaatgtggagtttaatgtattttcatagaagagatttacgattagcatctaacgcaatttgttctgcagtaccagttcactgggtgccaacctcgaggactacttggtcaatacatgcacaccatcaatggatgacaacagaagatatgcttacagtatggaatagagtatggattgaagataacccttggatggaagataaaacaccagtaactacctgggaagacgtcccctacttgggtaaacgcgaagatcaatggtgtggtagtctcatcggcttgacatctcgagcaacatgggcgcaaaatatcccaacagcaatacaacaagtccgttccttaataggcaacgaggagttcctggactacatgccatcaatgaaaaggttcagaaaggaggaagagtctgagggggcaatctggtag

SEQ ID NO: 23281 - RNA, 9873 nt, synthetic construct
  misc_feature 1..9873: note = derived and/or modified CDS sequence (opt6) from DENV-3__KF955456__SS-prME
  source 1..9873: mol_type = other RNA
acgagcttatgccttatgatgatcctcccagcagcactagcatttcacctaacatctcgggacggggaacctaggatgatagtcggcaaaaatgaacggggcaaatcactgctatttaaaacagcaagtggaattaatatgtgcacactaatagctatggacctaggcgaaatgtgcgatgataccgtgacctacaaatgccctcatatcgcagaagttgaaccagaggatatagactgctggtgcaacttaacttctacatgggtcacatacggaacttgcaatcaagcgggcgaacataggcgtgataaacggagtgtcgcacttgctccccatgttgggatggggttagatacaagaacacaaacgtggatgagtgcagaaggcgcatggcgacaagtggaaaaagttgaaacttgggcactacgccacccaggcttcacaatattagctctgttcttagcacattatatcggtaccagtctcacacaaaaagtagtaatttttgtcctcttgatgttagtaacaccgtcaatgaccatgcgttgcgttggagttgggaatcgagattttgtagaaggtttaagcggagcaacatgggtagatgttgtactagaacacgggggatgtgtcacgaccatggccaaaaacaaaccgacactcgacattgagctccagaaaaccgaggctacgcaattggctactctacgtaaattatgcatcgaaggaaaaataacgaatatcactacagacagtagatgcccaactcagggagaagcagtgctgcctgaagaacaagaccaaaactacgtgtgtaagcacacatacgttgacagaggatggggaaacgggtgtgggttattcggaaaaggctctctagtaacgtgtgcaaaatttcaatgtctagagcccatagaaggcaaggttgtacaatacgaaaatctaaagtacactgtaattataacagtgcatactggagatcaacaccaagtcgggaatgaaacgcaaggagtaacagcggaaataacccctcaggcaagcacaacagaggcaatactaccggaatatggcacactaggtttagaatgcagcccacgtactggactagattttaacgaaatgatcttgttgacaatgaaaaataaagcgtggatggtccatagacaatggttctttgaccttcccttgccttggacgagcggagcaacgacggagactcctacttggaacagaaaagaacttctcgtaacattcaaaaacgcacacgctaaaaagcaagaagtagtagttttggggtcacaagaaggcgcgatgcacactgcactaacaggcgcaacagaaatccaaaatagcggcggaacttcaatattcgcaggccacctcaagtgtaggttaaaaatggataaattagaactaaaagggatgtcatatgctatgtgtacaaacacatttgttttgaagaaagaagtatccgaaactcaacatggaacaattctgattaaagtggaatataaaggcgaagatgcaccatgcaaaataccgtttagcacggaggatgggcagggtaaggcacacaacggacgtcttataactgcaaatcctgtcgtcactaagaaagaagaaccagtaaatatcgaagcagaaccaccatttggcgaatcaaatatagtgataggaataggtgacaatgcgcttaaaatcaactggtacaagaaagggtcgagcataggtaaaatgttcgaagctaccgcacgaggagcgagacgtatggcaatcttgggtgatacggcgtgggattttggcagcgttggtggtgtactcaatagtttgggcaagatggtacatcagatttttggaagtgcgtacactgcattattctcaggcgtatcatgggtgatgaaaataggtatcggagtgttgttgacatggatcggcctcaactctaaaaacacaagtatgtcattttcatgcatagccatcggcataattactctgtatttaggagccgtagttcaagctgacaccggttgtgtgataaattggaaaggaaaagaactaaaatgcggctctggtatatttgtcactaatgaagtccacacatggactgagcaatacaaatttcaagcggactcgccaaaacgtctggcgacagctatcgccggtgcttgggaaaatggtgtatgtggaatacgctctaccacccgaatggagaatttactctggaaacaagtggcgaacgaattaaattatattttatgggaaaacaatattaaattaactgtcgtagtaggagatataataggagtattggagcagggtaaacgcactttgacaccacaaccgatggaactgaaatacagttggaaaacatggggtaaagcaaagattgtaacagctgagactcaaaattcatccttcataatcgatggtccaaatacaccggaatgtcccagtgcatcgcgtgcctggaatgtatgggaggtggaagactacggatttggtgtatttacaaccaacatatggttaaagttaagagaagtatatacacaactatgcgatcaccgccttatgagtgcagctgtaaaggacgaaagagcggtccacgccgatatggggtactggatagagagtcaaaagaacggatcatggaaattagagaaagcaagcctgatagaagtaaagacgtgtacctggccgaagtcacatactctatggtcaaacggcgtactagaaagtgacatgataataccaaaaagtttggcaggacctataagtcaacataattaccgacctggttaccacacccaaacagctggtccatggcacttgggtaaactagaactcgatttcaactactgtgaaggtacaactgtagtcataaccgagaactgtggtacacgaggtccttcattacgtacaacaacagtcagtggcaaattaatacacgaatggtgttgccgcagttgtacactcccaccgctacgctatatgggcgaagatgggtgttggtatggaatggaaattagacctatatcggaaaaagaagaaaatatggtaaaatctttggtgagtgcgggaagcggcaaagtcgacaattttaccatgggagtgctatgcttagctatattatttgaagaagtaatgcgtggcaagtttggtaagaaacacatgatagctggagttttctttacattcgtattactattatctggccaaataacatggcgagacatggcacacaccctagtaatgattggcagcaatgcaagtgatcgcatgggtatgggagttacataccttgcgctcattgcaacattcaaaatacaaccatttttagcattaggattctttctaagaaaacttacatcacgagaaaatttactattaggcgttggtttggccatggcaacaacattacaactcccagaagacattgaacaaatggcgaacggaattgcattaggactaatggcccttaaacttataacacaatttgagacttatcaactttggactgccctaatttcattaacatgttccaacactatatttactttaacagtggcgtggcgaaccgctacattaatacttgcaggggtatctttactgcccgtgtgccaatcatcgtcgatgagaaaaagcgactggctgccaatgacagttgcagccatgggcgtccctccactaccgttgttcatatttagcctaaaagacactctaaaacgaagatcttggccattgaacgaaggagtaatggctgttggtttagtaagcattttagctagttcactacttagaaacgacgttccaatggctggtccattagtggccggtggacttttaattgcgtgttatgtcataactggaacatcagctgatctgacagtagaaaaggctgcagatgtcacatgggaagaagaggcagagcaaacgggcgtctcgcataaccttatgatcactgtcgatgacgacggaacaatgcgcattaaagacgacgagaccgaaaatatactgaccgtgctacttaagacagcgctacttatagtatcgggaatttttccttatagtatacctgcgacattgctagtatggcacacatggcaaaaacaaacacgtagaagtggagtattatgggatgttcccagccctccagagacacaaaaagcagaattagaagaaggcgtatatcggataaagcaacaaggaatttttggaaaaactcaggtaggggtcggcgtacaaaaggaaggagtatttcacactatgtggcatgtaactaggggtgcagttttaacgtacaatggaaaaaggctcgaaccaaattgggcatccgtaaagaaagacttgatctcctatgggggaggttggaggctaagcgcacaatggcagaaaggggaagaggttcaagtcattgcagtagaaccaggaaagaatccaaagaactttcagaccatgccgggtacgtttcaaacgactacaggggaaatcggtgcaattgcccttgatttcaaacccggaacaagtggatcacccataataaatagagaagggaaggttgtcggactatatggtaacggtgtagtcaccaaaaatggcgggtatgtatctggcatagcacaaactaacgcagaaccagacggccccacacctgaactagaagaagaaatgtttaaaaagcgcaaccttactatcatggaccttcacccgggatctggaaaaacacgtaaatatttgccagcgatagttagggaagcaataaaacgacgactcaggacgttaatattagctcccacacgagtcgtagcagcagaaatggaagaggctttaaaaggactgcctataagataccaaacaacggcgacaaagtcagagcacacaggaagggaaattgtggatctaatgtgtcacgccacttttacaatgaggttactcagcccagtaagagtaccaaactataacctcatcataatggacgaagcacattttactgacccggcctcaatcgcggctagaggctacatatccactcgagtaggaatgggagaagctgcagctatatttatgaccgctaccccgccaggaacagcagatgccttcccccaaagcaacgcaccaattcaagatgaagaaagagatattcctgaaagatcctggaacagtggaaacgaatggataaccgattttgcaggtaagactgtatggttcgttccgagtataaaagccggaaatgacatagcgaactgtctacgtaagaatgggaagaaagtcatccaattgagtcgaaagacctttgacaccgaatatcaaaagactaaactaaatgattgggactttgtagttacgacagacattagcgagatgggagccaacttcaaagcagaccgggtgatagatcctagaagatgccttaagccagttatactcaccgatggaccagaacgtgttatactcgctggcccaatgcccgtaactgcggcttccgcagctcaacgacgcggtagagtaggacggaacccacagaaggagaatgaccaatacatatttaccggccaacctttaaataacgacgaggaccatgcacactggacagaagcaaaaatgttactcgacaatatcaatacaccagaaggaataatacctgcactgttcgaaccggaaagggaaaaatcagcagcgatagatggggaatatcgattaaagggagaatcgaggaagacttttgtagagcttatgagacgaggagatttaccggtatggctagctcacaaagtagcatctgaaggaatcaaatataccgatcgaaaatggtgttttgatggccagcgaaacaatcaaattctagaagaaaatatggatgtagaaatctggactaaagagggagagaagaagaaactgaggcctagatggttggacgcacgtacatattcagatccattggcgttaaaagaatttaaagactttgcagcaggaaggaaaagtatagcattggatctagtaaccgaaatcggtagagtaccaagtcatcttgcacaccgcacccgtaacgcattagataatctcgttatgttgcacacatcagaacacggtggaaaggcataccgccatgcagtcgaagaactccctgaaacgatggaaaccttattgttattaggccttatgatattgctaacgggtggtgctatgctattcctcatttcaggaaagggaatcgggaagacaagtataggtctcatatgtgtaatagcatcgagcggcatgttatggatggctgaaattcctctacaatggattgcttcggcaattgtattagagttctttatgatggtcttactgattccagaaccagaaaaacagcggacaccacaagacaatcaattagcttacgttgttatcgggatcttaactctggccgcaataatagctgcaaacgagatgggactacttgaaacaactaaaagagacctgggaatgagcaaagagccaggcgtagtaagtcctacaagttacttagatgttgacttgcaccccgctagcgcatggacactgtacgcagtagcgacaaccgttataacaccaatgttaaggcacacaatagaaaatagtactgcgaatgtcagcttggcagcgatcgcgaatcaagcggtagtactaatgggactcgacaaagggtggcccatatcaaagatggatcttggggttcccttgttagctctaggatgctattctcaagtcaaccctcttacactcacggcagctgttcttttattaatcacacattatgcgataataggacccggactacaagctaaggcaacccgcgaggcacagaaaagaacagcagctggaattatgaaaaatccaaccgtagatggtataatgaccatagacttagatcccgttatctatgattcaaaattcgaaaagcaacttggccaagtgatgcttttagtactatgtgcgattcaactactactcatgagaacttcctgggctctctgcgaagccctaacgctggcgacaggaccaatcacaacactgtgggaaggaagcccaggtaaattctggaataccacaattgcagtatctatggcgaatatttttagggggtcatatcttgctggggcgggtctcgctttctcgatcatgaagtctgtaggaaccgggaaacgagggaccggatcacaaggggaaaccctaggagagaaatggaagaagaaactgaatcaattatcgcgaaaagaatttgacctatataagaaaagtggaattaccgaggtcgatcggacggaagccaaagaaggcttaaaaagaggagagatcactcaccatgctgtcagccggggtagtgcaaagctacaatggtttgttgaaagaaacatggtaatcccggaaggacgcgtcatagatctaggttgtggcaggggcgggtggagctattattgcgcaggattaaagaaagtaactgaagtgagaggatacacaaaagggggtccaggacacgaagaacccgtcccgatgagtacatatggttggaatattgttaaattgatgtcaggaaaagatgtcttttatctgccaccagaaaaatgtgatacactattatgcgatattggcgagtcttccccatcccctacagtagaagagtcaagaacaataagagtattgaaaatggttgagccttggctgaaaaataaccagttctgcataaaggtattaaatccatacatgcctactgtaattgaacacttggaaagattacagaggaaatatggtggaatgttagtaaggaaccctctcagcagaaattccacacacgagatgtattggatcagcaatggaacggggaacattgtcgcatccgtcaacatggttagcagactattgttaaatcgattcacaatgacacacaggagaccaaccattgaaaaggatgtcgatctaggggcagggactcgccacgtaaacgccgaaccagaaactcctaatatggatgtaataggtgagagaataaagagaattaaggaggaacacaattcaacttggcactatgacgatgagaacccgtataagacatgggcttatcacggtagctatgaagtaaaggcaacgggcagcgcatctagcatgattaatggggtagtcaagctgcttactaaaccatgggatgttgtaccaatggtaacccaaatggctatgaccgacacgactcctttcggacagcaaagagtgttcaaagagaaggtagacactagaacacccaggagcatgcctgggacacgaagggttatgggaatcaccgctgaatggttatggagaaccttaggtaggaataagaagccaaggctctgtacacgtgaagagtttaccaagaaagttagaacaaacgccgcaatgggcgcggtttttacggaagaaaatcaatgggactcagctaaagcagccgtggaagatgaagacttctggaagctagttgatagagaacgagaattacataaattaggcaaatgtggttcttgtgtatataacatgatgggaaaaagggaaaagaaattaggtgagttcggtaaggctaagggaagcagagccatctggtatatgtggttgggagcaaggtatttagaatttgaagccctagggtttctaaacgaagaccattggtttagccgtgagaacagttattcaggagttgaaggtgaaggattacacaaacttggatacatcctcagagatatatctaaaattccaggtggcgccatgtatgcagatgatacagctggatgggacacacgcattacagaagatgacctgcacaatgaagagaaaatcacacagcagatggacccagaacatagacaactagcaaatgcgatatttaaacttacctaccaaaataaagttgtcaaagtacaaagaccgacacctacgggtacggtaatggacataatcagcagaaaggaccagcgaggctcgggacaagtagggacatacggcttaaacacctttactaacatggaagcacaattaatcaggcaaatggaaggggagggagttcttacaaaagcagaccttgaaaacccacacctcagtgagaagaaaataacacaatggttagaaacaaaaggggttgaacgattaaaaagaatggctatttccggagacgattgcgttgttaagccgatcgatgacagattcgcaaatgcgttgttagccttgaatgacatgggaaaggtaagaaaagatatacctcagtggcaaccaagtaaaggatggcacgattggcaacaagtccccttctgcagtcatcactttcacgaattaataatgaaagatggacgaaagttagtcgttccgtgtcgacctcaagatgaactaattggccgcgcccgaataagtcaaggagccggatggagtctccgtgagacggcgtgtctaggtaaagcgtatgcacaaatgtggagcctaatgtatttccaccgaagagatctacgattagcgagcaatgctatttgttctgcagtcccggtacattgggtgccaacatcacgcacaacatggagtatacatgctcatcatcaatggatgacaacagaggatatgttaacagtatggaatagagtatggatcgaagacaatccttggatggaagataaaaccccggtaacgacctgggagaacgtgccatatctcggaaaaagagaagatcaatggtgcggatctttaataggcttgacgagtcgtgcaacctgggcgcaaaatatcccaacagctatccaacaagttaggtcgctaattggaaatgaggaatttttagattatatgccgagtatgaagcgtttccgtaaagaagaagaatctgaaggtgcaatctggtaa

SEQ ID NO: 23282 - RNA, 9873 nt, synthetic construct
  misc_feature 1..9873: note = derived and/or modified CDS sequence (opt6) from DENV-3__KF955465__SS-prME
  source 1..9873: mol_type = other RNA
acatcgctctgcataatgatgatcctaccagctgcgttagcttttcacttgacatcaagagatggagaaccacgaatgatagtaggtaaaaacgaacgcggtaaatcactattatttaaaactgccagtggaattaacatgtgcactcttatagctatggatttgggagaaatgtgcgatgacacagtaacctataaatgtccacacataaccgaagtcgaaccggaagatatagattgttggtgtaatttaaccagtacctgggtgacttacggtacttgtaaccaagccggggaacataggagggataaaagatcggtagctttagcaccccacgtaggaatgggtttagacacaagaacacaaacctggatgagtgctgaaggagcatggcgtcaagtagaaaaagtagaaacatgggcattaagacacccgggttttactattctagcgctctttcttgctcattatatcgggacatcattaacccaaaaagtagtaatatttatactattaatgctagtgacaccaagcatgactatgcgttgtgtcggcgtggggaaccgagattttgtggaaggactctcaggagcaacctgggtagacgtagtactagaacacgggggatgcgtaacaaccatggccaaaaataaacccaccttggacatagaattacagaaaacagaagccacccaattagctacattacgaaaattgtgtatcgaaggaaaaatcaccaatatcacaaccgacagccgctgtcccacacaaggagaagcagtgttgcctgaggaacaagaccaaaactatgtttgtaaacatacttatgtagatagaggatggggcaatggatgcggtcttttcggaaaaggatctctagtcacttgcgcgaaattccaatgtttggaacccatagaaggaaaagtagtacaatatgagaatttaaaatacacggtaattataactgtacacacaggagaccaacatcaagtcggcaacgagacacaaggtgtcacagcagaaattacaccccaagcctcgactactgaagcgatactaccagaatacggcactttaggtcttgagtgtagtcccagaacaggcctagattttaacgaaatggttctgttaacaatgaaaaataaagcatggatggtacatcggcaatggttcttcgatttgccgctcccatggacgtcaggagcaacgaccgagacccctacttggaataggaaagaactattagttacatttaaaaatgcacatgcgaagaaacaggaggtagtagtccttggaagccaggagggtgcaatgcatactgcactaaccggagccacggaaatacaaaacagtggagggacaagcatttttgcaggacatctaaaatgtagactaaaaatggataaattagagttaaaaggaatgtcctacgccatgtgtacaaatacttttgtattaaagaaagaagtaagcgagacacaacatggaacaatactgataaaagtggaatacaaaggagaggatgttccatgtaaaatacctttttcaacagaagatggccagggaaaagctcacaatggccggctaataacggcaaacccagtggtaacaaagaaagaagaaccagtaaacatagaagcagagcctccctttggtgaaagcaacattgtaataggaattggagataatgccctaaaaataaattggtacaagaaaggttctagtattggaaaaatgtttgaggcgacagcccgcggagctagacgcatggcaatcctgggagacactgcatgggactttggaagtgtcgggggagtcttaaattcattaggaaaaatggtacaccaaatattcggatctgcctataccgcattgttcagtggagtgtcatgggtgatgaaaataggtattggggtattactgacttggataggccttaacagtaaaaacacgtcaatgtcattcagttgcatcgtaataggtatcataacattatatctaggggcagtagtacaagcagatatgggatgcgtgataaactggaaaggcaaagaactaaaatgcggctctggaatatttgttacaaatgaggtacacacatggaccgagcaatataaatttcaagctgacagtccgaaacggttagccacagcaatagccggagcatgggaaaacggagtgtgtggaataagaagcaccacaagaatggagaatctattatggaaacaaatagccaatgaattgaattatatattatgggaaaataatattaaactaacggtagtagtaggcgatataataggtgtattggaacagggaaaacgaaccctaacacctcaaccaatggaacttaaatacagctggaaaacttggggtaaagcaaaaatagtaactgcggagacacaaaatagtagcttcattattgatggtccgaacacaccagaatgcccctcagcctcgcgcgcatggaatgtttgggaggtagaagattatggcttcggcgtgtttacaaccaacatatggttgaaactaagggaagtatacacgcagttatgtgatcaccgattaatgtcagcagctgttaaagacgagagagctgtccatgcagacatgggatactggattgaaagccagaaaaacggatcatggaaactcgaaaaagcatccctcattgaagtaaaaacatgtacctggcccaaaagtcacactttatggagcaatggagtgttagaaagcgacatgattatacctaaatcgctagccggacctatatcacaacacaactaccgcccgggttaccacacacagaccgccggaccgtggcatttaggtaaactagagctcgattttaactattgtgaaggaaccacagtcgtgatcacagaaaattgcggtacaagaggtccatcattgcgtaccacaacagtgagtggaaaactaatacacgagtggtgttgtagatcatgtactctaccacctctaagatatatgggagaggacggttgttggtacgggatggaaatacggccaattagtgaaaaggaagaaaatatggtcaagtctctcgtgagcgccggatccggaaaggtagacaattttactatgggagttttatgtttagcgatcctttttgaagaagtcatgagagggaagtttggcaagaaacatatgatcgctggcgtattctttacttttgtactactactgtctggacaaataacgtggcgggatatggcacacacactcattatgatcggcagtaatgcatccgatcgaatgggcatgggggtaacttacttagcgttaatcgctacatttaaaattcaaccgtttttagcattaggtttctttttaagaaaactaacctctagggaaaatcttttgctcggagttggcttagcgatggcgaccactctgcaattaccggaagacatcgaacaaatggccaatggaatcgctttaggactaatggctttaaaactaattacccaatttgagacgtatcaactatggacagcattaatatcattaacatgttcaaatactatttttacactaacagtggcatggcggacagcaacattaattctcgctggagtctcccttttacctgtgtgccagtcttcaagcatgaggaaaacagactggttgcctatgaccgtggccgccatgggtgttccaccactaccactattcatattttcactcaaagatacattaaaaaggagatcatggccacttaacgaaggtgtgatggcagttggattggtttctatacttgcctcgtcactattacggaacgacgtacccatggcaggacctctagtagcgggagggttgttaatagcatgttatgtaataactggaacgagtgcagatctaactgtagagaaggcagctgacgtaacgtgggaggaagaggccgaacaaacaggcgtgtcgcataacttaatgataactgtagatgatgatggaacgatgagaattaaagatgatgaaacagagaatatattaacggtactactaaagacggcattattaatagttagtgggatttttccttacagtataccagcaaccctgctagtatggcatacttggcaaaagcaaacacaaagatcaggagtactatgggacgtgccaagtcccccggaaacacagaaagcagaactagaagaaggagtgtatcggattaaacaacaggggatctttggaaaaactcaggtaggagtaggagttcaaaaagaaggtgtatttcacactatgtggcatgttactcgaggggccgtcttaacgtacaacggcaaacgtttggaacccaactgggcatctgtcaagaaagatctgatcagttatggaggtggatggcgtttatccgcccaatggcaaaaaggggaagaagtgcaagttatagcggtagaacccggtaaaaatcccaaaaactttcaaacgatgcctggaacgtttcaaacaacaactggtgagataggtgcgatcgcattggattttaaacctgggacatcgggcagcccaataataaatcgtgaggggaaagtagtcggtctttatggaaatggtgtagttacaaagaacggcggttatgtctcaggaatagcccaaactaatgcagaacccgacggaccgacaccagagctggaagaggaaatgttcaagaaaagaaatctaactataatggacttacatcctggatcaggaaaaaccagaaaatacctacctgctatagtcagagaagcaataaaacggcggttaagaaccttaatattagcaccaacgagagttgtggctgcggaaatggaagaagccttaaaaggtttgccaatcaggtatcagactacagctacgaaatctgaacacacaggcagagaaatcgtcgatctaatgtgccacgccactttcactatgcgactattatcgccagttagagtgccaaattacaatttaattattatggacgaagcgcacttcaccgaccctgccagcatagcagctagaggatatatcagtacccgggtaggaatgggtgaagctgctgctatatttatgacagctactccacccggcaccgcagatgcatttccacaaagcaacgccccaattcaagatgaggaaagagatataccagaaagaagttggaactcaggcaatgagtggataacagattttgcgggcaaaaccgtttggtttgtcccgagcattaaagcaggaaacgatattgctaactgccttaggaaaaatgggaagaaagtaatacaactatccaggaagacttttgatacagagtaccagaaaactaaattaaacgattgggacttcgtagtaactaccgacatctcagaaatgggtgcaaacttcaaagcagacagggttattgacccgagacgatgtttaaaacccgtaatcttaacagacggtccggaacgtgttattctcgcaggcccaatgccggtaaccgcagcatccgcggcgcaacgaaggggaagagtgggcaggaacccacaaaaggaaaatgaccaatatatatttacaggacagccactaaataatgacgaagatcacgctcattggacagaagccaaaatgctactggacaatataaacacacctgaaggcatcataccagctctattcgagcccgagagagaaaaatcagccgcaatagatggagaatatagattaaagggagagtcacgtaaaacattcgtagagttaatgcgaagaggcgatctgcccgtctggttagcacataaggtagcaagtgaaggaataaagtacactgatcggaaatggtgtttcgatggtcaaagaaataaccagatattagaggaaaatatggacgtagaaatatggaccaaagagggtgagaagaagaaactccgacctagatggcttgatgcgcgaacttactccgatcccctagctctcaaagaatttaaagacttcgcagccggcaggaaaagtattgcattagatctagtcacagagatcggccgagtaccatcccatcttgcacatagaactagaaacgcacttgataatttggtaatgttacatacctctgaacacggaggaaaggcttataggcacgcagtcgaagaattacccgaaaccatggagactttacttttactaggattgatgatcctattaacaggcggagcaatgttgtttttaatatctggaaaagggatcggaaagacttccattggactcatatgtgttatagcatcctctggcatgctctggatggccgagatccccttacaatggatagctagtgcaatagtgcttgagttcttcatgatggtcctacttataccagaaccagaaaaacaaagaactccccaagataatcaattggcttatgttgtgataggcattcttactctcgctgctatcatagcagcgaatgaaatgggccttttagaaactactaaacgagacctcggaatgtctaaagaacctggcgtcgtaagtccaacgtcctacctcgacgtggatttgcacccagcatcggcttggactctatatgccgtagccactacagtaataaccccgatgttacggcacacaatagaaaatagtactgcaaacgtatccctggcagccatagctaaccaagccgtagttttaatgggacttgataagggttggccaatttctaaaatggacctaggggtgcccctgcttgcactcggttgctactcacaagttaatcccctaacgctcacagctgcagtattattgttgataacccattatgctatcattggacctgggcttcaagcgaaggccacaagagaagcacagaaaagaacggccgccggtattatgaagaacccgacagttgatgggattatgaccatagatctcgatcccgttatatatgattctaaattcgaaaaacagttaggtcaggtaatgctattagtcctatgtgcagttcaactcctactgatgcgtacaagttgggctctatgtgaagcacttacacttgctacgggacctataacaaccctgtgggaaggatcaccagggaaattttggaatactaccatcgcagtttctatggcgaacattttcagggggtcctaccttgctggtgcaggtttagcatttagtataatgaaatcggtcggcacagggaaacgtggaacaggctctcaaggcgaaactcttggagaaaaatggaagaagaaattaaatcaactatcaagaaaggagttcgacctatacaagaaatctgggataactgaagttgacagaacagaagcaaaggaaggattgaaaagaggagaaattacacatcatgcagttagccgtggatcagcaaaacttcaatggtttgtagagagaaacatggtcattcccgaaggccgcgtcatcgatttaggttgtggtcgtgggggatggtcatattattgcgcaggactaaagaaagtaaccgaggtgcgaggatacacaaaaggtggaccaggacacgaagaaccggttccaatgtctacttatggttggaacatagtgaaattgatgagtggaaaggatgtattttacttaccaccagagaagtgtgacacgctactgtgcgacatcggagaaagtagcccttcccctaccgttgaagagtcaaggacaatcagagtactaaaaatggtagagccttggctaaagaacaatcagttttgtattaaagtgctaaatccatatatgccaaccgtgatagaacatttagaacggttacaaagaaaacatggtggaatgttagttcgtaatcctctgtcaagaaatagcactcatgaaatgtactggatttcaaatggaactggtaatattgtagcttcagtaaacatggtatcacgactgctattaaatcgattcacaatgactcatcgaaggccgacaattgaaaaggacgttgaccttggagcggggacacgacacgtcaacgcagaaccagagacaccaaatatggacgtgataggagaacgcataaagcgtataaaagaagaacacaattccacttggcattatgatgacgagaacccttataagacttgggcataccatggctcgtatgaagttaaagcaactgggagcgcttcgtcaatgatcaacggtgtagtcaaacttttaacgaaaccatgggatgtcgtcccgatggtaactcaaatggcaatgacagatacaacaccttttggccaacaaagggtttttaaggaaaaagttgacactaggacccctaggtcgatgccaggaacccgacgagtaatgggaataaccgcggagtggctctggcgtacactggggcgaaataagaaacccagactttgcactcgcgaagaatttaccaagaaagttaggactaatgctgcaatgggcgctgttttcaccgaagagaaccaatgggattcagctaaagcggccgttgaagatgaagacttttggatccttgttgacagggaaagagaactccacaaattgggtaagtgcggaagctgtgtttataacatgatggggaagagagagaagaaattgggtgagttcggaaaagcaaaaggatccagagctatatggtacatgtggttaggcgctcgttatttagagttcgaggctttgggatttttgaacgaagatcactggttttcccgtgaaaactcctatagcggagtagaaggagaaggactacataaattaggatatatattgagggatatttctaaaatacctggcggagctatgtatgcggatgacactgctggctgggacactaggattaccgaagatgacctacacaatgaagaaaagataacacagcaaatggatccagaacacaggcaactcgcaaatgcaatattcaaactaacatatcaaaataaagttgtcaaggtacaacgccctacaccaacaggcaccgtcatggatataatatctagaaaagaccaacggggtagtggacaagtaggaacttacggcctcaatacattcacaaacatggaagcgcagttaataagacaaatggaaggagaaggcgtgctatcaaaagctgatttggaaaacccacacctaccagagaagaaaatcacgcagtggttagaaacgaaaggtgttgaaaggcttaaaagaatggcgatcagcggcgacgattgtgttgtaaaaccaatcgacgatcgattcgcgaatgcactattagctctaaacgacatgggcaaggtacggaaagacataccacaatggcaaccctcaaaaggttggcatgactggcaacaagtaccattttgttctcatcattttcatgagctcataatgaaggatggacggaagctagtagttccctgcagacctcaagacgagctgataggcagagcgagaattagccagggtgccggatggagccttagggaaacagcatgtctcggaaaagcgtatgctcagatgtggtcgctaatgtactttcatcgtcgcgatttacggttggcaagtaacgctatatgcagtgctgttcctgtccactgggtgccaacctcacgtactacctggtcaatacacgcacaccatcagtggatgaccacggaagatatgctaactgtatggaatagagtatggatagaagacaacccgtggatggaagacaaaactccggtgactacttgggaaaacgtcccttacctaggcaaacgcgaagaccaatggtgtggatcactgataggtctgacatccagagcaacctgggctcaaaacatcccaacagcaattcaacaagtacgatctcttatcgggaatgaagagttcttagattatatgccgagcatgaaacggtttcgaaaggaagaagaatcagaaggtgcaatatggtaa

SEQ ID NO: 23283 - RNA, 9873 nt, synthetic construct
  misc_feature 1..9873: note = derived and/or modified CDS sequence (opt6) from DENV-3__KF955466__SS-prME
  source 1..9873: mol_type = other RNA
acgtcactatgtttaatgatgatacttccggcagctctagcattccacctaacgtccagggatggagagcctaggatgatagtcggtaaaaatgaaagaggaaaatctcttcttttcaaaaccgcttcaggaatcaacatgtgtacactaatagcaatggacctcggggaaatgtgtgacgacacagtgacctacaaatgtcctcatatcacagaagtcgaaccggaggacatagattgctggtgcaacctgacatcaacgtgggtaacatacgggacttgtaaccaggcaggagaacatagaagagacaaaaggtcagtcgcgcttgctccgcacgtagggatgggtcttgatactcgcacacaaacgtggatgagtgccgaaggagcttggaggcaagtagaaaaagtagaaacctgggctctacggcacccaggattcacaatactagcgttatttcttgctcattacataggaacgtccttgactcaaaaagttgtaatattcattttgctaatgctagtcacaccatcaatgacaatgaggtgcgtgggagtcgggaacagagatttcgttgaaggactttctggagcaacctgggtcgacgtcgtattggaacatggagggtgtgtcacaacaatggctaaaaataaaccgactttagatatcgagttacagaaaaccgaagcaactcagctagctaccctaagaaaattatgcatagaaggaaaaattaccaatataacgacagatagtagatgtccaacgcaaggagaagcagtattaccagaggaacaagatcagaactatgtgtgtaaacatacatatgttgaccgaggatggggaaacgggtgtggtctgttcgggaaaggaagcctcgtgacctgcgccaaatttcaatgcctcgaaccaatagaaggtaaggtagtacaatacgagaacttaaaatatacagtaattataaccgttcatacaggggaccaacaccaagtaggtaatgaaacgcaaggagtcacagcggaaattacgccccaagcatccacaactgaagcaatattaccagaatacggaaccttaggattagagtgtagccccagaacaggactcgacttcaatgaaatgatactcttaacgatgaaaaacaaggcttggatggttcacagacagtggttcttcgatcttcctctcccgtggacaagtggggctactaccgaaacacctacttggaacaggaaggagctcctagtaacatttaagaatgcacacgccaagaaacaagaggtcgtagttcttggctcacaagaaggtgctatgcacactgccctcactggagctacggaaatacaaaacagcggaggtacatcgatatttgctggacatctgaagtgccgattaaaaatggacaaactggaacttaaaggaatgtcatatgcaatgtgtactaatacctttgttctcaagaaagaagtaagcgaaacgcagcatggtacaattcttataaaggttgaatataagggcgaagacgtaccgtgcaagattcccttctcaacagaggacggacaaggaaaggcgcataatggtaggttaataacggcaaatccagtggtgaccaagaaagaggaacctgtcaacatagaagcagagccaccatttggagagtcaaacattgttattggaattggggataacgcactaaaaatcaattggtataagaaaggttcttcgataggtaaaatgttcgaagccactgcaagaggagctagaagaatggcaatattaggtgatactgcctgggattttggttcagtcggaggcgttctcaattctttggggaaaatggtccaccaaatatttggtagtgcatatacagcattgttttcaggagtatcctgggtcatgaaaataggcataggcgttctactaacctggatcggactcaattccaaaaacacgtctatgagtttctcgtgcatagtaataggtataatcacattatacctcggggccgttgttcaagcggacatgggttgtgttataaattggaagggcaaggaactcaaatgcggaagtggaatatttgtcaccaatgaggtacatacgtggactgaacaatacaaattccaagctgacagtcctaaaaggttagcaacagctattgccggtgcatgggaaaatggagtatgtggcattcgaagcacaacacgtatggagaaccttctgtggaaacagattgctaatgaattaaactatatactttgggaaaataatatcaaactaacggtggtcgtaggagacataataggggtgctcgagcagggaaagagaactcttacaccccaacctatggaactaaaatacagctggaaaacttggggtaaagcaaaaatcgttacagccgaaacgcaaaattcctcttttatcatagatggtcctaacacacctgaatgtccgagtgcttctagagcatggaacgtttgggaagttgaagactacggttttggtgtatttacaacaaatatctggttaaaactaagagaggtatatacacagctttgtgaccatcgacttatgtcagcggctgtgaaagatgagcgtgctgtacacgcagatatggggtactggatcgagtcacagaagaacggatcttggaaacttgaaaaagccagtttaatagaagttaaaacatgcacgtggccaaaatcacacacactatggtcgaatggagtgctggaatcagatatgataataccaaaatcattagctggtcctataagtcaacataattatcgacccgggtaccatacccagaccgccgggccatggcacctcggaaaacttgaactagatttcaattactgcgaaggtacaacagtagtaataacggaaaattgtggtacgagagggcccagtttaagaactacaacagtctcgggtaaactaatacatgaatggtgctgtagaagttgtactttaccaccacttagatatatgggagaagacggatgttggtatggtatggagatacgacctataagtgaaaaggaagaaaatatggtcaaaagtcttgtatcagccggatcaggaaaagtagacaattttacgatgggggtattatgcctcgcgatcctatttgaagaagtcatgaggggtaagttcggcaagaaacacatgattgctggagtattctttacctttgtattattactgtctggacaaataacttggcgggacatggcacatacgctaatcatgattggatctaatgccagtgatcgaatgggcatgggagttacttacctggcactaatagctacatttaaaatacaaccatttctagcactgggattcttcctgcgaaagttaacttcaagggagaacttattattaggagtcggactagcaatggccacaacgcttcaactcccagaagacatcgaacagatggcgaatggcatcgcactaggattaatggcattaaagttaataactcaatttgagacgtatcaactctggaccgcgctaattagtttaacgtgctccaacactatttttacacttacagttgcttggcgtacggctacactgatcctcgctggggttagcctactacccgtctgtcaatcgtcaagtatgcgaaaaactgactggttgccgatgacagtcgcagctatgggagtaccgcccttaccactattcatattttcgctaaaagataccttaaaacgaagatcatggccacttaacgaaggagtaatggctgtaggattagtaagcatactggcgagtagtttgctaagaaacgatgtgccaatggcaggcccgctggtagcaggaggcttactaattgcatgttatgtcattacggggacctctgcagaccttacagttgagaaagccgctgatgtcacatgggaagaagaagcagaacaaactggagtgtctcataacttgatgataacagttgacgacgatggcacaatgagaataaaagatgacgaaacagaaaacattcttactgtattgctaaaaacagcattattaattgtaagtggaatattcccgtattctattccagcgacgctattagtatggcacacatggcaaaaacagacacaaaggtctggtgtcctctgggatgtgccaagtcctccagagactcaaaaagcagagctagaggaaggtgtataccgaattaaacaacaaggaatatttggaaaaactcaagttggagtaggggtacagaaagaaggagtcttccatactatgtggcacgtcacaagaggtgcggtattgacatataatggaaagcgattggaaccgaattgggcaagcgtaaagaaagacctaatctcgtatggagggggctggagacttagcgcacaatggcagaaaggtgaggaagtgcaagtaattgcagtcgaaccaggcaaaaatccaaagaattttcaaacgatgcccggaacgttccaaactactacgggagaaataggtgctatagcactcgacttcaaacctgggacaagcggcagtccaattataaatagagaaggaaaagtagtcggtctatatggtaacggagtggtaacgaaaaacggtggatatgtatcagggatagctcaaactaatgcggaaccggacggtccaacaccggaactagaagaggagatgtttaagaaacggaatttaaccattatggacttgcacccaggctcaggaaaaacacggaagtatctaccagctatagttcgtgaagctatcaaacgacgtcttagaacattaatcttagcaccaaccagagtcgtcgcagcagaaatggaagaggcactaaaaggattaccaatacgatatcagacgactgcaacaaagagcgaacacactggtagagaaatcgtcgacttaatgtgtcacgcgacatttactatgcgtttgttgtcccccgtcagagtacctaattacaaccttataataatggatgaagcacattttacagatccagcatcaatcgccgcacggggttatatatcaacaagagtaggcatgggagaggcagctgcgatattcatgacagcaacgccacctggaacagccgatgcgttcccgcaatctaacgcacccatacaagatgaagaaagagacatacccgaaaggagctggaatagtggtaatgagtggataactgactttgctggtaaaacagtatggttcgtaccaagtataaaagcagggaacgatattgcgaattgcttaaggaagaatggcaagaaagtcatacaactatctagaaagacatttgacacggaatatcagaaaacaaaactgaacgactgggattttgtggtaacgactgacatttcagaaatgggggcgaactttaaagcggaccgggttatagatccacgccgatgtctaaaaccagtaatattaacggatggaccagagagggtgatacttgcaggtcctatgcctgttactgcagcatcagccgcacaacgaagaggccgagttggacgaaaccctcagaaagaaaacgatcaatatatttttactggtcagccactaaacaatgacgaagaccacgcccattggacagaggcgaaaatgctattggataatattaataccccagaaggaataatacccgccttgtttgaacctgagagagaaaagtccgcagccatagatggagaatatcgtctaaaaggggaaagcagaaaaacattcgtggaattaatgagacgaggcgaccttcctgtttggctagcacataaagttgcctcagaaggaataaaatatactgatagaaaatggtgttttgacggacaacgaaataatcagatattggaagaaaacatggatgtagagatatggacgaaagaaggagaaaagaaaaagttaaggccccgttggcttgatgcaaggacttatagcgatccactagctttgaaagaatttaaggattttgcagctggaagaaaaagtatagcactagatttggttaccgaaataggaagagttccctcacatctagcacataggacacgaaatgcactagacaatctcgttatgctacacaccagcgagcatgggggcaaggcctatcgccatgcagttgaagaactgcccgaaacaatggaaacactacttttgttaggtctaatgatattattgacagggggtgcaatgttgttccttatctcgggtaaaggtataggtaaaactagcataggcttaatttgcgttatagcatcttcgggtatgttatggatggcagaaattccactacaatggattgcaagcgcgatcgtcctagaatttttcatgatggtactactaattccggagcctgaaaaacaaaggacgccgcaggataatcaacttgcctatgtcgtaatagggattctgacactagcagccataattgctgcaaacgaaatgggtcttctagaaactacaaaaagggaccttgggatgtcaaaggaaccaggtgtcgtaagcccgacaagttatttagatgtcgacctacacccagcgagtgcgtggacactctatgcagtggctacaacagtaataactccgatgctacgacataccattgaaaattcgacagcgaatgtatctttggcagcgatcgccaaccaggcagttgtgctcatggggctcgacaaaggatggccaataagcaaaatggatttaggggttcctctacttgccctagggtgttactcgcaagtaaacccacttacactaactgctgcagttctactcctcataactcactacgcaataataggacccggcctccaggctaaagcaacacgtgaggcgcagaaacgtacagcagcaggcataatgaagaaccccactgttgatggcataatgacaatcgatctggatccagtcatctacgacagtaagtttgaaaaacaattaggacaagtgatgttacttgtattatgtgctgttcagctcctacttatgcgcacctcatgggcactatgcgaggcattaacactcgcaactggcccaataactactttgtgggaaggatcacccggaaagttttggaatacgactattgctgtatctatggccaatatatttcgcggaagctatttagctggagcaggcctagcattttcaatcatgaaatcagtgggaacaggtaaaagaggtactggaagccaaggggaaacattaggtgaaaaatggaagaagaaactaaatcagttaagccgaaaagaatttgatttgtacaagaaatcgggcatcacggaagtcgatagaacagaagccaaagagggattaaaacgaggtgaaatcacgcatcacgcggtcagtcgtgggagcgcaaagttacaatggttcgttgagcggaatatggtaataccagagggcagagtaatagacttaggatgcgggagaggagggtggagttactattgtgcaggcctaaagaaagtcacggaggtgagaggatacacgaaagggggacctgggcacgaagaacctgtaccaatgtcaacatacggatggaacatagtgaaacttatgtccggaaaagatgtgttttacctaccgcctgaaaaatgcgacaccctactctgtgatataggagaaagtagcccatctcctactgtagaagaatcaagaacgatacgagttctaaaaatggtagaaccatggttgaagaataatcagttttgtataaaagttttgaatccttacatgccaactgtaatagaacatttagaacgcttacaacgaaaacatggtggaatgcttgtaagaaatcctttaagccgaaatagtacgcatgaaatgtattggatctctaacgggaccggaaacatcgttgcttcagtaaatatggtatccagattactgttgaatcgattcacaatgacccaccgaagacctacaatagagaaggatgttgacttaggcgctggtacgcgacacgtaaatgcggaacccgagacacctaatatggatgttattggcgagcgcattaaacgaatcaaggaggaacataatagtacatggcattatgatgatgaaaacccctataaaacatgggcataccacggtagttatgaggtgaaagccactggaagtgcaagttcaatgataaacggcgtcgtgaagttactaacaaaaccttgggacgtcgttccaatggtaacgcaaatggcaatgactgacacaacaccattcgggcagcagagggtgtttaaggagaaagtagatacacgtacaccaagaagtatgccaggtactagacgagtaatgggtattacagcagaatggttatggagaacactcgggaggaacaagaaaccaaggctatgtactagagaagaatttactaagaaagtacgtaccaacgcagctatgggggctgtatttactgaagagaatcaatgggattcagcaaaagctgccgtagaagatgaagatttttggatgcttgttgaccgtgagcgtgaattgcataaactcggtaaatgcggttcatgcgtctataatatgatgggtaaacgggagaaaaagctaggcgagtttggtaaagccaaggggtctagagcaatttggtacatgtggctaggagcaagatacctagaatttgaagccctcggctttctcaacgaagaccactggttctctagagaaaattcgtacagcggtgtcgaaggtgagggcctacacaagctaggatacatattaagggatatatctaaaataccagggggagctatgtacgccgacgatacggcaggatgggacactagaataactgaagacgacctacacaatgaagagaaaataacacaacaaatggatcctgaacatcgacaattagcaaacgcaatttttaaactcacttatcagaataaagtagtcaaggttcaaagaccaaccccaaccggaacagttatggatattatttcaaggaaggaccaaaggggttctggccaagttggtacttacggattaaacacattcaccaatatggaagctcagcttataaggcaaatggaaggtgagggtgtgctatcgaaagcagatcttgaaaaccctcacctaccggagaagaaaatcactcaatggctggaaacaaaaggagttgagcgtttaaaacgtatggcgataagcggtgatgactgcgttgtcaaaccgattgacgatcggtttgctaatgcactattggccttaaacgatatgggtaaagttcggaaagatattccacaatggcaaccttctaaaggttggcacgattggcaacaggtacctttttgttcacatcattttcacgaattaataatgaaagacggccgcaaattggtcgtaccgtgtaggccccaagatgaacttattgggagagcaagaatttctcagggggcagggtggagccttcgagaaacagcctgtttgggcaaagcatacgcacagatgtggtctctaatgtatttccatcgacgggacctcaggctagcgtcgaatgcgatctgcagtgcggtccctgtacattgggttccaacatcacgcacaacttggagtattcatgcgcaccatcagtggatgacaacagaagacatgctgacagtttggaaccgggtttggatcgaagataacccatggatggaagataaaaccccagtaacaacatgggaaaatgtaccttacttaggaaaaagggaggatcaatggtgcggcagtctaattggcttgacctcccgtgcaacatgggcacaaaatatccctacagcaatccaacaggttcgctcattaataggaaatgaagaatttctggactatatgccttctatgaaacgattccgtaaagaagaagaaagcgaaggagcaatttggtaa

SEQ ID NO: 23284 - RNA, 9873 nt, synthetic construct
  misc_feature 1..9873: note = derived and/or modified CDS sequence (opt6) from DENV-3__KF955468__SS-prME
  source 1..9873: mol_type = other RNA
acttctctttgtttaatgatgatcttaccagcagctttagcattccatttaacctcacgcgatggtgaacctagaatgatagtgggcaaaaatgagagaggaaaaagtttactatttaaaactgctagtgggataaacatgtgtacgttaatagccatggatttaggggaaatgtgcgacgacacagtaacttacaaatgtccgcacataacggaagttgaaccagaagatattgactgttggtgtaatttaacaagtacttgggttacatacggcacatgcaaccaagcgggtgaacacagaagagataaacgttcagttgcccttgcaccacacgttggaatgggtctagatactaggacgcaaacatggatgtccgctgaaggtgcgtggagacaagtagaaaaagttgaaacatgggccctgcgacacccagggttcactattttagctttattcttagcgcactatataggtacttccctgactcaaaaagtagtgatattcatacttcttatgctagtaacaccctctatgacaatgagatgtgtgggagtcgggaaccgtgatttcgtcgaaggattaagtggggccacatgggttgatgtcgtgctcgaacacggaggatgtgtcacaaccatggccaaaaacaaaccaacgttagatatagagttacagaaaacagaagcgactcaactagctactttaagaaaattatgtatagaaggtaaaataaccaacataacaacagattctagatgtccgacccaaggtgaggccgttttaccagaagaacaagaccaaaattacgtatgtaaacatacatatgtagatagagggtggggaaacggctgtggattattcggtaaaggatctctcgtaacatgtgcaaaatttcagtgtctcgagcctatagagggaaaagtagttcagtacgaaaacttaaaatacactgtcataattactgtacacacaggcgatcagcaccaggttggtaatgagacgcagggcgttacagctgaaattacacctcaggccagtacaaccgaagccattttgcccgaatacggaacactcgggttagaatgcagcccccgaaccggactagacttcaatgaaatgatacttttgacgatgaaaaataaggcttggatggtgcacagacagtggttcttcgatttgcccctaccctggacttcaggagcaacaaccgaaactcccacatggaacagaaaagaattactggttacctttaaaaatgcgcatgcgaagaaacaagaggtagtggttttaggtagtcaggaaggggcaatgcataccgcactaacaggagcaacagaaattcaaaattcaggcggcaccagtatatttgcgggccacttaaaatgtagattgaaaatggataaacttgagctcaaaggaatgagctatgcgatgtgcacaaatacatttgtacttaagaaagaagtttccgaaacacaacatggaacaatcctaataaaagtagaatataaaggggaagatgtaccatgcaaaattcctttttcaacagaagatggacaaggcaaagcccacaatgggcgtttgataactgctaaccccgttgtaaccaagaaagaagaacccgtcaatattgaagcagaaccaccattcggagaatcaaacattgtaataggaataggagataatgcgttaaaaattaattggtataagaaaggtagcagtataggtaaaatgtttgaagcgactgccagaggagcaagacgaatggctatcctaggtgatacggcctgggacttcggttccgtaggtggagtattaaattcgttagggaaaatggtgcaccaaatatttggaagcgcatataccgcactattctctggtgtcagttgggtgatgaaaattggaataggagtattactaacttggataggtctcaattccaaaaatactagcatgtcgttcagttgcatcgtgataggtataattacattatatttgggtgcagtagttcaagcagacatggggtgtgttataaattggaaaggaaaagaactaaaatgtggatccgggatatttgttactaatgaagtgcatacatggactgagcaatataaatttcaagcagacagccctaaacgtttggcaacagcgattgctggagcatgggaaaatggagtttgtggaataaggagtacgacgaggatggaaaacctattgtggaaacagatagcaaacgagctgaattatattctatgggaaaataacatcaaactaactgtcgtagttggggacataattggagtgctggaacaaggaaaaagaacactaacgccccagccgatggagcttaaatatagttggaaaacctggggcaaagcaaaaatcgttacggctgagacacagaatagttccttcattattgacggaccaaatactccggaatgcccatcggcgtctcgggcttggaatgtgtgggaagtagaagactatgggtttggagtttttactacaaacatatggctaaaactaagagaagtatatacgcagctttgcgaccaccgcttgatgagcgccgcagttaaggacgagcgcgctgtacacgcggacatgggatattggattgagagccaaaagaatggaagctggaaattagagaaggcttcattgattgaagttaaaacttgcacgtggccgaaatcccacacactctggagtaatggagtgttagaaagcgacatgatcattcctaaatcactagcgggaccaatctcacaacataattatagacctggataccatacccaaacagcaggtccttggcacctcggaaagctagaacttgacttcaattactgtgagggcacaactgtagtaattactgaaaactgcggaacaagaggacctagccttaggactacaacagtctcggggaaattaatacacgaatggtgttgtaggagttgtactctcccaccgttacgctatatgggagaagatggctgttggtatggcatggaaataaggccaataagtgaaaaagaagaaaacatggtaaaatcactcgtatccgctggttcgggaaaagttgataactttaccatgggtgtattgtgcttagcaatcttgtttgaggaggttatgcgaggaaaatttggcaagaaacatatgatagcaggagtattctttacattcgtccttttgttatctggacagataacttggcgagatatggcacacacactaattatgataggctcaaatgcatcggacagaatgggaatgggtgtaacatacttagcgctgatagcgacattcaaaattcaaccgtttttagctctaggattctttcttcgaaaacttacatctagagagaatttattgcttggagtaggtctggccatggcaacaaccttacaattgcctgaagatattgaacagatggcaaacggaatcgcgcttgggttaatggctttaaaactgataacccaatttgaaacatatcagctttggacggctcttatttctttaacatgcagcaatacaatattaaccctcaccgtcgcatggagaactgctaccctcatactagccggggtctcgctcctgccggtatgccaatcaagctcaatgagaaaaactgattggctacctatgacagtggctgcaatgggtgttccgcctttaccactttttatcttttcgctaaaagatacgctaaaacgacgaagttggccactaaacgaaggagtaatggccgtagggctagtttcgatacttgcctcaagtcttcttaggaatgacgtaccaatggcaggtcctctggtagccggaggcctcttgatagcatgttatgtcatcactgggacatcagctgacttaacggttgaaaaagctgccgatgtgacatgggaagaagaagcagaacagacgggagtttcccacaatctcatgattacagtagatgatgacggaacgatgcgcatcaaagacgacgagaccgaaaatatcctaacagttctgttaaaaactgcactactaatagtatcaggaatatttccttattcaataccagcaactctcttagtatggcatacttggcaaaaacaaacccaacgaagcggagtactttgggatgtcccaagcccacctgagactcaaaaagctgagcttgaagagggtgtctacaggataaaacaacaaggaatctttggcaaaacccaagttggagtcggtgtacaaaaagagggggtctttcatactatgtggcatgtaactaggggagcggtcctaacgtataatggaaaacgtttagaaccaaattgggcgtctgttaagaaagacctaatatcgtatggaggtggctggcgattatctgcccaatggcagaaaggcgaggaagtacaggtaatagccgttgaaccaggtaaaaaccctaaaaatttccagacaatgccagggacgtttcaaactaccacgggagagataggtgccattgcccttgactttaaacccggaacatctggatcaccaataattaaccgagaaggtagggttgttggactctacggcaatggcgttgtgacgaaaaatggaggttatgtcagcgggattgcacaaacaaacgctgaacctgatgggcctactcccgaacttgaagaggaaatgtttaaaaagagaaacttaacaatcatggacctacatcccggatctgggaaaactagaaaatatcttccagccatcgtgagagaagctattaagaggcgactgagaacgttaattctagcacctacccgagtggtagcggcagagatggaagaagcattgaaaggtttacccatcagatatcaaactacagccacaaagtcggagcatactggcagagagatagtggacctaatgtgccacgcgacatttacgatgagactgctatcccctgttcgggtacccaattacaatctaataattatggatgaggcacatttcacagacccagcttcaatagccgcaaggggatacataagcacgcgtgtaggaatgggcgaagcagccgctatattcatgacagcaacgcctccaggaactgcagacgcctttccccaatccaatgccccaattcaggacgaagaaagagatatccctgaacgaagttggaactctgggaacgaatggattacagacttcgcaggcaaaactgtttggtttgtaccatcaataaaagccgggaacgatatcgcgaactgtctcaggaaaaatggtaagaaagtcatccaactatccagaaaaacatttgacacagaataccagaaaacaaaattaaatgactgggatttcgtagtgactacagatataagcgagatgggagcaaacttcaaagctgacagggtaattgacccacgccgctgcctaaagcctgttatattaacagacggaccagaacgcgtaatattggctggtccaatgcccgtaacagcagcgagtgctgctcagagaagaggtcgagtgggaaggaacccgcaaaaggagaatgaccaatacatatttacagggcaaccactgaataacgatgaggaccatgcacattggaccgaagctaaaatgctattagacaatataaatacgcccgagggaataattccggcactattcgaacctgagagggaaaagtctgcagcaatagacggagaatacaggttgaagggagaaagccgaaaaacatttgttgaattaatgcgacgcggggacttaccggtgtggttagcacataaagttgcctcggaagggataaaatacacagatcgtaagtggtgttttgacggccaaaggaataaccaaattcttgaagaaaatatggacgtggaaatatggacgaaagaaggtgagaagaagaaattacggcccagatggctcgatgcacggacgtattcagaccctttagcgctcaaagagtttaaggacttcgccgccggccgaaaaagcattgctttagatcttgtcacggaaattggccgtgtaccaagtcatttagctcaccgtacaagaaatgcgttagataaccttgttatgctacatacaagcgaacacggcgggaaagcgtaccgtcatgcagtcgaggaactcccagagaccatggagactttacttctgctaggcttaatgattttactaacaggtggagccatgctgtttctgatatcaggtaaagggataggcaaaacctccataggcttaatatgcgttatagcttcttcaggaatgttatggatggccgaaattcctttacaatggatcgcgtcagcaattgttctagaatttttcatgatggtattattgataccggaaccggagaagcagcgaactcctcaagacaatcagttagcgtacgttgtaattggcatactcactctagctgctattatagctgctaatgagatgggcttattagaaacaaccaaaagagatttggggatgtccaaagaacctggggtagtgtctcctacatcttatctggatgtcgacttacacccagcatcggcttggaccctttatgctgtagcaactaccgtgataacccctatgctcagacacacaatagaaaactcgacggcaaacgtctccctcgctgctattgctaaccaagctgtggtattaatgggattggataagggttggccgatctcaaagatggacttaggcgttccactattagcactaggatgttattcacaagtcaatcctttaacattaacagcagcagtgctcttactaatcacacactatgctatcattgggccaggattgcaagcaaaagctaccagagaagcacaaaagcgcacagcggcaggaattatgaagaatcccactgtagacggcataatgacaatagacttagatcccgtgatttacgatagcaagttcgaaaaacagctcggacaagtaatgttattagtattatgcgctgtgcaattacttctcatgcgtacctcttgggcgttatgcgaggcgttgactcttgccacaggaccgatcactacattatgggaaggtagtccaggcaaattttggaatacaactatagccgtaagtatggccaacattttcagaggctcctatcttgccggtgccggtttagccttttccataatgaaatcagttggaacagggaaacgaggaacagggtcccaaggcgagacgctaggggaaaagtggaagaagaaattaaaccaattaagccgaaaagaatttgatttatataagaaaagtggaatcaccgaagtggatagaactgaagcaaaagaaggcttaaaaagaggagagataacacatcacgcagtatcacgaggctcagcaaaattacaatggtttgtagaaagaaacatggtaatcccagaaggacgggtaattgatttaggatgcggtcgaggaggatggagttattattgcgcggggctaaagaaagtaactgaagttagaggttatactaaaggaggtcccgggcatgaagaacctgttccgatgagtacctacggctggaacattgttaaactaatgtcaggaaaagatgtattctatcttccaccagaaaaatgtgacactttattatgcgacataggcgaatcgagtccatcacccactgtcgaggagtcacgaacaatcagagtgctcaaaatggtggagccatggctgaaaaataatcagttttgtatcaaggtcctaaatccatatatgcctaccgtgattgaacatttagagaggttacaacggaagcatgggggtatgttggtaaggaacccgttatcgagaaattctacacatgaaatgtactggatatctaatggcacgggaaatattgtagcttctgttaatatggtctcgcgattgcttctaaaccgattcacgatgacgcatcgtcgaccaaccatagaaaaagacgtagacttaggagcgggtacaaggcatgttaatgccgagcctgaaacaccaaacatggatgtcataggagaaagaattaaacgcattaaagaagaacataacagtacatggcactacgatgatgaaaatccatataaaacttgggcatatcacggcagctatgaagttaaagccacaggaagcgcttcatcaatgataaacggagtcgtaaaactactgaccaaaccatgggacgtagtgcccatggtcacgcaaatggcgatgacagacaccacaccctttggtcagcaacgagtatttaaagagaaagtagacaccagaactccccgctcgatgccaggaacaagaagagtcatgggtataaccgcagaatggctttggcggacgttaggaagaaataagaaacctagattgtgtactcgagaggaatttactaaaaaggtaagaaccaacgcggcaatgggtgcggtatttacagaagaaaaccaatgggattcggctaaagctgcagtagaggatgaagacttctggacacttgtagacagagaaagggaactccacaaattgggaaaatgtggatcctgcgtctataacatgatgggcaaacgtgaaaagaaacttggagaatttggcaaggcaaagggcagccgtgcgatttggtatatgtggctcggtgccaggtacctcgaatttgaagcacttggatttttaaacgaggatcactggttttccagggaaaattcatactccggcgttgaaggagaagggttgcacaagctaggttacatcttaagagacatctcgaaaattccaggaggtgcaatgtacgcagacgatacagcaggttgggatacaagaataaccgaggatgacctgcacaacgaagagaaaattacgcaacagatggaccctgagcatagacaattagcgaacgctatttttaaattaacttatcaaaataaagtagtaaaagtccagagacctaccccaacaggcacagtcatggatatcatcagtaggaaagaccaacgcggatcaggacaagtaggaacatatggtctcaatacttttacaaacatggaagctcaactaatcagacaaatggaaggagaaggagtactatcaaaagcggatctagaaaatccacatcttccagagaagaaaataacacaatggttagaaacaaaaggggttgaacgtctgaaaagaatggctataagtggagatgattgtgtggtgaaaccgatagatgacagatttgcaaatgcattattagccctaaatgatatgggaaaagtaagaaaagatataccccaatggcaaccttccaaagggtggcatgactggcaacaagttccattctgtagtcatcactttcacgagcttataatgaaagatgggcgaaaattagttgtaccatgccgacctcaagatgaactaattgggcgggcacgaataagccaaggagctggctggtccctgagagaaaccgcctgtttaggtaaggcatatgcacaaatgtggagtcttatgtactttcatagacgagacctaagactcgcttccaacgccatatgttcagcggttcccgtacattgggtgccaacgagtcgtactacatggagtattcacgctcaccatcaatggatgaccactgaggacatgcttactgtgtggaacagagtttggatagaggataatccctggatggaggataaaaccccggtcacgacctgggaaaacgtgccgtacctagggaaacgagaagaccaatggtgtggttcattgatcggattgacatctagagcaacttgggcacaaaacatcccaactgctatacaacaagtaagatcactaattggaaatgaagagtttctagactacatgccctcaatgaaacgtttccggaaagaggaagaaagcgagggcgcaatatggtaa

SEQ ID NO: 23285 - RNA, 9873 nt, synthetic construct
  misc_feature 1..9873: note = derived and/or modified CDS sequence (opt6) from DENV-3__FJ744726__SS-prME
  source 1..9873: mol_type = other RNA
actagcctatgtctaatgatgatgcttccggcaaccctggcgtttcacctaacctccagggatggagaaccacggatgatagtcgccaaaaatgaacgtggtaaaagtcttctttttaaaaccgcaagtggtattaatatgtgtactttaatagctatggatctgggagaaatgtgcgacgataccgtaacatataaatgccccttgatagcagaagtcgaacctgaagacatagattgctggtgcaatttaacatcaacctgggttacttatgggacgtgcaaccaagcgggagaacataggcgagacaaacgttcagtagctttggcaccgcatgtaggaatgggactagacaccagaacgcaaacctggatgtcagcagaaggcgcatggagacaggttgaaaaagtagaaacatgggctttacgtcatccaggctttacgattttagctctatttttagcacattacattggtacatccctgacgcaaaaagtagtaatatttatactactcatgttagtaacaccatcaatgacaatgaggtgtgtgggcgtcgggaaccgagattttgttgaaggcctgagtggagcaacatgggtcgacgtcgtactagaacatgggggctgtgttacaacaatggctaaaaacaaacctactttagatatagaactccagaaaaccgaagcgacgcaactagcaaccttacggaaattgtgcattgaaggtaaaattacaaatataacaaccgacagcagatgccctacacagggggaagctatactacctgaggaacaagatcaaaattatgtatgcaaacatacttatgtagatagaggctggggaaatggctgtggattatttggcaaagggagccttgtaacttgtgcaaaatttcaatgtctagagccgatagaaggaaaagttgtgcaacatgaaaacttaaaatacacagtcatcataactgtgcacaccggggatcagcatcaagttggcaacgatactcagggtgttacagtggaaattacgccgcaagcatccacagtcgaggccattctaccagagtatggtacactgggacttgaatgctcaccgaggacgggactcgatttcaatgagatgatcttattgactatgaaaaataaagcctggatggtacatagacaatggttctttgacttacccttgccgtggacctccggcgcaaccaccgaaacccccacatggaaccggaaagaattattggtgaccttcaaaaacgcgcacgccaagaaacaagaggtggtagtactgggttctcaggagggggcaatgcataccgctctcacaggtgcgactgaaattcagaacagtggaggaacatctattttcgcgggtcatcttaaatgcagactcaaaatggataaattagaattaaaaggcatgagctatgcaatgtgtctaaacacttttgtgttgaagaaagaagtttcagaaacacaacatggcacaatattgatcaaagtcgaatataaaggggaggatgccccgtgcaaaattccgttcagtactgaagacggtcagggcaaagctcataacggtaggctaatcacggcaaatccagtagttacgaagaaagaagaacctgtgaatatcgaggcagaacccccttttggagaaagtaatatagtgataggtatcggagacaaagctcttaagattaattggtacaagaaaggaagctcaataggaaaaatgtttgaagctactgcacgaggagcacgaagaatggctatcctaggcgataccgcatgggattttggttcagtgggaggagtattaaattcgttaggcaaaatggtccatcaaatctttggctcagcgtacaccgctttattcagcggcgttagttggataatgaagataggaattggggttctgctgacgtggattggactcaacagcaaaaatacaagcatgtcgttctcttgtattgtaataggcattattacattataccttggtgcagtggttcaagcagatatggggtgtgtgattaattggaaaggtaaagaactaaagtgcgggtctggtatatttgtaacgaacgaagtacacacctggacagaacaatacaagtttcaagcggatagtccaaagcgtttagcaactgctattgcgggtgcctgggaaaatggggtttgtgggatacgaagcacgacacgaatggaaaacctactatggaaacagatcgctaatgagctaaattatatactttgggagaataatattaaacttacagtcgtagttggcgacatcatcggagtcttggaacaaggaaaacgaacattaacaccccaaccaatggagctcaaatacagttggaagacctggggtaaggctaagatagtaactgcagagacccaaaactcctcattcataatagatggacccaacactcctgaatgtccttctgcatcgagagcatggaacgtatgggaagtggaggattacggctttggggtatttaccacaaacatttggctaaaacttagggaagtctatactcaatcatgcgatcaccgcttaatgagtgcagcaataaaagatgaacgagcggttcatgcagatatgggctactggattgaaagtcaaaagaacggaagctggaaattagaaaaggctagctttatagaggtaaaaacatgcacgtggccaaaaagtcatacactgtggagtaatggtgtactagagtcggatatgataataccaaagtcattagcaggaccgatatcacaacataatcacagacccggataccatactcaaactgctggaccatggcatttgggtaagctagaattggactttaattattgcgagggtacaacagtagtcataacagaaaattgcggtaccagaggacctagcttgagaacgaccactgtatcgggcaagttaatacatgaatggtgttgtaggagctgtacgctgccccctttgagatatatgggggaggatggatgttggtacggtatggaaataagacctattaacgaaaaagaagaaaacatggttaagagtttggtatcagctggctcaggtaaaatggacaacttcactatgggaatactctgtcttgccatactcttcgaagaggtaatgcgtgggaagttcggcaagaaacacatgattgcaggcgtactatttacatttgtgctactattatcaggtcaaataacgtggagggatatggcgcatactctaattatgataggaagtaacgctagcgatcgaatgggaatgggagtaacatatctagcattgattgccacctttaaaatacaaccattcttagcactcggtttcttccttcggaaattgacaagtagagagaacctactattgggtgtaggtttagcaatggcaactaccttgcaactcccggaagatatcgaacagatggctaatggaattgccctaggattgatgaccttgaaattaattacacaattcgaaacatatcagttatggacggctctcgttagcttaacatgcagtaatacaatattcacactcactgtagcatggagaacagcaacacttatactagcaggagtatctctactcccactttgtcagagttcatcaatgcgcaaaaccgattggctccctatgacagtagccgctatgggcgtgccaccactgccattgttcatttttagtttaaaagatactcctaaaagaagatcgtggcctcttaacgaaggagtcatggctgtaggattagtttcgatattagctagttccttattaagaaatgacgtacctatggccggaccattagtggctggaggacttttgatagcctgttatgtgataactggtacgagcgccgatctcactgtagagaaagccgccgatgttacatgggaagaagaggcggaacaaacgggcgtatcacacaatctaatgataactgtagatgatgatggaaccatgcgaataaaagacgatgagaccgaaaatatcctgactgttcttcttaaaacggccttactaatcgtatcggggatatttccgtactccattcccgcaacactattagtctggcatacatggcaaaaacaaacacaacgcagcggcgttttatgggacgtaccaagtccacctgaaacacaaaaggccgaactagaagaaggagtataccgtatcaaacagcagggaatttttggaaagacacaagtaggagtgggagtacaaaaggaaggagtattccataccatgtggcatgtgacacgcggggctgttcttacacataacggtaagagattagaaccaaactgggcatctgttaagaaagatcttatctcttacggaggaggctggaggctttctgctcaatggcaaaaaggcgaagaagtgcaagtaatagcagttgaaccaggcaaaaatcctaaaaattttcaaacaatgcccggaatatttcaaacaacaactggcgaaatcggtgccatagcccttgactttaagccaggtacctcaggtagccctataatcaacagagaaggcaaagtagttgggctatacggcaacggggttgtgacgaagaatggtgggtacgtaagtggaatagcgcagacaaacgcagaaccagatggtcccactccggagttggaagaagaaatgttcaagaaaaggaatttaactataatggatctacatccgggaagtggtaaaacacgcaaatatctaccagcaatcgtcagagaagcaataaagagaagacttaggactttaatattagctccaactcgcgtcgtggcggcagagatggaagaagcattaaaaggtttaccgataaggtatcaaacgacagctattaaaagtgagcatactggacgagaaatagtggaccttatgtgccatgcaacttttactatgagattactgtcgccagtccgtgttccgaactacaatctcataataatggatgaggcgcatttcacagatccagcatcgattgctgcacgaggatacatatctacacgagtaggaatgggcgaagcggcagcaatttttatgacagctacgcctccaggtaccgcggaagcatttccccaaagtaacgctccgattcaagatgaagaaaaagatataccggagcggtcatggaactcgggaaatgagtggataacagactttgttgggaaaactgtgtggttcgttccgtcaattaaagcaggtaatgatatcgcaaactgtttaaggaaaaatggcaagaaagtcattcaactaagtagaaaaacattcgatacagaatatcagaaaactcgtctcaacgattgggattttgtagtaacaacagatataagtgaaatgggagcaaatttcaaagcagacagggttatagatcctcgaaggtgcttaaaacctgtcattctgacagacggaccagaaagagttatattagctggaccaatgcctgttacggcggccagtgcagcacagaggcgaggtagagtaggcagaaaccctcagaaagaaaatgatcaatacatttttacaggacagccattaaataatgatgaagatcacgctcattggacagaagcaaaaatgctactcgataacatcaacactccagaaggcattatacccgcacttttcgaaccagaacgagaaaagtctgctgctattgacggtgaatatcgattaaaaggcgaaagtcggaaaacctttgtagagctcatgaggcgcggcgacctaccagtgtggctcgcacataaagtcgcatcagaaggaataaaatatacagatcgaaaatggtgtttcgatggtgaacgtaataatcaaatactagaggagaatatggatgttgagatatggacaaaggagggggaacgtaagaaacttcgaccgcgatggctagatgctagaacgtatagtgacccgctagcactcaaagaatttaaagacttcgcagcaggcagaaagtcgattgcactagacctcgtaaccgagataggtagggtgccttcgcaccttgcacatcggaccaggaacgccttggataatctcgtaatgctccatacgtctgaacacgggggacgagcttaccggcacgcggtcgaagaattaccagaaacaatggaaacccttctacttctcggtctgatgatattactaaccgggggagctatgctatttcttatctcaggtaaagggatcggtaaaacgagtataggtctcatatgcgttatcgtgtccagcgggatgctttggatggctgacgttccactacagtggattgctagcgcaatagtgttagaatttttcatgatggtgctactcatcccagagccggaaaaacagcgaactcctcaagataaccaattagcctatgtggtgataggaatattaaccctagcagctattgttactgcgaatgagatgggacttctcgaaaccactaaacgagatctaggtatgagtaaagaaccgggagtggtgtcccctacttcatacctggatgtcgacctacatcccgctagtgcatggactctatacgccgtagcaacaactgttataacaccaatgctgagacatacaatagaaaattcaaccgcaaacgtgtcattagcagcgatagctaatcaagccgttgtgctcatgggtctggacaaaggatggccaataagtaaaatggatcttggtgtaccactccttgccctcggttgttattcacaggtgaaccctctcacattaacagctgcagtactgctcctagtaacacattatgcaattataggaccagggctacaggcaaaggcaacacgcgaggctcagaaaagaacagctgctggtattatgaagaaccccacagtggatggcataatgacaattgacctggatcccgtcatttatgactcaaaattcgaaaagcaactagggcaagttatgctattagttctctgcgcagttcaattattattgatgagaacatcatgggcgttatgtgaggcactcactttagcaactggacctattacaactttatgggaaggaagccctggaaaattctggaatacaacaatagcagtgagcatggctaatatattcagaggaagctacttagcgggtgcaggacttgcattttctataatgaagtctgtagggactggaaaaaggggtacaggctcacaaggagaaacattaggagaaaaatggaagaagaaactaaaccaattatctagaaaagagttcgacttatacaagaaatcaggtataacggaagtggatcgaacggaagctaaagaaggtctcaaaagaggtgaaacaacacaccatgccgtatcacgagggtcagctaaattacaatggttcgtggaacgtaatatggtaatcccagaaggtcgtgtaatcgatctaggatgcggacgaggtggttggtcctactactgtgcaggattaaagaaagtaaccgaagtgagaggatatacaaaaggcgggccaggtcatgaggaaccagtcccaatgagtacatatggttggaatatcgttaaactaatgtcagggaaagacgtgttctatttacctccagaaaaatgtgacacattgttgtgtgatatcggtgaatcctctccaagcccgacagtggaagaatcccgaacgataagggtactcaaaatggtggaaccgtggcttaaaaacaaccaattttgcatcaaggttttaaatccatatatgcctacagtaattgaacatttagagcgactacagagaaaacacggaggtatgttagtacggaacccacttagtcgtaacagtactcatgagatgtattggatctccaacgggacaggaaatatagttagttccgttaatatggtcagccgactgttattaaataggtttactatgacacacagaaggcccactattgagaaagatgtagatctgggtgcaggaaccaggcacgtaaacgccgagccggaaacaccaaatatggatgtaataggcgaacgaataaaaagaataaaggaggagcactcaagcacatggcattacgatgatgaaaacccatacaaaacttgggcctaccatggatcttatgaggtaaaagcaacaggaagtgcatcaagcatgatcaatggagtagtaaaactactaacaaaaccttgggacgtggttcccatggttacacagatggctatgactgatactaccccttttggtcagcaaagagtattcaaagaaaaggtagacacaagaacgcctcgaccaatgccaggaacacgaaaagtaatggaaataacagcagaatggctatggaggacacttggacggaacaaaagaccacgactctgcacgcgagaggagttcactaagaaagtaagaacaaatgcggcgatgggtgcagtatttaccgaagagaatcagtgggacagtgcgcgggctgcagtagaagacgaagaattttggaagttagttgacagagaaagagaacttcataaactaggtaaatgtggaagttgcgtatataatatgatgggtaaaagggagaagaaattgggcgagttcggaaaggctaaaggaagtagagcaatatggtacatgtggctaggagcgaggtatctagagtttgaggcgcttggattcttaaatgaagaccattggttcagtagagagaatagttactcaggagtagaaggagaaggacttcacaaactcggatatattcttagagacatatctaaaatcccgggaggtgcaatgtatgccgatgatacagccggttgggacacacgaataacagaagatgacttacacaatgaagagaaaatcacgcaacaaatggatccagaacatcgacaactagctaatgcaatttttaaacttacctaccaaaataaggtagtgaaagttcaaaggcctacgccaaagggcacagttatggacattatatcaagaaaggatcagcgtggttcaggtcaagtagggacatacggattaaacacttttacaaatatggaagcccaacttgttcgtcagatggaaggcgaaggtgtgttatcgaaagttgaccttgaaaacccacatttactagagaaaaagatcactcaatggttagaaacgaaaggagtggagcgtctacgaaggatggccatatcaggtgacgattgcgtcgtaaaaccaatagatgatcggtttgctaatgcattactggccctcaacgatatgggtaaggttcgaaaagatatcccacagtggcaaccctctaaaggctggcatgattggcaacaagtgccattctgctctcaccacttccatgaacttataatgaaagatggcagaaaattagttgtaccatgtaggccccaagatgaattaataggtagagctagaatctcacaaggcgctggttggtcattaaaggaaactgcgtgccttggaaaagcgtatgcgcaaatgtggagtttaatgtattttcatagacgcgacctaagattagcttcgaatgcgatttgctcggccgtcccagtgcattgggttccaacgtcgcgtacaacgtggagcatccatgcgcatcaccaatggatgaccacagaggatatgcttacagtttggaaccgagtatggatagaggataacccctggatggaagataagacaccagtgacaacgtgggaagacgtaccatatttagggaaacgtgaagaccaatggtgtggtagtctaatcggattaacgagcagagcgacttgggcccagaatatcctgacagcaatacagcaggtaagaagtttgataggcgacgaagagttcttagattatatgccaagcatgaaacgatttcggaaagaagaagagtccgaaggagctatatggtaa

SEQ ID NO: 23286 - RNA, 9873 nt, synthetic construct
  misc_feature 1..9873: note = derived and/or modified CDS sequence (opt6) from DENV-3__FJ744729__SS-prME
  source 1..9873: mol_type = other RNA
acaagtttgtgtctaatgatgatgttaccagcgactctagcatttcatttgacatcacgagatggtgaaccacgaatgattgtcgccaaaaatgaaagaggaaaaagtttactcttcaaaaccgcatctggaatcaacatgtgcactctaattgcgatggacctaggagaaatgtgtgatgatacagtaacatataaatgtccactcatagcagaagtggaaccagaagatatagactgttggtgtaatctgacaagtacctgggtaacatatggtacatgcaaccaagcaggagaacaccgaagggacaaaagaagtgtagcattagctccacacgttggaatgggtctagatactcgaacccaaacttggatgtcagctgaaggtgcttggaggcaagtcgaaaaagtagaaacttgggctctgcgacacccaggattcacaatcctcgcactttttctggcacactatattggaacttctctgacgcaaaaagtcgtgatttttatattattgatgctagtaacgccgtcgatgactatgcgctgtgttggagtaggaaaccgagacttcgtagaaggtttgtcaggtgctacatgggttgatgttgtattggaacacggaggatgcgtaactaccatggctaaaaacaaaccaacgctagacattgaactacagaaaactgaagcgacacaattagccacactgagaaaactatgcatagaaggaaaaataactaacattaccacagactcgcggtgtccaactcaaggagaagccatcttgccagaagaacaagatcagaattatgtgtgtaaacatacatatgttgaccgaggatggggtaacggatgtggactgtttgggaaaggttccctagtaacatgtgcaaaatttcaatgcttgaaaccaatagaaggaaaagtggttcaacacgaaaacttaaaatatactgtcattataactgtacatacgggagatcaacaccaagtcggaaacgacacacaaggagtcaccgttgaaataacaccacaagcatcaacagtcgaagcaatactaccagaatacgggactctcggtctcgaatgttctccacggactggattagactttaatgagatgattctattgacaatgaaaaacaaagcctggatggttcacaggcagtggtttttcgatctaccgttaccatggaccagtggagccacgactgaaaccccgacgtggaatcgaaaagaattattggtaacatttaaaaatgcacacgctaagaaacaagaggtcgtggtactcggatctcaagaaggagctatgcatacggctctgacaggagctacagaaatacaaaatagcgggggaaccagcatattcgccgggcacctgaaatgtaggctaaaaatggacaagctagaacttaagggaatgtcgtatgccatgtgcctaaacacgtttgtcctaaagaaagaggtctctgaaacacaacacggaactatcttaataaaagttgaatataaaggcgaagatgcaccatgcaaaattccgttttcaaccgaagatggtcaagggaaagctcataacggccgactgattacagcaaatccagtagtaactaagaaagaagaacccgtgaacatagaggcagagccaccgtttggagaaagcaacatcgttattggtattggcgataaagcgctaaaaataaactggtataagaaagggagcagtatcgggaaaatgtttgaagcaactgccagaggcgccaggagaatggccatcttgggggatactgcttgggatttcgggtctgtaggtggcgttttaaactcgcttgggaaaatggttcatcagatctttgggtcagcatacaccgcacttttctcaggcgtctcatggataatgaagatcggaataggagtactactcacttggatcggacttaattctaaaaacacaagtatgtcattttcatgcatagttatcgggataataaccttatatcttggggcagttgttcaggcagatatgggatgcgtaataaactggaaaggaaaggagctcaaatgcggtagcggtatttttgttacgaatgaagtgcatacttggaccgaacagtacaaatttcaagccgattcaccaaagagactagcaactgctatcgcgggagcttgggaaaacggtgtatgtgggataaggtcaactacacgtatggaaaatcttttatggaaacaaatagccaacgagcttaattacatcctatgggaaaacaatattaagttgacagtagtagtaggcgacattataggcgtgcttgagcaaggtaagcgaaccctaacgcctcagcctatggaattaaaatactcttggaaaacatggggtaaggcaaaaatcgtaaccgcagaaacacaaaactccagctttattatagacgggcccaacacacccgagtgtccatctgcctcaagggcatggaacgtttgggaagtagaagactacggttttggagtgttcacaacaaatatatggctaaagttacgtgaagtatatactcagtcatgtgatcacaggttaatgtcggcagcaattaaagacgaaagggcagtacatgctgatatgggttactggattgagtctcagaaaaacggctcgtggaaactagagaaggcttcgtttatagaagttaaaacatgtacatggccaaagagccacacgctatggagtaacggagtgctggaaagcgatatgattattccaaaatcattagcaggcccaatctctcaacacaaccatagaccgggttaccacacacaaaccgcaggaccttggcaccttgggaaactcgagctcgacttcaattattgcgagggtacaacagtggtgataacggaaaactgcggaacaagaggtcccagcttacgaacaacaaccgtgagtggaaaattgattcacgagtggtgttgcaggagttgcaccttacctccactaagatatatgggagaagacggatgttggtacggaatggaaattagacctataaatgagaaagaagaaaatatggtcaagtcacttgtatcagctggaagtggtaagatggataactttacaatggggatactctgcctagccatccttttcgaagaagttatgcgaggaaaattcggcaagaaacatatgatcgcgggagtattatttacgttcgtattattactaagcggacaaattacatggagagacatggcacacactttgataatgattggatcgaacgcaagtgacagaatggggatgggagtgacatacttagccttgatcgcaacatttaagatccagccatttcttgcattaggatttttcctcagaaaacttacgagtagagagaaccttttgttgggtgtgggtctcgcaatggctacaacccttcagctaccagaggacatagaacagatggcaaacggaatcgcactcggtctaatgacgctaaaactcataacgcaatttgaaacatatcaattatggactgcgttagtctcactaacatgcagcaatactatatttacattaactgtagcgtggagaactgccacactaattctagcaggcgtctctttattaccactatgtcaaagttcatcaatgagaaaaactgattggttaccgatgactgtagccgccatgggtgtgccaccgctacctctgtttatctttagtttaaaagacacaccaaaacgaaggtcgtggccgttaaatgagggagtgatggcagtaggcttagtatcaatattagcgagctcactactacgaaacgacgtacccatggcaggaccgctagttgctggcggactattgattgcgtgttacgtcataactggaacctctgcggatctcacggttgaaaaggcagcggacgttacgtgggaagaggaagcggagcaaaccggcgtttcccacaacttgatgataacggtcgacgatgacggcacaatgagaatcaaagacgatgaaacggagaatatattgacagtcttattaaagacggccctcttaatcgtaagcggaattttcccttattcaataccagcaactttattagtatggcacacttggcaaaagcaaacgcaacggagcggcgtactatgggatgttccatctccgccagaaacacagaaagcagaacttgaagagggtgtctatagaatcaaacagcaaggtatttttggcaaaacacaagtaggtgtcggggttcaaaaggaaggtgttttccatacaatgtggcatgttacccgcggcgcagtattaacacacaatggcaaaagacttgaaccaaactgggctagtgttaagaaagatctaatatcatacgggggaggatggaggctcagtgctcaatggcaaaaaggcgaggaggttcaagtaattgccgtagagccaggcaaaaatcccaaaaacttccaaactatgccaggaatatttcaaacaacaacaggagaaataggagcaattgcattagatttcaagcctggaacaagtggaagtccaattataaaccgagaggggaaggtagtgggattgtacggtaatggtgtagtaaccaaaaatggaggatatgtttcaggaattgcacagaccaatgcggaaccagacggtccaacacccgagttagaggaagaaatgtttaagaaaagaaatttaacgataatggacttgcatcctggaagcggtaaaactcgtaaatatctaccagcaattgtaagagaagcgataaaacgaagactacgtactctaatattagcaccaacacgggttgtagcagcggaaatggaagaggccttgaaaggtctcccgataagatatcagacaactgctatcaagtcggagcacacgggacgcgaaatagttgatttaatgtgtcatgcaacatttacaatgcgactcctatctcctgtgagggtgcctaactataatctaattatcatggatgaagctcattttacagatccagcgagtattgcggcacgaggctacatatctactcgcgtagggatgggtgaagcagctgcaatttttatgactgctacgccaccaggaacagcggaggcatttccacagagtaacgctccaatacaagacgaagaaagagatataccagaaaggagttggaacagcggaaacgagtggataacagattttgtcgggaaaacagtatggtttgtaccatctataaaggctggaaacgatatagcaaattgtctaaggaaaaatggcaagaaagtaatccaattaagcaggaagaccttcgatacagaataccagaagacacgactgaatgactgggacttcgttgtcacaactgatattagtgaaatgggagctaatttcaaagcagacagagttatcgacccacgaaggtgtctcaaaccagtcattttaaccgatggacctgaaagagtcatacttgccgggccgatgcccgtcactgcagcttcagcagctcaacggaggggacgagtcggaagaaatcctcaaaaagaaaacgaccagtatatttttactgggcaacctcttaataatgatgaagaccatgctcactggacagaggctaaaatgttacttgataacataaacactcctgagggtatcatcccagcattatttgagccggagagagaaaaatcagctgctatcgacggtgaatatagactaaaaggagagtcgcgtaagaccttcgtagagctgatgcgacgcggagacttgcctgtatggcttgcacataaagtagcatctgaaggaattaaatacactgacagaaaatggtgtttcgacggagaaagaaataatcaaatcctagaggaaaacatggacgtagaaatatggacaaaagagggagaacgaaagaagctgcgaccaagatggttagacgcgcgaacatatagtgacccacttgcattgaaggagtttaaagatttcgccgcaggtcgaaaatcaattgcacttgacttagtaactgaaatagggagggtcccttcgcatttagcacataggaccagaaatgcattagataacctggtgatgttgcatacctcggaacacggcggtagagcatacagacatgccgtggaagagttaccagaaaccatggaaactttgctactattaggactaatgatcctcctaactggaggagcgatgttatttttaatatcaggtaaaggcatcggtaaaacatcgataggcctgatctgtgtgatcgtttccagcggtatgctgtggatggctgatgttccgcttcagtggatagcatccgcgatagtactagagttctttatgatggtcctccttatccctgaacccgaaaagcagcgaacgccacaggacaatcaattggcttacgtagtaattggcatattaactctagcagcaattgtaactgccaatgaaatgggacttctagagaccaccaagcgggatcttggaatgtctaaagaacccggtgtggtgagtcctacgtcttatctggatgtcgatctgcatccagcaagtgcatggactctatacgcagtggctactaccgttataactcccatgctcagacatactattgaaaatagcaccgccaacgttagtctagcagcaatagcaaatcaagcagtcgttctgatgggattggataaaggatggccgatttcaaaaatggacttaggagtcccactcttagcgttagggtgctattcccaagtaaacccgttgacactcaccgccgcagtgttattattggttacacattacgcaataataggtccaggattacaagcaaaagccactcgcgaagcacaaaaacgaacagcagcaggtataatgaaaaacccaaccgtagacggaataatgactattgatttagacccagtgatatacgacagtaagttcgagaaacaactagggcaggtaatgctattagtactatgtgcagtacaattgctactaatgagaacaagttgggctttgtgcgaagccctcacgttagcaactggacccatcacgactttatgggaaggaagtcctggcaaattctggaatacaacgatagctgtatctatggccaatatctttcggggctcttatctcgcaggcgctggcttggcattctcaattatgaggagtgtaggaactggtaaacgaggaacgggtagccagggtgagactctcggcgaaaagtggaagaagaaactgaatcagctttcgcgaaaagagtttgatctatataagaaatctggtataactgaggtcgaccgcaccgaagcaaaagaaggacttaaaagaggggagaccacacatcacgctgtatcccgaggttccgccaaactacaatggttcgtagagagaaacatggtaattccagaaggacgagtgatagatctaggttgcggtcggggtggatggtcatattactgtgcaggattgaaaaaggtaaccgaggtcagagggtatacaaaaggtggaccaggccacgaagaacctgtaccaatgtcaacatatgggtggaatatagttaaacttatgtctggaaaagatgtattttatctgcctccagaaaaatgtgacacgttactctgtgatatcggtgagtccagcccaagtccaacagtcgaggaaagcagaacaattcgtgtcctcaaaatggtcgaaccttggctcaaaaataaccaattttgtataaaggtactgaatccttacatgcccacagtaattgagcatctagagcgtcttcaaagaaaacacggaggcatgttggtaaggaacccacttagccgaaatagcactcatgagatgtattggattagtaacggcacaggaaacattgtaagctcagtaaatatggtatctcgcttgctattgaatagatttacaatgacacatcgtaggccaacaatcgaaaaggatgtcgacttgggcgcaggaacgcgtcatgtaaatgcggaaccagaaacgcctaatatggacgtaatcggagaaagaataaagcgcattaaagaagaacactcttctacttggcattacgacgatgagaatccatacaaaacatgggcgtaccacggaagttacgaagtcaaagccacgggatcagcaagcagtatgatcaatggggttgttaaattgcttactaaaccatgggatgtagtaccaatggtgacacagatggctatgacggacactactccgtttgggcaacaaagggtctttaaagagaaagttgacacgcgtacaccgagacccatgcctggaacaagaaaagtaatggaaattacagcagaatggctatggcgaacacttgggagaaataaaaggccaaggctttgtactcgcgaagagttcacgaagaaagtacggactaacgctgcaatgggggctgtattcacagaagaaaaccaatgggactcagcaagagcagctgtagaagacgaagagttctggaagttagtcgatagggaaagagaattacataaacttggaaaatgtggaagttgcgtatacaatatgatgggaaaacgtgagaagaaattaggggagttcggtaaagcaaaaggatcccgggccatatggtacatgtggctaggggctagatatttagagttcgaagcattgggatttctaaatgaagaccactggtttagtagagaaaatagctatagcggagtagaaggggaaggtcttcacaagttagggtatattctaagggatattagcaaaataccgggcggcgcaatgtatgccgatgacactgccggatgggacaccagaataacagaagacgatcttcacaatgaagagaaaattacacaacagatggatccagaacatagacaattggccaacgcaatatttaaattaacgtaccagaataaggtagtcaaggtacagcgacctacgcccaaaggaacggtcatggacataatttccagaaaagatcaacgaggaagtgggcaagtcggcacgtatggtcttaacacatttactaacatggaagctcaattagttcgtcaaatggaaggtgaaggtgtattgtcaaaagttgatttagaaaatccacacttattagagaagaaaattactcaatggttggagacaaagggcgtcgaaagactacgcagaatggcaataagcggcgacgattgtgtagtaaagccaatagatgaccgatttgcaaatgcattattagccctaaatgacatgggtaaggttcggaaagacatcccacaatggcaaccatctaagggatggcatgactggcagcaagttccattttgtagccaccactttcatgaattaataatgaaagatggtagaaagctagttgtaccctgtagaccacaggacgaattgattggtagggcccgcatctcacagggagccggctggtccttaaaggagacagcgtgtcttggtaaagcatatgcacaaatgtggtcgcttatgtactttcacagaagagatctgaggctggcgagtaacgccatttgtagtgcagtaccagtgcattgggtacctactagccgtactacatggtccatacacgcacaccaccagtggatgacaactgaagatatgctaacagtttggaatagagtatggatagaagataacccctggatggaagataaaacacctgttacgacatgggaggatgttccctaccttgggaaacgggaagaccaatggtgtggatccctgattggattaacatcccgagccacctgggcccagaatatactaacggcaattcaacaagtaaggtcactaataggagatgaagaatttctagactacatgcccagcatgaaaagatttaggaaagaagaagaatccgaaggggcaatctggtaa

SEQ ID NO: 23287 - RNA, 9873 nt, synthetic construct
  misc_feature 1..9873: note = derived and/or modified CDS sequence (opt6) from DENV-3__FJ687448__SS-prME
  source 1..9873: mol_type = other RNA
acctcattatgtctaatgatgatgctacccgcgacacttgcattccatctaacgtctcgagatggagaaccacgtatgattgttgccaaaaacgaaagaggaaaatcactactttttaaaactgcatctggaattaacatgtgcaccttaatagcgatggatttaggagaaatgtgcgatgatacagtaacatataaatgtcctctaatagcggaggtagaaccagaggatatcgattgttggtgtaatctaacatcaacctgggtaacatacggaacatgtaatcaagctggcgaacacagacgggataaacgatcagtagcactagcaccacatgtgggaatgggcctagacacacggactcaaacgtggatgagcgcagagggggcatggaggcaagtagaaaaagtagagacctgggcattacgtcatcctggatttactatattagcacttttcctagcgcattacatcggaacctctctaacacaaaaagttgtaatatttatcctgttaatgcttgtaacaccaagtatgacaatgcgatgtgtaggggtcggtaatagagatttcgttgaaggcctatcaggggctacgtgggtagacgtagtactggaacacggcggttgtgtaacaacaatggccaaaaataaaccaactcttgatatagaacttcagaaaacggaggcaacacaactagcaacgctgcgtaaattgtgtatcgaaggcaaaataacgaacataaccaccgattcgcgctgtcccacacaaggagaggcaatacttcccgaagaacaagatcaaaattatgtctgtaaacacacctatgtagacagaggttggggcaacgggtgcggcctatttggaaaagggagcttagttacgtgcgcaaaattccaatgtctggaacccatagagggaaaagtagttcaacacgaaaatttaaaatatacagtcataatcacagtgcacacgggcgaccaacaccaagtgggaaatgatacacaaggagtaacagtagaaataacgcctcaagcaagtactgtagaagcaatactaccagaatatggtactttaggtttagaatgttcgcctagaacagggttggacttcaacgaaatgatccttctaacaatgaaaaataaagcatggatggtacaccgtcaatggttcttcgacctaccgttaccatggacctcaggagcaaccacggaaacaccaacatggaataggaaagaacttcttgtcacattcaaaaatgcccatgccaagaaacaagaagttgtcgtcctcgggtcacaagaaggtgccatgcacacagcattaaccggtgcaaccgaaatacaaaatagcgggggcacttcgatctttgcaggacatctgaaatgtaggctgaaaatggataaattggaattaaaaggtatgtcatatgcaatgtgtctgaatactttcgttttgaaaaaggaagtaagtgaaacccaacacggaacaatcttaataaaagttgaatataaaggagaagacgccccctgtaaaattccattttcaacagaggatggacaagggaaagcccataatggaagattgatcacagcaaacccggtagtgacaaagaaagaagaacccgtaaacatagaagcggaacccccatttggggaaagcaatattgtgattggcataggcgacaaagcattaaaaattaactggtacaagaaaggttcttccattggaaaaatgtttgaagcaactgctagaggtgcacgacggatggctattctgggagacacagcttgggacttcggaagtgtcggaggggtattaaactccctcggaaaaatggttcatcaaatcttcggtagcgcctacacagcattatttagtggcgtatcttggatcatgaaaataggtataggggtattattaacatggattggacttaatagtaaaaatacatcaatgtcattttcatgcatcgttataggtataattacactatatttgggagccgtggttcaagcagatatgggttgtgttataaattggaagggaaaagaattaaaatgcgggagcggaatattcgtcacaaatgaagtacacacgtggacggaacagtataaatttcaagcagatagcccaaaaagactagcgaccgcaatagccggtgcatgggaaaatggagtgtgtggaatcaggtccacgaccaggatggagaatttactatggaagcagatagcaaatgagctaaactatatactctgggaaaataatataaagctaacggtagttgtcggagacataattggagttttggaacagggtaaaagaactttaaccccacaaccaatggaacttaagtattcttggaaaacttggggtaaagcgaagattgtaacagcagaaacacaaaactcgtcttttataattgatggtcccaacactccagaatgtcctagcgcatcgagagcctggaacgtttgggaggtagaagactacggctttggtgtattcactaccaatatctggctaaaattgagagaagtttacacgcaatcctgtgaccatagactgatgtcggctgcaattaaggacgagcgggcagtacatgctgatatgggctattggatagaatcacagaaaaacggctcatggaaattagaaaaagcaagtttcatagaagtaaaaacgtgcacttggcccaagtcacacacattatggtcaaacggcgtgttggaaagtgatatgatcataccaaagtcgcttgctggaccaatttcacaacataatcaccgtcctggataccatactcaaacagccggcccttggcatctcggaaagctcgaattagactttaattattgtgaaggaactacggtcgtcattactgaaaattgtggaacgaggggcccaagtctaaggacaacgactgtatctggaaagttgattcatgaatggtgttgcaggtcgtgcactctacccccattaagatatatgggggaagatggatgctggtatggaatggaaattagaccaattaacgagaaagaggaaaatatggtgaagagtctggtaagtgccggatcggggaagatggacaattttactatgggaatactttgtttagcaattcttttcgaggaagtaatgcgaggcaaatttggcaagaaacatatgattgccggtgtgctatttaccttcgtcttacttttgagtggacaaataacgtggagagatatggctcatactcttataatgatagggagtaacgccagtgatagaatgggtatgggagtaacatatctggcactcatcgccacattcaaaatacaaccgtttctcgcgctaggatttttcctcagaaaattaacatcacgagaaaatttactattaggcgttggactggcaatggctacaacgttgcaactaccggaagatatagaacaaatggctaacgggatagcactaggtttgatgacgctcaagctaataacacagtttgaaacttatcagctctggactgcccttgtgagtctaacatgcagcaacacaatatttacactcacggtggcttggagaacggcaacactaatactagctggtgtatcacttttacctctttgtcaaagcagttccatgaggaaaacagattggctacccatgacagtggccgcaatgggagtcccacctctacctttattcatatttagtctaaaagatacacctaaaaggcggagttggcccttaaacgagggtgtaatggcagttggcttagttagtatattagcgtcatctttgctaagaaatgacgttccgatggcaggtcccttagtagcgggagggctccttatagcatgctatgtaatcacaggaacctcagcagatctgacagtggaaaaagcggctgacgttacttgggaagaggaggcagaacaaacaggcgtttcccataacctaatgattacggtcgatgacgatggaacaatgagaataaaagacgacgaaacggaaaacatacttacggtgctacttaaaacagcgcttttaatagtaagtggaatatttccatactctataccagccactctcctagtttggcatacatggcagaaacaaacgcaacgatcaggtgtattatgggacgtaccaagtccacccgaaactcagaaagccgagttagaagaaggtgtatatcgaataaaacagcaaggtattttcggaaaaacacaagtaggagtgggagttcaaaaagaaggtgttttccacacaatgtggcacgtgaccagaggagcagtcctgactcataatgggaaaaggctagaacccaattgggcgagcgtaaagaaagatttaatttcttatggaggaggttggagattaagcgcacagtggcagaaaggtgaagaagtacaagtgatagcagttgaaccaggtaaaaatccgaagaatttccaaactatgcccggaatttttcaaacgaccacaggagaaataggcgcaatcgctcttgactttaagccaggaacctccgggagccctattataaatagagaagggaaagtcgtaggattgtacggaaatggagtggttaccaaaaatggaggttacgtttctgggatagcacagacgaatgcggaaccagatggaccaacaccagaattagaagaggaaatgtttaagaaacgaaacttaacgataatggatctccatccaggtagcggtaaaacaagaaaatatctaccagctattgtaagggaggctattaaaagacgcttacgaacacttatactcgcaccaacccgggtagtggcggcggaaatggaagaagcattaaaaggactgccaattagatatcaaacaaccgctattaaaagcgaacatacgggtcgagaaatagtagacttaatgtgccatgccacctttactatgagactgctatcgccagtaagagttcccaactataatcttatcataatggacgaagcccactttaccgacccggcaagcatagcagccagaggatacattagtaccagggttggaatgggtgaagcagctgcgatattcatgaccgcgactccgccagggaccgcggaagcattcccacaatctaacgcccccattcaagacgaagaaagagatataccagaaaggagttggaactcaggcaacgaatggataactgactttgtaggaaaaactgtctggtttgtcccaagcatcaaggcagggaacgatatagctaactgtctgaggaaaaatgggaagaaggtaatccaattatcgcggaaaacattcgatacagaatatcagaaaacacgactaaatgactgggattttgtcgttacaacagatatcagcgaaatgggagcaaatttcaaagctgacagagtaatcgatcctagaaggtgcttaaaacctgtgatactaactgatggtccggaaagggtcatactcgcaggacctatgccagtaacggcggcgagtgctgcgcaaaggcgaggacgcgtgggaagaaacccacaaaaggaaaatgaccaatacatatttacgggacaaccactaaataatgacgaggaccacgcacattggactgaagccaaaatgttattggacaatatcaacacaccggaaggcataatacctgctctcttcgaaccagagagagaaaaatcggcggctattgatggagagtatcgactcaaaggtgaatcgcgaaaaacgtttgtggaactgatgcgtagaggtgacctgccagtctggctcgcacataaggtagcaagtgaaggcataaaatatacggatcgtaaatggtgcttcgatggagaaagaaacaaccaaatactagaagaaaatatggatgtggaaatatggacaaaagaaggtgagcgtaagaaactacgaccacgatggttagatgctcgaacatatagtgatccattagcattaaaggaatttaaagactttgccgcagggagaaaaagtatagccctagatttagtcacggaaataggccgcgtaccaagtcatctagcacatagaacccgaaacgcgctggacaatctagttatgctacatacatctgaacatggtggcagagcttatagacacgctgtggaagaactcccagaaaccatggagacgctactgctattagggttgatgatactattaaccggaggagcaatgctctttttaataagcggaaaaggcatagggaaaacaagtataggcctaatctgcgtaatagtatctagtggaatgctatggatggcagatgtgccattgcagtggatcgcatcagctattgtgttggaatttttcatgatggtcctactaattcctgaaccagaaaaacaaagaactcctcaagataatcagcttgcatatgtagttataggtatactaacattggccgcgatagtaacagctaatgagatggggctgctagaaaccaccaagcgagacctaggcatgtccaaagaaccaggtgttgttagcccaacctcctatctagatgtagatctacacccagcaagtgcatggacattatacgccgtcgcgaccacagtcatcacgccaatgctgagacatacaatagaaaactcgacagcaaatgtaagtctagcagcaatcgcaaaccaagcagtagtgctcatgggcctagacaaaggatggccaatttcaaaaatggacttaggagtaccactactagcgcttggatgttactcacaggttaaccccctgacacttacggctgctgtgttactcctagtaactcattatgccataataggccctggattacaagcgaaagctaccagagaggcacagaaaagaacagcagcaggtataatgaaaaatccaacagtagacggaataatgacgattgacttggatccagtgatatatgacagcaagttcgaaaagcaattagggcaagtaatgttacttgttttatgtgcagtgcaactcctgttgatgagaacaagttgggcattatgtgaggctttaacgttggcaacgggcccgataactacactctgggaaggatcgcctggaaaattttggaatacgacgattgcagtatctatggccaatatctttcgcggctcatatctggcgggtgccggcttagcgttcagtataatgaaaagtgtcggaacgggtaaaagaggtacaggatctcaaggggaaacgctgggtgaaaagtggaagaagaaactcaaccagttaagccgtaaggaatttgatctttataagaaatcaggaatcactgaagtagatagaacagaagctaaagagggtctaaaacgcggagagactacacaccatgcagtaagtcgaggaagcgcaaagttacaatggtttgtagaacgaaatatggtaattccggaaggtagggttatagatttagggtgtggaaggggtggatggagttattactgcgctggactaaagaaagtgacagaagttagaggatacactaagggtggccctggacatgaagaacccgtacccatgtctacgtatggatggaacattgttaaattgatgagcggaaaggacgtattttatctgcccccggaaaaatgtgatacgttattatgcgacattggagaaagcagtccatcaccaacggtagaagagagccggactataagggttttaaaaatggtcgaaccatggctcaaaaacaatcaattctgcatcaaggtgcttaatccttatatgcccaccgtgatagaacatttggaacgcctacagcgaaaacatggtgggatgttagtaagaaatccattaagtcgaaatagcacacacgaaatgtactggataagtaatggcacaggtaatatagtctctagtgtaaatatggtttcaaggttgctactaaatagatttacgatgacacaccggcgacctacaatagaaaaagacgtggatttaggtgctgggacaaggcacgtgaatgcagagcctgagacccctaacatggacgtgataggtgagcgcataaagagaattaaggaggagcatagttcaacttggcactacgatgatgagaatccatataaaacatgggcatatcacggatcatatgaagtaaaagcgactgggtcggctagttcaatgatcaacggagtagtcaagttattaacaaaaccgtgggacgtcgtccctatggtaacccagatggcaatgacagataccacaccattcggacaacaacgtgtcttcaaagaaaaggttgatactcggactccccggcctatgccgggaacgcgaaaagtaatggaaattacagcagagtggctctggaggacactcggtagaaataaaagaccaagattgtgcacacgtgaagaatttacgaaaaaggtccgaactaacgccgctatgggggcagtatttactgaggaaaaccaatgggactcggcgcgcgcggcagttgaagatgaagagttttggaagctagttgaccgtgagagggaattacacaagctcggaaaatgcggatcctgcgtatacaacatgatggggaagagagaaaagaaattaggagagttcggaaaggcaaaagggtcgcgagcaatatggtacatgtggctaggggcacgatatctggaatttgaagcgctaggctttctaaatgaagaccattggttctctagggaaaatagctacagtggtgtggaaggcgaaggattacataagctcggttacatactaagagatataagcaagataccaggaggagctatgtacgctgacgacaccgccgggtgggacactcgcataactgaagatgatttacacaatgaagagaaaataacacaacagatggatccagaacacagacaactcgcaaatgcgatttttaaattaacatatcaaaacaaagtggtgaaagtacagcgcccaacaccaaaaggcacggtcatggacataattagcaggaaagatcagagaggttcagggcaagtaggcacatacgggcttaatacgttcacaaatatggaagctcagctagtaagacaaatggaaggagaaggcgtactgtccaaagtcgacctggagaatccacatctacttgagaagaaaataactcaatggcttgaaacaaagggagttgagagattaagaaggatggcaatatcgggtgatgattgcgtcgtaaaaccaatagacgacagatttgcaaatgccttattagcgttaaatgatatgggtaaggtgagaaaagatattcctcaatggcaaccatccaaagggtggcatgattggcaacaggttccattttgctctcatcacttccacgaattaataatgaaggatgggcgtaaattggtagtaccatgcaggcctcaagacgagttaatcggacgtgcacgcatctcacaaggtgctggatggagtttaaaggaaactgcctgtctaggaaaagcatatgctcaaatgtggtcactaatgtacttccacagacgggacttaagactcgccagcaacgcaatttgttcagcagtccctgtacactgggttccaacatcgcgaacaacatggtcaatacatgctcaccaccagtggatgactacggaagacatgttaactgtttggaaccgcgtctggatagaagataacccctggatggaggataaaacacccgtcactacctgggaggacgtaccttatctaggcaaacgcgaagatcaatggtgtggcagtttaataggattaacatctagagccacatgggctcaaaatatattaaccgcgatacaacaagtaaggtctcttatcggggatgaagaatttctggattatatgccttctatgaaacgattcaggaaggaagaggaatcggagggagcaatctggtaa

SEQ ID NO: 23288 - RNA, 9873 nt, synthetic construct
  misc_feature 1..9873: note = derived and/or modified CDS sequence (opt6) from DENV-3__FJ744732__SS-prME
  source 1..9873: mol_type = other RNA
acttctttatgtcttatgatgatgctacccgcaacactggcgtttcatttaacttctagagatggcgaaccgcgcatgattgtggcgaaaaacgaacgaggcaaaagcctcttattcaaaacggcaagcggaattaacatgtgtacactaatcgcgatggatttgggtgaaatgtgtgatgatacggttacatataaatgtccattaatagcggaagtagaaccggaagatatagattgctggtgtaatttaacttcaacatgggttacctacggaacatgtaaccaggctggagaacatcggagagataaacgctcagttgctctagcgccacacgttggaatgggcctggatacaaggacacaaacatggatgagtgcagaaggagcatggagacaagtagaaaaagtagagacttgggctttgaggcatcctggcttcacaatcttagctttatttttagctcattacatagggacaagtctaactcaaaaagtggtcatttttatcctactaatgttggtcacaccatctatgacaatgagatgcgtgggcgtaggcaaccgagactttgttgaaggcctcagcggggcaacatgggtagatgtagtacttgaacacggcggatgtgttacgaccatggctaaaaataaacctacattggacatagaattacagaaaacggaagcaacccagctcgccacgttaagaaaactttgcatagaaggaaaaataactaatataacaaccgactctcgctgtccaacacagggagaagctattttgccagaagaacaggaccagaactacgtatgtaaacacacatatgtcgatagaggatggggtaatggctgcggcttatttggaaaagggagcttagttacttgcgcaaaatttcaatgtctagagccaattgagggaaaagttgtccagcatgagaacttaaaatatactgtaataattacagttcacacgggtgatcaacatcaagtaggtaacgatacccaaggagttacagtcgaaataacaccacaggcttcaacagtagaagcgatcttacctgaatacggcaccctgggacttgaatgttcgccaaggacaggactagactttaatgaaatgatactattgacaatgaaaaataaagcctggatggtacatcgacaatggttctttgacctcccattaccatggacttcaggcgcaacgacagaaaccccaacctggaatcgaaaagaactgctggtaacatttaaaaacgcacatgctaagaaacaagaggtagtagtcttaggaagtcaggagggtgctatgcataccgccctcactggtgccaccgaaatacaaaacagcggtggaacctctatatttgccggacacctcaaatgcagactaaaaatggacaaactagaactcaaaggaatgagttacgcgatgtgcttaaacactttcgtattaaagaaagaggtatcggaaactcaacatggaacgatactcataaaagttgaatataaaggagaagatgcaccctgtaaaatacctttttcaacggaggatggccagggaaaggcacacaatggtaggcttattacagctaatcccgtagttactaagaaagaggaaccggtgaacatagaagcggagcctccatttggcgaatcaaatatagtaataggcataggcgataaagcgttaaagataaactggtacaaaaagggctcaagtataggtaagatgtttgaagccactgccaggggagctagaagaatggcaatcctaggtgatacggcgtgggactttggttctgttggaggagtacttaattcattaggaaaaatggtacatcaaatattcggatccgcttacactgccttattcagtggagtatcttggataatgaaaattggaataggagttctcctcacatggataggcttgaatagtaaaaatacatcaatgtcgttttcctgtattgtaatagggataattacattatatcttggggcagtggtacaagcggacatgggatgcgtcataaattggaaaggtaaggaactgaaatgtggttccggcatttttgtgacaaatgaggttcatacttggacggaacaatataaatttcaagctgattccccaaaaagattagctaccgctattgctggagcttgggaaaatggggtgtgcgggatccgctcaactacgcggatggaaaacttactatggaaacaaatagcaaatgaactgaattacatcctttgggagaataatataaaattaactgtcgttgttggtgatattataggagtgttagaacaaggcaaaagaactttaacaccacaaccaatggagttaaaatattcgtggaaaacttggggaaaggccaaaattgtaacagcagaaacacagaatagtagtttcattatcgacggcccaaacacaccggaatgtccaagtgcaagtagagcatggaacgtatgggaagtagaggactacgggttcggtgtttttacaacaaatatctggctcaaattaagagaggtatacacccaatcatgcgatcacagactcatgtcagcagccatcaaggatgaacgagcggtgcacgcggatatgggatactggatagaaagtcagaaaaacggctcgtggaaattagaaaaagcaagttttatcgaagtcaagacctgtacatggccaaaaagtcatacattatggagcaacggagtattagagagtgatatgataattccaaaatcacttgcaggtccgatcagtcaacataatcatcgtccaggctaccatacacaaacagcaggaccttggcatttaggcaagttggaattagattttaactactgtgaagggacaactgttgtaataacggagaactgcggcaccaggggaccgtcacttagaacaacaacagttagtggtaaactaattcatgagtggtgctgtagatcatgcacattacccccactaagatacatgggggaagacggctgctggtacggaatggagatcagaccgataaatgaaaaagaggaaaacatggtcaagagtctcgtctcagctgggagcggaaaaatggataatttcactatgggtatcctctgcttggcaatacttttcgaagaagtgatgagaggtaaattcggaaagaaacatatgatcgcaggagtactatttactttcgtattactactctcaggtcaaataacatggcgagatatggcacacacactcatcatgatcgggtcgaatgcaagcgatagaatgggcatgggtgtaacatacttagctcttatagcaactttcaaaatacagccattccttgccttgggcttctttctacgtaaattaaccagcagagagaacttattgttaggagttggacttgctatggcgactacgctgcaactacctgaggatatagaacaaatggcgaacgggatagcattaggcctaatgacactaaaattaataacacaatttgaaacataccaactatggaccgctcttgtgtcattaacatgctcgaacacaatcttcacattgactgtagcatggcgaaccgctacgcttattttagccggtgtttcccttctaccactgtgtcagtcaagctcaatgagaaaaacagattggttgcctatgacagtcgcagcaatgggagtcccaccactcccattatttattttcagccttaaagacactccaaaacgtcgatcatggccgttaaacgagggtgttatggcagtaggccttgtatccattttagcgtcatcgttattgcggaacgatgttcccatggcgggcccattggtggctggtggcttacttatagcatgctacgtcatcacagggacatctgccgatctcaccgtcgaaaaagctgctgatgtcacatgggaagaagaagccgagcaaaccggggtcagccataatctaatgataacggttgacgacgatggtacgatgcgcattaaagatgatgaaacagaaaatattctaacagtattattaaaaacggcacttcttatagtcagtggaatttttccctactctattccggcgacgttgttagtatggcacacatggcaaaaacaaacacagagatcaggagtattgtgggatgtaccttctccacccgagacacaaaaggccgaattagaagaaggagtatatcgaattaaacaacaaggtatattcggcaaaactcaagtcggagtaggagttcaaaaggaaggagtatttcacacaatgtggcatgtcacaagaggagccgtcctaacgcacaatggaaaaagactggagcctaattgggcatcggtcaagaaagatttgataagttacggtggtggatggaggctgtctgcacagtggcaaaaaggcgaagaagttcaagtgatcgcagtagagccagggaaaaatcccaaaaactttcaaacgatgccaggtatcttccaaacgacaactggagaaattggagcaattgcccttgattttaagccaggaacgtcaggatctcctataatcaatcgtgaaggaaaagttgtagggttatacggaaacggggtggtcaccaagaatgggggttatgtttctggcatcgcacaaacaaacgcggaaccagatggtccaacccctgagttagaagaagaaatgtttaagaaacggaatttgacaataatggacctccatcctggttccggtaagactaggaaatatttacccgcgatagttcgggaagctattaaacggcgccttagaacattaatattggcgcctactagagttgtagccgctgagatggaggaggcactaaaagggttacctattagatatcaaacaacggccattaaatccgaacatacaggtcgggaaatagtagacctcatgtgccatgccactttcaccatgaggttactatcacctgttcgtgtaccaaattacaacctgatcattatggatgaagcacattttacggatcccgcttctatcgccgccagaggatatatttcaacaagagttggaatgggggaagctgcagcaatattcatgaccgccactcctcctggaactgctgaagccttcccccagagcaacgcacccatacaagatgaagaacgagacattccagagcgtagctggaactcaggaaacgagtggatcactgattttgcaggcaaaaccgtatggttcgttcctagtattaaagcgggaaacgacatagcaaactgtctacggaaaaacgggaagaaagtgattcaattatcgcgaaaaaccttcgacactgaataccagaaaacacgtctgaacgattgggactttgtagttacaacggacatttccgagatgggagctaatttcaaagcagacagagtcattgacccaagacgttgtctaaaaccagttatcttaaccgatggaccagagcgcgttatattggcaggacctatgcctgtgacagcggcgtcagcggcacaaagacggggtagagtcggacgtaatccacaaaaggaaaatgatcaatatattttcacaggccagcctctgaacaacgatgaagaccacgcgcactggacagaggctaagatgttactagataacattaatactccagaaggaattattcccgcgctatttgaacctgagcgagaaaagagtgccgcaatagacggtgagtatcgcctaaaaggtgaaagtagaaaaacgtttgtagaactaatgagaagaggtgatctgcccgtttggctagcacataaagtagcttcagagggaataaagtacactgatcgaaaatggtgctttgatggagagcgaaataatcaaatactagaggaaaatatggacgttgaaatctggaccaaagagggagaaaggaagaaactaaggcctaggtggttagatgcgaggacctattccgaccctttggctctaaaagaatttaaggatttcgcggccggacgcaagtctatcgcgttagatttggtaacagaaattggacgtgtaccaagccaccttgctcatagaactagaaatgcattagacaaccttgtaatgttacatacaagtgagcatggagggcgcgcttatcgacatgcagtagaagaactgccggagaccatggagactctgttactacttggcttgatgatcctgctaacgggtggggccatgttattcttaattagcggaaaggggattgggaaaacatcaatagggttaatatgtgtaatagtgagctcaggaatgctttggatggctgatgtaccgctccaatggattgcgtccgccattgttttagaatttttcatgatggtgttattaattccagaacctgaaaaacagagaacccctcaggataaccaactggcttacgtcgtaatagggatcttaacactagcggctatagttaccgccaatgaaatgggactacttgaaacaaccaaacgcgacctcggtatgtctaaggaaccaggcgtagtttccccaaccagctacttagatgtggacctgcaccctgcctcagcctggactctctacgctgttgcaacaacagtcatcacacccatgcttcgacatacaatagagaatagcacagcaaacgtttcgctagcagctatagcaaatcaggctgtagtactaatgggactagataagggttggccaatcagtaagatggatctaggggtgcctcttctagcgttagggtgctacagtcaagtcaatccattaacactcacggccgccgtactactattagttacacactacgcaattattggtcccggattacaagctaaagctactagagaagcacaaaagagaacagctgcaggaataatgaaaaacccaacagttgacggtataatgacgatcgatctcgatcctgttatatacgattctaaatttgaaaaacaacttggacaagtgatgttgttggtgctgtgtgccgttcaactcctactgatgagaacttcctgggcactttgtgaagcattaacgttagcgacaggtcctataacaacgttatgggaaggttcacctggaaaattctggaataccaccatcgccgtaagcatggccaatatttttcgcggaagctacctagccggtgcaggccttgcatttagcataatgaaaagtgtcggaaccggtaagagagggactggtagccaaggagaaacgctaggagaaaagtggaagaagaaacttaaccagctctcgcgcaaggagtttgatctctataagaaatccgggataactgaagtagatcgcacagaagcaaaagaaggtttgaaaagaggagaaactacgcaccacgctgtcagcagaggttcagcaaaactacaatggtttgttgaacgaaatatggttataccagaaggaagggtaattgacttaggttgcgggagagggggatggtcatactattgtgcaggtttgaagaaagtaaccgaagtaagaggatacactaaaggaggtccagggcatgaagaacctgtacccatgtcgacttacgggtggaatatcgtcaagttaatgtccggaaaggatgtattttatctaccacctgaaaaatgcgatacacttctgtgtgacattggtgagtcgtctccctcgccaacagtcgaggagagcaggactatcagagtcttaaaaatggtagaaccgtggctaaagaataatcaattctgcataaaagtattaaatccatatatgcctacggtgattgaacatttggaaaggttacagcgaaaacatggcggaatgcttgtaagaaaccccttatcaagaaattctacacatgaaatgtattggattagcaacggaacaggtaatatagtgtcctctgttaatatggtatcacgattactactaaataggttcactatgacacatagacgccccaccattgaaaaagatgtcgacttgggagccgggacacggcacgtaaatgctgaaccagaaacccctaatatggatgtaatcggagaacgaataaaacgaataaaagaagaacattcaagtacgtggcactacgatgacgaaaatccctacaaaacgtgggcatatcacggatcatatgaggtgaaggcaacaggctccgcttcatccatgataaacggagttgtgaaactgctaactaaaccctgggacgttgttcctatggtaacgcaaatggcgatgacggacaccacgccttttggccaacaacgagtatttaaagaaaaggtagacacacgcacgccaagacctatgccaggaacaagaaaagtaatggaaattaccgctgaatggttatggcgaactctgggacggaacaagcgacctaggctttgtactagggaagaatttactaagaaagttagaacgaacgccgcaatgggtgcagtgttcacagaagaaaatcagtgggactcagctagagcagcagtggaagatgaggaattttggaagttagtcgacagagagagggagctacataaacttggtaaatgtggttcatgtgtttacaatatgatggggaagcgagagaagaaactcggggagttcggaaaagctaaaggtagcagggcgatctggtatatgtggctaggcgccagatatttagaatttgaagcactaggctttctaaatgaagatcattggtttagccgagaaaatagctattctggtgtcgaaggagaaggattacacaaattaggatacatactgagggacatatctaaaataccaggaggtgccatgtatgccgatgatacagccggatgggatactcgcataacagaagatgatttacacaacgaggagaaaataacacaacaaatggatcccgagcaccgccagctggcaaatgccatattcaaattgacgtatcaaaataaagtggtgaaagtacaacgaccaactcctaagggcaccgttatggacatcatcagccgaaaggatcaaagaggatctggacaagtagggacttatggacttaataccttcacaaacatggaagcccagttagtaagacaaatggaaggtgagggggttctctcgaaagtagatcttgagaatccacatcttctagaaaagaaaataactcaatggctagaaacaaaaggcgttgagcgactgagaagaatggccataagcggagatgactgcgttgtgaaaccaattgatgacaggtttgccaatgcgttattggctttgaatgacatgggaaaagtcagaaaagatataccacaatggcaaccttcgaaaggctggcatgattggcaacaagtacctttctgtagccatcattttcacgaattaattatgaaagacgggcgtaaacttgtagttccatgtcggcctcaagacgagctaatcggccgagcaagaatatctcaaggagcggggtggagtcttaaagaaactgcttgtctcggcaaagcatatgcacaaatgtggtcccttatgtatttccacaggcgagacctaaggttagccagcaatgctatctgctcggctgttcctgtgcattgggtccctacctcacgaacgacatggagcatacatgcccaccatcagtggatgacgaccgaagacatgctaaccgtgtggaatagggtatggatagaagacaatccgtggatggaagacaaaacgcctgtcaccacttgggaagacgtaccatacttgggtaaaagggaggatcaatggtgtgggagtttgataggtctaacttctagagctacttgggcgcaaaatattttaacggcaatccaacaagtaagatctttaataggagatgaagaatttttagattacatgccaagcatgaaacgatttcgaaaggaagaagaaagtgaaggcgcgatatggtaa

SEQ ID NO: 23289 - RNA, 9873 nt, synthetic construct
  misc_feature 1..9873: note = derived and/or modified CDS sequence (opt6) from DENV-3__FJ810414__SS-prME
  source 1..9873: mol_type = other RNA
acttcactctgtttaatgatgatgttacccgcaactctcgcatttcacctaacaagcagggatggggagccgcgaatgattgttgccaaaaatgaaagaggtaaatcattactctttaaaacagcaagtggaattaatatgtgcacattaatagcaatggaccttggcgaaatgtgtgatgatactgtaacctataaatgccctctaatcgctgaggtagaacctgaggatatagattgctggtgtaatttgacaagtacatgggttacttacggaacatgcaatcaagcaggcgaacatcggcgagacaaaagatccgtggcattagcccctcacgtaggtatgggactcgatacgagaacccaaacatggatgtcggcagaaggggcatggagacaagtagaaaaagtagagacgtgggcactgcggcatccagggtttacaatcctcgctttattccttgcacactatataggcacctcccttacacaaaaagttgtaatatttattttactgatgttagttacaccgagtatgaccatgagatgtgtaggagtaggcaatcgagatttcgtggaagggctcagtggggcaacatgggtagacgtggtattagagcacggagggtgcgtaacaacaatggctaaaaacaaacccacattggatattgaattgcagaaaaccgaagcaacccaactggccaccctaagaaaattatgtattgagggaaaaattaccaatattacaaccgatagtcgatgtccaactcaaggagaggcaatactccctgaggaacaagaccaaaattacgtttgcaaacatacatatgtagacagaggatggggaaatggatgcggactattcggtaaagggagcctagtcacatgtgcaaaatttcaatgcttggaaccgattgagggaaaagtcgtacaacacgagaatctaaaatatactgtgatcatcacagttcatactggagatcaacatcaagtgggaaacgacactcaaggggttacagtagaaataacaccgcaagccagcactgtcgaggcaatcctacctgaatatgggactttagggctagaatgctctccacgaacaggactggattttaacgaaatgattttattaactatgaaaaacaaagcatggatggtacatcgacaatggttcttcgatttgccgctaccatggacatctggagctacaaccgaaacacccacttggaacaggaaagagttgttagtaacatttaaaaacgcacatgctaagaaacaagaagttgtagttctgggttcacaagaaggcgccatgcatactgctttaaccggcgctactgagatacaaaatagtggtggcaccagcatattcgcaggtcacctaaaatgccgcttaaaaatggacaaattagaactcaaaggaatgagttacgctatgtgtctcaatacttttgtattaaagaaagaagtctctgaaacgcaacatggcacaatactgattaaagtggagtataaaggtgaggacgccccctgtaaaatacccttttctacagaagatggacagggaaaagcgcataatggcagattaatcacagccaatccagttgtcacgaagaaagaagaacccgtaaacatcgaggccgaacctccttttggcgaatcgaatatagttataggcataggagacaaagctctgaaaattaactggtataagaaaggatcatctattggaaaaatgtttgaggctacggctcgcggcgcaagacgcatggcaatcttaggcgacacagcatgggatttcggatctgttggcggagtcctaaattctttaggcaaaatggtacatcaaatttttggatccgcatacactgcgcttttctcaggggtatcatggataatgaaaatcggcatcggcgttctattaacatggattggtctcaattctaaaaatacaagtatgtcattcagctgtatcgttataggcatcattactctttaccttggtgcggttgtgcaggccgatatggggtgtgttattaactggaaaggaaaagagttgaaatgcggtagtggaatatttgttacgaatgaagttcatacatggaccgagcaatacaaattccaagcggatagtccgaaacgtctcgcaaccgccatagccggagcgtgggaaaatggagtctgcggcattagatcaacaacaagaatggagaacctactatggaaacagattgcgaatgaattgaattatattttatgggaaaataatatcaaattaacggtggttgtaggtgacataataggagtactagaacaaggaaaaaggactttaacccctcaacctatggaattaaaatacagctggaagacttggggtaaagcaaagatcgtaacggccgagacccaaaactctagctttataatagacgggcctaatacgccagagtgtccaagtgcatctcgtgcttggaatgtgtgggaagtcgaggattatggtttcggggtctttaccactaacatatggctcaaattacgcgaagtatacacacaaagttgtgatcatagattaatgagcgctgcgatcaaagatgaaagagccgttcacgcagatatgggttattggatcgaatcacagaaaaatgggtcttggaaattagaaaaggctagttttatagaagtaaaaacgtgtacttggccaaaatcacacacgttgtggtcaaatggagtacttgaatctgacatgattatacctaaatctttagcaggtccaatctctcaacacaaccaccgtccaggttatcacacacaaacagcaggaccgtggcatctagggaaactcgagcttgacttcaattactgtgaaggaacaaccgtggtaataactgagaattgtggcacaagaggaccaagtttgagaacaacgactgtatcaggaaaactaatacacgaatggtgttgcagaagttgcacactaccacctttacgatatatgggtgaagacggctgttggtatggtatggaaattcgccctattaatgaaaaagaagaaaatatggccaaatctttagtcagtgctggatcaggaaagatggacaattttactatgggtattctatgtctagcaatcctattcgaggaggtgatgagaggaaaatttggaaagaagcatatgattgcgggcgtattattcacctttgttttattacttagtggtcaaattacatggagagatatggcacatacgttaatcatgataggttcgaatgcatcagacagaatggggatgggagtgacttacctggctttaatcgccacattcaaaatacaacctttcttagccttagggttctttctaaggaagctaacaagtcgtgaaaatttactgttaggagttggtcttgcaatggcgacaacactacaactcccagaagatatagagcagatggcaaacggtattgccctaggtctaatgacgcttaaactgattactcaattcgaaacataccagttatggaccgcattagtcagcttaacgtgctccaacacaatttttaccctaacagtagcctggagaacagcaactctaatactcgcaggagtgagtctactaccactatgccaatcaagttcaatgagaaaaactgattggttacccatgacagtagcagcaatgggagtgccacctttaccattatttatattttcactaaaagatacgccaaaacgaagaagctggccgcttaacgaaggcgttatggccgttggcctagttagcattttagcctctagcttacttagaaatgatgtccctatggctggcccattagtggcaggaggcttacttattgcctgttatgtcataactgggacatcagccgacctgactgttgaaaaagcagccgatgttacatgggaagaagaagccgagcagaccggagtatcacacaatttaatgattactgtagacgatgacggaacgatgcgcattaaagatgacgagacagagaatatactgacggttttattgaaaaccgcattgctgatcgtttcaggaatattcccatattcaatccctgctacgctactcgtctggcatacttggcaaaaacaaactcaaaggtcaggtgtattatgggatgtaccttcgcctccagaaacccaaaaagcagaattagaagagggcgtctatcgaataaaacaacagggaatatttggcaaaacccaagtaggggtaggcgtgcaaaaagaaggcgtattccataccatgtggcatgtgacccgcggagccgtacttacacataatggcaaacgcctagagccaaactgggcaagcgtcaagaaagatctaatttcatatggaggtgggtggagattatcagcgcaatggcagaagggtgaagaagttcaagtcatcgcggtggaaccgggtaaaaacccgaaaaactttcaaaccatgcccggaatatttcaaacaacgacaggagaaataggtgcgattgctctggatttcaagccgggcacatctggatctccaatcataaacagggaaggaaaggttgtgggattatatgggaatggagtcgttactaagaacggtggctatgtgagcggaatagcacaaacaaacgccgaaccagatggtccgacaccagaattagaagaagagatgttcaaaaagcggaatttaacaattatggatttgcatccaggttcgggaaaaaccaggaaatatttgccagctatagtaagagaagctattaagaggaggcttcggactctaatacttgctccgactagggtagttgcagcggaaatggaggaagcattgaaaggcttgcctattagataccaaacgacagcaatcaaaagcgaacataccgggcgagaaatagtcgatttaatgtgtcatgccacattcacaatgaggctattaagtccagtgcgggttcccaattataatctaattatcatggacgaagcacattttactgacccagcctctatcgctgccagaggttatatctcaacccgagtcggaatgggagaggctgctgcgatctttatgacagctacccctcctggcacagcagaagcattccctcagtcaaatgcacctatccaagatgaggaacgggacatcccggaacgtagttggaactctggaaatgaatggataacagattttgttggcaaaactgtttggtttgtaccttccattaaagcaggaaacgatatagcaaattgcttaaggaaaaatgggaagaaagtaatacaactaagtagaaaaacatttgatacagagtatcagaaaacgcgattaaatgattgggattttgtagtaacgacagacatttccgagatgggggcaaattttaaagcggatagagtaatagatccaagacgctgtttaaaaccagtaattttgacagacggtccggagagggtaatactcgcagggccgatgccagtaaccgccgcctcagccgcccaacgacgaggtcgagtaggaaggaatccacaaaaggaaaatgatcaatacatcttcactggtcaaccattgaataatgatgaggatcatgcgcattggaccgaagcaaaaatgttacttgataatatcaacacgcctgagggcataatacctgcactgtttgaaccagagagagaaaaatcagctgctatagacggcgaatacagactaaaaggagaatcgcgcaagacttttgtggagttaatgagaagaggagacctgccggtatggttggcacataaagtcgcttccgagggaataaagtatactgaccgaaagtggtgcttcgatggagaacgaaacaatcaaatattggaagaaaatatggacgtagaaatatggacgaaggaaggtgaacggaagaaattaagaccaagatggttagacgcgcgaacatactctgacccacttgcactaaaggaatttaaagacttcgctgcagggcgaaaatcaatcgccctggacctagtcaccgaaataggaagggttccttcccatttagctcacagaacacggaatgccttagataatttggtaatgcttcatacctccgagcatgggggtagagcttatcgacatgcagttgaagagttgcccgaaacgatggaaacccttttattactcgggttaatgatattgttgaccggaggtgcgatgctgtttttaatttctggaaagggaataggaaaaacgtccattggactgatatgtgtgatcgtaagctcaggcatgctttggatggctgacgtaccattacagtggatagcaagcgcaatagtactagaatttttcatgatggtcttgctcataccagaacctgaaaaacaacgaacccctcaagataatcagttagcgtacgtagtaataggcatcctaaccttagcagctatcgtaactgcaaacgagatggggcttttagaaaccacaaaacgagatctaggtatgagtaaagagccaggtgtcgtatccccaacctcttacctcgatgttgacctgcaccccgcaagtgcgtggacattatatgccgttgccacgacagtcatcacacccatgctacgccacacaattgaaaacagtacagcgaatgtaagtttagcagcaatagctaatcaagctgtcgtattaatgggtctagataaagggtggccaatcagtaagatggacctcggagtacccttactagctttaggatgctattcacaagtgaatccgttaacacttactgcggctgtattactattagtgacacactatgccataattggacctggattacaagctaaagcaacacgtgaagctcagaaaagaaccgcagccggcatcatgaaaaatccaactgtagacggtataatgactatagatctggatccggtcatatatgatagcaaatttgagaaacaacttggtcaagtaatgctactcgtattatgtgcggtacaacttcttctcatgcgtacaagttgggcgttatgtgaagctcttacattggccacaggcccaataactacattgtgggaaggaagccctggtaaattctggaatacgactatcgctgtgtcgatggcaaatatatttagagggagttacttagcaggagctggtttagcttttagcatcatgaaaagtgttggtacgggaaaaagaggaaccggctcgcagggggaaacattaggagaaaagtggaagaagaaactgaaccaactttcaagaaaagaatttgatttatacaagaaaagcgggattactgaagtagatagaacagaagcaaaagaagggctaaaaagaggggaaactacgcaccacgcagtttccaggggtagtgctaaacttcaatggttcgttgaaaggaatatggtaattccagaaggtcgggtaatcgatttgggttgcggacgaggagggtggtcctattactgcgcaggattgaagaaagtaacagaagtgagaggatacacaaaaggagggccaggacatgaagaacccgttcctatgtccacgtacggctggaatatcgtgaaactcatgagcgggaaggatgtattttatctgccacccgaaaaatgtgatacgttattatgtgacatcggggaatcatcaccaagccctacggtggaagaatcgaggacaatacgagttttaaaaatggttgagccatggcttaagaataaccaattttgtattaaggtactaaatccatacatgccgactgtaatcgaacatttagaaagattacaacgaaaacatggaggaatgctagttagaaatccgctaagccggaacagtacgcatgaaatgtactggattagtaatggcacgggaaatatcgttagtagtgtaaacatggtatcaagattgttgctaaatagatttacaatgactcacaggagaccaacaattgaaaaggacgtcgacttgggcgcgggtactagacatgtgaatgcagagccagaaacacctaatatggacgtaataggagagcgaattaaacggatcaaggaagaacattcttctacatggcactatgatgatgaaaacccttacaagacatgggcctatcatggatcctatgaagttaaagccactgggagcgcaagctcaatgataaacggagtagtgaaattactaaccaagccatgggatgtcgttccaatggtcacccaaatggctatgacagacacaaccccattcgggcaacagcgagtattcaaggaaaaggttgacaccagaaccccgaggccgatgccaggaaccagaaaagtaatggaaatcactgcagaatggctatggcgaacattaggaagaaacaagcggccacggctttgtactcgtgaagagttcaccaagaaagtaagaacaaatgccgcaatgggcgccgtgttcacagaagaaaaccaatgggattcagcacgagctgcagtggaagacgaagagttttggaaattagtagatcgagaaagagaacttcataaattaggaaaatgtggttcatgcgtgtacaacatgatgggtaaaagggagaagaaattaggtgaatttggaaaagcaaaaggaagcagggccatctggtatatgtggttaggagcacgatacctagagtttgaggctcttggctttctaaatgaagaccactggttttcaagggaaaactcttatagcggcgtagaaggcgaaggcctacacaaacttgggtatatcttaagggatatatcaaaaattcccggtggggctatgtatgcagatgacactgctggatgggatacacgaataacagaagacgacttgcataacgaggagaaaatcactcaacagatggatccggaacaccgacaattagctaatgcgatttttaagttaacatatcaaaataaagtagttaaggtacaaaggccaacgccgaaaggcactgttatggacatcatttctcgaaaagatcaacgaggttctggacaggtaggaacgtatggactaaatacctttactaatatggaggcccaattagttcggcaaatggaaggagaaggcgtgctaagcaaggttgacttggaaaaccctcatttgttagagaagaaaataacccaatggctcgaaacaaaaggcgttgagaggttgcgcagaatggcaataagtggtgatgactgtgtagtgaagccaattgacgatcgattcgcaaacgcattacttgcactgaacgatatgggaaaggtaaggaaagacataccacaatggcagccctcaaagggttggcatgactggcaacaagtgcctttttgttctcatcatttccacgaattaataatgaaggacggtagaaagttggtagtcccctgtaggcctcaagatgagttaattggtagggcgcggatatctcagggtgcaggctggtcgcttaaagaaacagcttgcttaggaaaagcatatgcgcaaatgtggagtctaatgtattttcacaggagagatctaaggttggcaagtaatgcgatatgctctgctgttcctgtacactgggtcccaacttcacgtaccacatggagtatccatgcgcaccatcaatggatgaccactgaagatatgttaacagtgtggaacagagtatggatagaagataacccctggatggaagacaaaacacctgttacgacctgggaggacgtaccatatcttggtaaacgagaagatcaatggtgcggatcattaataggactaacatcacgagcaacgtgggcccaaaacatcttgacagccatccaacaggttcggtcactcatcggggacgaggagttcctagactacatgccgtcgatgaaacgcttcaggaaagaggaagaatccgaaggcgcgatatggtga

SEQ ID NO: 23290 - RNA, 9873 nt, synthetic construct
  misc_feature 1..9873: note = derived and/or modified CDS sequence (opt6) from DENV-3__FJ744734__SS-prME
  source 1..9873: mol_type = other RNA
acatccctgtgtttaatgatgatgcttcccgctactctggcatttcatcttacgagcagagacggagaaccaagaatgatagtggctaaaaacgaaagaggcaaatctttacttttcaaaaccgctagcggcataaatatgtgtacattgatcgcaatggatctgggtgaaatgtgtgatgacacagttacctataaatgtccattaatagcagaagtagaaccggaagacatcgattgctggtgcaacctcacaagcacatgggtcacatatgggacatgtaatcaagcgggagaacatcgaagagacaaacgttcagtggcattagctccacacgttgggatgggtcttgacactcgcacacaaacctggatgtcggctgaaggcgcttggcgacaagtagaaaaagttgaaacatgggcactaagacatcctggattcacgatacttgctctattcctggcacactacatagggacttcattaacacaaaaagtcgtgatatttattttgctaatgctagtaactccttcgatgacgatgagatgtgttggtgtaggaaaccgagattttgtagaaggtctatcgggagcaacctgggtagatgttgtactagaacacggcggatgcgttacaaccatggccaaaaataaaccaacactagatattgaattacagaaaacagaggcaacccagctagcaacattgcgcaaactatgcattgagggtaaaataactaacatcacaaccgacagccgatgccctacccaaggcgaggcgattttgccagaagaacaggaccaaaattacgtttgcaaacatacatacgtcgacagggggtggggtaatggatgtggattgtttggcaaaggaagcctggtcacctgtgcaaaattccaatgccttgagcctattgagggcaaagttgtacaacatgaaaacctgaaatatactgttatcattactgtccatacgggggaccagcatcaggtaggcaatgacacacaaggcgtaacagtcgaaataactccccaagcatctacagtggaagctatactacctgaatatggtactttaggattagaatgcagtccacgtactggcttagattttaacgaaatgattttattgaccatgaaaaataaagcatggatggtacacagacaatggttctttgaccttccactaccgtggacttctggagctacaaccgagacaccaacttggaatagaaaagaactattagtcacgtttaaaaacgcacatgctaagaaacaagaggtcgtagtcctgggcagccaagaaggtgcaatgcatacagcattgacgggcgcaactgaaatccaaaatagtggcgggacatcaatctttgccggacatttaaaatgtcgattaaaaatggataaacttgaattaaaaggtatgtcatatgcaatgtgtttgaatactttcgtgctaaagaaagaggtaagcgaaacacaacatggaacaatactaatcaaagtggaatataaaggagaagatgcaccatgtaaaattccattctccacggaagatggacaggggaaagcgcacaatggaagactaataacagccaatccagtcgttactaagaaagaagaacccgtaaatatcgaagctgaaccaccctttggggaatccaatattgttatagggattggagataaagcactaaaaataaattggtataagaaaggaagttcaataggtaaaatgttcgaagcaaccgccagaggtgctagaagaatggcaattcttggtgacacagcatgggactttgggagtgtcggtggagttttaaactcacttggtaaaatggtccaccaaatcttcggaagtgcatacaccgctttattcagcggtgtaagttggattatgaaaatcggaataggtgtattactaacatggataggtttaaatagcaaaaatacttcaatgagtttttcatgcatcgtgattggaatcattaccctatatctgggtgctgtggtacaagcagatatgggctgtgtaatcaattggaaaggaaaagaactaaaatgtggctcaggtatttttgtaaccaacgaagtacatacgtggacagaacaatacaaatttcaggctgactctccaaaacgattggctactgccatcgctggagcgtgggaaaatggagtgtgtggcattcgctcaacaacaagaatggaaaaccttttatggaaacaaatcgcgaatgagctgaattacattttgtgggaaaacaacattaaacttactgtcgtggtaggagatatcataggagtgctagaacaaggtaaaagaacactcactccccaacccatggaattaaaatactcctggaaaacatggggtaaagcaaaaatagtgactgcagaaacccaaaactctagctttataatagatggacccaacactcccgaatgtccttccgctagcagagcctggaacgtgtgggaagttgaagattatggctttggagtttttaccacgaatatatggttaaaattgcgagaagtctatacacaatcatgtgaccatagactgatgtccgccgctataaaggatgaaagagctgtgcacgccgatatgggatattggattgagagtcaaaagaatggaagctggaaactcgaaaaggccagcttcatagaggtaaaaacatgtacttggcccaaatcgcacacactctggagtaacggagtgcttgaatcagacatgattattccaaaatccttggctggcccaatttctcaacataatcatcgaccaggttaccacactcagaccgcaggcccttggcatcttggaaaattagaacttgactttaattattgtgaaggaactacggtggttataacggaaaattgcggcacaagaggaccatccttacgtaccacaacagtgtctggcaagctaattcatgaatggtgctgtaggtcatgcaccttgccaccactacgttacatgggagaagacggatgttggtatggaatggagattcgaccaataaatgaaaaagaagaaaatatggtcaagtcgttagtaagtgcaggttcaggaaaaatggacaactttactatgggcatattatgtctcgcaattctatttgaagaagtaatgcgaggtaagtttggcaagaaacacatgatagcgggtgtattgttcacattcgttttattacttagtggacagataacatggcgggatatggctcatacattaataatgataggttctaacgcgtcagatagaatgggcatgggagtcacctacctggcgttaatagcaaccttcaagattcaaccttttcttgcactaggattctttttaagaaaactaacctcgagagaaaatcttcttctgggagtggggcttgccatggcaactactttacaattaccggaagacattgaacaaatggcgaacggtatagccttaggactaatgacgcttaaattgattacacagttcgaaacataccagttatggacagcattggtcagtcttacttgtagtaacacaatttttaccttaacagtagcttggagaactgcgacactaatcctagctggcgtgagcttacttcctctatgtcagtccagtagcatgaggaagactgattggttaccaatgacagttgcagcaatgggagtcccacccctgccattatttatatttagtttaaaggatacaccaaagcggcgctcttggcccctaaatgaaggggtgatggcagtagggttggtaagtatactagcatcgtctctattacgtaatgacgtacccatggctggccctctagtagcaggagggttattgatcgcctgttacgttataactggcacgtccgcagatctaacagtagaaaaagcagctgatgtaacttgggaagaagaagcagaacaaaccggtgtatcacataacttgatgattaccgtagatgatgatggcacaatgagaattaaagatgatgagacagaaaacatattaaccgttttattaaagacggcactgctgatagttagcggcatatttccatattctattccagcaacgctgttggtctggcatacatggcaaaaacaaacccaaagatccggagtcttgtgggacgtgccatctccacccgagacccagaaggcagaactcgaagaaggtgtttatcggataaaacagcaaggcatttttggaaaaacccaagtaggtgtcggggttcaaaaagaaggtgtgttccacacaatgtggcacgtaacaaggggcgctgtacttacgcacaatggaaaaagattagaacccaactgggcatcagtcaagaaagaccttataagctacgggggtggatggcggttatctgcacagtggcaaaaaggtgaggaagttcaggttattgctgtagaaccggggaaaaaccctaaaaactttcaaaccatgccgggcatttttcagactacgatgggtgaaatcggtgcgatagcgcttgacttcaaaccaggaacatctggttctccaataataaacagagaaggaaaagttgttgggttgtatggtaatggtgtagtcactaaaaatggagggtacgtgagcggaatagcacaaacgaacgctgaaccagatggcccgaccccagaattagaagaagaaatgtttaagaaacgaaaccttacaataatggatttacatccaggaagtggaaagactcggaaatacctacctgctatcgtacgtgaggcaataaagcgcagattacgcacgttaatcctagcaccaaccagggttgtcgccgcggaaatggaagaggctttgaaaggcctgccaataagatatcaaacaacagcaataaaatctgaacataccggccgtgaaatagtcgacttaatgtgtcacgcaacatttacaatgcgtcttttaagtcctgttagagttccgaattataatctgataatcatggatgaagctcactttacagatccggcctcaatagctgcgagaggatacatttcaacacgagttggtatgggagaagcagccgccatatttatgactgcaacaccgccgggcactgcagaagcattcccgcaatccaatgccccgatacaagatgaagagagagatattccagaaagatcatggaactctggcaatgaatggatcacagactttgtcggtaaaaccgtgtggttcgttccaagtataaaggctggtaatgatatcgccaactgtttaaggaaaaatggcaagaaagtaatacaattatctagaaaaaccttcgacacagagtatcaaaagacaagactcaacgactgggattttgtagttaccacagacattagcgaaatgggagcaaatttcaaagccgacagggtaatagatccccggagatgtttaaaaccggtaatattgacggacggccctgaaagagttatattggcaggcccaatgccagtcaccgcagcttcagctgcacaaagacggggtcgggtaggcaggaacccgcaaaaggagaatgatcaatatatatttacaggacaaccacttaataatgacgaagaccatgctcattggactgaagccaaaatgctactggacaatataaataccccagaagggatcattcctgccctattcgaaccagaaagagagaaaagtgcagcaatagatggagaatacaggttaaaaggtgagagccgcaaaacattcgtggagttaatgcgcagaggtgatcttcctgtatggttagcgcataaagtggcttctgaaggaataaaatatactgacagaaaatggtgctttgacggggaaaggaataaccaaatattagaagaaaatatggacgtagaaatatggacaaaagagggtgaaagaaagaaattaagacctaggtggctagacgcacgtacatatagtgatcctttagcattaaaagaatttaaagactttgctgcaggccgtaaaagcatagctttagacctagtaacggaaataggccgagttccatcccatttagcccacagaacaagaaacgccctcgataatttagtgatgttacacacatccgaacacgggggtcgtgcgtatagacacgcagttgaagaattaccagaaacaatggaaacgctcttactactgggactaatgatattattaacaggaggcgctatgctgttcttaatatcagggaagggaattgggaaaacatctataggattaatctgtgttatagtatcatcaggaatgctgtggatggcagacgttcctttacagtggattgcaagtgccattgtcttagagttctttatgatggttcttctaatcccagaacccgaaaaacagagaaccccacaagataaccagttagcgtatgtcgtaatagggatattaacactagctgcgattgtcactgcaaatgaaatgggactgttagagaccactaaacgtgatctcggcatgagcaaagaaccgggcgtagtatcaccaacatcatatcttgatgtcgatcttcatcctgcgagcgcctggactctgtacgctgttgctacaacagtgattacacccatgttacgacatacaatagaaaattcaacggcgaatgtatcgcttgccgctatagctaatcaagcggtggtattgatggggctggataaggggtggccaattagtaaaatggatttaggcgtacctctactagcactggggtgttattcacaggttaatccattgacactgacagcagctgtactattgttagtaacacactacgcaattattggacctggcctacaagcgaaagctacacgagaagcacaaaaacgaactgccgcaggaataatgaagaatcctactgtggatggaatcatgactattgacctggatcctgtgatttacgattcgaaattcgaaaaacaattaggacaggtgatgttacttgtcctctgcgcggtacaacttctgttaatgcgtacctcttgggctttatgcgaggctttgacactagcaacagggccaataacgactctatgggaaggatctcccggaaaattttggaatacaaccatagccgtatcgatggcaaacatattcagaggaagctacttggccggggccgggttagcattcagtataatgaagtcagtagggactgggaaacgcggcacgggaagtcaaggtgaaacactaggagagaaatggaagaagaaattaaaccaactctcacgaaaggaatttgatctctacaagaaaagtggaattactgaggtagacaggacagaggctaaagaaggtctaaaaagaggggaaacgacgcatcatgctgtgagtagaggtagtgcgaaactgcaatggtttgttgaaagaaacatggtgataccagaggggcgagtcatagacttggggtgcgggagaggaggatggtcctattattgtgcggggctgaagaaagtaactgaggtacgcggttatacaaagggtggaccaggtcatgaagaaccagtaccaatgagcacttacggttggaatatcgttaagctaatgtcgggtaaggatgtattttaccttcctcccgagaaatgtgataccctgttatgtgacataggtgaatcgtctccatccccgacagtcgaggagtcgaggacgatccgtgttttaaagatggttgaaccatggctcaaaaataatcagttttgcattaaggtattaaatccatacatgcccacggtaatagagcacctagagcgactgcaacgaaaacacggcgggatgttagtacgaaacccattaagtcgtaactctacacatgaaatgtattggataagcaatgggacaggaaatattgtatccagcgtaaacatggtcagccgtttactcctaaataggttcacaatgacacatcgacgtccaaccatagaaaaggatgtagacctcggcgcaggcactaggcacgtaaatgcggagccagaaacgccgaacatggacgtgataggagaacgcataaaacgaataaaagaggaacatagttcgacttggcactacgatgacgagaacccgtataaaacttgggcgtaccacggtagttacgaagttaaagctacaggaagtgcatctagcatgatcaatggcgttgtaaaactactaacaaaaccatgggacgtcgtaccaatggtgactcaaatggcgatgactgatacaacaccgtttggtcaacagcgtgtattcaaagaaaaagtagatactagaacccccagacctatgccaggaaccagaaaagttatggagattacagcagaatggctatggagaacactaggaaggaataagcgaccacgactctgtacaagagaagaatttacaaagaaagttcgtacaaacgcagcgatgggagcagtattcactgaagaaaatcagtgggacagcgcccgtgcagccgttgaagacgaagaattttggaaattggtagacagagaaagagaactacataaactaggaaaatgtgggtcgtgtgtttataatatgatggggaaaagggagaagaaactaggagagtttggaaaagctaaaggttcgcgagcaatatggtatatgtggctaggggcgaggtacctcgaatttgaagcattgggtttcctaaatgaggatcattggtttagccgagagaacagttatagtggtgtagagggtgagggactccataaactaggatacattcttcgtgacatatcaaaaattccaggtggagcgatgtatgcagatgacactgcgggatgggacacacggataactgaagatgatctccataacgaagagaaaataacccaacagatggatcctgaacacagacaactggcaaatgctatcttcaagttaacatatcagaataaagtggttaaggtacaacgaccaaccccaaaaggtaccgttatggacattatatcacgtaaggaccaacgaggatcagggcaagtaggaacttatggactaaacactttcacaaatatggaggcccagctcgtgcgacaaatggaaggagagggagttttgagcaaagtagatcttgaaaatccacatttacttgagaagaaaattacccaatggttagaaacaaaaggtgtcgagcggttgaggcgaatggcaattagtggggacgattgcgtagtcaaaccgatcgatgaccgtttcgcgaacgctctactagcgcttaatgacatgggaaaggtaagaaaagacataccacaatggcaaccctctaaagggtggcatgactggcagcaagttccattttgttctcatcattttcatgaacttataatgaaggacggaaggaaattagtagtaccttgccgccctcaagacgagttaataggtagagccagaataagccagggggctggatggagcctaaaagaaactgcatgtctaggcaaggcgtatgcacaaatgtggagcctaatgtacttccatcggagagatcttaggttagcaagtaacgctatatgctcagctgtacctgtacattgggtgccaacaagccgcaccacatggagcatacatgcacatcatcaatggatgactactgaagacatgctcacggtctggaacagagtctggatagaagacaatccctggatggaagataaaacgcccgtcactacatgggaggacgtaccttatctgggcaaaagggaggatcagtggtgcggatctctaattggattaacttcgcgcgcaacatgggctcaaaatatattaacagctattcagcaggttaggagtttaataggggatgaggaatttttggactatatgccttcgatgaaacgatttcgaaaagaagaagaaagcgaaggggcgatttggtaa

SEQ ID NO: 23291 - RNA, 9873 nt, synthetic construct
  misc_feature 1..9873: note = derived and/or modified CDS sequence (opt6) from DENV-3__FJ744737__SS-prME
  source 1..9873: mol_type = other RNA
acgtccttatgtctaatgatgatgttacctgcgactttggcattccatctaacatcaagagacggggaaccgagaatgatagtagctaaaaatgaacgaggaaaatcattattgtttaaaacagcgagtggcataaatatgtgtactttaatcgcgatggatctgggagaaatgtgcgacgatacagttacatataaatgccccctcatagcagaagttgaaccagaagatatagattgttggtgtaatttgacatctacctgggttacttatggcacatgtaatcaagccggtgaacatagaagggataaaagatcagtcgcactggcaccgcatgtgggtatggggttggataccagaacacaaacttggatgtccgcagaaggagcatggagacaagtcgaaaaagtagaaacctgggctctaaggcatccaggatttacaattttggctttatttcttgcgcattatatagggacaagcctgacccaaaaagtagttatattcatcttgttgatgcttgtaaccccatccatgacgatgcgatgtgttggagtaggtaacagggattttgtggaaggattgtcgggcgctacatgggttgatgtcgtattagaacacggtgggtgtgtgacaactatggccaaaaacaaaccaaccctagatattgaactacagaaaacagaagctacccaacttgccacattacgtaaactttgtattgagggtaaaatcactaacataacaacggactcaaggtgccctacacaaggagaagcaattctaccggaggagcaggaccaaaattatgtgtgcaaacacacttatgtggatagaggctggggtaatggttgcggtctcttcggaaaaggcagtctagtaacgtgcgccaaatttcaatgcctagaaccaattgagggaaaagtagtccagcatgaaaatctaaaatacactgtgattatcacagtacatacaggagatcaacatcaagttggaaatgatactcaaggagtaacagcggaaattaccccacaagcaagtacagtagaagcaatactccctgaatacggcaccctaggcttggaatgctcgccaagaactggcctagacttcaatgagatgatacttctcaccatgaaaaataaagcatggatggtgcatcgacagtggtttttcgatctccccttgccgtggacctctggcgcaacaacagaaacacccacctggaacagaaaagaattgttggtcacgtttaaaaatgcccatgccaagaaacaagaagtggtggtgctagggtcacaagaaggcgcaatgcacactgcactaactggagcaacagagattcaaaattctggtgggacaagcatcttcgctggacatctcaaatgccggcttaaaatggacaaactagaactcaaaggtatgagttatgcgatgtgtttaaacacttttgtcctcaagaaagaggtcagcgaaactcaacatggaacgattttaatcaaagtagaatataagggtgaagatgcaccgtgcaaaatcccttttagtaccgaagacggacaaggaaaagcacacaacggtagattaatcaccgcgaatcccgtagtaactaaaaaggaagaacctgtcaatatcgaagccgaacctccatttggtgaatctaatatagttatcggcataggtgataaggctttaaaaattaattggtataagaaaggctcatcaatcggaaaaatgttcgaagcaactgcaagaggagcaaggagaatggcaatattaggagacacggcgtgggatttcggatcggtgggtggagttttaaatagcctaggtaaaatggtacatcagatatttggttctgcttatacagcgttatttagcggcgtatcctggataatgaaaataggtataggagtactattgacgtggataggacttaacagcaaaaatacaagtatgagcttttcgtgtattgttatcggaatcataacattatatttgggagcagtagtgcaggcggatatgggatgtgtaattaactggaaggggaaagaattgaaatgcggatcagggatcttcgtcactaatgaagtacatacatggacagaacagtataagtttcaggcagacagccctaaacgactggcaacagcaatagcaggcgcatgggaaaacggagtatgcggaatcagatctacaacaagaatggaaaatctcttgtggaaacagatagcaaatgaattaaactacatcctgtgggagaacaacataaaactaacggtcgtagtaggagacattataggcgtactggagcaaggcaaaagaactctaaccccacagccaatggagctaaaatactcatggaaaacatggggcaaagcgaaaatagtaaccgcagaaacacaaaacagcagtttcataatcgacggaccaaacacaccagaatgtccgagcgcttcaagggcttggaatgtgtgggaagtagaagactatggcttcggagtgtttactacaaatatctggcttaaactcagagaagtttatacacaatcatgtgaccatagattaatgagcgccgctattaaagacgaacgtgcagttcatgccgatatgggttactggatagagtctcagaaaaatggatcatggaaattagagaaagctagttttatagaagtcaaaacttgtacgtggccgaagagtcacacactatggtcgaacggggttttagagagtgacatgataatccctaaatcattagcagggccaattagccaacacaatcatagacccggttatcatacgcaaacagccggaccgtggcacttaggcaaattagagttagattttaactattgcgaaggtactacggtcgtaataactgaaaattgtggaactcgagggcccagtttaagaaccacaacagtaagtgggaaacttatccacgaatggtgttgccgcagttgtacactccctccgttgagatatatgggagaagacggctgctggtatggtatggagatcaggcccattaacgaaaaagaagaaaatatggtcaagtctttagtttcagcgggatctgggaaaatggataactttaccatgggtatactatgtttggcaattctatttgaagaagtaatgcgcggcaaatttggtaagaaacatatgatagcaggagtactatttaccttcgtcttattattaagtgggcagataacgtggagagatatggctcatactctcataatgataggatctaatgcttcagatagaatgggaatgggggtcacttaccttgcgctcatagcgacatttaagattcagccatttctggcgttgggtttcttcctaagaaaattaacgtctagagaaaatttactgctaggagtcggcctcgccatggccactactctacaacttcctgaagatatagaacagatggctaatggaatagccctcggcctaatgacacttaaactcataacccagttcgaaacatatcaactatggacagccctagtaagcctaacgtgttccaatacaatatttacccttacagtagcctggagaacagctacattgatattagcaggcgttagcctcctaccactatgccaatcatcatccatgcgaaagacagattggctacctatgacagtggctgctatgggtgttccgccactaccgttattcattttcagcctcaaagatacacccaaaagaagaagttggcctttaaatgaaggagtgatggcagtagggcttgtaagtatattagcgagcagtttattacgtaatgatgtccccatggcgggcccacttgtcgctggaggattactaatagcttgctacgtaatcacaggtacatcggctgatctaacagtggaaaaagcagccgatgtgacttgggaagaagaagcagaacaaacaggggtaagtcataatcttatgatcacagtggacgatgatggaaccatgcgtatcaaagatgatgaaaccgaaaacatcttaacagtattattgaagacagccctccttattgtgagtggaatatttccatatagcatcccagccacactcttagtatggcatacgtggcagaaacagactcagagaagtggcgtcctctgggatgtccctagtccgccagaaactcagaaggctgaattagaagaaggagtttataggattaaacagcaaggaatttttggcaagacgcaagtcggggtgggtgtacaaaaggaaggagtatttcatacaatgtggcatgttacaagaggagcagttctcacacataatggtaaacgactagagcccaactgggcaagcgttaagaaggacttaatatcttatggaggagggtggagactaagcgcccagtggcaaaaaggggaggaagtgcaagttatagctgtagaaccagggaaaaaccccaaaaactttcagacaatgccaggtattttccagacaacaactggcgaaataggagcaatcgctttagactttaagcctggcacttccgggagcccaattatcaacagggaaggtaaggttgtcggattatacggtaatggcgtcgtaactaaaaatggtgggtatgtaagcggaatcgcacagacaaacgcggaacctgatggaccaacccctgaacttgaagaagaaatgttcaagaaaaggaatttgacgataatggatctacatccgggctcggggaaaacccgaaagtacttaccagcaatagtgcgcgaagcaattaagagacgattacgaacattgatcttagcgccgactcgcgtcgtcgccgcggaaatggaggaggcactaaaaggacttcccattagataccaaacaacagcgataaaatcagaacatacgggccgagaaattgtcgatttaatgtgccacgccacattcacgatgcgtcttctcagtcctgtacgcgtacccaactataacttaatcattatggatgaagcacatttcacggacccggcctcaatagctgccagaggatacataagtaccagagtaggcatgggcgaggctgccgccatattcatgaccgcaacgcctccaggtactgcagaggcttttccacaatcaaatgctccgatacaagatgaagagagggacataccagaaagatcttggaacagtggaaacgagtggatcacagactttgtcggcaaaactgtatggtttgtaccgtccataaaggcgggaaacgatatcgcaaactgccttaggaaaaatgggaaaaaggtaatacaactaagtagaaaaacgtttgatacagaatatcagaaaacgcgactaaatgactgggatttcgtagtcaccaccgatattagcgaaatgggcgcaaatttcaaagcagatcgagtcatcgacccccgtcgatgtctaaagcccgttatattaactgacggcccggaacgtgtgatactagcgggccctatgccagtaacggcggcatcagcagcgcagaggagaggtagagtgggcagaaacccacagaaagaaaacgatcaatatatatttactggccaaccccttaacaacgatgaggatcatgcgcattggactgaagccaaaatgttattagacaatataaacactcctgagggtataattccagcactgtttgaaccagaacgagagaaatctgctgctatagacggagaataccgcttaaagggagagtcacggaagacttttgttgaactaatgcgtagaggcgacttaccagtatggctagcacataaggtggcatcggaaggcataaaatacactgacagaaagtggtgcttcgatggcgagaggaacaaccagatactagaagaaaacatggacgtggagatctggactaaagaaggagagagaaagaagctacgaccacgatggttagatgcacgtacttatagtgatccattagcgctaaaagaatttaaagactttgctgcagggcgcaaaagcatcgcattagatctcgtcactgagatcggccgagtaccctctcatctagcacatagaacacgcaacgcccttgataacctggtcatgttgcacacatcagaacacggcggtagggcatatcgccatgctgtagaagaattaccagaaaccatggaaacgctattattattaggcttaatgatattactaaccggtggagctatgttatttttaatatcaggtaaggggattggaaaaacaagcattggattgatctgcgtgattgtatcaagcggcatgctatggatggccgacgttcccttacaatggatcgcctccgctattgtccttgagttcttcatgatggtactgttaatccctgaacctgaaaaacaacggacaccacaagataatcaactcgcgtacgttgtaattggtatccttactttggctgcgatagttacagcaaacgaaatgggattgttagaaaccacaaaaagagaccttggtatgtctaaagagccgggagttgtatcacctacgtcttacttggacgtagatctacatccagcatcagcctggacgctttatgcagtagcaactaccgtaataactcccatgttaagacatacaatcgagaactcaacagcaaatgtcagcttagctgcgatcgctaatcaagctgtggtcctaatgggtttagataaaggatggccaatctctaaaatggatttaggagtacccctattagccctggggtgctattcacaagtaaacccacttactttaacagctgcggtgttattattagtaacacattatgcaatcattggaccaggcttacaagcaaaagcgactagagaagcccagaaaagaaccgcagccggtataatgaaaaatccaacagtagatggaataatgacaatcgatttagaccccgtgatttacgattccaaatttgaaaaacaattaggccaagtcatgttactggtcctttgtgcagttcaattactcctcatgcgaaccagctgggcactatgtgaggctttgacgttagcaaccgggccaataacaacgctatgggaagggtcaccaggcaagttctggaacactacgatcgcagtgtccatggcaaatatatttagaggatcttatctcgccggcgcaggactggcttttagtataatgaaaagtgtaggaacaggaaagcgcggcactgggagtcaaggtgagactctaggagaaaaatggaagaagaaattgaatcaactatcaagaaaagaatttgatttatataagaaatccgggattacagaggtagatcgtacagaggctaaagagggactaaagcgcggcgaaactacacaccatgcagtaagtaggggaagtgccaaattgcagtggttcgtagaacgaaacatggtgatacctgaggggcgtgtaatagacttaggatgcggtcgtggtggctggtcctactattgtgcaggtctcaagaaagtaacggaagttagggggtatactaaagggggtccaggacatgaagaacctgttccgatgtcaacttacggttggaatattgtcaaattaatgagcggaaaagatgtattttacctcccaccagagaaatgcgacaccctactatgcgacattggagaaagttctccatctcctactgtcgaagagtcgcgcacaatccgagtattaaaaatggtcgagccttggttgaaaaataatcagttttgtattaaagtattaaatccatatatgcctacggtaatcgaacacttagagaggttacaacgtaaacatggaggcatgttggttagaaacccgctgagcaggaacagtacacacgaaatgtattggataagcaacgggactggaaatatagttagttctgttaatatggtttctcgactactcctaaacagattcacaatgacacatcgacgtcccaccatagaaaaagacgtcgatttaggcgcaggaacaaggcatgtaaatgcagaacccgaaacaccaaatatggatgtaattggtgaaagaattaagagaattaaagaggaacatagtagcacctggcattatgatgatgaaaacccctataaaacatgggcctaccacgggtcatacgaggtcaaagcaacgggaagtgcttcaagtatgataaatggcgtggtcaaattactaaccaaaccttgggatgtagtgccaatggtcacccaaatggctatgacagataccacgccattcggtcagcaacgagtcttcaaagaaaaagtagacacacgaacacctcgtccgatgccaggcacaaggaaagtcatggaaattacagcagaatggttatggcgaacactgggacgcaataagagaccaaggctgtgtaccagagaagaatttactaagaaagtgagaacaaacgcggccatgggtgcggtgttcacagaagaaaatcaatgggactcagcaagagctgccgtcgaagacgaagagttttggaagctagtcgatcgggaaagagaacttcataaactaggcaaatgcggatcctgtgtatacaatatgatgggcaaacgcgagaagaagctaggagagtttgggaaagcaaaaggatcaagagcgatatggtatatgtggctaggagcacgctatctagagttcgaagcattaggatttctgaatgaagaccattggttctccagagaaaactcgtactcaggagttgaaggagaggggctacacaaactcggatatatattacgcgacataagtaagattccagggggagctatgtatgcagatgatacggctggttgggatactcggatcactgaagacgatctacacaatgaagagaaaataacccaacagatggatccggaacatcgtcaactagctaacgctatcttcaagttaacataccaaaataaggtagtgaaggtacagaggccaaccccaaagggtacggtgatggacattatatccagaaaggaccaacgcggaagtggccaggtcggaacttacggacttaacacttttaccaatatggaggcgcaattagtaaggcaaatggaaggtgagggagtattatcaaaggtggacttagaaaacccccacttactagagaagaaaattacacaatggcttgaaaccaaaggagtagaaagacttagacgaatggcaatttctggtgatgattgtgtagtaaagccaatagacgatagattcgctaacgcactattagcactgaatgacatgggcaaagtaagaaaagatattccacagtggcaaccaagcaagggttggcatgactggcagcaagtgcccttttgttcgcaccactttcatgaattaattatgaaggacggaagaaaactggttgttccttgtcgcccacaggacgaattaattggtcgtgcacgcatttcacaaggggctggctggtcacttaaagaaacagcatgtctaggaaaagcatatgctcaaatgtggtccttgatgtatttccatcgaagggatctaaggctagcgagtaatgcaatatgctcagctgtaccagtacactgggtccccacttcaagaacaacatggtctatccacgcacatcaccaatggatgacaacagaagatatgttaacggtttggaaccgcgtttggatagaagataatccatggatggaagacaagacccccgtaacgacctgggaggatgtaccttatttgggaaaaagggaagaccaatggtgtggaagtctcattggactaacatcaagagctacctgggcacaaaacatcttaacagctattcaacaagttagaagtctaataggagatgaggagtttttagactacatgccctccatgaaacgtttcagaaaagaagaagaaagcgaaggcgctatttggtaa

SEQ ID NO: 23292 - RNA, 9873 nt, synthetic construct
  misc_feature 1..9873: note = derived and/or modified CDS sequence (opt6) from DENV-3__FJ744739__SS-prME
  source 1..9873: mol_type = other RNA
acgagtttgtgccttatgatgatgctacccgcgactctggcgttccatcttactagcagagatggagaacctcggatgatagttgctaaaaatgaaagaggaaaaagtttattatttaaaaccgttagtggcattaacatgtgtacgctaatagctatggacttaggcgaaatgtgtgatgacaccgttacttacaaatgtcctctaatagctgaagtagaacccgaagacattgactgctggtgcaacttaacatcgacatgggtgacctacggaacatgtaaccaagcgggcgaacatcgacgtgataaacgatccgttgcactagcacctcacgtgggaatgggcttagatacacgtacacaaacatggatgagcgctgaaggtgcttggcgacaagtagaaaaagtagaaacttgggcactaagacacccgggctttaccatacttgccctctttctagctcattatatcggaacatcattaacacagaaagtcgtcatattcatacttctgatgctagtgactccatctatgactatgagatgtgttggtgttggtaatagagactttgtggaaggattatctggtgccacatgggtagacgtggtcctagaacacggagggtgtgtaacaacgatggcgaaaaacaaaccgaccttagacatagaattacagaaaacagaagctactcagcttgcaactttacgaaaactatgtatagaaggcaaaattactaacatcaccaccgactctagatgcccaactcaaggtgaagcgattttaccggaagaacaagatcaaaattacgtatgcaaacatacttatgtagaccgaggatggggcaacggttgtggactatttggtaaaggaagtttagttacgtgcgctaaatttcaatgtttagaacccatagaagggaaagtggtacagcatgaaaacctaaaatatactgtaattattactgttcatacgggagaccaacaccaagtaggaaacgatacgcaaggtgtaactgtagagattactccacaagcgtcgactgtcgaagcaatattaccggaatacggtacccttgggttagaatgttcaccgaggactggtcttgactttaacgaaatgatactattaactatgaaaaataaagcatggatggtacacagacaatggttctttgatttacctttaccctggactagcggcgcaaccactgaaacaccaacatggaatcgtaaagaattactcgtaacgtttaaaaatgcccacgccaagaaacaagaggtagtagttcttggctcccaagaaggtgctatgcatacggctctaacgggtgcaacggagattcaaaactcaggagggacgtcaattttcgccggccacctaaaatgtaggttaaaaatggacaaattagagctcaaagggatgagttatgcaatgtgtttgaacacattcgtactcaagaaagaggttagcgaaactcagcacggcacaattctaattaaagtcgaatataaaggggaggacgcaccatgtaaaataccatttagtacggaggatgggcaaggaaaagcacacaatggaagacttattacggcgaatcctgtagtaacaaagaaagaagaacctgtaaatatagaagctgaacctccatttggcgaaagcaacatagtaataggaattggagacaaagccttaaagataaattggtacaagaagggttcgagcataggaaagatgtttgaagcgacagcgcgtggcgcccgcagaatggctatactaggtgacaccgcgtgggactttgggagcgtagggggcgtattaaattccctcgggaaaatggtacatcagattttcggaagcgcatatacggcattatttagcggagtaagttggataatgaaaataggcattggagttcttctaacgtggatcggcttgaacagtaaaaatacaagtatgtccttcagttgtatagttataggaataatcactttgtacttaggcgccgtggtccaagcagatatgggatgcgtaatcaactggaaaggaaaggagttaaaatgtggctccggaattttcgtcactaatgaagtacatacttggacggagcaatataagtttcaggcagattccccaaaaagactagcaactgcaatagccggtgcttgggaaaacggggtctgtggtattcgatcaaccacaaggatggaaaatctcttgtggaagcaaatcgcaaatgaacttaactatatattatgggaaaacaatatcaaattaactgtggtagtcggggatataatcggagtactagaacaagggaaacggacattgactccccaacccatggaattaaaatactcctggaaaacatggggcaaagccaaaatcgtaacggcagaaacgcaaaattcgagctttataatagatggtccaaatacaccggagtgcccaagtgcttcgagggcatggaacgtatgggaggttgaagattacgggtttggagtattcacgacaaacatatggttaaagttaagagaagtgtacactcaaagttgcgaccacaggttaatgtctgcggctataaaggacgaacgtgcggtgcacgcggacatgggctattggattgagtctcaaaagaacggttcttggaaattagagaaggcgtctttcatcgaagtaaagacttgtacttggcctaagagtcatacgttatggagtaatggcgttttagaaagtgatatgattatacccaaaagcctcgcgggtcccatcagtcagcataaccatagaccgggatatcatactcagacagccggtccatggcatttaggtaaattagaactagactttaattattgtgagggaacgaccgtagttattacggaaaattgtgggaccaggggtcctagtttaagaaccactacagtctcgggaaaactaatacatgaatggtgttgtagatcttgtacgcttccaccattacgatacatgggggaggatggatgttggtatggtatggaaatacgaccgataaatgaaaaagaagaaaacatggtaaaaagtctcgtaagtgcgggctcaggaaaaatggataattttactatgggcattttatgcttagcgattctgttcgaagaggtaatgagaggcaaattcgggaagaagcacatgatcgcgggtgtgttatttactttcgtactattattaagtgggcaaattacatggcgcgatatggctcacacgcttattatgataggtagtaacgcgagtgatcgaatggggatgggtgttacttacttagcattaatagcaactttcaaaatacaaccctttttggctttaggctttttcctaagaaagctcacaagtagagaaaatttactactcggtgtaggattagctatggcaactacactgcaactccccgaagatatagagcaaatggcgaatggaattgcactcggtttaatgaccctaaagttaattacacaatttgaaacatatcaattatggacagccctagttagtctaacatgttctaacactattttcaccttaacagtagcgtggcgcaccgcgaccttaatactagcgggggtttcattgctacccttatgccagtcctcgtcgatgagaaaaactgactggttgcccatgacagtagcagcaatgggcgtcccacctctacccttgtttatattttcattgaaagatactcctaaacgcagatcttggcctctcaatgaaggagtcatggcagttgggttagtttccatattggcgtcaagtcttctcagaaacgatgtgcccatggcagggccgttagtagctgggggtttgttgattgcctgttacgtaataactgggacatcagcggatttgacagtagaaaaggcagccgatgttacatgggaggaagaagctgagcaaacaggagtatcacacaatcttatgataactgtagacgacgacggtacgatgagaataaaagacgatgagacagaaaatatactcacagttttgttgaaaacagcccttttaatagtatccggcatctttccttatagtatacccgctacgttattagtatggcatacttggcaaaaacaaactcagagatctggagtattatgggatgtaccatcaccacccgagacgcaaaaagcagaattagaagaaggtgtctatagaattaagcaacaagggatatttggtaaaactcaagtaggagtaggcgttcagaaagaaggagtgtttcataccatgtggcatgttacacgcggcgccgtcttaactcataacggtaaaagactggaacctaattgggcatccgtaaagaaggatttgatatcatacggaggcggttggcgcttatcggctcaatggcaaaaaggtgaagaagtacaagtcatagcagtggagccaggcaagaaccccaaaaactttcaaactatgcctggaatattccagacaacaaccggtgagataggagctatagcacttgattttaagccaggtacgtctggatcaccaattataaatcgcgaaggaaaggttgtcgggctttacggcaatggagtggtgaccaagaatggcggatatgtttccggaattgcacagactaatgctgaaccagacggacccacccctgaactcgaagaagagatgtttaagaagcgaaacctaacaattatggatttacatccaggaagtgggaagacgcgaaagtatctcccggctattgttagagaagcaataaagcgaaggctcagaacacttattctagctccaacgcgagtagtcgccgcggaaatggaagaggcgctaaaaggcttgcctattcgatatcaaacgactgcaatcaaatcagaacatactggacgagagatcgtcgacctcatgtgtcacgcgacattcacaatgcgtctactgagcccagtacgagttcctaactataaccttatcataatggacgaagctcattttacagatcctgcttcaatagcggcaagaggatatattagtaccagagtcggcatgggagaagcagccgctatatttatgacggccactccccctggaacagccgaagcatttcctcaatcgaacgctccaatacaagacgaagaaagagatatccctgaaaggagttggaatagcggtaatgagtggattacagatttcgtcgggaaaactgtctggttcgtaccatccattaaagctgggaatgacatcgctaattgtctcaggaaaaatgggaagaaagtcattcaattgagcagaaagacgtttgacaccgagtaccagaaaacgcgattgaatgattgggacttcgtagtaacaaccgacatctcagagatgggggcaaattttaaagcggatcgcgttatagatccaagaagatgtctaaaaccggtaattcttacggatggacccgagagagtcatactagcgggccccatgcctgtcacagccgcgagtgcagcacaacgaagaggcagggtaggaagaaatccccagaaggagaacgaccagtatatttttacaggacagcccctgaacaacgacgaagaccacgcccattggaccgaggcaaaaatgttgctagataatataaatacacctgagggaattatacctgctcttttcgaacctgaacgcgagaaatctgcagccattgacggagaatacaggcttaaaggtgaatccagaaaaacctttgtagaactgatgagaagaggggatctaccagtatggttggcacacaaagtagcatcagaggggattaaatacaccgatcgtaaatggtgctttgacggagaacgcaataatcaaatacttgaagaaaacatggacgtcgagatatggacaaaagagggcgaaaggaagaaactcagacctcggtggctagatgcaagaacatatagcgacccattggcacttaaagaatttaaagactttgccgcaggcagaaagagtatagcattagacttggtaactgaaataggaagggttccgtctcatttggctcacagaacaagaaatgcactagataatttagttatgttacatacttccgaacatggaggacgcgcatatcgacacgcagttgaggaactacccgaaactatggaaacattgttactcttaggactaatgatcctgctcactgggggtgcaatgctatttttaattagtgggaaaggaatcgggaaaacatcaatcggactaatatgtgttatagtaagtagcgggatgctatggatggcagatgtaccactacaatggatcgcatctgcgattgtgttggagttctttatgatggtactattaatccctgaacccgagaaacagcgaacaccacaagacaaccagttagcctacgtcgttattggcatactgactctagctgcgattgttacagctaatgaaatgggtctattggaaactactaagagagatctgggtatgagtaaagagcccggtgttgtatcaccaacgtcatatttagatgtcgaccttcatcctgcaagcgcatggacattatatgcagtagctacaactgtcataacaccaatgcttagacacacaatagaaaacagcacagcaaacgtatcattagctgcaatcgctaaccaagcagtggttctcatgggtttagacaagggatggccaatatcaaaaatggacctgggcgtgcctttattagctctaggatgttattcacaagttaatccgttaacgttaacagcagcagtgttgcttttagtaacacactacgcgattattggacctggcctacaagcgaaggcaacaagagaggcgcagaaacggaccgcggctggaataatgaaaaatcctaccgtagatggcattatgactatagacctcgatccagtaatatacgattcaaaattcgaaaagcaattggggcaggtaatgttactcgttttatgtgcagtccaactgttattgatgagaacatcttgggcgctatgtgaagccctaacgctcgccacaggtccgataacaaccctatgggaaggatcacctggaaaattttggaatacaacaattgctgtaagcatggcgaacattttcagaggctcttatttagctggagcgggactagcgttctcaattatgaaaagcgttggtacaggaaaacgcggcacgggatcacaaggtgagacactaggagaaaaatggaagaagaaattaaatcagttatcaagaaaggagtttgacctctacaagaaaagcgggataacggaagttgatagaacagaggctaaagaaggcctaaaaagaggagaaacaacccatcacgccgtctcgcgtgggagcgctaaactccaatggtttgtcgaaagaaacatggtgatccccgaaggaagagtgatagatttaggatgtggcagagggggctggtcttactactgtgcaggactgaagaaagtgacggaagtaaggggctatactaaaggagggccaggtcatgaagaaccagtacctatgtcaacatacggctggaatattgtaaaacttatgtccggaaaagatgtattttacctaccacctgaaaaatgcgacaccctgttatgtgatatcggcgaatctagtcccagcccgacagtagaagaatctagaacaattagggtcttaaagatggtagagccatggcttaaaaataatcaattttgtataaaagtcttgaacccttacatgccaacagtgatagaacacctagagcgcctccaacggaaacacggtggaatgctagttagaaatcctctcagtaggaactcaacacacgagatgtattggatttccaatggcacaggaaatattgtctcatcggtgaatatggtaagtagattactacttaacaggtttactatgacccatagaagaccgacaatagaaaaagacgtggacttgggcgcgggcacacgtcacgtcaatgcagagccagaaacacctaatatggatgtgattggagagagaatcaaaagaattaaagaggaacacagtagcacgtggcattacgatgacgagaacccatataaaacctgggcatatcatgggtcatacgaagtcaaagcaacaggatctgcatctagtatgataaacggagtcgttaagctgttaaccaaaccttgggacgttgtaccaatggtaactcaaatggcaatgactgatactacaccattcggccaacagcgagttttcaaggaaaaagtcgatactagaacaccgagaccaatgcctggcactagaaaagtaatggagataacagctgagtggctttggagaacgttaggccggaataaacgaccaaggctatgtacgcgagaagaatttactaagaaggtcaggacaaatgccgctatgggcgccgtttttacagaggaaaatcaatgggattctgcacgggcggcagtagaagacgaagagttctggaaattagtagacagggagagagagttacataaattggggaaatgcggctcatgtgtttataatatgatgggcaagagagagaagaaattaggagagttcggcaaagccaaaggaagcagagcaatatggtacatgtggttaggagctcgatatctggagttcgaagcgctaggctttttaaacgaagaccactggttcagcagagaaaactcctacagtggcgtggaaggtgaaggcctccataaattgggatatatattacgtgatatatcaaagattccgggtggagcgatgtacgccgatgacactgctggctgggatactagaataactgaagatgacttgcataatgaggagaaaataacacaacaaatggatccagagcatcgtcagttagccaatgcaatattcaaattaacgtaccagaacaaagtggttaaagttcagagaccgaccccaaagggtaccgtaatggatattataagtcgtaaggaccaaaggggttcaggtcaagtaggaacatatggacttaatacgttcacgaatatggaggcacaactcgtaagacaaatggagggcgaaggagtgctatcaaaagtagatctcgaaaatccccaccttctagaaaagaaaataacccaatggctcgaaactaaaggagttgaaagacttaggcgaatggccataagtggagatgattgtgttgtaaaacccatagacgatagatttgcgaatgcactattagctctaaacgatatgggcaaagtcaggaaggacatacctcaatggcaaccatcgaaaggctggcatgactggcaacaagtcccgttctgtagtcatcattttcacgaactcataatgaaagacggtcgaaagctagttgtgccttgtcgacctcaggacgaattgattggaagggcccgaatctcgcaaggagctggatggtcactaaaggaaacagcttgtctagggaaagcatatgcacaaatgtggtccttaatgtactttcacagaagagacttgcggttagcgtcaaatgccatctgttctgcggtaccagttcactgggttccaacctcaaggactacatggagcatacatgcgcaccatcaatggatgactactgaagacatgctaacggtctggaatcgagtctggatagaagataatccttggatggaggacaaaactcccgttacaacatgggaagacgtaccatatcttgggaagcgtgaagatcaatggtgtggaagttttatcggcctcactagccgagctacctgggcgcaaaatatcttgactgcaatacaacaagttcggtcactcataggtgatgaggaatttttggattatatgccctcaatgaaacgattcagaaaggaagaggaatcagaaggtgcaatatggtaa

SEQ ID NO: 23293 - RNA, 9873 nt, synthetic construct
  misc_feature 1..9873: note = derived and/or modified CDS sequence (opt6) from DENV-3__FJ744740__SS-prME
  source 1..9873: mol_type = other RNA
actagcttatgccttatgatgatgcttcctgcaacactcgcgttccatctgacaagtcgagatggtgaacctcggatgattgttgccaaaaacgaaagagggaaaagcctgttatttaaaactgcatccggaataaatatgtgcaccctgatcgctatggacttaggagaaatgtgcgacgacactgttacgtataaatgtcctttaatcgcagaagtcgaacctgaagatatagattgctggtgcaatttaactagcacatgggttacatacggcacatgtaatcaagcaggggaacatagacgtgacaaacgttccgtagcgcttgcacctcacgtgggtatgggtctagacactagaactcaaacctggatgtcagcagaaggagcatggcggcaagttgagaaagtcgaaacatgggcgcttagacatcctggattcacaatcctcgcattatttctcgctcattatataggaacgagtttgacccaaaaagtagttatatttatattgctcatgcttgttactccttcgatgactatgcgatgtgtgggtgttggcaatagggacttcgttgaaggactaagtggtgccacttgggtagacgttgtactcgaacacggaggttgtgtcaccaccatagctaaaaacaaacctacacttgatatcgaattacagaaaaccgaagcaacacaactagcaacgcttcgtaaactctgcatagaaggtaaaataacgaacataacaacggattcacgatgtccaacacaaggcgaggccatcctacctgaagaacaagatcaaaactatgtctgtaaacacacctacgttgatcgcggatggggcaacggatgcggcttgtttggcaaaggcagtttggtgacgtgtgcaaaattccaatgtcttgaacccatagaaggcaaagttgtacaacacgagaacttaaaatacacagtgataattacagtacatactggagatcaacaccaagtgggtaatgatactcagggagtcactgtggaaattacaccacaagctagcactgttgaagcaatccttccagaatatggtacacttgggttagaatgttcgccgcggaccggcctagattttaatgaaatgatactcttaacaatgaaaaataaagcatggatggttcacagacagtggttcttcgacctgcccctcccatggacttctggagccacaacggaaacaccaacctggaacaggaaagaattattggtgacttttaaaaatgcccacgccaagaaacaggaggtagtagtactcgggtctcaagaaggagcgatgcatactgcgctaacaggagctactgaaatacaaaacagtggtggaacgtcaatatttgcaggccaccttaaatgtagacttaaaatggataaattagaactaaaaggtatgtcgtatgccatgtgcttaaatacatttgtcctgaagaaagaggtatccgaaacacaacacggcacaattctgataaaagtcgaatacaaaggagaagatgcaccatgtaaaatcccctttagcaccgaagatggacaaggtaaggcccacaatggaagactgataacggctaacccggttgtaacgaagaaagaagaacctgtcaacattgaagcagaaccacctttcggcgagtctaatatcgttatcggagttggcgacaaagcgttaaaaatcaactggtacaagaaaggatcatcaattggaaaaatgttcgaagctactgcaaggggagccaggagaatggctatattaggtgatacggcatgggatttcgggagtgtcggaggagtcttaaactccctaggcaaaatggtccaccaaattttcggctcagcttatacggcactattttctggggtaagttggataatgaaaattgggataggagtgttgctaacttggataggattgaatagtaaaaacacatccatgtcgttttcctgtatagtcatcggaataattacattatatttaggggctgttgtacaagcagatatgggatgcgtaataaattggaaaggcaaagaattaaaatgcggatcagggatatttgtcactaatgaagtacatacatggacagaacagtacaaatttcaggctgatagtccaaaaagactagccacagcgatagcaggagcctgggaaaacggtgtatgcggtatccggagtactacaaggatggaaaatctactttggaaacaaatagcaaatgagctcaactacatactctgggaaaataacatcaagttaactgtcgttgtcggagacataatcggagtactagagcagggcaaaagaacattaactcctcaaccgatggaacttaaatatagttggaaaacttggggtaaggctaaaatcgtaactgctgaaacacaaaactcgagtttcattatagacggccccaacacacctgaatgtcctagtgcatcccgagcgtggaacgtttgggaagtggaagactatggcttcggtgtattcacaactaacatctggttaaaacttagagaagtttatactcagagctgcgatcacaggctcatgtctgcagccattaaagacgaacgtgctgtccacgccgatatgggctattggattgaatcacagaaaaatggaagttggaagttagaaaaagctagtttcatagaagtaaagacatgtacatggcctaaatcacacactttgtggtcaaacggagttcttgaatcggatatgattatcccaaagtccctcgcgggcccaatatcacaacataatcatagaccaggataccacacacaaacagcaggtccctggcatttgggcaaactagagctagatttcaattactgcgagggcactacggttgtaataacggaaaactgtggaacacgaggaccgtctctccgaacgacaacagtttccggcaaattaatacatgaatggtgctgcagaagttgtactttgcctccattaagatatatgggggaagatggttgctggtacgggatggaaatacgaccaattaatgaaaaagaagaaaatatggtaaagagtctggtttcagccggatcaggtaaagtagacaactttacaatgggaatactgtgtttagccatattgtttgaagaagtcatgaggggtaaatttggcaagaaacacatgattgctggtgtactttttacatttgtcctactgctaagtggtcagattacttggcgggacatggcccataccttaatcatgataggtagtaacgctagtgataggatgggtatgggagttacatacctagcactaatcgccacgtttaagattcaaccatttttagcattgggattctttttacggaaactaacaagccgagagaatttacttttaggagtaggattagcgatggccacaaccctccaattacctgaggatatagaacaaatggcaaacggcattgctttaggattgatgacgttaaaattgataacacaatttgagacttatcaattatggaccgccttagtatccctcacctgtagtaataccatatttactttgaccgtggcatggagaacggcaacattgatattggctggagtttcactacttcccttatgtcagagttcatctatgagaaaaacagattggttaccaatgacagtagccgctatgggcgtacctccattacctctctttatctttagtttgaaagatacacccaaaagaagatcatggcctctaaatgaaggagtcatggcagttggactcgtctcgatactcgcgagctcattacttcgtaacgacgtaccgatggccggaccactcgtggcagggggactactgatcgcatgttatgttataacggggacaagtgcagatctcactgttgagaaagcagcggatgtaacttgggaagaagaagcagaacagacgggagtgtctcacaatctaatgataaccgtggacgatgacggcactatgagaattaaagatgatgaaactgaaaacattctgacagttctgcttaaaacggcattgttaatagttagcggaatctttccttattctattccagcaacactattagtttggcatacttggcagaaacaaacacaaagatctggtgtgttgtgggatgtacccagtccgcctgaaacacaaaaagcagagctcgaggagggagtctataggatcaaacaacaaggtatatttggaaaaacacaggttggtgtgggagtacaaaaagaaggcgtttttcataccatgtggcatgtgacgaggggcgctgttttaactcacaatgggaaaaggttggaacccaattgggccagcgtgaaaaaggacttaatcagctatgggggaggctggagactaagcgcacagtggcagaaaggagaggaggttcaggtaatcgcagtcgaacccgggaaaaatcccaaaaactttcagacaatgcccggcatctttcaaacgacaacgggtgaaatcggagctatagcattagatttcaaaccaggaacatcaggttcgcccataataaacagagaagggaaagtagtcggattgtacggcaatggagtagttaccaaaaatggcggctacgtatcaggaattgctcaaactaatgctgaacctgatgggcccacgccagaactggaagaagaaatgttcaagaaacgaaacctgactataatggacttacatcctggttccggaaaaacgcgaaagtatctaccggccatagtccgtgaagcaataaaaagacgtcttagaacactaattttagcccctacgagggttgtagctgctgaaatggaagaagccctcaaaggcctacccataagataccaaaccacagccataaaatccgaacacacaggtagagagattgtagatttaatgtgccatgcgacctttactatgcggctcttatcacctgtaagggtacctaactataatcttattattatggacgaagcccacttcactgatccggcaagtatagctgccagaggctatatctctacacgcgttggtatgggcgaggccgcagccatatttatgacggcgacgccacctgggaccgcagaagcatttccacaatctaatgcacctatccaagacgaagaacgggatatacctgaacggtcgtggaactctggaaatgagtggattactgattttgtgggtaagacagtctggtttgttccttccattaaagctggtaacgatatagctaactgcctacggaagaacggtaagaaagttattcaactctcccgtaaaacttttgacacagaatatcagaaaactaggttaaatgactgggatttcgtagtaaccacagacatttctgaaatgggggcaaatttcaaggcagaccgagtgatcgacccaagaagatgtttaaaaccagtaatattaacagatggacctgagcgtgtcattttagcaggacctatgccggtaactgctgcatcagcggcgcaacgaagaggcagagttgggaggaacccgcaaaaagagaatgatcaatacatattcaccggtcaacctttaaacaatgacgaggaccacgcacactggactgaggccaaaatgcttctagataatataaatactcctgaaggaattattccagctctattcgaacccgaaagagaaaaatcggccgcgattgatggtgaataccgactcaaaggcgaatctcggaaaaccttcgtagagttaatgaggagaggggacctccccgtatggcttgcacataaagtcgcttcggaaggaataaaatatactgataggaagtggtgctttgatggcgagcggaacaaccaaatccttgaagaaaatatggatgttgaaatatggacgaaagaaggtgagagaaagaaacttagacctagatggctagacgcacgaacatattccgacccattagcgctcaaagagtttaaagactttgccgccgggcgtaaaagtatagctttagatttggttacagagataggacgcgttccatcacatctagcacatcgtacaagaaacgcgctagataatctggtcatgttacacacgtccgagcatggtggtagagcgtacagacatgccgttgaagaactacctgagacgatggaaacgcttttattgctaggactgatgatcctcttgaccggaggagctatgctatttttgatatcgggaaagggaataggaaaaacctctataggcctaatatgtgttatagtttcttccgggatgttatggatggcagatgtaccgctgcaatggattgcctctgcaattgtactagagttcttcatgatggttttacttatacctgaaccggaaaaacaacgaactccccaagacaatcaactggcctatgtagttattgggattctcactttagccgcaatagtcactgctaacgaaatgggattgctggaaacaaccaaaagagatcttgggatgtccaaagaaccaggggttgtaagcccaacttcttatctcgacgtagacttgcaccccgcgtcggcgtggactttatacgctgtggccacaactgtgataacaccaatgttaaggcatacgattgaaaattccactgcaaatgtctcattagctgcaattgcaaatcaagctgtagtgctgatgggtctagataaaggatggccaatctcaaagatggacttaggggtcccgctattagcattaggatgctattctcaggttaacccattaactctcacagcggccgtattattgctcgtaacacattacgccattatcgggccaggacttcaagctaaggcaacaagggaagcacaaaagaggactgccgcgggcattatgaaaaatccaacggtggacggaatcatgacaattgacttagacccagtgatctatgattccaaatttgagaaacagcttggacaggtaatgctgctagtactatgtgcggtacaactactattgatgagaacctcctgggcattatgcgaagcattaacattagcaacgggacctattacaaccctgtgggaggggtctccaggaaaattctggaataccacaatcgctgtatcgatggctaacatttttagaggatcgtatctcgccggtgcaggcctagcatttagtataatgaaatcggtgggaacgggaaaacgaggaactggttcacaaggagaaaccctaggcgaaaaatggaaaaagaagttaaatcaacttagcaggaaagagtttgacctatataagaaaagcggtataacagaagttgatagaacggaagcaaaagaaggtctaaaaagaggagaaactacccatcatgcagttagtcgcggatcagcgaaactacagtggtttgtagaaagaaacatggtgattccagagggacgagttatagatcttggatgcgggcgtggaggatggtcgtattactgtgcgggacttaaaaaggtaactgaggtacggggatacaccaaaggtggacctggacatgaggaaccagttccaatgtcgacgtacggatggaatattgttaaactaatgagcggaaaagatgtcttttatctaccgcccgaaaagtgtgatacgttactttgtgacataggagagagttctccatcaccaacagtagaagaatctcgaacaattcgggtactcaaaatggtagaaccatggcttaagaacaatcagttttgtataaaagtactgaatccttatatgcctacagtcatcgaacatctggaacgactgcaacgaaaacatggaggaatgcttgttcgaaacccactttctcgaaattctacacatgaaatgtactggatcagtaatgggaccggaaatattgtctcttcagttaacatggtcagtcgattattacttaatagattcacaatgacccatcgccgacccactatagagaaagatgtagatcttggggcaggaacaagacatgtcaacgctgaacccgaaacgcccaatatggacgtaatcggagaaaggattaaacgtataaaagaagaacactctagtacgtggcactatgacgatgagaatccgtataaaacttgggcgtatcacgggagctatgaagtgaaggcaacaggaagtgcatcaagtatgataaacggtgtggtaaagttacttacgaaaccatgggacgtagtaccaatggtgactcaaatggctatgacggacaccactcccttcggacaacagcgagtctttaaagaaaaagtggacacaaggacaccacgtcctatgcccggtacaaggaaggtgatggaaatcacagcagagtggctttggagaacactgggacgtaacaagagaccaagattatgtacacgcgaagaatttactaagaaagtgagaacgaacgctgctatgggcgccgtgttcacagaagaaaaccaatgggattccgccagggcagcagttgaagatgaagaattttggaaattagtagaccgtgaacgcgaattacataagctaggaaagtgcggaagttgcgtttataacatgatggggaaaagagagaagaaattaggagagttcggtaaagctaaagggtcaagggcaatatggtatatgtggttgggtgcgcggtacctggaatttgaagctcttggttttctcaacgaagaccactggttttctagggagaatagctattcaggtgttgaaggagaaggactccacaaattaggatacatactcagagacatttcaaagataccagggggtgcaatgtacgccgatgataccgcaggctgggatactcgaataacagaagatgatttacataacgaagagaaaataacacaacaaatggatcctgaacaccgacaattggccaacgccatatttaaacttacataccaaaataaagttgtaaaggtacagcgtccaacacctaagggtaccgtcatggacataatttcacgaaaagatcaaagaggttccggacaagtcgggacgtatggtttaaatacatttactaatatggaggcccaattggtgaggcaaatggaaggcgaaggggtattatctaaagttgacttggagaacccacatctactagagaagaaaattacacaatggctagaaaccaaaggggtagaacgacttaggcggatggccatctctggcgacgattgcgtggtaaaacctatagatgatcgattcgcgaatgctctactagctttaaatgatatgggtaaagttcgaaaagacataccgcaatggcaaccctctaagggatggcatgattggcaacaagttccattttgctctcaccattttcacgaattgataatgaaagacggacgtaaacttgtggtaccttgcagaccccaagacgaattaattggacgtgcccgtatttcgcagggagcaggatggtcactgaaagagacagcatgtctaggtaaagcatatgcacaaatgtggagtctaatgtattttcaccggcgagacctaagacttgcatcaaacgcaatttgttccgcagtacctgtacattgggtaccaacttccagaacaacatggtcaatacacgcacatcaccaatggatgaccactgaggacatgctaacagtatggaatcgagtttggatcgaagacaacccctggatggaagataagacaccagtgacaacctgggaagacgttccatacttaggaaaaagagaagatcaatggtgtggctcacttattggccttacttcacgagctacttgggcccaaaatatactaacagccatccaacaagtacgctctttgataggagatgaagagtttctggattatatgccgtcaatgaaaagatttcgcaaggaagaagaaagtgagggtgcgatctggtaa

SEQ ID NO: 23294 - RNA, 9873 nt, synthetic construct
  misc_feature 1..9873: note = derived and/or modified CDS sequence (opt6) from DENV-3__GQ868593__SS-prME
  source 1..9873: mol_type = other RNA
acgtcactatgtttgatgatgatgctaccagctaccctagcctttcacctaacaagtagagacggtgaaccgagaatgattgtggggaaaaatgaacgaggtaaatctcttctatttaaaacagcttcaggaattaacatgtgcactttaattgcaatggacctgggggaaatgtgtgatgacacagtcacctacaaatgtccccatatagcagaagtcgaaccagaagatatagactgttggtgtaacttgacaagtacctgggtaacatacggaacatgcaatcaagcaggagaacatcgaagagataaacgcagtgtagcactggcaccacatgtaggtatgggtcttgatacaagaactcaaacatggatgtcggcagaaggagcgtggaggcaagttgaaaaagtcgaaacctgggcactacgtcacccaggttttacaatccttgctttgttcctcgcccattatattggaacaagtctgacgcaaaaagtagtaatttttatccttctaattctagttactcctagtatggctatgaggtgcgtaggagtgggaaacagggatttcgtcgaaggactaagtggcgctacgtgggttgatgttgttctcgaacacggcggatgtgtaaccactatggcgaaaaataaaccaactcttgatatagaattacagaaaacggaagcaacacaacttgcaacgctccgtaaactttgtatagaaggaaaaatcacaaatattacaaccgattcacggtgtccaacgcaaggagaagcaatactgcccgaggaacaagaccaaaactatgtgtgcaaacacacgtacgtagatcgcggctggggaaatggttgcgggctgttcggtaaaggctcacttgttacctgcgctaaatttcaatgtttagaatcaatcgaaggaaaagttgttcaacatgagaacttaaaatacaccgtgataattacggtccatacgggcgatcaacatcaggtaggtaatgaaacgcagggagtgaccgccgagattaccccgcaggcttcaacggttgaggcaatcctaccggaatacggaacccttggtctagagtgctcacctcggacgggtcttgactttaatgaaatgatactacttacgatgaaaaataaagcatggatggttcacagacaatggttctttgatcttcctttaccatggacgtctggggcaaccacagaaaccccaacatggaacagaaaagaactattagtgacattcaaaaatgctcacgctaagaaacaagaagtagtggtattgggatcacaagaaggtgctatgcacaccgcccttactggtgctacagagatacaaaacagtggcggcacgtcaatttttgctggacacttaaagtgcagattaaaaatggacaaacttgaattgaaaggaatgtcatacgcaatgtgtctgaatactttcgtcctgaagaaagaagtttccgaaacacagcatggaaccatcctaataaaggtggagtataagggagaagatgccccctgtaaaataccattctctacggaggacggtcaaggtaaagcacacaacggtagattgataacagctaatcctgtagtcactaagaaagaggaacctgttaacatcgaagcagaaccaccatttggagaaagtaatatcgttataggaattggcgacaaagcgttgaagattaattggtataagaaaggctcatctataggcaaaatgtttgaagccaccgctcgtggtgcaagaagaatggccatccttggagatacagcttgggactttggatcagtgggcggagtactcaattcgttgggcaaaatggtacaccaaattttcggaagtgcatacacggccttattctctggtgtatcgtggattatgaaaataggaattggtgttttacttacttggataggattaaattccaaaaatacaagcatgagtttttcttgcatcgcgataggaataattactttgtatctcggtgcggttgtacaagctgacatgggatgcgttattaactggaaaggcaaggaactaaaatgcggatcagggatcttcgttaccaatgaagtacatacttggacagaacaatacaaatttcaagccgactctcccaaacggttggcgacggcaatcgcaggagcatgggaaaacggggtgtgcggaataagaagtactaccagaatggaaaatttgttgtggaagcaaatagcaaatgaactaaattatatcctctgggagaataacattaaacttacggttgtagtaggagatataatcggagtgctagaacaagggaaaagaacacttacccctcagccaatggaattaaaatacagttggaagacatggggtaaagctaagatcgtaaccgccgagacacagaacagttctttcatcatagacggtccaaacacaccagaatgtccaagtgcttcacgagcatggaacgtctgggaagtagaggactacgggttcggagtctttactacgaacatatggctaaaactacgagaagtgtacacccaactttgtgatcacaggttaatgtcagctgctgttaaggatgaaagggctgtacacgcagacatgggatactggattgaaagtcagaagaacgggtcctggaaattagaaaaagcatcattaattgaagtaaaaacttgtacttggccgaaatctcacacactatggtcaaatggtgttctagaaagcgacatgataataccgaagagtctagccggtcccatatcacaacataaccatagaccaggatatcatacacaaacggcgggaccttggcatctaggaaaactagaattagatttcaattattgcgaaggaacaacagttgttatcacagagaattgcggtactagaggtccgagtcttagaacaacgacagtatctggaaaacttatccacgagtggtgttgtcgaagctgtacgctcccaccgctacggtatatgggcgaagacggatgctggtacgggatggaaatacgcccaataaatgaaaaagaggaaaatatggtaaagtccctagcttcggcgggatcgggaaaggtagataattttacaatgggagtgctctgcctcgccattctatttgaagaggtaatgcgaggtaaatttggtaagaaacacatgatagccggagtcctcctaacctttgtacttctgctctccgggcagataacttggcgagatatggcacatactctcataatgattggtagtaatgcctccgatagaatgggcatgggagtaacataccttgccttaattgcaacgtttaaaatacaaccgttcctagctttaggcttctttctgcgaaagctaacgagtagagaaaacttattattgggagtggggctagctatggcaacaacgctgcaattaccagaagatatagaacagatggctaatggtattgctctaggactgatggctcttaaattgataacacaatttgagacctaccaattatggacggccttagtaagtcttacatgcagtaacacaatattcacgctaaccgttgcatggaggacagcaactcttatattggcgggcgtaagcctattaccggtatgtcagtcgtcaagtatgcgaaagacagactggttaccaatggcagtagccgcaatgggtgtacccccgctcccattgtttatatttagcttaaaagatacacttaagcgaagaagctggccactaaatgaaggtgtaatggcagtaggcttggttagcatattggcaagctcattattaaggaatgatgtacctatggctggaccacttgtagcgggtgggcttttgattgcgtgttatgttataaccggaacttcagccgatctaacagtcgaaaaagcagctgatgtaacatgggaagaagaagcagagcaaacaggcgtgtcacataatttaatgataaccgtggacgatgatggaacaatgagaataaaggatgacgaaaccgagaatatcttaacagtactccttaagacggcattattaatagtcagtggaattttcccttattcaataccagcaaccctcctagtctggcatacttggcagaaacagacgcaaaggagtggagtattgtgggatgtacccagtccaccagaaacgcagaaggcggaactagaagaaggagtgtatcggattaagcaacaaggaatctttggaaagactcaagtaggagtaggggttcaaaaagaaggggtgtttcatactatgtggcacgtaaccagaggagcagtactcactcataatggaaagaggttagagccaaactgggctagtgttaagaaagatctgataagctatggaggtggatggcgactttctgcacaatggcaaaagggtgaagaagtacaagtcatagcagtcgaacctggtaaaaatccgaaaaatttccagacaatgccaggtatatttcagactacaaccggtgaaataggggccattgcgcttgattttaaaccgggcacatcgggaagtcctataataaatcgagaaggcaaggtagtaggattgtatggcaatggtgttgtcactaaaaatggaggctacgtgagtgggatcgctcaaactaatgccgaaccggatggccctactcctgaattagaagaggaaatgtttaagaaaagaaatctaactatcatggatcttcaccccgggtcaggcaaaactcggaagtatcttccagccatagtacgagaagcgattaaacgaagattaagaactctgatattagcacccacgagagtagtcgcggctgaaatggaagaagctcttaaaggattacctatacgttaccaaaccactgcaacgaaatcagagcatactggaagagaaattgtagacctaatgtgtcacgccacattcacaatgaggttattatctccggttcgagtacccaattataatttaatcatcatggacgaggcacacttcactgatcctgcaagtattgcagctcgcgggtatattagcactagagttggtatgggtgaagctgctgcaatatttatgactgcaactccacctggaacagcagacgcattcccccaatccaacgcccccatccaagatgaggagagggatatacctgagcgatcatggaacagtggaaatgagtggataacagattttgtggggaagaccgtatggtttgtgccttccattaaagcgggaaatgatattgcgaactgtttgaggaaaaatggcaagaaagttattcaactttcaagaaaaacctttgacacggaatatcagaaaactaagctaaatgattgggactttgtcgttacaacagacattagtgaaatgggtgcaaattttaaagcagatagggttatagatccaagacgttgcctaaaacctgtaatcttgacggacggccccgagagagtgattttggcggggcccatgccagtaaccgctgcatcagcggcgcaaagaagggggagggtaggtcgtaatcctcaaaaggaaaacgaccaatatatatttactggccagccgttgaataatgatgaagatcatgctcattggacggaagcaaaaatgctactagataatataaatacaccagaaggaatcataccggccctctttgaacctgagcgggagaaaagtgcagctatcgacggagaatacaggctaaaaggcgaaagtcgcaagacttttgtggaattaatgagacgcggagatctcccggtctggttggcccataaagtcgctagtgagggtatcaaatacactgataggaaatggtgtttcgatggggagagaaataatcaaatattagaggaaaatatggacgtagaaatttggactaaggaaggtgagaagaagaaacttcgacctagatggcttgatgccaggacatactcagacccattagcattaaaagaatttaaggatttcgctgctggaagaaaaagtatagcactcgatttagtcacagaaatagggagagtaccaagccatttagcacatagaacaagaaatgccttagataatttagttatgttgcacacctcggaacatggcgggcgagcatatagacatgcagtagaagaactaccagaaacgatggaaactttattattattgggcttaatgatattgcttacaggaggtgcaatgttgtttctaataagtggcaagggaataggtaaaacctccatagggttaatctgtgtaatagcaagcagcggtatgttatggatggcagatgtaccacttcaatggatagcctcggctatagtactggaatttttcatgatggtattattaataccagaacctgaaaaacaacgaacacctcaagataatcaactggcttatgttgttattggaatattaacattggcagcaatagttgcagccaatgagatgggtcttctcgaaactacaaagcgagacttggggatgagcaaggaacctggcgtagtatcacctacatcctacttggatgtagatctacatcccgcatccgcatggacattgtatgctgtggccaccaccgttattacacctatgcttagacatacaatagaaaattcaacagcaaacgttagtcttgccgcaattgcaaaccaagccgttgtcctaatgggattagacaaaggatggccaatatctaagatggacctcggagtaccactgttagcgttaggctgctacagtcaggtaaatcccctaactcttaccgcggctgtcttactactggcgacccattatgcaataataggcccgggcttgcaagcgaaggcaacgagagaggcacagaagagaacagccgcgggtataatgaaaaatccaacagtagacggtattatgacaatcgatctagaccccgtcatatatgacagtaagtttgaaaagcagcttggacaagtgatgctcttagtattatgtgcagtccaattattattaatgagaacttcctgggcactttgtgaagcattgaccttggctacagggcctataactacactgtgggaaggttctccgggaaaattttggaacacgacaatagcagttagcatggccaacatttttagagggtcctacctcgccggggctgggcttgcattttcgattatgaagtccgttggaacaggaaaaagaggcaccggaagtcaaggggaaactttgggcgaaaagtggaagaagaaactaaatcaattatctcgaaaagagttcgatctatataagaaaagtggtatcacagaagtagatagaacagaagcgaaagaagggcttaaaagaggcgaaattacgagacatgccgtaagcagaggttccgctaaactccaatggttcgtggaacggaatatggtgatacctgagggtagggtaatagacttagggtgcggaagaggtggttggtcttactattgtgccggtctaaagaaagtaacggaagttagaggctatactaaaggtgggcctgggcatgaggaacctgtaccaatgtcaacatatggctggaacattgtaaaattaatgagtggcaaagacgtgttttacttacccccagaaaagtgcgatactctcctctgtgatataggtgaaagctccccatccccaaccgtagaagaatcaagaacaataagggtacttaaaatggtagaaccttggcttaaaaataaccagttttgtataaaggtattgaatccatacatgccaaccgtaattgaacatttagaaagactacaacgaaaacatggcggaatgctagttcgcaaccccctatcccgaaattcaacacatgaaatgtattggattagcaacggaacaggaaatatagtttctagcgtcaacatggtgtctcgcttattgcttaatagatttacaatgacgcataggcgtccaacaatagaaaaagacgtagatttaggagcaggtacccgtcacgtcaacgccgaaccagaaacaccaaatatggacgtcataggagaacgaattaaaagaattaaagaagaacataactcgacttggcattacgatgacgaaaacccgtataaaacgtgggcatatcacggcagttacgaggtaaaagccacaggaagtgcgtccagtatgataaatggcgtcgtcaaactcttaacgaagccatgggatgttgtacctatggttattcaaatggcgatgacagacactactccttttgggcaacaacgagtctttaaagagaaggtcgacacccgaactccacggccaatgcctggtaccagaaaagtaatggaaataacagccgaatggctgtggagaacactaggacgcaataagcgtccaaggctgtgcactcgcgaagagtttactaagaaagtccgaacaaatgcagcaatgggagccgtatttacagaggagaatcaatgggatagcgctagagcagctgtggaggacgaagagttctggaagttagtagatcgtgaaagggaattacataaacttgggaaatgtggaagttgtgtatataatatgatgggcaaaagagaaaagaaattgggagagtttggtaaggcaaaaggatcccgcgccatatggtatatgtggctaggggcgagatacctggaatttgaagcactaggtttcttaaatgaggaccactggttctcacgtgaaaatagttactccggtgtggaaggagagggtttacataaattagggtatatactacgagatatatcaaaaatcccaggtggtgcaatgtatgcggatgatactgcagggtgggacacccgaattacagaagatgatctccacaatgaagagaaaatcacacaacaaatggatcctgagcataggcaattagcaaacgctatttttaaactcacttatcaaaataaagtggtcaaagttcagagacccacaccaaaaggtacagtaatggatatcatatcgagaaaagaccaacggggttcaggacaagtcgggacatacggtttgaacacattcaccaatatggaagctcagctagtcaggcaaatggaaggtgaaggcgtattgtcaaaggccgatcttgaaaatccacacttgcttgaaaagaagataacgcaatggttagaaacaaaaggagtcgaacgattaaaaagaatggcaatctccggtgacgactgtgtcgttaaacctatagacgacaggtttgctaatgcactcttagcgttgaatgatatggggaaagtaaggaaagacatccctcaatggcagccatcaaaaggttggcacgattggcaacaagtgcccttttgcagtcaccattttcatgaattaataatgaaagatggtagaaaattagtagtcccctgcaggccccaagacgaacttataggtcgggcacgcatctctcaaggagcaggttggtctttaaaagaaaccgcttgtctcggtaaggcttatgcccagatgtggagtttaatgtacttccaccgtcgcgacttaagattagcatcaaacgcaatttgcagcgccgtccctgtgcactgggtaccaacctccaggacgacatggagcattcatgcgcaccaccagtggatgacaactgaggatatgttaacagtttggaacagagtctggattgaggacaatccatggatggaggacaaaactcctgtcactacctgggaagacgtaccctaccttggcaaaagggaagaccagtggtgtggttcactaattggcctaacatcaagagcaacatgggcacaaaacatattaacagccatacaacaagtacggtcattgatcggtaatgaagaatttctagattacatgccatccatgaaaagattcaagaaagaagaagaaagtgaaggagcgatttggtaa

SEQ ID NO: 23295 - RNA, 9873 nt, synthetic construct
  misc_feature 1..9873: note = derived and/or modified CDS sequence (opt6) from DENV-3__FJ898459__SS-prME
  source 1..9873: mol_type = other RNA
acatctttatgtctaatgatgattctaccagcggcattagcttttcatctaacctctagagatggagaaccaagaatgattgttgggaaaaatgaaagaggaaaatcattgctctttaaaacagcgagcggtatcaacatgtgcacattaatagcaatggacttaggtgaaatgtgtgatgatacggtaacttataaatgtccgcacattacggaagttgaacctgaagatatcgattgctggtgtaacttgacatctacatgggtaacctatggtacatgcaatcaagcaggagaacaccgcagagataagagaagtgtcgcactggcgccacatgtgggaatgggattggatacaagaacacaaacttggatgagtgcagaaggggcatggcgccaagtagaaaaagtagaaacatgggcccttagacatccgggattcacgattctagctttatttctggcccactacataggaacatctcttacacaaaaagtggtcatatttatattgttaatgctcgtgacaccttccatgacaatgcggtgtgtcggggtaggtaacagagatttcgttgaagggctcagcggtgcgacgtgggtggatgtagttctagaacacggaggttgcgttacaacgatggcgaaaaataaacccacactggacatcgaactacagaaaactgaagctacacaattagctaccttaagaaaattatgcatcgaaggtaaaataacaaacatcactacagattcgagatgtcccacgcaaggcgaggctgtacttccagaagaacaagatcaaaattacgtgtgtaaacatacgtacgtagatcgaggatggggaaacggctgcggcttgtttggaaaaggatcacttgtaacatgtgcaaaatttcaatgcttggaaccaatcgaaggaaaagtagtccaatatgagaatctaaaatatacagtaataatcaccgtccataccggagatcagcatcaagtgggaaatgaaacgcagggagtaacagctgaaatcacaccacaagcgtcaacgacagaagcgatactgccggaatacgggacactcggattggaatgctccccgagaacaggactagattttaatgaaatgattttactaacgatgaaaaataaggcttggatggtacatagacaatggttcttcgatcttccattgccgtggacgagcggcgcaaccacggaaacacccacctggaatcggaaagaattgctagtaacatttaaaaacgcgcatgcaaagaaacaagaagttgtagtcctagggtcccaagaaggagctatgcacacagcattaacgggagcgacggaaattcaaaattcaggaggcacatcgatattcgcaggacatctcaaatgcagactaaaaatggacaaacttgaactaaaaggaatgagctatgcaatgtgtactaacacattcgtactcaagaaagaagtttcagaaacacaacacggcacaattcttataaaggtagaatataagggtgaagatgcaccatgcaaaatccctttctcgaccgaagacggacaaggtaaagcccacaatggaaggttaattaccgcgaatccggtagtaaccaagaaagaagaaccagttaacatagaggctgaacccccattcggtgaatccaacatagtgataggtattggcgataatgcgcttaaaataaactggtacaagaaaggatcaagcatcggcaaaatgtttgaagcaacagccagaggtgcaagaagaatggctatcctaggtgatacagcatgggatttcggatcagtcggaggagtcttgaactcattaggaaagatggtccatcagatatttggcagtgcgtacacagcattatttagcggagtgagttgggtaatgaagattggaataggtgtattattaacctggattggattaaattcgaaaaatacgtcaatgagttttagttgcatagctattggaattattaccctttatctaggtgcagtagttcaagcagacatgggatgtgtaatcaattggaaaggaaaagagctaaaatgcgggagcgggatattcgttacaaatgaggtacatacttggacagaacaatacaaatttcaagccgatagtcctaagaggctagcaacagcaatagccggtgcttgggagaatggagtttgcggtatacgatctacaaccagaatggaaaacttattatggaaacaaatagcaaatgaactcaattacatactatgggaaaacaacatcaaactgacagtagtagtgggagacatcataggagttcttgaacagggaaaacgaaccttgacacctcaacccatggaactcaaatatagttggaaaacttggggaaaagccaaaatagttacggcagaaactcaaaatagttcattcataatagatggacctaatacaccagaatgcccttctgcaagcagagcttggaacgtatgggaagtggaagactacggcttcggtgtttttacgacgaacatatggttgaaacttagagaagtatacacgcagttgtgcgaccacagattaatgtcagccgcagtaaaagatgaaagagcagtacatgcagacatggggtattggatagaaagccagaaaaatggaagttggaaactcgaaaaggctagtctaatagaagtaaaaacatgtacatggccaaagagccatacgctttggtccaatggagttctagagagtgatatgataattccaaaaagcctggctggtccaatatctcaacataatcatagacctggctaccacactcaaaccgcaggaccttggcatttaggaaaactagaattggacttcaattactgtgaaggaacaacagtagttataacggagaactgcggaaccaggggaccatctctacgcacaaccacggtttctggaaaactaatccatgaatggtgctgtcgcagttgcacacttccgccgttaaggtatatgggagaagatggatgttggtacggaatggaaatacgtccaatttcagaaaaagaagaaaatatggttaaatctttagtctcagcagggtcaggcaaagtggataattttacgatgggggtgctgtgcttagcaatactattcgaagaagtgatgaggggcaagtttggtaagaaacacatgatagcgggagtattctttacgtttgttctattactatcaggacagattacatggcgtgatatggcacacacgttaatcatgattgggtcgaatgcaagtgatagaatgggaatgggagtaacttatttagcattaattgccaccttcaaggttcaacccttcctagctttgggctttttcttaagaaagctaacaagtagagaaaatcttctactcggtgtggggttagcaatggcaaccaccttgcaattaccggaagatattgaacaaatggcaaatgggatcgcattaggcctcatggcattgaagttaattacacaatttgagacttaccaactatggactgcgttgatatctctaacctgcagtaacacaatgttcaccctaactgtagcttggagaaccgcaacactaattttagccggagtatcattattaccagtctgtcaaagctccagtatgagaaaaacagactggctacccatggccgtagcagcaatgggagtacctcctctaccgttattcatattttctctaaaggacactctaaaacgacgaagttggcccttgaatgagggggtgatggccgtaggattagtctcgatcctcgcatctagtttactcagaaatgatgttccaatggcagggccgttagtagctggaggattactaatagcttgctacgttataacggggacgtctgctgacttaactgtcgaaaaagccgccgatattacttgggaggaagaggcagaacaaactggagtatcacacaatctgatgatcactgtagatgacgacggaaccatgcgcataaaggatgacgagacagaaaacatattaaccgtccttctaaaaaccgcactattaatcgtaagtggagtttttccgtacagcataccagccactctacttgtatggcacacctggcagaaacaaacacagagaagtggagtgttatgggatgtaccaagtccaccagagacacaaaaagcggagctcgaagagggcgtctatcgaattaaacaacaagggatatttggaaagactcaggtaggggttggcgtacaaaaagagggggtgtttcataccatgtggcatgtcacacgcggagcagtactgacatataatggaaagaggctggaaccaaattgggcttctgtgaaaaaggaccttatatcctacgggggtggatggagactgagcgcacaatggcaaaaaggagaagaagttcaagtgattgctgtagagcctgggaaaaatcccaaaaattttcaaacgatgcccggaacgtttcaaactactacaggagaaataggcgctattgccctcgatttcaagcccggtacttctgggagccctattatcaaccgtgaaggaaaagttgtaggattgtatgggaacggcgtagtaactaagaacggcggatatgtatcaggaatagcgcaaactaatgccgaacctgatggaccaaccccagaactagaagaagagatgttcaagaaaaggaatctcacaataatggatctccatccaggatctggtaaaactcgtaaatacctacctgctatagtgcgagaagctattaaacgaagactaagaaccttaatccttgcacccaccagagtcgttgcagctgaaatggaagaagcgttgaaaggactgccaataagatatcaaactacagcgacaaagtctgagcatacgggtcgtgagatcgtggatctaatgtgccatgcgacctttactatgcgactattaagtcccgtcagggtgcctaattacaatttaatcataatggacgaagcccacttcacagatcctgcttctattgccgcaagaggatacatatcaactagagtaggcatgggagaggcagcagctatattcatgactgccacaccgccaggaacagcagacgcattccctcaaagcaatgccccaattcaggatgaggaaagagatataccagaaagatcatggaacagtggaaacgagtggattaccgatttcgctggaaaaacagtatggtttgtgccatctataaaagcgggtaatgacatcgcaaattgtttgaggaaaaatggcaagaaagtaattcaattatcacgtaagacctttgacaccgaataccagaaaactaagttaaacgactgggattttgttgtaactacagatattagtgaaatgggagccaatttcaaagctgacagagtgatagatccaagacgatgcctaaagcccgtgatcctgactgatgggcctgaaagggttatactagctgggccaatgccggttaccgcagcttcagcagctcaacgacgtggtagggtcgggcgaaatcctcagaaagagaatgaccaatacatttttacggggcaacccctaaataatgacgaggatcatgcacattggacagaggcaaaaatgcttttagataacataaacaccccagaaggtattattcccgctctatttgagccagaaagagaaaaatcggcagcaatagatggggaataccgcttgaaaggagaatcacgcaaaacattcgtcgagctaatgagacgcggagatttgccagtgtggctggcgcacaaagttgcttcagaaggaatcaaatacaccgatagaaaatggtgtttcgacggtcaacgtaataaccaaattcttgaagagaacatggacgtcgaaatttggacaaaagaaggagagaagaagaaattgcgacccagatggctagacgcaagaacttatagtgatcctcttgcattaaaagagtttaaggacttcgcagccggtcgaaaatctatcgcattagatctcgttacggagataggccgagttccatcacatctagcgcatcgcacaagaaatgccctagacaacttagttatgctgcatacatctgagcatggtggcagagcatatcgtcatgcagttgaagagttaccagaaactatggaaacactcttattacttggcttaatgatcctcctaactggaggagcgatgttattcttaatatctgggaaaggaataggaaaaacgtccataggtcttatatgtgtaattgcctcctctggtatgctatggatggccgaaattcctctgcaatggattgcaagcgcaatcgttctagagttctttatgatggtactacttattcctgaacccgaaaagcagaggacaccacaagataaccaactagcctacgtcgttataggtattctaacactggcagctatcatcgcagccaacgaaatgggtttattagaaacgaccaaaagagatcttggtatgagtaaagaacctggggttgtgtcccccacatcgtacttagatgtagaccttcatccagcatcggcatggacactgtatgccgtggcgactacagttataacacctatgttgaggcacacaatagaaaattctaccgccaacgtgagcttagcagcgatcgccaaccaagctgttgtgttgatgggtctagataaaggatggccaataagtaagatggatttaggagttccattattagccttaggatgttacagccaagttaatccattaacgttaacagcagcagtgttacttctcattacacattacgcaattattggtcccggtttgcaagcaaaagcaactcgggaagctcaaaaacgtacagccgcgggaatcatgaagaatccgacggtagatggaattatgactatcgaccttgaccctgttatatatgacagcaaatttgagaaacaattaggacaggtaatgttgctagtactttgtgccgtacagttgttactgatgcgtacctcttgggcattgtgcgaagcattaactcttgctactggccccataaccaccctgtgggaggggtcgccaggcaaattttggaataccaccattgctgtaagtatggccaacatcttcagaggcagttatttagctggcgcaggattggcatttagcataatgaaaagcgtaggcaccggcaaacgggggacaggatctcaaggtgaaacacttggagaaaaatggaaaaagaaactcaatcaattgtcccgaaaagaatttgacctatacaagaaaagtggtattaccgaagtagatagaaccgaagcaaaggaaggattaaaacgaggcgaaacgacgcaccacgctgtaagcagaggatctgcaaaattacagtggtttgttgagcgtaacatggtcataccagagggtagggtcatagacctaggatgcggaaggggaggttggtcgtattactgcgcaggacttaagaaagtaacagaagtgagaggctataccaaaggaggaccaggacacgaagaacctgtaccgatgagcacctacggatggaacattgtaaaattgatgtctggcaaagatgtattctatcttccacccgagaaatgcgacacgctactttgtgatataggtgaatcatcaccaagtccaaccgtagaagaatcacgcaccatccgggtattgaaaatggttgaaccatggcttaaaaataaccagttctgcatcaaagtcctaaacccttatatgcccactgtgatcgaacacctcgagagacttcagcgcaaacacggaggcatgctagttagaaatccgctaagccgcaattcaacacatgagatgtattggatatccaatggaaccggaaatatagtagcaagcgtcaatatggtcagccggttattattaaacagatttacaatgactcatcgccgacccactatagagaaagacgtagatcttggcgctggaacccggcatgtcaatgcagaacctgaaacgccaaatatggacgtaattggggaaagaataaaaagaataaaggaagaacacaattcaacttggcattacgacgatgaaaacccctacaaaacttgggcataccatggttcctatgaggtaaaagccacaggtagtgcctcaagtatgattaatggtgtcgtgaaattgctgactaaaccatgggacgtagtaccgatggttacccaaatggcaatgactgatacaacgccatttggtcaacaaagagtattcaaggaaaaagtagatactagaacaccaagaagtatgccaggaactcggcgggtgatgggtattaccgcggaatggctatggagaacgttagggcgaaataagaagcctagattatgcactcgtgaagaatttactaagaaagtaagaactaacgcggcgatgggagctgtgttcactgaagaaaaccaatgggattcagcaaaagctgctgtggaggatgaagacttttggaaactggtagatagagaacgcgagctgcataaattggggaaatgtgggtcatgtgtatacaacatgatgggtaagagagaaaagaaacttggagaatttggaaaggcgaaagggtcacgcgctatatggtatatgtggttgggtgctagatatttggagttcgaagctctaggtttcttaaatgaagaccactggttctctagagagaactcttattctggtgtagagggagaaggacttcacaaacttgggtacatactcagagatatttctaaaatacccggaggtgcaatgtacgccgatgataccgcaggctgggacactagaataactgaggatgatttacacaacgaagagaaaataacacaacagatggatccagagcatcgtcaattggcaaacgcgatattcaaactcacttaccagaataaagtagtgaaagtccagcgaccaaccccaacaggaactgtaatggacataatatcgcggaaagatcaaaggggatcaggacaagtaggaacctatggactaaatacattcacaaatatggaggcacaattaataagacaaatggaaggagaaggtgtacttagcaaagctgatttagaaaacccccaccttcctgagaagaaaatcacacagtggttagaaacaaaaggagtagaaagactaaagcggatggcaatatctggagatgactgtgtagtcaaacccatagatgaccgttttgctaatgccctcttggccctcaacgatatgggaaaagtacgtaaagatataccacaatggcagccctctaaaggatggcacgactggcaacaagtaccgttctgcagtcatcatttccatgaattaataatgaaagatggacgtaaactggtcgttccatgtaggccacaagatgagttaattggacgtgctcgtataagtcaaggtgccgggtggagtctacgagaaaccgcgtgtctaggaaaggcttatgcgcagatgtggtcattaatgtatttccacagaagagatctgagacttgcatctaatgctatatgttccgcagtcccagtacattgggtacctacctcaagaacaacttggtccattcacgcgcaccatcaatggatgaccacggaggatatgttgacggtatggaacagagtatggatagaagacaatccgtggatggaagataagactcctgtgacaacttgggaaaatgtgccttacttaggaaaaagagaggatcagtggtgcggatcgttaataggactaacatctcgtgccacatgggcacaaaatattcccactgctatacaacaagtacgttcccttatagggaacgaggagttcttggattatatgccctcgatgaaaagatttagaaaggaagaagaatcagaaggggcgatatggtag

SEQ ID NO: 23296 - RNA, 9873 nt, synthetic construct
  misc_feature 1..9873: note = derived and/or modified CDS sequence (opt6) from DENV-3__EU482555__SS-prME
  source 1..9873: mol_type = other RNA
acaagcctttgtttaatgatgattttgccagcagctttagcattccatctaacatctcgcgatggggaaccacgtatgattgtggggaaaaacgaacggggtaaatcgttactattcaaaacggcatcgggtataaatatgtgtactctgatcgcaatggacctaggagaaatgtgtgatgacactgtgacatataaatgtcctcatatcaccgaagtggaacctgaagatattgattgttggtgtaaccttacttctacctgggttacctacggaacatgtaatcaagctggagaacatcgacgtgataaacgctccgtagctttggcaccgcacgttggcatggggttggacacacgaacacagacttggatgagtgcggaaggggcttggcgccaggtagaaaaagtagaaacatgggctctacgtcaccctggttttactattttagcactattcttagctcattacatcggcacgagtctaactcaaaaagtagtcatctttatactacttatgttagttactccatctatgacaatgcgatgtgttggggtcgggaacagggattttgttgaaggactatcaggagcaacatgggtagacgtagtccttgaacatggcggatgcgtcactactatggccaaaaataaaccaacccttgatatagaattacagaaaactgaagcaacacaactcgctacattacgtaaactatgtatagaagggaaaatcaccaacataactacggacagtcgatgtccaactcaaggagaagcagttctgccagaagaacaagatcaaaattatgtatgtaaacacacttatgtagacagggggtggggaaacggatgcgggttatttggcaaaggctcgttggtcacctgtgcaaaattccaatgcttagaaccaatagaagggaaagtcgtccaatacgaaaacttaaaatacaccgtaatcataacagtacatacaggagatcaacatcaagttggcaacgaaacacaaggagtcacagcggaaatcacccctcaagcatctacgactgaggcaatcttgcctgaatatggcacattagggttggagtgttcaccacgaaccgggttggattttaatgaaatgatattattgactatgaaaaataaagcgtggatggttcaccgacaatggttctttgatctgccactaccatggacatctggggcgacaaccgaaacaccaacttggaaccgaaaagaactattggttacatttaaaaacgcgcacgccaagaaacaggaagtcgtagtgttgggttctcaagagggggctatgcatacagcgttaacgggcgctacagaaatacagaacagtggtggcacttccatatttgcaggccacctcaaatgcaggctaaaaatggacaaactggaattaaaaggaatgtcatacgccatgtgtactaacacttttgtattgaagaaagaagtctcagaaactcagcacggaacaatattaattaaggttgagtataagggcgaagatgctccatgcaagattcccttcagcactgaagatgggcaaggaaaagcacacaatgggagattaatcacagccaatccggtagtaacaaagaaggaggaaccagtgaacatagaggccgaacctccctttggagaatcaaatattgtaatcggaattggtgataatgctttaaagataaattggtacaaaaagggaagttccattggaaaaatgttcgaagcgacggcaagaggggcccgtaggatggccatattaggagacacagcatgggattttgggtccgttggaggggtcctaaactcactaggaaaaatggttcaccagatctttggctcagcatatacggccttattttcgggcgtctcttgggtaatgaagataggaataggggtcttactaacatggataggattaaatagtaagaacactagcatgtcatttagctgcatagcgataggagtaataacgctataccttggtgcagttgttcaagccgatatgggatgtgtaatcaactggaaaggaaaggaactcaagtgtggatcaggcatctttgtaactaacgaagtgcacacttggaccgaacaatacaaatttcaggctgactcacccaagagattggccactgcaattgctggagcttgggagaatggagtgtgcgggatcaggagcacaacacgaatggagaatttgctatggaaacaaatagcgaacgaacttaactacattctctgggaaaacaatataaaactaacagtggtagtcggagacataatcggggtattggagcaaggtaaaagaacccttacaccgcaaccgatggaattgaaatattcttggaaaacatggggtaaagctaagattgtcactgcagaaatacaaaattcatcgttcataatagatggcccaaatacaccagaatgcccgagtgcttccagggcttggaatgtctgggaggtcgaggactatggatttggggttttcactaccaatatttggttgaaattaagggaggtatatacacaactatgtgatcatagacttatgtctgcagctgttaaagacgagcgtgccgtgcatgctgatatgggctactggatcgaatcccagaaaaatggaagttggaaactcgagaaagcatctcttattgaagtcaaaacttgtacatggcctaaatcgcacaccttatggagtaatggagttctagaatctgatatgattatcccgaagtccctagcaggtccaataagtcaacacaattatagaccagggtaccatacacaaacagcaggaccgtggcacttaggtaaattagacctcgatttcaattattgcgaagggactacagtagttatcacggagaattgtggcacccgtggaccatcccttagaacaaccacagtgagcggcaaattaattcatgaatggtgttgcaggagttgcacacttcctcctctaagatacatgggtgaagatggttgctggtatggcatggaaatccggccaatctcagaaaaagaggaaaatatggttaaaagtcttgtatctgcaggttcaggaaaagttgataattttacgatgggcgttttgtgtttggcaatattatttgaagaggtcatgaggggtaagtttggaaagaagcatatgattgctggtgtctttttcacgtttgtgctgcttctatccggacagattacgtggagagatatggcccacaccttgattatgatcggtagcaatgcctcagataagatgggtatgggagttacttacttagctctcattgccacctttaaaatacagccatttttagcccttgggtttttcctgaggaaattaacaagtagggaaaatttattacttggagtgggactagccatggctaccacattgcaacttcctgaggatattgaacaaatggctaacggcatcgctctcggtctcatggctctgaaactaataacgcagttcgaaacttaccaattatggacagcactaatttcgttaacttgttccaatacaatgtttacgcttaccgttgcctggagaacagccacactcatcctggcaggagtatcattattacctgtgtgccaatcttcgagcatgagaaagactgattggttaccgatggcagtggcagcaatgggcgtcccgcccctgcccctatttatattttcattaaaagatacattaaaaagacgtagctggcctctcaatgagggtgttatggcggtgggattagtctcaatactagcctcctcccttctgcgaaatgacgtacccatggctggccctctagtggcagggggacttttgatcgcgtgctatgtaatcacagggacatcagcggacctaacagtagaaaaagccgccgacatcacatgggaagaagaagctgaacaaaccggtgtttcccacaatctcatgataacagtggatgatgacgggacaatgcggataaaagatgatgaaaccgagaacatactcactgtcttacttaaaacagctctgcttattgtttctggtgtattcccgtatagtattccggcaacactgttagtatggcacacgtggcaaaaacagactcaaaggtctggagtattatgggatgtaccctctcctcccgaaacccaaaaggcagaactagaagaaggagtttatagaatcaaacaacaaggcatatttgggaaaactcaagtaggcgttggcgttcagaaggaaggagtttttcacactatgtggcatgttacgaggggtgcggtactaacatacaacggtaagcgtttggaacccaactgggccagtgttaagaaagacttaatctcctatggaggcggatggagactcagcgctcaatggcaaaagggggaggaagtacaggtaattgcagtggaaccaggcaaaaatcctaaaaacttccaaaccatgcctggaacattccaaacaactaccggtgagattggcgcaattgcgctagactttaaacctggtacaagtggaagtccaataataaaccgtgaaggtaaggtagtcggactttacggtaatggagtcgttactaaaaatggcggttacgtgtctggtatagctcagactaatgcagaacctgacggacctacaccagagttagaagaagagatgtttaagaaacgtaacttaacgataatggacttacatccaggatctggaaaaaccagaaaatatctccccgcaatagtacgcgaagccatcaagaggagactgcgcactctgatattagctcctacaagggtggttgcggcagaaatggaagaagctcttaaaggactccctataagataccaaacaacagcaacaaaaagtgaacatacaggtagagaaatagtagatttaatgtgtcacgcaacatttacaatgagattactcagtccagttagagtgcctaattataacttaattataatggacgaagcacactttacagaccccgcctcaatagccgcacgcggatatatatcgactagggtagggatgggagaggcagcagcgatatttatgactgcaacacctcccgggacagcagatgcatttccacaaagtaatgcacccatccaggacgaagaacgagacataccagaaagaagctggaactctggcaatgaatggattacagactttgctggtaaaacagtatggtttgttccatccatcaaggctggtaatgacatcgccaattgtcttcgcaaaaatggcaaaaaggtcatacaactctctcgaaaaacctttgatacagagtatcagaaaaccaagctcaatgactgggattttgtagttacaacagacatatctgaaatgggtgctaactttaaagctgatcgggtcatagatcctcggcgttgcttaaagcctgtaatattaacagatggacccgagagggtcattcttgcgggccctatgccagttaccgcagcgagtgcagcacaacgaagaggaagagtaggacgcaacccacaaaaagaaaacgatcaatacatttttaccggacagcctctaaacaacgacgaagatcatgctcattggacggaagcaaagatgttactagacaatataaatacaccagaagggataatccccgcattattcgaaccagagagggagaaaagtgccgcgattgacggtgaatacagattgaaaggagagtctagaaaaacatttgttgaattgatgcgaagaggggacttacctgtttggctagcccataaagtcgcgagtgaaggtatcaaatacactgatcgtaagtggtgtttcgacggacaacgaaataaccagatattagaagagaatatggacgttgaaatttggaccaaagaaggagagaagaagaaattaagaccacgatggttggatgcacgaacttattcagacccgctagccctaaaagaatttaaagacttcgcggctgggaggaagtcaattgcgctggatttggttacggaaatcggtagagtacctagtcacttagctcatcgaactcggaatgcattggataatcttgttatgcttcatacatccgaacacgggggaagggcctaccgacatgcagtcgaagaattaccagagacgatggaaacattattattgctgggtttgatgatattattaaccggtggagcgatgctattcttaatatcgggtaaagggatagggaaaacaagtattggtttaatttgtgtaattgcatcttccgggatgctgtggatggccgagatccccttacagtggatagcaagcgccattgtacttgaatttttcatgatggtcttgttaataccagaaccggaaaaacaaagaacaccccaggataaccagctcgcttatgtcgtgataggaatactaaccctagcagctataattgcggccaatgaaatgggtctattagaaaccacaaagcgggacttaggaatgagtaaagaacccggagtagtttcacctacaagttatttagatgtagatctacaccctgcatcagcgtggactttgtacgccgtcgccacgacagtaattacacctatgttaagacataccattgaaaattctactgctaatgtgagcctagctgcaatagcaaatcaggcggttgtattaatgggactagacaaaggatggccaataagcaaaatggacttgggtgtcccgcttctagcattgggctgctatagtcaagttaatccattaacactaaccgccgcagtacttctgctcataacacattacgcaataataggcccagggctccaagcaaaggcaaccagagaagcgcagaaacgtaccgcagctggaatcatgaaaaacccgactgtcgacggcataatgacaatagacttagatcccgtcatatatgattcaaaatttgagaaacaattaggacaagtgatgctactggtactatgcgctgtacagctattacttatgagaacatcgtgggctttatgtgaagcactgaccttagctacgggtccaataacaacactgtgggaaggaagtccagggaaattttggaatactaccatagctgtttcaatggcaaatatatttcgtggaagctatttagccggagcgggcttagctttttccataatgaaatccgtaggaacaggaaagcgtggtactggatcccagggggaaaccttgggtgagaaatggaagaagaaactaaatcaacttagcaggaaagaatttgatttgtataagaaatcaggaataaccgaggtggacagaacagaggcaaaagaaggtctaaaacgtggagaaactacacatcacgcagtatctagagggacagctaaattacaatggtttgtagagcgaaatatggtcattccggagggaagagtgatcgacttaggttgtggtagaggaggatggtcatactattgcgcaggcctcaagaaagtcacagaggtccgcggatacacaaaaggtggacctggtcatgaagaacctgtaccgatgagcacctatggttggaatatagtaaaacttatgtccggaaaagatgtattttatttgccaccggaaaaatgcgatacgttgttatgtgacataggggaaagttcccccagcccaaccgttgaagagtcaagaactatacgtgtgctaaaaatggtagaaccatggcttaaaaacaatcaattctgcatcaaagtcttaaatccctacatgccgactgtcatagagcatctagaacgattacagcgaaaacatggaggtatgctcgtacggaatccactgagtcgaaatagtacacacgagatgtattggatcagtaatggaacaggaaatatagtggctagtgttaacatggtcagccggctacttttaaaccgctttacaatgacacacagacggccaacaatcgaaaaagacgtagatctaggagcgggaacgcgacacgttaacgcagaaccggagacaccaaacatggatgttataggtgaaaggattaaacggatcaaagaggaacataattcaacttggcattacgacgatgaaaatccatacaagacttgggcttatcatggttcatacgaagtcaaagcgactggttcggcatcttcgatgataaatggggtcgtgaaattattaacaaaaccctgggacgtggtcccaatggtgactcaaatggcaatgacagacaccactccatttggccaacagagggtattcaaagaaaaagtagacacccgaacaccaaggagtatgccaggaaccagaagggtcatggggataactgcagaatggttgtggaggacattgggaagaaacaagaaacctcgattatgtacacgcgaagaatttactaagaaagtccgtaccaacgcagctatgggagccgtgtttacagaagagaaccaatgggattcagccaaagctgcggtggaagacgaagacttctggaaactggtagatagagaacgagagctacataaactgggcaaatgcggaagctgtgtctacaacatgatggggaaacgagagaagaaactcggtgagtttggcaaagccaaaggatcgcgcgcgatttggtacatgtggttaggagcaagatatttggagtttgaggctttgggtttcttaaacgaagaccactggttttcacgcgaaaactcctatagtggtgtagaaggtgaaggtcttcacaaacttggatacattcttcgtgacataagtaaaatacctggtggtgcaatgtatgccgatgacacagctggatgggatacgcgaatcacagaagacgatttacacaatgaagagaaaataacacaacagatggaccctgagcacagacaattagcaaatgcgatatttaaattaacttatcaaaataaggtggtgaaagtacaacgaccgactccaacgggtactgtaatggatattatatctcgtaaagatcaacgtggctcaggacaagtaggaacttatggattaaatactttcaccaatatggaagcacagctgattagacaaatggaaggagaaggtgtactttcaaaggcagatttagaaaaccctcaccttcccgagaagaaaattacccagtggctagaaacaaagggggttgagcgactgagaagaatggccatatcaggagatgattgtgtcgtaaagcccattgatgatagattcgcaaatgccttgctggctttaaacgacatgggcaaagtaagaaaagatataccgcaatggcaaccttcgaaggggtggcatgactggcaacaggtccccttctgttcccatcattttcatgaattaatcatgaaagacggaagaaaattagtagtaccatgccgcccacaggatgaattaatcggcagggctagaatctcacaaggagctgggtggtcactcagagaaacagcctgcctgggcaaagcatatgctcaaatgtggtcactcatgtattttcaccgaagagacctgagattagcgagtaacgcaatatgctcagcagtgccagtgcattgggttcctaccagccgcaccacatggagtattcatgcacaccaccagtggatgacgaccgaagatatgctgactgtctggaatagagtatggatagaagataacccatggatggaggacaaaacaccggtaacaacgtgggagaacgtaccatatttgggtaagcgagaagaccaatggtgtggatcattaataggcctcacgtcacgtgcaacttgggctcaaaatatacccaccgccatacaacaagttagatcgctaataggaaatgaagagttcttagattatatgccaagcatgaagaggtttcggaaagaagaagaatcagaaggagctatatggtaa

SEQ ID NO: 23297 - RNA, 9873 nt, synthetic construct
  misc_feature 1..9873: note = derived and/or modified CDS sequence (opt6) from DENV-3__EU529692__SS-prME
  source 1..9873: mol_type = other RNA
acaagtttatgtctaatgatgatccttccggctgcattagcctttcacctgacatctagggatggggaaccaagaatgatagtaggcaaaaacgaacgcgggaaatctctgcttttcaaaacagcgagcggtataaatatgtgcacattaatagccatggatttgggggaaatgtgtgacgatactgttacgtacaaatgtcctcatatcacagaagtagaaccagaagacatcgactgttggtgcaatttaacatcgacttgggtcacttatggaacctgcaaccaagctggagaacatagacgtgataaacgctcagtagctctagcgccacatgtcggaatgggattagacacacggactcaaacttggatgtcagccgaaggtgcttggcgccaagttgagaaagtggaaacttgggctttacgtcatcctggattcacaattcttgcactgttcctagcacactatattggtacatcactaactcaaaaagtagtcatctttatattacttatgctggtgacgccatcaatgaccatgaggtgtgtcggagtcggtaaccgagatttcgtagaagggctaagtggagctacatgggtggatgtagtcctagaacatggtggatgtgtcacaaccatggccaaaaataaaccgaccttagacattgaactacagaaaacggaagccacccagctcgcaacactacgaaaattatgtatcgagggaaaaattacgaacataaccaccgatagcagatgtccaacccagggagaagcagtactaccagaagaacaagaccagaattacgtatgtaaacacacatacgtagacagggggtggggaaatgggtgtggtctatttggcaaagggagtttagttacttgtgcaaaattccaatgtctagagccgatcgaaggtaaagtagtacaatatgagaatttgaaatatacagttataataacagtgcatacaggagatcaacaccaagtgggaaatgaaacgcaaggagtgacggctgaaatcactccacaagcgtcaactacggaagcaatcctgccagaatatggaacactagggctggagtgtagtcccagaacgggattagacttcaatgaaatgattcttcttacgatgaaaaacaaagcgtggatggtacaccgccagtggttctttgacttacctttaccgtggacgagcggagcgaccacagaaacccccacatggaataggaaagaactcctagtaacttttaaaaacgcacatgcgaagaaacaagaagttgtagttttgggcagccaggaaggagcaatgcacactgcactaaccggcgcaaccgagattcaaaactcgggtggtacgagcatcttcgccgggcatttaaaatgcaggctaaaaatggacaaactagagttaaaaggcatgtcgtatgcaatgtgcacaaatacatttgtgcttaagaaagaggtctcggaaactcaacatggtacgatactaatcaaagttgaatataaaggcgaagacgcgccttgcaaaatcccgttttcgactgaagatggccaaggaaaagcgcataatggacgtcttattacggctaatcccgtagtaaccaagaaagaggaaccggttaatatagaagcagaacctccattcggagaatctaacattgttataggtattggtgataacgctttgaaaataaattggtataagaaaggcagcagcatcggaaaaatgtttgaggccaccgcaaggggtgcaagaagaatggcgatcctaggagatactgcgtgggatttcggatcggtcggtggagtgctcaactcattagggaaaatggtgcatcaaatattcgggagtgcgtacacagcactattttcaggtgtatcctgggtaatgaaaatcggtataggggtattactaacctggattggtctaaatagtaaaaatacctccatgagcttttcctgtatagcaataggcgtgataacactatacctaggggctgtcgtacaagcagatatgggttgcgtaataaattggaaagggaaagaactaaaatgtgggagcggcatatttgtaacaaatgaagtacatacgtggacggaacagtacaaattccaggctgactcaccaaaacgacttgctacagctatagccggtgcatgggagaatggagtatgcggtattagaagtacaacgaggatggaaaatttgctgtggaaacaaatagcaaacgaactaaactatatactatgggaaaacaatattaaactaaccgtggttgtcggcgacataattggagtattagagcaaggaaaaagaaccctgacaccccaaccaatggaactgaagtacagttggaaaacttggggaaaggccaagattgtcactgccgaaattcaaaatagtagttttattatagacgggcctaatacaccagaatgtccgagtgcctcccgtgcttggaatgtatgggaagtcgaagactatggctttggtgtctttacaaccaacatatggttaaaactaagggaagtatatacccaattatgtgatcaccgactgatgagcgcagcagttaaagacgaaagagctgtacatgcagatatgggttactggatagaatcacagaaaaatgggtcatggaaactagaaaaagccagtttaatcgaagtcaaaacgtgtacgtggcctaaaagtcatacgttgtggtcaaacggagtgctcgaatctgatatgataatccctaagagcttagccggtccgatcagccaacataactataggccaggttatcatactcaaacagcaggtccatggcacttaggaaagttagacttggatttcaattactgcgaggggaccacagtagtaatcaccgaaaactgtggaactcgtggaccatcgcttagaacaacgacggttagcggaaagttaatacacgagtggtgttgtcgatcttgcactttaccccctttacgctatatgggcgaggatggatgctggtacggaatggagattcgtcccataagcgaaaaagaagaaaatatggtcaaaagtttagttagtgcagggtcaggtaaggtcgacaactttaccatgggggttttatgcttggcaatactctttgaagaggtgatgagaggcaaatttggaaagaaacacatgatagccggtgtatttttcacttttgtacttcttttgtcgggccaaattacctggagggacatggcacatacattaatcatgataggttctaatgcatcggacaaaatgggaatgggagttacttacctcgcactaatcgccacctttaaaattcaaccattcctagcactcggtttcttcttaagaaaacttacaagccgagagaatttattactaggtgtaggcttggcaatggcaactaccctgcaactacccgaggatatcgaacaaatggcaaacgggatagctctcgggctaatggcattaaaactaatcacacaatttgaaacctaccaactatggacggcattgatttcattgacatgttcgaatacaatgttcactttaaccgtagcttggcgtacggctacgctaatactagcgggcgtgtcactactacctgtgtgtcaatcctcgtctatgcgcaagacagattggctgccgatggccgtagctgcgatgggtgtgccgcccctcccactttttatttttagtcttaaagacacattaaaacggagatcatggccactaaatgaaggagtaatggccgtgggattagtatcaatactcgcaagtagcctgttaagaaacgatgtgccgatggcaggaccacttgttgcgggcggactattaatcgcgtgttacgtaatcaccgggacttcagctgaccttactgttgaaaaagcagctgatattacgtgggaagaggaagcagaacaaacgggggtctctcataacctcatgattactgtagatgatgacggcacaatgaggatcaaagatgacgaaacagaaaatattttaacggtactattaaaaactgcattgcttatcgtatctggagtatttccatatagcataccagcaacattgcttgtatggcatacatggcaaaaacaaactcaacgtagcggagtcctctgggatgtgccaagcccaccagaaacacaaaaagccgaattagaggaaggagtgtaccgaatcaagcaacaaggtatttttggtaaaacccaagtaggagtaggcgtccaaaaagaaggagtgttccacacaatgtggcacgtaactcgtggagcggtgttaacatataacggtaaaagattagagccaaattgggcctcagtcaagaaggacttaatttcgtatggtggtgggtggaggttatcagctcaatggcaaaaaggagaagaggtgcaggtaatagccgtagagccaggcaaaaaccccaaaaatttccaaactatgccgggaacattccaaacaacaactggcgaaatcggggctatagctttagactttaaaccgggaaccagtgggagtcccattatcaacagggagggaaaagtcgttgggctatatggcaatggagtagttactaaaaacggaggctacgtaagtggaattgcacagacaaacgcagaacccgacggacccacgccagaacttgaggaagaaatgtttaagaaaagaaatttgactataatggatcttcacccagggagcggcaaaaccagaaaataccttccagcagttgtccgggaggctataaaaagacgtttaagaacacttatcttggctcctacacgagtagtagcagcggaaatggaagaagcacttaaaggactaccaattcgatatcaaaccactgcaacgaagtccgaacataccggacgcgaaatagtggacttaatgtgccatgcaaccttcacaatgcgattactgagccccgtaagagtgccaaattataacttaatcattatggatgaagcccatttcacggatcccgcatcaattgctgcaagaggctatatttcaactcgagttggcatgggtgaagcagcagcaatcttcatgacagcaacaccaccagggactgcggacgcatttcctcaatctaatgcgcctatccaagatgaagaaagggacataccagaaagatcttggaactcaggtaatgaatggattacagacttcgctggcaaaaccgtatggtttgttccatctattaaagcaggaaatgatatagccaattgccttaggaaaaatggaaagaaagtaattcaactctcaaggaagactttcgacacagaatatcagaaaacaaaattgaacgattgggattttgtggtaaccacagacatatcagaaatgggcgcaaattttaaagccgatagagttatcgatcccaggagatgtctaaaacctgtaattttgactgatggtcctgagcgggtaatactggctggaccaatgccagtcactgcagcatccgcagcacaaagacgtggaagagtaggacgaaaccctcaaaaggagaacgatcagtatatatttactggacaaccactaaataacgacgaagaccacgctcactggacggaagccaaaatgttgctagataacataaacaccccagaaggcattataccagctttatttgaaccggagagagagaaatcagcagcgattgacggggaatataggttaaaaggtgagtcacggaagacgtttgtagagctaatgcgtcgaggtgacttgcctgtctggcttgctcacaaagtagcatcagaaggcatcaaatatacagacagaaaatggtgtttcgatggacagagaaataatcaaatactcgaagaaaatatggacgtagaaatctggacaaaagagggcgagaagaagaaactaagaccgaggtggctggatgcgagaacatattcagaccccttagcactgaaagaatttaaagattttgcagcaggaaggaaatcgatcgcgctcgatttagtcacagagataggaagagtaccaagtcatcttgcacataggacccgcaacgcacttgataacctagttatgttacatacaagtgagcacggtggacgggcgtatcgacatgcagtagaagaattaccagagaccatggaaacacttctgttattaggattaatgatcttactcacgggtggagcaatgctgtttcttatttccggtaaaggcatcggaaaaacaagcatcggtcttatatgcgtaattgctagttcagggatgttgtggatggctgaaataccactacaatggatcgcatcagcaattgtcctcgagttcttcatgatggttttacttatacccgaacctgaaaaacaacgaaccccgcaagataatcagctggcctatgtagtgataggcattctgactttagctgctatcatagctgcgaatgaaatgggtctactagaaaccaccaagcgggatctgggaatgagcaaggaaccaggtgttgttagccccaccagctacttggatgtcgatcttcatcctgcgagcgcatggactctatacgccgtcgcgactactgttatcactccaatgctacgccacaccatagaaaattcgactgcaaatgtctccctcgcagctattgcaaatcaagctgtcgtcctaatgggtttagataaaggatggccaatctctaaaatggatctaggtgtgcccctgctggcgttaggatgctattctcaggtcaatccacttactttaactgctgcagttctcttactaataacacattatgctattatagggccagggttacaagccaaagcaacgagagaggctcagaaaaggaccgctgccggtataatgaagaaccccaccgtagatggaataatgacaatagacttggatccagttatatatgacagcaaatttgaaaaacaattaggacaagttatgctcctagtcctatgtgctgtgcaactactcttaatgagaacatcctgggcattatgcgaagcactgacacttgcaactgggcctatcacgaccctgtgggaaggatctccaggtaaattttggaatacgactatcgccgtctctatggctaacatctttcgcggatcatatctagcaggcgcaggccttgctttctcaataatgaaaagcgtaggtacgggaaaacggggaaccggttctcaaggagaaacgttaggcgaaaaatggaagaagaaactaaaccagctaagtaggaaagagtttgatttatataagaaatccggaattaccgaagtagatagaacagaggcaaaagaaggacttaaaagaggagaaaccacacaccatgctgtttctcgtggcactgcaaaactacagtggttcgtagaacgaaacatggtgattcctgaaggacgagtaattgacctcggctgtgggcgaggcggctggtcatattattgcgcaggtctcaagaaagtaacagaagtgcgtggatataccaagggaggtccaggccatgaagaaccagtacctatgtcaacatacggatggaatatagtaaaattaatgagtgggaaggatgtattctacctacctcccgagaaatgtgatacactactatgtgacataggtgaatctagcccatcaccaacggttgaagagtcacgaacaataagagtcctgaaaatggtagagccatggctcaagaataatcagttctgcataaaagtactaaacccttacatgccaactgtgatagagcatttagaacgccttcaaagaaagcacggagggatgcttgtacgaaatccgttatcgcgcaattcaacccatgaaatgtattggatctccaacggaacaggaaacatcgtagcgagcgttaacatggtgagcagacttctactaaaccgatttactatgacacatagaaggccaaccatagaaaaagatgtcgatttgggtgcaggtaccagacatgtaaatgcggaacctgagactccgaacatggatgttataggagaacgcatcaaacgtatcaaggaggaacataattcaacatggcattacgatgatgaaaatccttacaagacatgggcgtaccacggatcctatgaagttaaagcgacaggctccgcaagttcaatgattaatggagtcgtgaaattgctcacgaaaccatgggatgtcgtgccaatggtcactcaaatggcaatgactgacacgactccttttggccaacaacgcgtattcaaagaaaaagtagacacaagaactccgcgttctatgcctgggaccaggcgcgtcatggggattaccgctgaatggctttggagaacgctaggccgaaataagaaaccacggctttgtactcgtgaagagtttactaagaaagtaaggacaaacgccgctatgggcgctgtctttacagaagaaaaccaatgggactccgcaaaggcagctgttgaggatgaagatttttggaagctagtggaccgagaacgagaattgcataaactggggaaatgtgggtcctgtgtatacaacatgatgggaaaacgagagaagaaattaggggagttcggaaaggcaaaaggatctagggcaatatggtacatgtggctgggcgcaagatacctagagtttgaggcattaggtttcttaaacgaagatcactggttctcaagagaaaatagctattcgggagtagaaggagagggattacacaaattaggttacatattaagagatatctcaaaaatacctggtggtgcaatgtatgccgacgatactgcaggatgggacacccgaatcacagaagatgacttacataatgaagagaaaataactcagcaaatggaccctgaacaccgtcagctagctaatgcaatattcaaacttacgtaccaaaataaagtcgtaaaagtccaaaggcctacacctacaggaacagtcatggatattattagtagaaaagaccaaagaggttcggggcaggttggaacttatggattaaatacgtttacaaatatggaggtacaactaatacgtcagatggaaggagaaggggtcttgagtaaagccgacctggaaaatccccatttaccagagaagaaaataacacaatggctagagactaaaggagtcgagagattacgtagaatggcaatttctggggatgattgtgtagtaaagccaatagacgatagatttgcaaacgcattactagcgttaaatgatatgggaaaggtaaggaaagatataccacagtggcaacctagtaaagggtggcatgactggcaacaagtcccattctgctcacaccatttccacgaacttataatgaaagatggacgaaaattagtggttccctgcaggccacaagatgaactaataggcagagcaagaatatctcagggggcaggttggtctctaagagaaacagcgtgtcttggaaaggcgtacgctcaaatgtggtctctgatgtacttccataggcgcgatttgagactagcaagtaacgccatatgcagcgctgtccccgtccattgggtaccaacaagtcgaacaacatggtcaatacacgcccatcaccagtggatgaccactgaggatatgttaactgtctggaatagagtatggatagaggataatccatggatggaagataaaacaccagttactacttgggagaatgtcccgtatctcggtaagagagaagatcaatggtgcggctcactaataggattgacttcccgggcaacatgggcacaaaatatacccacagcaatccaacaagttagatcactcatcggcaatgaggagtttcttgattatatgccttcaatgaaaaggtttcgaaaagaggaggaatccgaaggcgcgatttggtaa

SEQ ID NO: 23298 - RNA, 9873 nt, synthetic construct
  misc_feature 1..9873: note = derived and/or modified CDS sequence (opt6) from DENV-3__EU482558__SS-prME
  source 1..9873: mol_type = other RNA
acctctttgtgcctaatgatgatactacccgcagcactagcatttcacttaacctcacgagacggggaacctagaatgatagtaggtaaaaatgaaaggggaaaatctttgttgtttaaaaccgcaagtggaattaatatgtgtacattaattgcaatggatttaggagaaatgtgcgatgatacagtcacttacaaatgcccacacatcacagaagttgaacccgaagatatagattgctggtgtaatctaacgtcaacttgggtaacgtatggtacatgtaaccaagctggagaacaccgtcgcgacaaacgaagtgttgcgctggcacctcacgtaggtatgggtctcgacactagaacccaaacctggatgagtgcagaaggtgcttggagacaagttgaaaaagtcgaaacatgggcattacgtcatcccggctttacaatacttgccctcttccttgctcattatataggaacatccttaacccaaaaagtcgttatatttatattattaatgctagtcacaccttccatgactatgcgatgtgtgggcgtaggaaatcgtgatttcgtagaaggattgtctggagcaacatgggttgacgttgttttagaacacggtggatgcgtgacaaccatggccaaaaataaaccaacgttggacatcgaactgcagaaaactgaagcgactcagcttgcaacgctacgtaaattatgcatcgaaggaaaaatcacgaatataacaacagattctcgctgtcccacccagggggaagccgtccttcctgaagaacaagatcaaaactatgtttgcaaacacacatatgtagatcgtggttggggaaatgggtgtggtctttttggtaaaggttctttagttacatgcgcaaaattccaatgcctagaacccatagaagggaaagtagtacagtatgaaaatcttaaatacactgttatcataacagttcataccggagatcaacatcaggtaggaaacgaaacacagggagtgacagcagaaattacgccacaagcaagtactacagaagcaatactgcctgagtacggtacacttggattagaatgcagtcctagaacgggtctagattttaacgaaatgatccttctgacaatgaaaaataaggcttggatggtacacagacaatggttcttcgaccttccacttccatggacttccggagcaactactgaaacccctacctggaacaggaaagaattgttagttacgtttaaaaatgcccacgccaagaaacaagaagtcgtagtcttgggatcccaggaaggggccatgcacactgctttaaccggtgcaacagagatacaaaattccgggggcacatctatattcgccggtcatttaaaatgtagattaaaaatggacaaattagagctaaaaggcatgtcatacgctatgtgtacgaacaccttcgtgctaaagaaggaggtatcagagacccagcatgggacaatattaataaaagtagaatataagggagaagatgttccatgtaaaatacccttttcaacagaggacggtcagggcaaagcccataatggtagattaataacagcaaacccggttgtgactaagaaagaagaacccgtaaatatagaagctgagccacctttcggtgagtccaatattgtaataggcattggtgataatgcactaaaaataaattggtacaagaaaggttcgtctattggaaaaatgttcgaagctacggcacgaggcgcacggcggatggcaatactaggagatactgcttgggacttcggcagcgttggcggcgttttaaacagtttgggtaaaatggttcatcagatctttggatcagcatacactgcactgttttctggagtatcttgggttatgaaaatagggattggagttctcttgacctggattggtcttaatagcaaaaataccagtatgtcttttagctgtatcgctattggaataataacgctatatctaggagctgtggttcaagctgacatgggatgtgttataaactggaaaggcaaagaactaaaatgtggatcagggatttttgtaacaaatgaagtgcatacctggacagagcaatataaattccaagctgactcacccaaaaggttagctacagctattgccggtgcatgggagaacggggtctgtggcatcagatcgaccacacgaatggaaaacctactctggaaacaaatagctaacgagttgaattacatactgtgggaaaacaatataaaactaacagttgttgtaggtgatataataggagtgctcgaacaggggaaaagaacactaacacctcaaccaatggaattgaaatacagctggaaaacctggggaaaagccaaaattgttaccgcggaaacgcaaaatagctcctttatcatagatgggccgaatactcccgagtgtccgtcggccagcagggcgtggaacgtatgggaagtagaagattatggatttggtgtctttactactaacatatggctaaaattgagggaagtatatactcaattatgtgaccaccgcttaatgagtgcagctgtaaaagatgaaagggctgttcacgctgacatgggatactggatcgagagtcagaaaaatggatcatggaaactcgaaaaggccagtctaatcgaggtaaaaacatgtacttggccaaaaagtcacacactttggagtaacggagttttagagtcggacatgataatccctaaaagtttagcgggcccaatttctcaacataattatagaccaggataccatacacagacggcagggccatggcatttaggtaaactagaattagattttaactattgtgaaggaacgacggtcgttataacagaaaattgcggtacaagaggtccttcattaaggactacaaccgtatcagggaaattaatccacgaatggtgttgcaggtcctgtacacttcctcccctgagatatatgggagaagacggctgctggtatggtatggaaataagacctatatccgaaaaagaagaaaacatggtaaagagtttagtttcggcgggatcgggcaaagtcgacaattttacaatgggcgttttatgtctagcaatactttttgaggaggtcatgagagggaagttcggcaagaaacatatgattgcaggggtattctttacgtttgtactactattgagtggtcaaataacctggagggacatggcacacacacttattatgataggcagtaacacctcagaccgtatgggtatgggggtaacttatttagctttgatagcaaccttcaaaatccaaccatttttagcattaggattcttcctcaggaaactgacgagtagagagaacctccttctcggagtaggtctcgctatggcgactacgcttcaattacctgaggacatcgaacaaatggctaatgggatcgccttgggcttaatggcgttaaagctaataacacaattcgaaacttatcaattatggactgcattgatttcgttaacctgcagtaacacaatatttacattaactgtggcatggcgtactgcaacactaatactagcaggagtaagtttgttacctgtttgtcaatcgtcatcgatgagaaaaacggactggttaccaatgactgtcgctgcaatgggcgtacccccacttccgttattcatatttagtttaaaggatactctcaaaaggagatcttggccgctcaatgagggagttatggccgtggggctggtcagtatactagcttcctctctattacgtaatgatgtaccgatggccggacctctagtagccggaggactattaatcgcttgctatgtaataactggaacgtcagcagatttaactgtagaaaaagccgcagatgtcacatgggaagaggaggcagaacaaacaggagtcagtcacaatcttatgattactgtagacgatgacggcactatgagaataaaagatgatgagaccgaaaatatattaacagtcttacttaaaacagctctactaattgttagcggtatcttcccttatagtattcccgctacactgttagtatggcacacatggcaaaaacaaacacaacggagtggagtattatgggacgttcctagcccgccagagactcagaaagcggaacttgaagagggtgtgtatagaatcaagcaacaaggaatctttggaaaaacccaagtgggtgtaggagttcaaaaggaaggagtgtttcatacaatgtggcatgtaacccgtggtgcggtactaacatataatggaaaaagactcgaaccaaattgggccagtgttaaaaaggacctcatatcgtatggaggcgggtggagactgtcagcccaatggcaaaaaggagaagaggtacaagttattgccgtggagccgggtaaaaacccaaagaacttccaaactatgcctgggacattccagacgacgacaggagaaataggggccatagctttagacttcaaacccggtacatcaggcagtccaataataaatcgcgagggaaaagtcgtagggctttatgggaatggtgtggtaacaaagaatggtggctacgtatcaggaattgctcagacaaatgcggagcccgatggacctactccagaattggaggaagaaatgttcaagaaaaggaacttaacaattatggatttacatcctggatcaggtaaaactagaaaatatctccctgcgatagtaagggaggccataaagagaagactacgaacattaatacttgcgccaacaagagtagtggcagcagagatggaagaggctcttaaaggcttgcctattagatatcaaacgacagcaacaaaaagcgaacatacgggcagggaaatagtcgatttgatgtgccatgcaaccttcacaatgagattattatcacccgtgagagttccgaactacaatcttataataatggatgaagcacatttcacagacccagcgtcaattgccgcacgaggttacatatcaacaagagtgggcatgggcgaggcagcagcgattttcatgacggcgacaccacctggtacagctgacgcattccctcaatcgaatgctccaatacaagacgaggagagagatataccagaaagatcttggaactccggtaacgaatggatcaccgactttgctggaaaaaccgtgtggtttgtaccttcaataaaagcaggaaatgacatagcgaattgtcttcgaaagaacggcaagaaagtgattcaattatccagaaagacttttgatactgaataccagaaaacaaaactcaacgactgggatttcgtcgtaacaacggacatatcagagatgggtgctaatttcaaggcggacagggtgattgatccgaggagatgtcttaaaccagtaatactaacggatggaccagaacgtgtcatcctagccggccctatgcctgttacagccgcgagtgcagcccagcggcgcggaagagtcggaaggaaccctcagaaagaaaacgatcagtacatatttactggtcaaccactaaataatgatgaagatcacgcccactggacagaggcgaaaatgcttttagataatataaacacgccggagggaataattccggcattatttgagccggaacgtgagaaaagtgcagcaattgatggagaataccgattaaaaggagaatcaagaaaaacatttgtagaactcatgaggcgaggtgacctaccagtatggttggctcataaagtagcaagcgaagggattaaatacacggatcgcaagtggtgtttcgatggacagcgcaacaatcagatccttgaagaaaacatggacgtagaaatttggacaaaggaaggtgagaaaaagaaactcagacccagatggttagacgctaggacttatagcgatccacttgcgctaaaagaatttaaagactttgcagcaggaaggaaaagtatagctcttgatttagttacagaaataggcagagtaccatcccacttagcacatagaacaaggaacgcactagataatctcgtaatgttgcatacctccgaacatggcggaaaggcttacagacatgcagtagaagaactacctgaaactatggaaacattactactattaggtcttatgattttgttaacagggggtgcaatgctctttctcatatcaggaaaaggaattggtaaaacaagtataggcctaatttgcgtaatagcgagcagcggaatgctttggatggcagaaattcccctacaatggatagcatccgctatcgtgctggaatttttcatgatggtcctactcattccggagccagaaaaacaaagaacacctcaagataaccagctagcttacgtagtaattggtatattaacactagcagctataattgcagctaacgagatgggccttctagaaacaaccaaaagagatttaggtatgagtaaggaaccaggagtagtctcacccacctcgtacttagacgtagaccttcatccagctagcgcatggacactatatgcagtagctaccaccgtaataactcctatgttaaggcatacgatcgagaactccactgcgaatgtcagccttgcagcaattgcaaaccaagccgtagtgctaatgggattagataaaggatggccaatctctaagatggatttgggagtcccgctcttggcgctgggatgttacagtcaagtaaatccgttgacattgaccgctgcagtgctactgctcataacccactacgcaataataggcccgggactgcaagctaaagcaactcgcgaagctcaaaaacgaacagcagctggaataatgaagaatcctacagtcgatggaataatgacgatagatttagaccctgtaatctacgactcaaaattcgaaaaacagttaggacaggttatgctgttagtactttgcgcagtgcaactactattaatgcgtacctcctgggccctatgtgaagcattgacgttagctacaggaccaattacaacactgtgggaagggagtccagggaaattttggaacactaccatagcggtcagcatggcaaacatcttccggggttcctatttagcaggcgccgggctggcattctcgatcatgaaatccgttggaacaggaaaacgcggaacaggctctcagggagaaacactgggagagaaatggaagaagaaattgaaccaactgtctcgaaaagaatttgacctatacaagaaatcaggtataacggaagtagataggacagaagccaaagagggattgaaaaggggtgagatcactcatcatgccgttagtagaggcagcgcgaagctgcaatggttcgtcgagcgaaatatggttattccagaaggtcgcgtaatagacttaggctgtggtaggggcggctggagttattactgcgcaggtttaaagaaagtaactgaagtccgtggatacactaaagggggaccaggccacgaagaaccagtaccaatgagtacctacgggtggaatatagtaaaattaatgagcggaaaagatgttttctatctgccgccagaaaaatgcgatactctactatgcgatatcggagaatctagtccctcaccaacggttgaggaatcaagaacgattagggtcctaaaaatggtggaaccatggttgaaaaacaatcaattttgcattaaggtattaaatccttatatgccgacagtcatagaacaccttgaaagactccaaagaaaacatggaggcatgcttgtaagaaatcctcttagcagaaattctacccacgaaatgtactggatatctaacggtaccgggaacatcgtggcgagcgtaaacatggtatcaagactcctacttaatagattcacaatgactcatcgtcgtccaacgatcgaaaaagatgtagaccttggtgccggaacgcgacacgtaaatgcagaacctgaaacacctaatatggatgtgattggtgaaaggattaaaagaatcaaggaagaacataatagtacttggcattatgacgatgaaaacccatataaaacttgggcctatcatggatcatatgaagtcaaggcaacaggttcagcgagctcaatgattaacggagtggttaaattacttaccaaaccatgggacgtggttcctatggttactcagatggcaatgacagatactacaccctttggacagcaaagagtattcaaggaaaaagtagatacaagaacacctaggtctatgcccggaacaagacgagtcatgggaattacggcagagtggctatggaggacactaggccgaaacaaaaagccgcgtttatgcacaagggaagagttcactaagaaagtaaggacaaacgccgcaatgggagctgttttcacggaagaaaatcaatgggacagcgccaaggccgctgtagaagacgaagacttttggaaattagtggacagagagagagaactacacaagctcggaaagtgtggaagttgtgtctataatatgatgggaaaacgagagaagaaattgggagagtttggtaaagcaaaaggatcgagagcgatttggtacatgtggttaggagcgcgatacctagaatttgaggctttaggatttttgaatgaggaccattggttctcaagggaaaatagctattcgggcgtagaaggagaaggattgcataaattgggttacatattacgagacatttccaaaataccaggcggagcaatgtacgcagatgatacggctggctgggatactcgcataactgaagacgatctacacaatgaggagaaaataacccaacaaatggaccctgaacacagacaactcgccaatgcgatatttaagttgacgtaccaaaacaaagtagtaaaggttcagcgaccaacccccacaggtactgtgatggacatcatatcgagaaaggaccaacgcggatcagggcaggttggaacatacggtttaaacacattcacaaatatggaggcgcagttaatacgtcaaatggaaggtgaaggtgttctctcgaaagccgatctggaaaatccacatcttcctgagaagaaaataactcaatggttagagacaaagggggtagagagactaaaaaggatggctattagtggagatgattgtgttgttaaacccatagatgataggttcgctaatgcgctgctagctttaaacgacatgggtaaggtgagaaaagacatacctcaatggcagccgagtaaaggttggcacgactggcagcaagtaccattttgcagccatcacttccatgaattaattatgaaagatgggagaaaactcgtggtaccatgcagaccacaagacgaattaattggaagggctcgtatatcacaaggcgcaggatggagcctaagagaaactgcatgtttaggcaaagcatatgcccaaatgtggagcctgatgtactttcacagacgtgatctaagacttgcgtcaaatgccatatgttccgccgtcccggtacattgggtccctacttcgcggacaacatggtcaatacacgcgcatcatcaatggatgacaactgaagatatgttaacagtatggaaccgagtatggatagaagacaatccgtggatggaggataaaacccctgtcacaacgtgggaaaacgtaccttatctcggtaaacgagaagatcaatggtgcggatccttgataggactcacaagtagagctacatgggctcaaaatatccctactgccatacaacaggtaagatcactgataggaaatgaagagttcctggactatatgccatcaatgaagaggtttagaaaggaagaggaatccgaaggcgccatatggtaa

SEQ ID NO: 23299 - RNA, 9873 nt, synthetic construct
  misc_feature 1..9873: note = derived and/or modified CDS sequence (opt6) from DENV-3__EU482563__SS-prME
  source 1..9873: mol_type = other RNA
acttccttatgtctaatgatgatactaccagcagccttggcgttccatttaacgagcagggatggtgaaccacgaatgattgtgggtaaaaatgaaaggggaaaaagtttactattcaaaacagccagtggaataaatatgtgcacgttaatcgctatggatctaggagaaatgtgtgatgatacggttacgtataaatgtccccacatcgcggaagttgaacctgaagatatagactgctggtgcaatttgacaagtacatgggtaacatacggtacttgtaatcaagccggagaacacaggagggacaaacgtagtgtagctcttgctccacatgtgggaatgggtctagacacaagaacacaaacatggatgagcgcagaaggagcatggcgtcaggtagaaaaagtagaaacgtgggcgttaaggcatcccgggttcactattttagctctatttcttgcgcattatattggtacaagcctcacccaaaaagtagttatatttgtcctacttatgttagtgacaccgtcgatgacaatgaggtgcgtgggggtagggaaccgcgacttcgtagaaggtttatcaggcgcaacctgggttgacgtggtactggaacatggtggatgtgtcactacaatggccaaaaataaacctacattagatatagaacttcagaaaaccgaagcaacacaactagctacgttacggaaactatgtatagaaggtaaaatcaccaatatcacaacagactcaaggtgcccaacccaaggggaagctgttctgccagaagaacaggaccaaaactacgtctgtaaacacacttatgtagaccgtgggtggggaaacggctgtggtcttttcggaaaaggcagcttagtaacctgtgcaaaatttcaatgtctcgaaccaattgaaggaaaagtagtacagtatgaaaacctcaaatacactgtcattataactgtacatactggggatcaacaccaagtaggcaacgaaactcaaggagtcacggctgagattacacctcaggcaagcactactgaagcaatattacccgagtacggaacgttaggattagaatgttccccacggacaggtctagattttaacgagatgatattattaacaatgaaaaacaaggcttggatggtccatagacaatggttcttcgacttacctctcccttggacatcaggcgctacgacagaaacaccgacgtggaaccgtaaagaattattagtaacatttaaaaacgcgcacgcgaaaaagcaagaagttgtagtgctaggtagccaggaaggcgctatgcacaccgctcttactggagccacagaaattcaaaattcgggagggacctctatatttgccggtcacttgaaatgccgtttgaagatggataagctagagctaaaagggatgagctatgcgatgtgtacaaatacgttcgtgctaaagaaagaagtatccgaaacccaacatggaacaatcctcataaaagtcgagtataagggagaagatgctccctgtaaaataccattttctaccgaagatggacagggaaaagcgcataacgggaggctaattaccgcgaaccctgttgtaacgaaaaaggaagaaccagtaaacattgaggcagaacctccttttggagagtcgaatatcgtaataggcataggagacaatgcgttgaaaataaattggtacaagaaaggttcgtctatcggaaaaatgttcgaagctacagccagaggagcccgtcgtatggctatcctaggggatactgcttgggattttggaagtgtgggaggggttttgaatagcctgggaaagatggtacaccaaatattcggcagcgcttacacagcattattttcaggtgtcagttgggtaatgaagataggtataggagttttactaacctggatcggccttaatagtaaaaacacatccatgtcatttagttgcatagcgataggaataataactttatatttgggagcggtcgtacaagccgatacagggtgcgtaataaattggaaaggcaaagaactcaaatgtggttctggtatattcgtcactaatgaagtccatacatggaccgaacagtacaaatttcaagccgatagtccgaaacgtttggccacagctatcgcgggagcttgggaaaacggcgtatgcggaataaggagcacaacacgaatggaaaacctgctctggaaacaagtagcaaatgaattaaattatatactgtgggaaaataatataaaacttacggtagtagtgggtgatataataggagtattagagcaaggaaaaagaacactgactccccaaccgatggaactaaagtattcatggaaaacatggggaaaagcaaaaatagttacggccgaaacacaaaatagctcctttataatcgatgggcctaatacacctgaatgcccatcggcgagtcgagcatggaatgtgtgggaagttgaagactatgggtttggtgtatttacaacgaatatatggttaaaactgagagaagtctatactcaattatgcgaccatagattgatgagtgcggctgttaaagacgaacgggctgtacatgccgacatgggatattggatagaatctcagaaaaacggatcatggaaacttgaaaaggccagccttatagaggtaaaaacttgtacatggcctaaaagtcatactctatggagtaatggtgtacttgagtcggatatgatcataccaaagagcttagccggtccgatcagccaacacaactatagaccaggttatcatacacaaacggccggcccatggcatctaggcaagttggaacttgacttcaattattgtgaaggaaccacggtcgttattacggaaaactgcggaacccgtggtccatcgctacgtactacaacggttagcggcaaactgattcatgaatggtgctgtaggagctgcaccctgccaccgctaagatatatgggagaagatggttgctggtatggtatggagatacgccctattagtgagaaagaggaaaatatggtaaagagcttagtgagtgcaggtagtggtaaagtagacaactttacaatgggtgtcctgtgcttagcgatactattcgaggaggtcatgcgcggaaaattcggcaagaaacacatgatagccggagtatttttcacatttgttttactattaagcggccaaatcacatggcgggatatggctcacactcttattatgataggatccaacgcgtcagacaggatgggaatgggagtaacttatctggcactaatcgccacctttaaaatccaacctttcctcgccctcggatttttcttgaggaagctaacttcaagagaaaatctattgctgggtgtgggcctagcgatggcaacaacattacaattacccgaggacatagaacagatggccaatggaatcgctttaggtctaatggcgctcaaattaataacacaatttgaaacatatcaattatggaccgcactaatcagcttaacctgtagcaatacaatatttacactaacagttgcatggaggactgcgacactaatactagcaggagtttcattgcttccagtgtgtcaaagttcatcaatgagaaaatccgattggttacccatgactgtagcagcaatgggcgtacccccattacccttatttatcttctcactaaaggacacactaaaacgaagatcctggccactaaacgagggggtaatggcggtgggcctagtgtccatactagcctcatctttattaagaaacgatgtgcccatggccggtcctctagtcgcaggagggttattaatagcttgttatgtcattaccggaacaagcgctgatctgacagtagaaaaggctgctgatgttacctgggaagaagaagcagaacagacaggagtatcccacaatttaatgattactgttgatgacgacggcacaatgcgaataaaagatgacgagacggagaatatcctaactgttttattaaaaacagcattattaatagtctcgggtatcttcccctacagtattcctgccaccctattggtatggcatacctggcaaaaacaaacaagaagatctggggtattatgggacgtcccatcaccaccagaaacacaaaaggcagaacttgaagagggagtctatagaataaagcaacaaggtatattcggaaaaacacaagttggagtcggtgtccaaaaagagggagtgttccatactatgtggcatgtaacaagaggagcagtactgacatacaacggtaaaaggctggaaccaaactgggcgagtgttaagaaagacttaatttcatatggcggcggctggagactaagtgcccaatggcaaaaaggagaagaggttcaagtaatcgcagtagagcctggcaaaaatcccaaaaattttcaaacaatgccagggactttccaaacaacaacaggcgaaataggcgcaatcgctttggactttaaaccaggaacatccggatctccaatcattaaccgagaaggtaaagtggtaggcttatatgggaatggagttgtaaccaaaaatggtggctacgtatcaggaattgcacaaacaaacgcagaaccggacggcccaacaccagaattagaagaagaaatgtttaagaaacgaaacctcacaattatggatctacatccaggaagcggtaaaacgcgaaaatatctgcctgcaatagtacgggaagccataaaaaggagactacggacccttattctagcaccaacgcgagtagttgcggcagaaatggaggaagctctcaaaggacttccaatcaggtatcaaacaactgctacaaagagcgagcacacagggagagaaatagtcgacttaatgtgtcatgcaacattcacaatgcgactcctcagtcctgtacgggtaccaaactataatcttattataatggacgaggcccattttacagatcccgcttcgatagctgcaagaggttatatatcaactagagtcggtatgggagaggccgcggcaatcttcatgacagccacgcccccaggaacagcggacgcatttccacaaagtaacgctccaattcaggatgaggaaagggacatacctgaacgtagttggaactcaggaaatgaatggattacagactttgcaggcaagacggtatggtttgtaccgagtattaaggctggcaatgacatcgcaaactgtctgaggaaaaatgggaagaaagtaatccaactctccagaaagactttcgacaccgagtatcagaaaacgaagctgaatgattgggactttgttgtcacaaccgatattagcgaaatgggtgctaattttaaggcagacagagtcattgacccacgaagatgtttgaaaccagtgatattgactgacggacccgaaagggttattctagcagggcccatgcccgtgacagcggcttctgctgcacagcgccgcggtcgggtagggcggaaccctcaaaaagaaaatgatcaatatatatttacgggtcagcctctgaacaatgacgaagaccacgcccattggactgaagcaaaaatgttactagataacattaacacacctgaaggaataattcccgcactcttcgaaccagaacgagagaaaagcgcagcaatagacggggaatacagactgaaaggagagagccgaaaaacttttgttgaattaatgcggcggggagatctgccggtttggctggcacataaggtggcaagtgaggggataaaatatacggatagaaagtggtgttttgacggtcaaagaaataatcagattttggaggagaatatggatgtagaaatatggactaaggaaggcgagaagaagaaactgcgaccacgatggctagatgcccgtacatacagtgatcccttagctttaaaagagtttaaagatttcgctgcaggtcgtaaatccattgctttagatttagtcacggagattgggcgggtcccctctcacctagctcatcgtacaagaaatgcgttggataatctggtgatgctccatacttcagaacatgggggaaaggcttatagacatgctgtagaagaattgccagaaacgatggaaacgttacttttgctgggacttatgatacttttaacaggaggtgcaatgctctttcttatttctggaaaaggaattggtaaaacgagtataggactcatatgcgtaatcgcaagttctggtatgttgtggatggcagaaattccccttcagtggattgcaagtgcaatagttttagagttctttatgatggtattgctgattccagaacccgaaaaacaacgaacaccgcaggataatcaattggcatatgttgtaattggtatcctcacactagcggcaataatagcggcaaacgagatgggtttactagagacaacaaaacgtgacttaggaatgagtaaagaacccggtgttgtctctccgacgtcttatctggacgtagaccttcatcccgcttctgcgtggacgttatatgcagtagctacaacggttataacgcctatgctccgccataccatagaaaactcgaccgcgaatgtaagtctggctgcaatagcaaaccaggccgtagtattaatgggtttagataagggctggccaattagtaaaatggacctaggagttccccttttagctctagggtgttactcacaagttaacccactaacattaacagccgctgtattacttctgataacgcattatgcaataatagggcccggattacaagcaaaggctaccagggaggcacaaaagcgcacagcagctggtataatgaagaatccaaccgttgacggcattatgactattgatcttgacccagttatatacgattccaagtttgaaaagcaacttgggcaagttatgttgctagtactatgtgctgtgcaactgctgttaatgaggacaagctgggcactttgtgaggctttaacattagcaactgggccaataaccaccttatgggaaggatcacccggcaagttttggaacacgaccatagccgtaagcatggccaacatcttccgcggttcgtacttggccggagctggactagcgtttagtataatgaaatcggtgggaacgggaaaaaggggtacagggagtcagggagaaacattaggagagaaatggaagaagaaattgaatcaattatccagaaaggaatttgatctatataagaaaagcggtattacagaagtcgacagaacagaagcaaaggagggattgaagagaggagaaataacgcaccatgcagtgagcaggggcagtgccaagttacaatggttcgtagaaagaaatatggttattccggaaggccgcgttatagatttgggatgcgggagaggaggttggagctactactgtgccggattaaagaaagtcacggaagtccgtggatatacaaaaggaggaccagggcatgaagaaccagtgccaatgagtacatatggctggaatattgtcaaacttatgagcggcaaagacgtattttacctaccacctgaaaaatgtgatacacttttatgtgatataggagaaagctcaccctccccaacagttgaggagagtagaacgatacgggtcttaaaaatggtagaaccttggctcaaaaataaccaattctgcataaaagttctaaatccctacatgccaacagtaatagagcacttagaaagactacagcgtaagcatggtggaatgctagtacggaacccactctctagaaattcaacacatgagatgtattggataagcaatggtactggtaacatagttgcttcagtaaatatggtctcaagactattgctgaaccgatttacgatgacccataggagaccgacaatagaaaaagatgttgaccttggagcagggactcgacatgtgaacgcggaaccagagacaccaaatatggatgtgattggagaaagaataaaacgtattaaggaagaacataacagtacttggcactatgacgatgaaaatccatataaaacttgggcctaccacggatcatacgaggtaaaagcaacgggatcggcctcatctatgattaacggggtagtaaaactgctcacaaaaccgtgggacgtggttcctatggtaacacaaatggcaatgaccgacacgaccccttttgggcaacaaagggtatttaaagaaaaagtagacacacgtacacctcgaagtatgccaggaacacggcgcgtaatgggcataactgcggaatggttatggcggacattgggtcgcaacaagaaaccgcgactatgtacgcgtgaagaatttaccaagaaagtccggacaaatgcagcgatgggggcagtttttacggaagagaatcagtgggattccgccaaggcagcagtggaagatgaagatttctggaagctagtagatagagaaagagagctgcataaacttgggaaatgtggaagctgcgtttataacatgatgggcaaaagagagaagaaattgggggagtttgggaaggcaaaggggtcaagggctatctggtacatgtggttaggagcaagatatttagaatttgaagcactagggtttctgaatgaagatcactggttttcccgggagaatagttattccggagtggagggagaaggattgcacaaattaggttatatactccgagacatatcgaagatacctggtggagcaatgtatgccgacgatactgcaggttgggacacaaggatcactgaagacgacctgcataacgaagagaaaataacacaacagatggatccagaacatcgacagcttgcaaacgcaatatttaaattgacataccagaataaggtagtaaaggttcagagacctacaccaactggaacagtaatggacattatctcgaggaaggaccagagagggagcgggcaggttggcacttacggattgaacacttttacaaacatggaagcgcaattaattcgacaaatggaaggcgagggggtgttaaccaaagcggaccttgaaaatccgcacttatccgagaagaaaatcactcaatggttggaaacgaaaggggtcgaaagattaaagagaatggcaataagcggagatgattgcgttgtaaagccaattgacgataggttcgcaaatgcattattggcgctcaacgatatggggaaggtcaggaaagatataccacaatggcaaccctctaaaggttggcacgattggcaacaggtccctttttgttctcatcactttcatgaactaatcatgaaggatggaaggaaactggttgtaccgtgtcgtcctcaggacgaactaataggtcgtgctcggatttctcagggggcaggttggtcattaagagaaacggcctgcttaggcaaggcctatgcgcagatgtggtctctaatgtattttcatcgacgggatttaagattagcaagtaacgctatttgtagcgctgtccctgtgcattgggtgcccacctctaggacaacttggagtatccacgcacaccaccaatggatgacaaccgaagacatgcttacagtgtggaatagagtatggatagaagataacccgtggatggaagacaaaacacctgtaacaacctgggagaatgtcccctatttgggaaagcgtgaagatcaatggtgcggaagtctcataggactcaccagtagagcaacatgggctcaaaatattccaacagcaattcagcaagtgagatcattgataggaaatgaagagttcctggattacatgccaagtatgaaaaggtttaggaaagaagaggaaagcgaaggcgcaatatggtaa

SEQ ID NO: 23300 - RNA, 9873 nt, synthetic construct
  misc_feature 1..9873: note = derived and/or modified CDS sequence (opt6) from DENV-3__EU529696__SS-prME
  source 1..9873: mol_type = other RNA
acaagtttatgtctaatgatgatactgccagccgcgctagcttttcacctcactagcagagatggggaaccccgtatgatcgtagggaaaaatgaaagaggaaaatcactattgttcaaaactgcaagtggaatcaatatgtgtacacttatcgctatggatctaggggaaatgtgcgatgatacggtcacgtacaaatgtccgcatattacagaagttgaaccggaagacatcgattgttggtgtaacttaacaagtacatgggtaacgtatggcacgtgtaaccaggctggggaacataggcgagacaaacggagtgtggcactggcaccacacgtgggtatggggttagacacacgtacgcaaacatggatgagtgcggaaggagcctggagacaagtggaaaaagttgaaacatgggcgcttaggcatccaggtttcacaatactagcactatttttagctcactatatagggacatccctaacacaaaaagtcgttattttcatattactaatgctagtcacgcctagtatgaccatgagatgtgttggtgtcggcaaccgagatttcgtagaaggactgagcggagctacatgggtggacgttgtcctagaacatggtgggtgcgttacaaccatggccaaaaacaaacctacactggatatcgagctccagaaaactgaagctactcaactagcaactctcaggaaactgtgcatcgaaggcaaaataacgaatatcacaacagacagcagatgtcctacacaaggggaagctgtactgccggaggaacaagaccaaaattatgtatgtaaacacacatacgtggatcgtggatggggtaacggttgtggtttgttcggaaaaggaagcctagttacatgcgcaaaattccaatgcctagaacccattgagggtaaagtagtccaatacgagaacttaaaatatacagttatcataacagtacataccggagaccaacatcaagtcggcaatgaaacacaaggagttacagctgagattactcctcaggctagtaccacagaggctatactccccgaatatggaacgctggggctagaatgttctcctagaactggtttggatttcaacgagatgattttactaacaatgaaaaataaggcttggatggtgcatcgacaatggttctttgacctaccgcttccatggacctctggagcaacaacagaaactcccacttggaacaggaaagaattattagtaacattcaaaaatgcacatgcaaagaagcaggaggtcgtcgtattaggcagtcaagaaggagcaatgcatacagccttgacgggcgccacagaaattcaaaacagtggaggaacatcaatttttgcgggacatcttaaatgtagactcaaaatggataaactggaactgaagggtatgagctacgctatgtgtacaaatacttttgtcctgaaaaaggaagtatctgaaactcaacatggtacaattctaataaaagtagaatataagggtgaagacgcaccatgcaagatccctttctctacagaagatggacaaggaaaggcccataacggccgactaattacggcaaatcccgtcgtaacaaagaaagaagaacccgtcaatatcgaagcagaacctccctttggagaaagcaacatcgtaattggcattggtgacaatgccctaaaaataaattggtacaaaaagggtagttccataggcaaaatgtttgaggcgacagcccgaggagcaaggaggatggcaatattaggagatactgcatgggatttcggaagtgttggtggcgtactaaattcactgggaaaaatggtacaccaaatcttcggcagcgcctacacagcacttttcagtggtgtctcttgggtaatgaaaattggaataggagttttattaacttggataggactgaatagtaaaaacacgtcaatgtccttttcttgcatagcgatcggtgtgatcaccctttacctaggtgcagttgtgcaggcagacatgggttgtgtgataaattggaaaggaaaagaacttaaatgtggatctggaattttcgttactaacgaagtccatacctggacagagcaatacaagtttcaagcggacagccctaagcgactagcaacagctatagcaggagcttgggaaaatggcgtatgcgggatacgaagtactactagaatggaaaatttactctggaaacaaattgccaacgaactaaactatatcctatgggaaaataatattaagctaaccgtagtggtcggagatataataggagtattggaacaaggcaaaagaacgttgaccccacaacccatggaattaaagtatagttggaaaacatggggtaaagcaaaaatagtcacagctgaaatacaaaactcttcctttataatagatggacccaatacgcctgaatgtccatctgcgagtagagcgtggaacgtatgggaagttgaggactacggatttggcgtattcactacgaatatatggctaaaacttagggaagtctatactcaattgtgcgatcatagactaatgagtgctgcagtaaaagatgagagagcggtgcatgcagatatgggatattggatcgagtcacagaaaaatgggagctggaagttagaaaaggcttcccttatcgaagtgaaaacgtgcacttggcctaaaagccatactctttggagtaatggtgtcctagaatcagatatgataattcctaaatcactagcaggccctattagtcaacataattatcgcccaggatatcatactcagacagccggaccatggcacctcggaaaacttgacttagatttcaattattgcgaaggaaccaccgttgttatcactgagaactgtggcactaggggaccgagtcttcgcaccacaacggtctcgggaaaattgatccatgagtggtgttgcagatcttgcacccttccaccgcttagatacatgggagaagacgggtgctggtacggaatggaaatacgccctatcagtgaaaaagaggaaaatatggtaaaatccttagtcagtgccggaagtggaaaagtagataactttactatgggtgtcttgtgcttagctattttgtttgaagaagtaatgcgaggaaaatttggtaagaaacacatgatagcaggggtctttttcacatttgttttattattaagcggtcaaattacatggagagatatggcccatacactaatcatgattggatcgaacgcatcagacaagatgggtatgggtgtgacatacttagcgttaatagcaacatttaaaatacaaccctttcttgcgcttggatttttcttacgaaaactaacctctagagaaaacttgctattaggagtaggattggccatggcgacgactctacaattaccagaagacatcgaacaaatggccaatggaatcgcacttggcttaatggcactgaaattaataacgcaatttgaaacataccaattatggacggccctaatctccttaacctgctccaacacaatgttcacattaacagtggcatggaggaccgcaacactcatcctagccggggtctccttgctccctgtgtgccaaagttcttcgatgagaaagacagattggcttccaatggccgttgccgctatgggagttcctcccctgcctttatttatattttcccttaaggataccttaaaaagacggtcgtggccactcaatgaaggagtcatggcagtaggcttagtgagtatcctggccagctcacttcttcgcaacgacgttccgatggcaggaccattagtagcaggaggtttactcattgcctgttatgtaatcacgggtacatcagcagacctcacggttgaaaaagccgctgatataacctgggaagaagaggcagaacagactggtgtgagccacaatttaatgattaccgtggacgatgacgggacgatgcgtataaaagatgatgaaactgaaaatatacttacagttctgttaaaaaccgcactcttaatagtatcgggagtttttccttatagtatacctgcaaccctattggtatggcatacctggcagaaacaaacacaaagatccggcgtattatgggatgttccgtcacctccggaaacccaaaaggcggagttagaagaaggagtgtacaggataaaacaacaaggaatttttgggaaaactcaagtaggagtaggagtacagaaggaaggtgtttttcacaccatgtggcacgtaacgaggggcgctgtactaacttacaatggcaaaaggctcgaacctaactgggcctccgtcaagaaagacttaatcagttatggtggaggctggcgcctttcggcgcaatggcagaaaggggaagaagtccaggtaatagccgtagaacctggcaagaatccaaagaactttcagactatgccaggaaccttccagacaaccacaggcgaaataggtgcaatagcactagattttaaaccaggtacatcaggatccccaataataaatcgagaaggcaaagtcgttggattatatggaaacggggttgttaccaaaaatggcggatatgtgagtggtatagcacaaacaaacgcagaaccagacggacccacaccagaactagaagaagaaatgtttaagaaacgtaacctcacaattatggatcttcatcccggaagcggcaaaacgaggaagtacctacccgcagtagtacgtgaagcaattaaacgacgactcaggacgctgatcttagcacccacaagagtagtagcagcggagatggaagaagctctaaaaggacttcctataagatatcaaacaacagctactaaatcagaacataccggcagagaaatagtagacttaatgtgtcacgctacattcacgatgagactattaagtccagtccgggttcctaattataatctgattataatggacgaagcccacttcacggatccagcatctattgctgccagaggatatatttcaacaagggtgggaatgggcgaagcagctgctatttttatgactgctacaccacccggcactgcagacgcttttccacaatccaatgcacctatccaagacgaagaaagggacatcccagagagatcatggaactcagggaacgagtggataacagatttcgctggtaaaacagtatggttcgtccctagtattaaagcaggcaacgatattgcaaattgtctaaggaaaaatggcaagaaagtcattcagctgtcaagaaagactttcgacacagagtatcagaaaacgaaattaaatgattgggacttcgttgtcacaactgatatttcagaaatgggtgcaaattttaaagcggacagagtcatcgacccaagaaggtgcttaaaaccagtcatcttaacagatggcccagaaagggttatccttgcaggaccaatgcccgtaaccgcggccagcgctgcacaacgacggggaagagtaggtagaaatccacaaaaggaaaacgatcagtacatattcactggacaacctttaaataatgatgaagatcacgcccactggactgaagctaaaatgctacttgataacatcaacacaccagagggaattataccagctttatttgagccagaaagagaaaagtccgccgctatcgatggagaatataggctaaaaggagaaagccgtaagaccttcgttgaacttatgcgcagaggtgacctgccagtttggctagcacacaaggtggcgtcagaaggaataaaatataccgaccgaaaatggtgcttcgacggccaaagaaataaccaaatacttgaagaaaatatggatgtggaaatctggaccaaagaaggcgaaaagaagaaacttcgcccacgctggttggatgcacgaacgtatagcgatccccttgctttaaaggagtttaaagattttgcagctggacgaaagtcaattgccttggatttagtaactgaaattggccgtgtaccaagtcacctagcacaccgaacaagaaacgccttagacaatctcgtgatgctgcatacaagtgagcatgggggccgagcgtatagacacgctgttgaagaactacccgaaactatggaaactctattacttctaggactgatgatacttttaacaggcggagctatgctctttttaatctcaggaaaaggaataggcaaaacgagcatcggtctgatctgtgtcattgcaagctcggggatgttatggatggctgagataccattacaatggatagcatcagcaattgtactggaatttttcatgatggtccttctcatccccgagccagaaaaacagcgtactcctcaagacaatcaattggcttatgtggtcataggaattttaacgctcgctgccattatagcagcaaatgagatgggattgttagaaactacgaaaagagatttaggtatgtctaaggaaccaggcgtagtgtcccctacaagctacttagatgtagacctgcatcccgcctctgcctggaccctatacgcggtagcaacgacggtaattacacccatgctaagacacactatagagaacagtactgcaaatgtcagcttagcggcaatagcaaatcaagcagttgtattgatgggattagataaaggttggccgatttctaagatggatttgggagtaccacttcttgcactaggttgctattcacaagtgaacccgttaacgttaacagctgcagttttattattgatcacacactatgcaataataggtcctggccttcaggcaaaagcaacacgagaagcccaaaagagaacggcagctggtataatgaaaaacccaacggtggatggaatcatgacgatagatttggacccggtgatatacgattctaaattcgaaaaacaactagggcaagtaatgctattggtactttgcgcagtacaactacttttaatgagaacctcatgggcgttatgtgaggcgctaacactagctacggggcccataactacattgtgggaagggtctccaggaaaattctggaacacaacaatagcggtttcgatggcaaacatctttagaggatcttatctagctggagctgggttagcttttagcataatgaaaagcgtcggaacagggaaacgaggaactggcagccagggggaaacactaggcgaaaaatggaagaagaaattaaaccaactatctcgcaaagagttcgatttatataagaaaagtggaatcactgaagtagataggacagaggctaaagaagggctcaaaaggggagaaaccactcatcacgctgtatcgcgtggaacagcaaaactacagtggttcgtcgaaagaaatatggtaataccagaaggaagagtgattgatttaggttgcggacgaggaggttggtcatactactgtgcgggtcttaaaaaggtcacagaggttagaggatacactaaagggggtcctgggcatgaagaacctgttccaatgtcaacttatggctggaatatagtaaaattgatgtccggtaaagacgtattttaccttcctccagaaaaatgtgacacgcttttgtgcgatattggagaatcaagtccatctccaaccgtcgaggagtcacgaaccattagagttttaaagatggtcgaaccatggctgaaaaataaccaattttgcataaaagttctaaatccgtatatgcccaccgttatagaacacctagagcgactacaaagaaaacacggaggtatgttggtcaggaatccattatcacgaaattcaacacatgaaatgtactggatcagcaacggaacaggcaatattgtagccagtgtaaatatggtatcaagacttctactcaacagattcacaatgacacatcggaggcctactatagagaaggacgtcgaccttggtgcaggaactagacatgttaatgcagaacccgaaactccgaacatggacgtcataggagaacgtattaaaagaataaaggaggagcataactccacctggcattacgatgacgaaaatccatataaaacgtgggcctatcatggctcttacgaagttaaagcaactgggagcgcatcaagtatgataaatggagtagtaaaactcttaactaaaccatgggacgtcgtcccaatggtaacccaaatggccatgacggataccacaccattcggtcaacagagggtgtttaaagagaaagtagatacaagaacacctagaagtatgccaggcacacgaagggtgatgggaataacagcagaatggttatggcggaccctagggagaaataagaaaccccggttatgcacaagggaagaatttactaaaaaggttaggaccaacgctgcgatgggagccgtatttactgaggagaatcaatgggactccgcaaaagcagcagttgaagatgaagatttctggaaacttgtagatcgtgaacgtgaactgcacaagttgggaaaatgtggttcttgtgtttacaacatgatgggcaaaagggaaaagaaattaggcgagttcgggaaagctaaaggtagcagggctatatggtatatgtggttaggcgcccgttacttggagtttgaggcgctaggctttctaaatgaagatcattggttttctcgtgagaactcatactccggagttgaaggcgaaggacttcataaactggggtatatattacgtgatataagtaaaatacctggaggggctatgtatgcagacgacacagcaggatgggatacccgcataacagaagacgatctgcataatgaagagaaaataactcagcaaatggatccggaacacaggcaactagccaatgcaatctttaaactgacatatcagaataaagtggttaaagttcagcggcccacaccaacgggaacagtaatggacatcataagcagaaaagatcaaagaggtagcgggcaagtgggcacctacggacttaataccttcacgaatatggaagctcagctaattagacaaatggagggtgaaggagttctcagcaaagcggatctggaaaacccgcacttgcctgaaaagaagattacccagtggttagaaacaaaaggcgtagaaagactaaggagaatggcgatatctggtgatgattgcgtagtaaaacctatcgacgatagattcgccaatgcactgcttgctctgaacgacatgggcaaagtaagaaaagacataccacaatggcaaccctcgaagggctggcacgattggcaacaagtaccgttctgtagtcatcattttcatgaattaataatgaaggacggcagaaaattagtcgtgccatgtcggccacaggacgaactaatcggaagggcaagaatctcccagggtgctggttggagcctaagagaaacagcctgtttaggcaaagcatatgcccaaatgtggagtctaatgtattttcatagaagggacttaagattagctagcaacgcaatctgctccgccgtcccggtacactgggtcccaacgtcccgtacaacatggagcattcacgcacaccatcaatggatgacaacagaagacatgctcactgtatggaacagggtttggatagaagataacccttggatggaggataagaccccagttactacgtgggaaaatgtaccttatctcggcaaacgggaagatcaatggtgtggcagcttaatcggattaacaagtagagctacatgggcgcagaatataccaacggcaatacaacaggtgaggtccctaataggaaatgaagaatttctagactatatgcccagtatgaaacgtttcagaaaagaagaggaatccgagggagcaatctggtag

SEQ ID NO: 23301 - RNA, 9873 nt, synthetic construct
  misc_feature 1..9873: note = derived and/or modified CDS sequence (opt6) from DENV-3__EU529697__SS-prME
  source 1..9873: mol_type = other RNA
actagcctatgtttaatgatgattttgcctgctgcgcttgcatttcatctcacaagtcgtgacggagaaccaagaatgattgtaggcaaaaatgaacgtggaaaatcattgttattcaaaaccgcaagtgggataaacatgtgtacgctgattgcgatggatttaggagaaatgtgcgacgatactgttacatacaaatgcccccatatagcggaagtggagccggaagacattgattgctggtgtaatctaacttcaacgtgggtgacttatgggacttgcaatcaagctggtgaacacaggcgtgataaaagatctgtagctttagcacctcacgtaggtatgggattggatacccgtacgcaaacatggatgtcagcagaaggagcttggagacaagtggagaaagtggaaacatgggcattgagacatcctggctttactattctggccctctttctggcacactatataggaacttctctaacgcaaaaagttgtcattttcgtcctgttaatgctagtaactccatctatgaccatgagatgtgtaggggtaggaaacagggactttgtggaaggtctctcaggggcaacttgggttgacgtagtcttggaacatggaggctgtgttactaccatggccaaaaataaacctaccctagatattgaacttcagaaaactgaagcaacacaattagcaacccttagaaaactctgtatagagggaaaaatcacaaatatcactacggattcccgatgcccaacacaaggcgaagcggcgttgccggaagaacaagaccaaaattacgtttgtaaacacacttatgttgatagaggatggggaaatggatgtggactattcggaaaaggaagcctagtcacttgtgcaaaattccaatgtttggagcccatagaaggcaaagtggtacaatatgaaaatttaaaatacaccgtaataattactgtacatacaggggatcaacatcaagtaggcaacgaaacacaaggagtaactgccgaaataactccacaggcttcgacaacggaagcaattctccctgaatacggaacgctaggactcgaatgtagtccaagaacgggactagactttaatgaaatgatactgttaaccatgaaaaataaagcatggatggtacatagacaatggtttttcgatcttccactgccatggacttcaggtgcaactactgaaacgcccacatggaacagaaaagaattgctcgtaacatttaaaaatgcgcatgccaagaaacaagaagtggttgtactcgggtcccaagaaggagctatgcatacagcactaactggtgctaccgaaatccaaaactctgggggaacaagtatattcgcaggacacttaaaatgtcgcttaaaaatggataaactcgagctgaaaggaatgagctacgcaatgtgtacaaatacttttgttctgaagaaagaagtatcagaaacgcagcatggcacgattttaataaaagtagaatataaaggggaggacgccccctgtaaaattccattcagcacagaggatggccaaggaaaagcccataacggaagactaattactgcgaatcctgtggtcactaagaaagaggaaccagttaacatagaggcggaaccgccattcggagagtcaaacattgtaatagggatcggtgacaacgcactaaaaatcaattggtacaagaaaggaagctcaatcggaaaaatgtttgaggccactgcaagaggagcaaggcgaatggcgatcctcggggatactgcatgggattttgggtcagtcggcggggttttgaacagtctgggaaaaatggtacatcagatcttcggtagtgcttacactgcattgtttagcggcgttagctgggtaatgaaaattggtattggagtcttactcacatggataggtttaaatagtaaaaacacaagcatgtcattcagctgtatagcaatcggtattattactctgtatttaggcgcagtagtacaggctgataccggatgtgtgataaattggaaaggcaaagaacttaaatgtggatcaggaatctttgtcacaaatgaagtacatacatggacagaacagtataaatttcaagcggacagcccgaaaagactagcgactgctatagcaggagcctgggaaaatggagtctgtggcattagaagcacaacgcgcatggaaaatctattatggaaacaagttgcgaacgaacttaactatatattatgggaaaacaatataaaactcactgtcgtcgtcggtgatataatcggcgtacttgagcagggaaaaagaacgcttacaccccaacccatggaactaaaatactcttggaaaacatgggggaaagcaaaaattgtcacagcagagactcaaaacagttctttcataattgacggaccgaacacaccagaatgcccatctgcttcaagagcatggaacgtgtgggaggtggaagattatggctttggtgtgttcacaacaaacatatggttaaaacttcgtgaagtctatacacaactatgtgatcaccgactaatgtcggcagcggtaaaagacgaacgagcagttcacgctgacatgggttattggatcgagtcgcagaaaaatgggagctggaaacttgaaaaagctagccttatcgaagttaaaacttgcacatggccaaaatcacatacactgtggagcaacggagtccttgagagcgatatgattattcccaaatcattagctggacccataagtcaacacaattatcgaccaggataccatactcagacggcaggtccttggcacttaggcaaattggagttagattttaattattgcgaaggtacaacagtggtcataacagaaaactgcggaacaagaggaccatcgctacggaccacgacggtcagcggcaaactgatacatgaatggtgctgcaggtcatgtacattgccaccattacgatatatgggcgaagatggatgctggtatgggatggaaattcgaccgatttctgaaaaggaagaaaatatggttaaaagcctcgtgagcgcagggtcgggtaaagttgacaattttacaatgggtgtattatgcttagctatattatttgaagaggtgatgagaggaaagtttggcaagaaacatatgatagctggggtgttctttaccttcgtgttattgctgtctggccaaattacctggcgagatatggcacatactttgataatgattggatctaacgcatctgataggatgggaatgggcgttacgcatttggcattaattgctacgtttaaaatacaaccatttttagcactaggtttcttcttacgaaagctgacgagtagagagaacctgttgctcggcgtgggactcgcaatggcaacaaccctccagctaccagaagacatagaacagatggcaaatggaatagcacttggcctaatggcattaaagctaatcacgcaattcgaaacgtatcagttatggaccgctctcatctcattgacatgctcgaacacaatctttaccctaacggtagcttggcggactgctactttaatactagcaggagtttcgctcctgcccgtgtgccagtcgtcttcgatgcggaaaagcgactggcttccgatgacggtggctgcaatgggtgttcccccattaccactgtttatattttcacttaaagatacgttaaagagaagaagttggccgcttaatgaaggagtaatggcagtaggattggtgagtatcctggcttcttcattacttcgaaacgatgtcccaatggccggaccattggtggccggaggcttactaatagcctgttatgttataacagggacaagtgctgatctaacggtcgaaaaagcagcggacgtcacttgggaggaagaagcagaacaaacaggtgtgagtcacaacctaatgataactgttgatgacgatggcacaatgagaattaaagacgatgagaccgaaaacattttaacagtattgttaaaaacagcgctactaattgtgagcgggatttttccttatagcataccagcaacactattagtatggcatacctggcaaaaacaaactcgaagaagtggcgtactatgggatgttcctagcccacctgaaacccagaaagccgaactagaagagggagtctacagaatcaaacagcaagggatatttggcaaaacacaagtaggagtcggcgtgcagaaagagggagtatttcataccatgtggcatgttactagaggagcagtactaacatataatggaaaaagattagaaccaaattgggccagtgtcaagaaagatttgataagctacggagggggatggaggctgagtgctcagtggcaaaaaggggaagaagtacaagtaatcgcagtggaaccgggcaaaaaccccaaaaattttcaaactatgcctggtacctttcaaacgactacgggagagataggtgcaattgccttggacttcaaacccggtacgagtggttctcctataatcaacagagagggaaaagtagtcggactatatggaaatggtgtcgtaactaaaaatggaggatatgtttccggaatagcgcaaacaaacgcagaacccgatggtccgacgccggagttagaagaagagatgtttaaaaagagaaatctaaccattatggatctccatccagggtctggtaaaacaagaaaatatctaccagcaatagtaagggaagcaatcaagcgtagattgagaacactcatactagcgcctacgagagtagttgccgctgaaatggaagaagctctaaaagggttacccataagatatcaaacaacggcgacgaagtccgagcacacaggtagagaaatcgtcgatctaatgtgtcacgcaacctttacaatgcgtttacttagtcccgtccgggtaccaaattacaaccttataattatggatgaggcgcactttacagacccggcttcaatagctgctagaggatatataagtactagagttggaatgggagaagcagcagcgatctttatgactgcaacgccaccaggaacggcggatgctttcccccagtctaatgccccgatacaagatgaagaacgagacattccagaacgatcctggaactccggcaatgaatggatcactgatttcgcaggaaagactgtgtggtttgtaccttcaattaaagcaggaaacgacatcgcaaactgtctaaggaaaaatggtaaaaaggtgatacagttaagcagaaagacattcgacaccgaatatcagaaaacgaaattaaacgattgggattttgtagtaacgacagacatttctgaaatgggagccaactttaaagctgatagagtaatagatccaagaagatgtctaaaacccgtgatacttacagatgggccagaaagggtaatactagccggaccaatgccagttaccgcagcctccgccgcgcaacgacgtggcagggttggccgtaatcctcaaaaggaaaacgatcagtacatttttacgggtcagcctttgaacaatgatgaagatcatgctcactggacagaagccaaaatgctgcttgacaatatcaatacaccagagggaattattcccgctctcttcgaaccagaaagggagaaaagcgcagcaatagacggagagtatcgtctgaagggagaaagtcgcaagacgttcgtagaactcatgaggagaggtgaccttcccgtctggcttgcacacaaggttgccagtgaggggataaaatacactgacaggaagtggtgtttcgatggccaaaggaataatcaaatacttgaagaaaatatggatgtggaaatttggacgaaagagggggaaaagaagaagctacgaccaagatggcttgatgcgagaacatattccgatcctctagccctaaaagaatttaaagacttcgccgcaggaagaaaaagtatcgcacttgacctcgtaactgagatcggaagggttccttcgcatctagcgcatcgaacacggaatgcgctagataacttagttatgcttcatacaagtgaacacgggggtaaggcttatagacatgctgtagaagaactacctgagaccatggaaacactattactcttaggactaatgattctcctaacaggaggtgccatgttatttttaatatctggtaaaggcatagggaaaacctctatagggctgatttgtgtcattgcatcaagcggcatgttatggatggcagagataccgttacagtggatcgctagtgccatagtgcttgagttctttatgatggtgttactgatcccagaaccagaaaaacaaaggacacctcaagataatcaactagcatatgtggttataggaatattaacacttgcggcaataattgcagcgaatgaaatgggtctactagaaactacaaagagagacctaggcatgagtaaagagcctggggtcgtaagtcctacaagctatctagatgtagacctacacccggcttcagcatggaccctatatgctgtagcgacgacggtaataacgcccatgttaagacacaccatcgaaaacagtacagcaaatgtatcattagccgctattgcaaatcaagccgtagtgttaatgggacttaataaaggatggccaatctcgaagatggatttaggagttcctctattagcgctagggtgctattcacaagtaaatcccctaaccttaactgccgccgtgttactactaattacacactatgcaatcataggaccaggattacaagctaaagcaactagagaagcgcaaaaacgaacagctgcagggataatgaaaaatccaacagtggatggaataatgaccatagacctagatccagtaatttatgactcaaaatttgaaaaacaattaggacaagtaatgttattagtattatgtgcagttcaattgcttttaatgaggacatcctgggccctgtgtgaagcattaacccttgcaaccggaccaataacaactttatgggaaggctccccaggcaagttttggaacactactatagcagtgtcgatggcaaatatttttcgaggaagctacctggctggagctggtctagcattttcgattatgaaatcggttggaacgggcaagagaggtacaggatcgcaaggggaaacattgggagagaaatggaagaagaaactaaatcaattatctcgaaaagagtttgatttatataagaaaagtggaataacagaggtggaccgtactgaggccaaggagggcctgaaaagaggcgagatcacacatcatgcagtatcaagaggttcagcaaaattacaatggtttgtagaacgaaatatggtgattccagaaggacgcgtgatagacttaggttgtggcagaggcggttggagttactactgtgcgggactgaagaaagtaacagaagtaagggggtacacaaagggtggtccgggacatgaggaacccgtcccgatgtcgacctacggttggaacatagtaaaattgatgtccggtaaagacgttttctacttgcctcccgagaaatgcgacacattgttatgtgatataggggaatcgagtccgtccccaacggtggaggaatctcgcactataagggttctaaaaatggtagagccgtggctcaaaaataatcaattttgcataaaagtactaaatccctatatgcctacagtcatagaacatctagaacgtttacagcgtaagcacggtggaatgttagtaagaaaccctctttctagaaatagtactcatgaaatgtactggatatctaacggaacaggtaatatcgttgcaagtgtcaatatggtatctcgcctattgctaaatcggtttacaatgactcatcgcagaccaactatcgagaaggacgtcgacctaggcgccggaactcgacacgtaaatgcagaaccagaaactccaaatatggatgtaattggagaaagaatcaaacgaataaaagaggaacataactctacatggcactatgatgatgaaaatccgtataaaacatgggcctaccacgggagctacgaggtaaaagcgacgggtagcgcttcaagtatgataaatggtgttgtcaaactgttgactaaaccatgggatgtagtaccaatggtaacccaaatggcaatgactgatacaacaccttttggacagcaaagagtttttaaagagaaggtcgacaccaggacgccgagaagcatgcccggcacgagaagagtcatgggcataactgcagaatggctttggcgcacgctaggaagaaacaaaaagccaagattgtgcacgcgtgaagaatttactaagaaagtgagaaccaatgcagccatgggtgcggtgttcacagaagagaatcaatgggatagcgctaaggccgccgttgaggacgaagatttctggaaattggttgatagagaaagggaattacataaactaggaaaatgcggtagctgcgtgtacaatatgatgggaaagcgcgagaagaaactgggagagttcggcaaagccaaaggtagcagagccatatggtatatgtggcttggcgcacgatacctagaatttgaggctttgggctttttaaatgaagatcattggtttagcagagaaaattcttatagtggtgttgaaggagaaggattacataaactaggatacatcttacgtgatataagcaagatacctggcggagcaatgtatgcggacgacacggctggatgggatacaagaataactgaagacgatcttcataatgaggagaaaattacacaacagatggacccagaacacagacaattagccaacgctatatttaaactaacctatcaaaacaaggtcgtaaaggtgcaaagaccgacacccacggggacagttatggacattataagtagaaaggaccaacgaggcagtgggcaagtcggaacatatgggttaaatacattcacaaatatggaagcccagctaatacgacaaatggaaggtgaaggagttcttactaaggcggatcttgaaaatccacatctgagtgagaagaaaattacacagtggcttgaaactaaaggcgttgaacgactgaagcgaatggctataagcggagatgattgtgtggttaaacccatcgacgatagatttgcaaatgcactactagctttgaatgacatgggaaaagtcagaaaagacattccacagtggcaaccatctaaaggatggcatgattggcaacaagtacctttttgttcacaccatttccacgaactaataatgaaagatggacgtaaattagtagttccctgcagaccccaagatgaacttattgggcgagcaagaatctcgcaaggagccggttggtctctaagagaaacagcatgcttgggcaaagcgtatgcacaaatgtggtcactaatgtatttccatagaagagatttaaggttagcaagcaacgcaatttgttctgcggttccggttcactgggtaccaacatccaggacaacttggagtatacatgcacaccaccagtggatgactacggaggacatgcttactgtttggaatagagtctggattgaagataatccctggatggaagataaaactccagtcacaacttgggaaaacgttccttacctgggtaagagagaggatcagtggtgtggttcattgataggattaacttctcgggcaacttgggcccaaaatatacctacagcaatccaacaagtacgcagcctcattgggaacgaagaatttctcgattatatgccatcaatgaaaagatttagaaaagaggaagagtcagagggagcaatatggtag

SEQ ID NO: 23302 - RNA, 9873 nt, synthetic construct
  misc_feature 1..9873: note = derived and/or modified CDS sequence (opt6) from DENV-3__EU482564__SS-prME
  source 1..9873: mol_type = other RNA
acctcattatgtctaatgatgattctaccggctgcattggcatttcatctgacttcacgcgatggagaaccacgcatgattgttgggaaaaacgaacgcggaaaatctttgctttttaaaactgcctccgggattaacatgtgcactttgatagcaatggatctaggagaaatgtgcgacgatactgtaacgtataaatgtccacacattacagaagtagaacctgaagatattgactgctggtgtaaccttaccagcacctgggtgacttatggcacatgtaatcaagcaggcgaacatcgtcgagataaacgttcagtcgctttagcaccacatgtagggatggggctcgatactagaactcagacatggatgagtgcagagggcgcctggcgacaagtagaaaaagttgaaacatgggctctaagacaccctggctttacaatactagcacttttcctggcacattacattggaacatcacttactcaaaaagtggtaattttcatactactaatgttggtaaccccttctatgacaatgagatgcgtaggagtaggaaatagggacttcgtggaaggattgtctggtgccacctgggtcgacgtcgttctcgaacatgggggctgtgtgaccactatggccaaaaataaaccaacattggatatagagttacagaaaacggaggccacgcaactagctacactacgaaaattgtgcatagaaggaaaaataacaaatattacaaccgacagccggtgtcctacccaaggcgaagcagttttaccggaagaacaagatcaaaattatgtttgtaaacacacctatgtagatcgaggttggggaaatggttgtgggttattcggtaaagggagtttggtcacatgtgccaaatttcagtgtttagaacctattgaaggaaaagtagttcaatacgaaaatttaaaatatacggtgattattacagtacacactggagatcaacaccaggtaggcaatgagacacaaggtgttacagcagaaataaccccacaagcgtccacaactgaggctattttacccgaatatggtacgctaggcttggaatgctccccaagaacagggctagattttaatgaaatgattttactaacaatgaaaaataaagcatggatggtacatagacaatggttcttcgacctcccattaccatggacctcaggagctacaaccgagacgccgacatggaacaggaaagaactattggtcaccttcaaaaacgctcatgctaagaaacaagaagtggtggtactaggatcccaagaaggtgctatgcacactgctctaactggggccaccgagattcaaaacagtggagggactagcatttttgcaggtcatcttaaatgtcgcctcaaaatggataaactggaactaaaaggaatgagttatgccatgtgtactaacacctttgtattaaagaaagaggtatcagaaacccaacacggaacgatattaataaaagtcgaatataaaggagaagatgcaccctgcaaaatccctttcagtaccgaagacggacagggcaaggcgcataatggaagattaattacggcaaatcccgttgttactaagaaagaggaacctgttaacatcgaggccgaaccaccctttggggaaagcaatatcgtaataggtatcggcgacaatgcattaaaaataaactggtataagaaaggttcaagtattggaaaaatgtttgaagccacggctagaggcgctcgcagaatggctatcttaggagacaccgcctgggactttggatccgtgggcggagtcttgaatagtttaggtaaaatggtccatcaaatcttcgggagcgcgtatacagctctattcagtggtgttagttgggttatgaaaataggcataggggtcctcctaacttggatcggtctcaatagtaaaaacaccagtatgtctttctcttgcatagctataggtgtcataaccctatatctgggtgcagttgtgcaagcagacatgggatgcgtgatcaactggaaagggaaagaactaaaatgcggaagtggtatatttgtcacaaacgaggtacatacttggactgaacaatataaatttcaggccgattctccaaagaggttagctacggctatagctggtgcttgggaaaacggcgtgtgtggaattaggtcaaccactaggatggaaaatttgttgtggaagcaaatagccaatgaattaaattatatcttatgggaaaataacataaaactaactgtggttgtcggagatattataggtgttttagaacaaggcaaaaggacattaacaccacaacccatggagctgaagtattcatggaaaacttggggaaaagcgaaaattgtgactgcagaaatccaaaatagcagtttcataatagacggtcctaatactccagaatgcccatcggcctcaagagcctggaacgtatgggaggtagaggactatggttttggagtatttaccacaaatatctggttgaaattacgtgaggtatatacacaactgtgtgatcacaggttaatgagcgcagcagttaaagacgaaagagcagtacatgcagatatgggatattggatcgaaagccagaaaaatggatcttggaaattagagaaagcctccttaatagaggttaaaacttgcacatggccaaaaagtcatacactatggtcaaatggagttcttgagagcgatatgattataccgaagagtttggcaggtccaatctctcaacacaattaccgaccaggataccacactcaaactgcaggtccatggcacttaggtaaactcgacctcgactttaattattgtgaaggaacgacagtagtcattactgaaaactgtggaaccaggcgacccagcttgcgcactacaactgtatctgggaaactaatacatgaatggtgttgccggagttgcactctacctcccttacgatatatgggcgaagacggatgttggtatggaatggaaatccgaccaatttcagagaaagaagagaacatggtgaaaagtctcgtaagtgcaggtagtggaaaagtggataattttaccatgggtgtcttatgtttggccattttattcgaagaagttatgagagggaaatttggcaagaagcacatgatcgcaggagtattctttacctttgtacttctattatcgggacaaattacttggcgcgatatggcgcacacactcataatgataggcagtaatgcatccgataaaatgggaatgggcgtaacatatctcgcgctcatagcaacattcaaaatacaaccatttcttgctctaggattctttttgcgtaaacttacaagtcgagaaaacttattattgggtgttggtttagctatggcaacaacccttcaacttccagaagatatagagcaaatggctaacggaatcgcgttagggctaatggcattaaaactaattacacaattcgaaacttaccagttatggaccgccctaatcagcttgacctgctctaatacaatgttcacattaacagtggcgtggaggaccgcaaccctcatactagcgggggtttccttacttccggtatgtcaaagttctagcatgaggaaaacagattggctcccaatggctgtagcagcaatgggagtcccgccattgccgctattcattttctcacttaaagacacgcttaaacgcagaagttggccattaaacgaaggggtgatggcagtgggacttgtatcaatacttgctagctccttgttacgaaacgatgttccgatggcaggtccattagtggccggtggactattgatcgcatgttacgttataactggtacatctgcagatctaaccgtagagaaagcagctgacatcacctgggaagaagaggcggagcaaacaggcgtttcacataatctaatgataacagtagatgatgatggtaccatgcgtattaaagatgacgaaacggaaaacatcttaacggtactattaaaaaccgcattacttatagtatcaggcgtctttccttattctataccagccacattattggtgtggcacacttggcaaaaacagacacaacgctcaggggttttatgggacgtgccctcgcctcctgagacacagaaagctgagttggaagagggcgtttatcgtatcaaacaacaagggatcttcgggaaaacccaagtgggtgttggggttcaaaaagaaggggtatttcatacgatgtggcatgtgaccaggggcgccgtactaacctataacggtaaacgccttgagcctaattgggcgagcgtcaagaaagaccttatttcctatggaggagggtggaggcttagcgcacaatggcaaaagggcgaggaagtacaggtaatagccgtagaaccaggcaaaaaccctaaaaatttccaaacaatgcctggcacctttcagacaactacaggtgagataggggctatcgcacttgacttcaagcctggaacatctgggtcccctattataaatagagaaggaaaagttgtggggttatatgggaacggagtagttactaaaaatgggggttatgtgtcaggaatagcacagacaaacgcggagccagacggacctacaccagagttggaagaagaaatgttcaagaaacgaaatttaaccataatggatctacaccctggaagtggaaaaactcgaaaatatctgccagcagtagtgcgagaagctataaaaagacgtctgagaacactaatcctagcacctacaagagttgtggcagcggaaatggaagaagcgcttaaaggtcttcccataagataccagacgacagcaacgaagagtgaacatacaggtagagagatagtcgatctgatgtgtcatgccacatttaccatgcggctcttgtcaccagtcagggttccaaactacaatctaattataatggacgaagcgcattttactgatccggcttctatcgccgcacgaggatacatatctactagagtagggatgggtgaagctgccgcgatattcatgacggcaacaccccctggaacggctgacgcgtttccccaatcaaatgcaccaatacaagatgaagaacgtgatattccagaacggtcttggaactcaggaaacgagtggataactgattttgcgggcaaaacggtgtggttcgtaccttcaataaaagcgggaaatgatatcgcaaattgtctacggaaaaacggcaagaaagtaattcaattatcaaggaaaacttttgatactgagtatcagaaaacaaagctcaacgattgggattttgttgtcacaacagatatatctgagatgggagcgaactttaaagcagatagggtaattgacccccgacgttgtttaaagcctgttatcttgacggacgggcccgagagagtcatattagcaggacccatgcccgtaaccgcagcttccgcagcacaaagaaggggtcgagtaggaagaaacccccagaaagagaatgatcaatatatcttcaccggacaaccattaaacaatgatgaagaccatgctcattggacggaggcaaaaatgctgttagataacataaacacccccgaaggaattattcccgctctgtttgaacctgaaagagaaaaatcagcagctattgacggagagtaccgattaaagggtgagagtcgcaaaacttttgttgaacttatgcgtagaggagatcttccagtttggcttgctcataaggtggcgtctgaaggtataaaatatacagatagaaaatggtgttttgatggtcaacgcaacaaccagattttagaagaaaacatggatgtagaaatatggacgaaggaaggcgagaagaagaaacttcgtcctcgatggttagatgcacgcacctattcagatcccctcgccttgaaagaatttaaagatttcgcagcaggaagaaaatcaatagctctggacttagtaaccgaaataggccgagtgccctcacacttagcacatcggactcgcaacgctctggataaccttgtaatgctacatacatctgagcatggaggtcgggcctataggcatgctgttgaagaactcccagaaacaatggaaacgcttctgcttctaggattaatgatcctgttaaccggcggagcaatgttattcctcataagtggcaaagggattggaaaaacctctataggtttgatatgtgttatcgcatcaagcggaatgctctggatggccgaaatccccttgcaatggatagcttctgctatagtattggaatttttcatgatggtgttattaatacctgagccagaaaaacaacgaacacctcaagataatcaactcgcttatgtagttattggaatacttacacttgcggcgataatagcagcgaatgaaatgggcctactagagacgacgaaacgtgacttagggatgtcgaaggaacccggagttgtcagcccaacttcctatctagatgtcgatctccaccctgcgtcagcatggacattatatgctgtcgcaactactgtaattacacctatgttgagacacacaatcgagaactccacagcaaacgttagtttagccgcaatcgcaaaccaggcggtagtgcttatggggttagataaaggatggcctatctcaaaaatggacttaggtgtacctctactcgcacttggatgttattcacaagttaatccactaactttaaccgctgctgtattattattgataactcattacgccataataggcccaggattgcaggcaaaagctacgagagaagcacagaaaaggacagccgccggtataatgaaaaacccaacagtagatgggataatgactatagacttagacccagtcatctatgattctaaatttgaaaaacagttaggccaagtaatgctcctcgttctctgcgctgttcaactactgttaatgagaacaagttgggctctgtgcgaagcgttaactctcgcgacaggaccaataaccaccttatgggaggggtccccagggaaattctggaatactacgatagcagtctcaatggctaacatattccgaggttcatatcttgccggcgctggtctagccttctctatcatgaaatccgtcggtacaggaaagaggggtacaggctcacaaggggagacgctcggcgaaaaatggaagaagaaacttaatcaacttagtagaaaagaatttgacttatataagaaaagcggaataacggaagtggatagaactgaggcaaaagaaggacttaaaagaggcgaaactacacatcacgcggtcagtagggggactgcaaaactacaatggttcgtggaacgaaatatggtaatacccgaaggtagggttatagatctagggtgtgggcgcggaggctggagctattattgcgctggtctcaagaaagtgactgaagtccgaggatacactaaagggggtcctgggcatgaggaaccggtaccgatgagcacgtacggttggaatatcgttaaacttatgtcaggaaaagatgtcttctacttaccaccagaaaaatgcgatacactcctatgtgatattggggaaagtagccccagccccactgtagaagaatcaaggacgatacgtgtattaaaaatggttgagccttggctcaaaaataatcagttttgcattaaggtattaaatccgtacatgccaactgtcatagaacatttagaacgactacagagaaaacacggaggaatgctagtacggaatcctctttcacgaaacagcacacacgaaatgtattggatatcaaacggaacaggaaatatcgtcgcctcagtgaacatggtttcgagactactacttaatcgcttcaccatgactcaccgtagacctactatagaaaaagacgtggatttaggggcaggtacacgtcacgttaatgcagaaccagaaactccaaacatggatgtaattggtgaaagaataaaaagaataaaggaagaacataattctacatggcactacgacgatgaaaatccctataagacatgggcataccatggctcttatgaggtcaaagctacaggttcagcatcaagtatgataaatggagttgtcaaattacttaccaagccttgggatgtcgtaccaatggtaacccagatggcaatgacagacaccactcccttcggccaacagagagtgttcaaggaaaaggttgatacgagaacccctagatccatgcctggtacaaggagagttatggggattaccgcagaatggctttggcgaactttaggacggaataagaaaccgagactctgtactagagaagagtttactaagaaagtacgaactaatgcagcaatgggcgcggtttttaccgaagaaaatcaatgggatagtgcaaaagcagcagtggaagatgaggatttttggaaattggtagatagggaacgagagttacataaattaggaaaatgcgggtcatgcgtgtataacatgatggggaaaagagagaagaaacttggagagttcggtaaagctaaaggatctagagccatatggtatatgtggttgggagcaagatatttagaatttgaagcacttggatttttaaatgaggatcattggtttagtcgcgagaatagctatagtggagttgaaggtgaaggccttcataaactgggttatatacttagagatatttctaaaatcccagggggagctatgtatgcggacgatacagcaggttgggatacgaggataacagaagacgacctgcacaatgaagagaaaattactcagcagatggatccagaacacagacaactagctaatgctatatttaaactgacttatcagaacaaagttgtgaaggtgcaacggcctacaccaacaggcactgttatggacattataagcaggaaagaccagagaggtagtggacaagtagggacatacggactaaacacttttacaaacatggaagcacagctaataaggcagatggaaggagagggtgtgttaagtaaagcggatttggaaaacccgcacctacccgaaaagaaaattacacaatggttagagacaaaaggagtggaaagacttcgtagaatggcaatctctggtgatgactgtgttgtgaaacctattgacgaccgcttcgcaaacgccctactagccttaaacgatatggggaaagtaaggaaggacatcccacaatggcaaccatcaaaaggatggcatgactggcaacaggttcccttctgttcccatcatttccatgaattaataatgaaagatggtagaaagctagtagtcccatgtagaccgcaagacgaacttattggtcgtgcaagaatatctcaaggggcagggtggtcattaagagagacggcatgtcttggtaaagcatatgcgcaaatgtggtcattaatgtattttcataggcgagatttgagattggcttcgaatgcaatctgctcagctgtcccagtgcattgggttccaacatcaagaacgacctggtcaattcatgcacaccatcagtggatgacgacagaggacatgctcactgtctggaacagggtgtggattgaggataacccatggatggaggataaaacgccagtaaccacttgggaaaatgtgccatatcttggaaagagggaagaccaatggtgcggtagcctaattggattaacaagtcgtgccacatgggcacaaaatattcctaccgccattcaacaagtaagaagtttaataggaaatgaggaatttttagattatatgccgtcaatgaagcgattcaggaaagaagaggaaagtgaaggcgcaatctggtga

SEQ ID NO: 23303 - RNA, 9873 nt, synthetic construct
  misc_feature 1..9873: note = derived and/or modified CDS sequence (opt6) from DENV-3__EU529699__SS-prME
  source 1..9873: mol_type = other RNA
acctcactgtgcttgatgatgatactgccagccgctctagcttttcatcttacttcaagagatggcgaaccacgtatgattgtaggtaaaaatgaaaggggcaaatccctgttattcaaaacagcaagcggcatcaacatgtgcacactcattgcgatggatttaggggaaatgtgcgacgacacagttacatataaatgcccccatataactgaagttgaaccggaagacatcgattgctggtgtaacttaacaagcacatgggtgacatacgggacctgtaatcaagccggagaacataggcgagataaaaggtctgtcgcgttggctcctcatgtcgggatggggcttgacacacgaacccaaacgtggatgagtgcggaaggagcatggagacaagtcgaaaaagtagaaacatgggcacttcgacaccctggatttacaattttggccttgttcttagcgcattatataggaacttcacttacgcaaaaagtagtcatatttatactcttaatgttagtcacaccgtcaatgaccatgcgctgtgttggcgtaggaaatagggacttcgtagaaggtctgtcgggtgcaacatgggtcgacgtagtcctcgaacacggaggttgcgtaactactatggcgaaaaataaaccaacattggacattgaactccagaaaactgaagcgacccaacttgctactctgagaaaactatgtatcgaaggaaaaatcacgaatatcactacagatagtcggtgccctactcaaggagaagcagttctgcctgaagaacaagaccaaaattacgtatgcaaacatacatatgtggatcgaggatggggtaacgggtgtggcttattcggtaaagggagtttggtaacttgtgctaaatttcaatgtcttgaacctatagaaggtaaagtagtgcaatatgagaatctgaaatataccgttataattactgttcacacgggagaccaacaccaagtgggaaatgagacacaaggtgtaactgctgaaattactccacaggcatctactacggaagcaatcctaccagagtatggtacattgggattagagtgtagccccagaacaggtttagactttaacgaaatgatactattaaccatgaaaaacaaagcctggatggtccatcgtcaatggtttttcgatctacctttgccatggacgtccggcgctaccacagaaacgcccacttggaacaggaaagaattattagttacttttaagaatgctcatgccaaaaagcaagaagtagtcgtacttgggtcacaagagggagctatgcatacagctctcacgggggcgacagaaatacaaaactccggcggaacatctatttttgcaggacatttgaaatgccgtctaaaaatggataaattagagctaaaaggtatgtcttacgctatgtgtacgaatacttttgtcctaaagaaagaagtgtccgaaacccaacatggtacaattcttataaaagtagaatacaaaggagaagacgtcccatgtaaaatcccattttcaaccgaggatggtcagggaaaagcgcacaacggaagattgattacagcaaatccagttgttacgaagaaagaagaaccagtaaacatagaggcagaacctccatttggtgagagtaacatcgttatcggaattggagataatgccttgaaaataaactggtataagaaagggtcaagcatagggaaaatgtttgaagctacggcgagaggagctagaagaatggctattctaggagataccgcgtgggattttggttccgttggaggagtattaaatagcctcggaaaaatggttcaccagattttcggatctgcatataccgcgctattctcgggtgtatcatgggtgatgaaaattggaataggggtactcttgacgtggattggcctaaatagtaaaaacacctcaatgtctttctcatgtatagccatcggaataattacgttatatcttggagcggtggtgcaagcggatatggggtgcgtaataaactggaaaggaaaagaacttaaatgtggctcaggaatttttgttacaaatgaagtgcatacgtggaccgaacagtataaattccaagcagatagcccaaaacgtttggctactgcaattgccggagcctgggaaaacggcgtatgtggaatacgcagtacaacccgaatggaaaatctcctttggaaacagattgccaacgaactaaattacatcctatgggaaaataacataaaactaactgtagtagtaggagatactataggggtgctagagcaaggaaaaagaacactcactccacaaccgatggaactgaagtattcatggaaaacctgggggaaagcaaaaattgtaacagctgaaacgcaaaacagctctttcataattgatggaccgaacactccagagtgcccaagtgcatctagagcttggaatgtatgggaagtagaagactatggtttcggagtctttacaacaaacatttggttaaaactacgggaagtatatactcaattatgcgatcatcgattaatgagcgcagccgtaaaagacgaacgcgcagtacatgctgatatgggttactggattgagagccaaaagaatgggagttggaaactagagaaagcgagcctaatagaagtaaagacatgcacatggcctaaatcgcacaccctatggagcaatggggtattagagtcagacatgataataccaaaatcactcgcgggccccataagccaacataattacagaccaggataccacacacaaacagcgggtccttggcatttaggaaaactagaacttgattttaattattgtgagggaactactgtagttatcacagaaaactgcggaactcggggcccaagtctaagaacgacaacagtatcaggaaaattaatacacgaatggtgctgccgttcctgcacgttacctcccttaagatacatgggagaagatggatgttggtatgggatggaaataagaccggtgtccgaaaaggaagaaaacatggtcaaaagtctggtgtctgcgggaagcggaaaggtagataactttacaatgggggtactctgtctagctattttattcgaagaggtaatgagagggaaatttgggaagaaacatatgatcgcaggagtattctttacatttgttttattactgagcggccaaataacctggcgtgatatggctcacacgcttatcatgatcggttcaaatgcatctgaccgtatggggatgggtgtaacttatctagctttgatagctacctttaaaatacaaccattcttagccttaggatttttcctaagaaaactgacaagccgtgaaaatctcctattaggagtggggttagctatggccacgacccttcaactaccagaagacatagaacaaatggcgaatggtatcgctttaggtttaatggcattaaagctaattactcaattcgaaacctatcaattgtggaccgcgctaatttccctgacatgtagcaatactatcttcacattaacggttgcctggcgtacagctactctcatactagctggagtctcattattaccagtttgccaaagtagctcaatgaggaaaactgactggctaccaatgacagtggcagcaatgggagtacctccattacctttgttcatttttagtctcaaagacacactaaaacgtcgaagttggcctttaaatgaaggagtcatggcagtagggttggtaagcattcttgccagttctttacttagaaatgacgtacccatggctggccctttggtagcaggaggactcttaatagcatgctatgtcattacaggcacctctgctgatctaacagtggaaaaagcggccgacgtaacctgggaagaagaagctgaacaaacaggggtctcccataaccttatgattactgtggacgatgatggaactatgagaattaaagacgacgaaacagaaaatattctaaccgtactgttaaaaactgctctcctaattgtaagtggaattttcccgtacagcattccagctactttattagtatggcatacatggcaaaaacagactcaaaggtcaggagtcttatgggatgtcccatctcccccggaaactcaaaaggccgaactggaggaaggtgtatatagaataaaacaacaaggaatatttggcaaaactcaagttggtgtaggtgtacaaaaggaaggtgtcttccatacaatgtggcatgtgacgaggggcgcagtactaacatataatgggaagcgtcttgaacccaattgggccagtgttaaaaaggacctaatatcatatggtggtggatggcgattaagcgcacaatggcaaaaaggtgaagaagtacaagttatcgcagtagaaccaggaaagaacccgaaaaacttccaaacaatgccgggaacttttcaaacgactacaggggaaattggagcaattgcactagatttcaaacctggaacaagtggttccccaataatcaatcgggaaggaaaagtcgtcggtctctacggaaatggagtagttacgaaaaatggtggatacgtctcgggtatcgctcaaacaaacgctgaacccgatgggccaacgcctgagttagaggaggaaatgttcaaaaagcgaaatctaaccataatggacctacatcctggatcaggcaaaacaagaaaatatttaccagcgattgtcagggaggctataaaaagaagactccgtactttaatattagcgccaacccgggtagtagcagccgaaatggaagaagcgttgaaaggattaccaattcggtatcaaacgacggctacaaaaagtgaacatacgggtagagaaatagtagatttaatgtgccacgcaacatttacgatgcgacttctaagccctgtccgagtaccgaactataatttgattatcatggatgaagcacatttcactgaccctgcctcgattgcagccagaggttacatatcaacgagagtcggcatgggtgaagcggcagccatattcatgacagccacaccaccggggacggctgatgcgtttccacaatcaaatgctcccattcaagatgaagaaagggacattcctgaacgctcgtggaactccgggaatgaatggataacagattttgctggaaaaaccgtatggttcgtacccagcattaaggcaggtaatgatatagcaaattgccttcgcaaaaacggcaagaaagtaattcaattaagccgtaaaacttttgataccgaatatcagaaaaccaaactcaacgattgggactttgttgtaacaacagatatctcggaaatgggcgcgaatttcaaggctgatcgggttattgatcccagaaggtgtttaaaacccgtcatcttaaccgatggtccagaacgggtcatacttgctggccctatgccagttaccgcagcgagtgcggcacaacgacgggggagagtaggcaggaatcctcagaaggaaaacgaccagtatatatttacaggtcaaccgcttaacaatgatgaagaccacgcacactggacagaagcgaaaatgctactcgacaatatcaatacccccgaagggattattccagcactattcgaaccagaaagagagaaaagtgcagcgatagacggtgagtatagattaaagggtgagagccgaaaaacatttgttgagttaatgcgacgtggagatctaccagtctggttagcgcacaaagtggcctcagaaggtataaagtataccgacagaaagtggtgctttgatggccaaagaaataaccaaattctagaagaaaatatggatgttgaaatatggactaaagaaggagagaagaagaaactacggccgaggtggctcgatgcacgaacctattcagaccccctagctttgaaagaatttaaggacttcgcagcggggaggaaatcaatagccctagacctagtcacagaaattggacgtgtacctagccatttggctcatagaactcgcaatgcgttagacaacttggtaatgttacatacttcagagcatgggggaaaggcttatcgacatgctgttgaagaattaccagaaacgatggaaaccttattgttgttaggattgatgatacttttaaccggaggagccatgttatttctgatttccggtaagggaattggaaaaacctcaatcggtttaatatgtgtcatagcaagcagcggaatgctatggatggctgagatcccactccaatggatagctagcgctattgtactcgaatttttcatgatggttctattgatacctgaaccggaaaaacaaagaactcctcaagacaaccaactagcttacgtcgtcattggaatattgactctagctgctatcattgctgcaaacgaaatgggcttgttagagactactaaacgagacctaggaatgagtaaagaaccaggagtagtaagtcctacaagctacttagacgttgatttacaccctgcaagcgcttggactctatatgccgtagccacaactgtaataactccaatgttgaggcacacaatcgagaactcaactgcaaacgtttccttggcggccatagcaaaccaagcagtcgttctaatgggtctcgacaaaggctggccaatttccaaaatggacctgggagtaccgttgctggcattgggttgttatagtcaagtcaaccccttaactctaacagccgcagttctgctactcattacacactatgctatcatagggccagggttacaggctaaagcaactagagaggcccagaaaagaactgcagcggggatcatgaagaacccaactgttgacggaattatgaccatcgatttggaccctgttatctatgactctaagtttgaaaaacaattaggacaagtgatgttattagttctttgtgcagtgcagttactgcttatgagaacatcgtgggctctatgtgaagcattaaccttagctacaggacctattactacgttatgggaaggttcacccggcaaattttggaatacaacgatagcagtaagcatggcgaacatatttaggggtagttatttagctggcgctgggctggcgttctcaattatgaaatcagttgggacaggaaaaagaggaactgggagtcaaggagaaactttaggtgaaaagtggaagaagaaattgaatcagttatccaggaaagaatttgacttatacaagaaatcaggtatcaccgaggtagaccgaacagaagccaaagagggattaaaacggggagaaattacccatcatgctgtatctcgtggtagtgctaagttacaatggttcgtcgaaagaaacatggtcatacctgaaggtcgcgtaatcgatttgggatgtggaagaggtggttggagctactattgtgcaggactaaagaaagtgacggaggtacgaggatacacaaaaggaggcccagggcatgaagaaccagtgccaatgagcacatatgggtggaacattgtcaaacttatgagcgggaaggatgtattctaccttccacctgaaaagtgtgatacgcttttatgtgatatcggggaaagctcaccaagtccaactgtcgaagaatctagaacaatccgagtattaaaaatggtggaaccgtggcttaagaacaatcaattctgtatcaaagtactcaatccctatatgccgacagtgatcgaacatttagagagattgcaacggaagcacgggggaatgctagtgcgaaacccactcagtcgtaacagcacacacgaaatgtattggatatcaaatggtactggaaacatcgtagcatcagtaaacatggtatctagactactattaaaccggtttacaatgacgcatcgaaggccaacgatagagaaagacgttgaccttggtgctggaacgcgccatgtcaatgcagaaccagaaactcctaacatggatgtaattggtgaacgaatcaagagaatcaaagaagaacacaattccacatggcactatgatgatgagaacccatataaaacatgggcttaccacggaagctacgaagtcaaagccaccggatcggcaagctcgatgataaatggagttgtgaaactactaaccaaaccttgggatgttgttccaatggtgacacaaatggctatgacagacacgacgccgtttggtcaacagcgagtgtttaaggaaaaagtagacacaaggactcctaggtcaatgccaggcacccggagagtaatgggaattactgcagagtggttatggcgcactttaggccgtaacaagaaaccaaggttatgcacaagagaagagttcactaagaaagttcgaaccaatgccgccatgggagctgtctttactgaagaaaatcaatgggacagcgctaaggccgccgtggaagatgaggatttttggaagttagtggacagagaacgtgaactgcataaactgggaaaatgtggtagctgtgtttacaacatgatgggtaaaagggagaagaaattaggggaatttggcaaagcgaaggggtcacgcgcaatttggtatatgtggctgggtgcgcgatacttggagttcgaggcgctaggctttcttaacgaagaccattggttctcccgagaaaacagttattctggtgttgaaggggaaggtctacataagttggggtatatactcagggatataagcaaaataccaggaggcgcaatgtacgccgatgatacagccggctgggatacccgtatcactgaagatgacctccataacgaagagaaaataacacagcaaatggacccagagcataggcaactggcgaatgcgatatttaagctaacataccagaacaaagtggttaaggtacagcgaccaacacctacaggtactgttatggacattataagcagaaaggaccaacggggatccggtcaagtaggaacctacggactcaatacttttactaatatggaggcacaactaatccgacagatggagggtgaaggcgtactcagtaaagcggatttagaaaatccacacttaccagaaaagaaaattacccaatggttggaaacgaaaggtgtggaaaggttaaaaaggatggccatatcaggagacgattgtgttgtaaagccgatagatgatagattcgccaacgcccttcttgcgctaaatgacatgggaaaagtaagaaaggatatacctcaatggcaaccatcgaaaggttggcatgattggcaacaagtacctttttgtagccaccatttccatgagcttattatgaaagacggacgaaagctcgtggtaccgtgccgtccccaagatgagcttatagggagagcaagaattagtcaaggggcaggttggtctctaagggagacagcttgtttaggcaaagcctatgcgcagatgtggtccttaatgtactttcaccgacgtgacttgagattagcttccaacgcaatatgcagtgccgtacctgtccactgggtacctacctcccgcactacctggtctattcatgcacaccaccaatggatgacaaccgaagacatgttgacggtttggaatagagtatggattgaagacaacccatggatggaagataagacccccgtaaccacatgggaaaatgtaccgtaccttggcaaacgagaggatcaatggtgtggctccctaatcgggctaacttcacgagcaacttgggctcaaaatattcccaccgcaatacaacaagtgcgtagcctaataggcaacgaagaatttctagattacatgccatctatgaaaagatttagaaaagaagaagaaagcgagggggcaatatggtga

SEQ ID NO: 23304 - RNA, 9873 nt, synthetic construct
  misc_feature 1..9873: note = derived and/or modified CDS sequence (opt6) from DENV-3__EU482566__SS-prME
  source 1..9873: mol_type = other RNA
acttccctctgcctaatgatgattttaccagcagctttagcatttcacttgacaagtagagatggagaaccacgaatgatcgttggcaaaaatgagagaggaaaaagccttctttttaaaaccgcatcaggaattaatatgtgtactctcatagccatggacttaggagaaatgtgcgacgatacagtcacgtacaaatgcccacacattactgaagtcgaaccagaagatatagattgctggtgtaatctgacaagtacttgggttacatatgggacatgtaatcaagctggtgaacatcgtagagacaaacgatctgttgcattagcgccccacgttgggatgggacttgatacaagaacccaaacatggatgtcggcggaaggagcttggcgacaggtagaaaaagtagaaacttgggcacttagacacccagggttcacaatattagctttatttttagctcattatatcggtacttcgcttacacaaaaagttgttatatttactttattaatgttagtaactccgtctatgacaatgaggtgtgtcggagtaggtaatagagattttgtagaaggattatccggagctacgtgggttgacgtcgtactggaacacggaggttgcgtcactactatggccaaaaataaaccgacattagatattgaattgcagaaaactgaagcgacacaattagctactctacgaaaactctgcatagaaggcaaaatcaccaatattacaacggattctagatgccctactcaaggtgaagcagttctaccggaagaacaagatcaaaattacgtatgcaaacacacgtatgtggatagggggtggggaaatggctgcggtctgttcggaaaaggaagcctagtaacatgcgctaaatttcaatgcttagagccgatagaaggaaaagtagtacagtacgagaacctgaaatatactgtcattataactgtccacacgggagatcaacaccaagtaggtaacgaaacacaaggcgtaactgcagagattacaccacaagcatcaacaacagaagctattctaccggagtacgggactctcggacttgaatgcagtccccgcactggactggatttcaacgagatgatattactaactatgaaaaataaagcatggatggtacaccggcaatggttctttgatctcccacttccgtggacaagcggagcgactactgaaactcctacatggaataggaaagaactattggtcacatttaaaaacgctcatgccaagaaacaagaagtcgttgtgttaggttcacaagaaggagcgatgcatacggctttaacaggcgctactgagattcaaaactcgggaggaacgagcatattcgcaggacacttaaaatgtagattaaaaatggacaaactcgaacttaaaggaatgagttatgctatgtgcactaatacgtttgtactaaagaaagaagtttcagaaactcaacatggaacaatcttgataaaagttgagtataaaggggaagatgtaccttgcaaaatacccttcagcacagaagacggccaagggaaagcacataacggtaggcttatcacagcgaaccctgttgtgactaagaaagaagaacccgtgaatatcgaggctgagccaccgtttggagagtcaaatatagttattggcatcggcgataatgcacttaaaataaactggtataagaaaggtagttcaattggtaaaatgtttgaagcaaccgctcgaggggcaagaagaatggctatcttgggagacacagcctgggattttggctccgtaggtggtgtcctcaacagcttaggcaaaatggtccatcaaatatttggcagtgcatacacagcattattctcgggagtaagttgggtgatgaaaatcggtattggagtcctactgacgtggataggactcaactcgaaaaataccagtatgtctttcagctgtatagccattggtattatcacattgtatttgggggcagtcgttcaggctgatatgggatgcgtcataaactggaaaggcaaagaactcaaatgcggctccggaatatttgtaactaatgaggtgcatacatggacagaacaatacaaattccaggcagactcgccaaaacgcctagctacggccatagccggtgcttgggaaaatggggtatgtggcatacgttctacaacacgtatggaaaatttactgtggaaacaaattgccaatgaactcaactacatactgtgggagaacaatattaaactgacagttgtcgtaggggacataataggtgttctcgaacagggaaaacggactctgacaccacaaccgatggaattaaaatattcttggaaaacatggggtaaagctaaaattgtaactgcggaaacccaaaattcttcatttattattgacggcccaaatacaccagaatgtccatctgctagtagggcctggaatgtctgggaagtagaagattacggatttggagtttttacaacaaatatatggctgaaattacgagaagtttacacacaattatgcgatcacagactaatgtcagctgcggtaaaagatgaacgtgcggttcatgctgatatgggatattggattgagtcccagaaaaatggaagttggaaactagagaaagcatcattgatagaagtcaaaacgtgcacatggcctaaatcccatactttatggagcaacggcgtattagaaagcgatatgattatccctaaaagtctggcaggcccaatctcacaacataactatcgacctggctatcacactcaaaccgcaggaccgtggcatctaggaaaactagaattagactttaattattgtgaggggacgacagtagtaatcactgaaaattgcggcacaaaaggcccgagcttacgtactaccaccgtatctggtaaactaatacatgaatggtgctgtcgctcatgcacgcttcctccattacgatacatgggcgaagacgggtgctggtatggaatggaaattagaccaatctccgaaaaagaagaaaacatggtcaaaagcctagtatcggcaggatcgggcaaggtagataattttactatgggagttctctgcttagctatcctgtttgaggaagttatgagaggaaaattcggtaagaaacatatgattgctggagttttcttcacgtttgtcttactattgtctggtcagatcacatggagggacatggcacacacacttataatgattgggtcgaatgcaagtgacagaatggggatgggtgtaacttacttggctttgattgccactttcaagatacaaccctttctggctctaggcttctttttaagaaaactgacctcgcgagagaaccttcttctaggagttgggttagctatggccaccactttacaactgcccgaggatatagaacaaatggcaaacgggattgccttaggtttgatggccctcaaacttattacccaatttgaaacttatcagctatggacagcgctaatttccctaacatgcagtaatacaatttttacattaacggtcgcgtggagaacagcaacgctgatcctcgctggtgtatccttgttacctgtatgtcaaagttcatctatgagaaaaactgactggcttccaatgaccgtcgcggcgatgggagtgcctcccttaccattgtttatattttcgcttaaagatacattgaagaggagatcatggcctctcaacgaaggcgttatggccgtaggcttagttagcatcttagcgtcttcgttgttaagaaatgatgtgcctatggcaggccctttagtagcgggaggtcttttaatagcttgttacgtcatcacaggaacatctgcggatttaacagtggaaaaagcagcagatgtcacgtgggaagaagaagctgaacaaactggcgtaagccataacttgatgataactgttgacgacgacggaacgatgagaatcaaagatgatgaaaccgaaaacattctgacagtactacttaaaactgctttattaatagtttcaggtatatttccatactctatacctgcgacactattagtatggcacacatggcaaaaacaaacacaaagatcaggagtgttatgggatgttccatcaccaccagaaactcaaaaagcagaactggaagaaggtgtatacagaataaaacagcaaggaatatttggaaaaacacaggtaggtgtaggagttcaaaaagaaggcgtatttcacacgatgtggcacgttactagaggggctgttcttacatacaatggcaagcggttagagcctaactgggcttctgtcaagaaagacttaataagctacggaggaggttggaggctttcagctcaatggcaaaaaggagaggaagtacaggtaatagctgtcgaacctggtaaaaaccccaaaaactttcagactatgcctggtacgttccagactaccactggagaaataggtgcaatagccctagattttaagccaggcacttctggaagccctattataaatagagagggaaaagttgtcggattatatgggaatggcgtcgttactaagaacggcggttacgtaagtggaatcgcacagacaaacgcagagccggacggtccgacaccagaactagaagaggagatgtttaagaaaagaaatcttaccattatggatctacacccgggctcaggtaaaaccaggaaatatttacctgctattgttagggaggcgataaaaagaagactgagaacactcattctagctcctacgagagtagtagctgcagaaatggaagaggctttaaagggattacctatccggtaccaaactactgctacaaagtccgaacacacaggacgagaaattgttgatttaatgtgccatgcgacttttactatgcgactattaagtccagtcagagtccccaattataacttgatcataatggatgaagcacatttcacagatcctgcttctattgccgcacgaggctatatttcaacacgagtcggcatgggtgaagcagcagccatctttatgacagcaactcctcctggaacagcagatgcttttccacaatctaacgctcccatccaagacgaagaaagagacattccagaacgatcttggaactcgggaaatgaatggatcactgattttgctggaaaaacagtatggttcgtccctagcattaaagcgggaaatgatattgcaaattgtttgaggaaaaatgggaagaaagttattcaactttcacggaaaacgtttgacactgaataccagaaaactaagttaaatgattgggattttgtagtaacgacagacataagcgaaatgggcgccaattttaaagcagacagggtgatcgatcctcgaagatgtttaaaaccagtaatattaaccgacggtccagagcgagtgatcttagcaggcccaatgccagttacggcagcctcggccgcacaaaggcgcggcagagttggtcgaaatccgcagaaggaaaatgatcagtatatctttacaggacaaccgttaaacaatgacgaggatcacgcacattggaccgaagctaaaatgctcttggataacataaacactcccgaaggaattatacctgcattatttgaaccagaaagagagaaatctgccgcgatagatggtgaatatcgtttaaaaggagaatcacgaaaaactttcgtcgaactgatgagaagaggagacttacccgtctggttagcgcacaaagttgcttcagaagggataaaatatacagacaggaaatggtgcttcgacggacaaaggaacaatcaaattttagaagagaatatggacgtagagatatggaccaaagagggagagaagaagaaattaagaccacgatggctagacgctcggacatatagtgatcccttagccctcaaggaatttaaagattttgcggcaggacgtaaatctattgcacttgatctggtaacagaaataggacgcgtaccatcccatctggcccaccgaacacggaacgccttagacaacttagtcatgctgcacaccagcgagcatggtggcaaagcctatagacatgccgtagaagagttaccagaaacaatggaaacgttattattgctaggccttatgatactactaacaggtggcgcaatgctttttctaataagcggcaaaggaattggaaaaacttctattggacttatatgtgtaatagcatctagcggcatgttatggatggcagaaataccgttacaatggattgctagcgctatcgtactagaatttttcatgatggtcctcttgataccagagcctgaaaaacaacgtacgccccaggacaaccagttagcctacgtagtcatcggaatactaacactagcggctatcattgctgctaatgaaatgggcctattagaaacaacaaaaagagacctcggaatgtcaaaagaaccaggagtagtttcgccaacaagttacttagatgtagatttacaccctgcgagcgcatggactctatatgctgttgctaccaccgtcatcactccgatgcttcgacatactatcgaaaatagtactgctaacgtctctctcgctgcaattgctaatcaagccgtagtattaatgggattagataaagggtggcctataagcaaaatggatttgggagtccctttgctagcattaggttgttattctcaagtcaatccattaaccctaacagctgcagttttattactaatcacacattatgcaatcattggacctggtctacaagcgaaagctacacgagaagcacaaaaacgaactgcagccggaattatgaagaacccgactgtggatggaataatgacgattgaccttgatccagtaatatatgattccaagtttgaaaagcaactaggccaagttatgttattagtattatgtgcagtacagctcctgttgatgaggacttcgtgggctctttgtgaagcccttactctcgcaacaggaccaattaccaccttgtgggaaggaagcccaggtaaattctggaatacaaccatagcagtgtcaatggcgaatatattccgcggttcatacttagctggcgcagggctagcatttagtatcatgaaatcagtaggaacggggaagagaggaacaggaagtcagggtgaaacgctaggagaaaaatggaagaagaaactaaatcaactttcccgaaaagaatttgacttatataagaagagtggtataaccgaggttgacagaacggaggcaaaggagggacttaagcggggagaaatcacacaccacgcagtgtcgaggggatctgcgaaactccaatggtttgtagagaggaacatggtgatacctgaaggtagagttatcgatttgggctgtggaagaggaggttggtcatattactgtgctggtctaaagaaggttaccgaggttaggggatacactaaaggaggacctggtcacgaggaaccagtaccgatgtctacatatggatggaacatcgtcaaactcatgagcggaaaagatgtattctatctacccccagaaaagtgcgatacgttgttgtgcgacataggtgaatcaagtccaagtccaacggtagaagaatctcgaaccattagggtgctaaaaatggtcgaaccttggctaaagaacaatcaattttgtatcaaagtgctaaatccatacatgcctaccgtaatcgagcacctagaaagattgcagagaaagcacggaggaatgctggttcgcaatcctctaagccgcaatagcactcacgaaatgtactggatatccaatgggacgggaaatattgtagcaagtgtgaatatggtttcccgacttctgctcaacagatttacaatgacacaccgtagaccaacaatcgagaaagatgtagatctgggagcggggactcgacacgtaaacgcagagccggagaccccgaatatggatgtaatcggagaaagaatcaagcgaataaaggaagaacacaatagtacatggcattatgacgatgagaatccttacaaaacctgggcatatcatggaagttacgaggttaaagctactggatcagctagttcaatgataaatggtgtagtaaagctacttactaaaccttgggatgtagtacctatggtgactcagatggccatgacagacaccacacctttcggacaacaacgcgttttcaaagaaaaagttgatactaggactccccggtctatgccagggacaagacgcgtgatgggtatcacagctgagtggctatggcgaacacttggcaggaataagaaaccaaggctctgcacacgtgaagaatttactaagaaagttcgaaccaatgcagcaatgggagccgtattcaccgaagaaaaccaatgggactcagcaaaagctgcagtcgaagacgaggacttctggaaactggtcgaccgagagcgggaacttcataaattaggaaagtgtgggagctgtgtctacaatatgatgggtaaaagagagaagaaactgggagaatttggaaaggccaaggggtcaagagcaatatggtatatgtggctaggtgctcgttacttagaatttgaagcattaggttttctcaacgaagatcactggttctcgagggagaatagttattcaggtgtagaaggtgaaggacttcacaaacttggatatattctacgtgacatatccaaaattccagggggagcaatgtacgccgacgataccgcaggatgggacactagaataactgaagacgatctacacaatgaagaaaagataacacagcaaatggatccagagcaccggcagttagccaatgcaattttcaaactcacataccagaataaggtagttaaagtacagagaccgactcctacaggaacggtcatggatataataagtcgtaaggatcagaggggaagcggtcaggtggggacatacggattaaacaccttcacaaatatggaagcacaattaatcagacaaatggaaggagaaggagtcttatctaaagcagatctcgagaatccacaccttcctgagaaaaagataactcaatggttagaaacgaaaggggtcgagaggttaaaacgcatggcaattagcggcgacgattgcgtggtcaaaccaatagatgataggtttgctaacgcactattagccttaaatgatatggggaaagtacgtaaagatatcccccaatggcaaccttcaaaaggatggcatgattggcaacaagtacccttttgcagccaccattttcacgaattaataatgaaagatgggagaaaattagttgtaccttgtcgtccacaagatgaactaattggcagagcaaggatttcacaaggtgcaggatggtcattgagagaaacggcctgtctgggaaaggcatatgctcaaatgtggagtttaatgtattttcatagacgtgacctaaggctggcaagtaatgctatatgttcggccgtccccgtacattgggtacctaccagtcggacaacttggtcaatacacgcgcaccatcaatggatgaccacggaagatatgctaacagtatggaatcgtgtctggatagaggataatccatggatggaggataaaacacctgtgaccacatgggaaaacgttccatatttgggcaagcgcgaggatcaatggtgcgggtcgttgataggattaacatctcgagctacgtgggcacaaaacatcccaacggctatacaacaagttaggtcattgataggcaatgaagagtttttagattacatgccgagtatgaaaaggttccgaaaagaagaagaatccgagggtgcaatttggtaa

SEQ ID NO: 23305 - RNA, 9873 nt, synthetic construct
  misc_feature 1..9873: note = derived and/or modified CDS sequence (opt6) from DENV-3__EU529702__SS-prME
  source 1..9873: mol_type = other RNA
acgtcattatgtctgatgatgattcttccagcagctttagcgtttcacttaactagcagagatggagaaccaagaatgatcgtagggaaaaacgaaagaggaaaatcattactttttaaaacagcttcaggaataaacatgtgcacactaatcgcaatggatctaggagaaatgtgtgatgatacagtaacttacaaatgcccacatatcaccgaagtagaaccagaagatatagattgttggtgtaatttaacatcaacatgggtaacttatgggacctgcaaccaagcaggagaacaccgtagagataaaagatcagttgcgttagctcctcatgtgggaatgggattagatacgcgtacccaaacatggatgtcagcagaaggagcttggcgacaagtggaaaaagtagaaacctgggcgcttcggcaccccggtttcacaattctggcgctatttttagctcactatgttggaacatctcttacacaaaaagtcgtaattttcatactactgatgttagtaacaccatctatgacaatgagatgcgtcggagttggtaatcgggattttgtagaagggctaagtggggccacttgggtagacgttgtgcttgaacatggcggatgtgttacaacaatggcgaaaaacaaaccaacattggacatagaacttcagaaaacagaagcaacacaactcgctacgcttaggaaattatgtatcgaaggaaaaatcacaaatataacgacagacagtaggtgtcctactcaaggagaagcagtcctgcctgaagaacaagatcaaaactatgtatgtaaacatacttacgtagatcgaggatggggaaacgggtgcggtctctttggcaaagggtcattggtaacgtgtgctaaattccaatgtttagaacccatagaggggaaagtagtccaatacgaaaatcttaaatacacagtgatcataacagttcacactggtgatcaacatcaagtaggtaatgagacccaaggagtcacagccgagattacaccccaagcgagtacgacagaagcaattttgcctgaatacggaacactcggactggagtgttctcccagaacagggttggattttaatgaaatgatattattaaccatgaaaaataaggcttggatggtacatcgacagtggttctttgacttaccactaccatggacatcaggagcaaccacggagacaccaacatggaaccgaaaagagctattggtcacatttaaaaacgctcatgccaagaaacaagaagtagtcgtactaggttcgcaggaaggagcaatgcatactgccctgactggagccacagaaatccaaaacagtgggggaacttcgatatttgcaggccatctgaaatgtaggttaaaaatggacaaactagaattaaaaggaatgagttatgcaatgtgtactaatacattcgtgctcaagaaagaagtgagtgaaactcagcacggaacaatattaataaaagtggagtacaaaggagaagatgttccatgtaaagtgccgttttcaacagaggacggacaaggaaaagcgcataacggtagattaatcacagcaaatccagttgtcaccaagaaagaggaaccagttaatatcgaagcagaacctccatttggcgaatctaatatagtaataggaatcggtgacaatgcgctaaaaatcaactggtacaagaaagggagttctataggaaaaatgttcgaagctaccgcacgaggagccagacggatggctattttaggtgacactgcatgggactttggatctgttggaggggtactaaatagcctaggtaaaatggttcatcaaatttttggatctgcttataccgccttattcagtggtgtcagttgggtaatgaaaataggcataggggttttgttaacgtggattggtttaaactccaaaaacacatcgatgtcttttagctgtattgtcataggaataataaccctctatcttggagcagtcgtgcaggctgacatgggatgcgtaattaattggaaaggcaaagaattgaaatgtgggtcagggatttttgtgactaatgaagtccatacttggactgaacaatataaattccaggccgattctcctaaaagattagccacagccatcgcgggagcatgggagaacggagtatgcggaattagatctacaaccagaatggaaaatcttttatggaaacagatagcaaatgagctaaattatatactatgggaaaacaacataaaattgaccgtagtagtaggtgatataataggtgttcttgaacaggggaaaaggacactcaccccacaacctatggagctaaaatactcatggaaaacctgggggaaagcaaaaatcgtcaccgccgaaacccagaatagttcctttataattgacgggcctaacaccccagaatgcccaagtgcaagtagagcttggaacgtttgggaggttgaagactatggcttcggtgtattctctactaatatatggctaaaattacgcgaagtttacacccagctttgtgatcacagactgatgagtgcagcagttaaagacgaaagggcagtacacgcagatatgggctattggatcgagagtcagaaaaatggttcatggaaactcgagaaggccagtttaattgaagtaaaaacgtgtacttggcccaaatctcatacactatggagtaacggcgtcttggaaagtgacatgataatacctaagagcctcgcggggcccatctcccaacacaattacagaccgggctatcatacacaaacggcagggccatggcatctgggtaaactcgagctagattttaactattgcgaaggcacaacagtagtaataactgaaaattgcggaacccgtggcccttcattacgaacaactacggtcagtggaaaactcatccacgaatggtgttgccgaagttgtacacttccacctctgaggtatatgggtgaagacggctgttggtatggtatggagatcagacctatatctgaaaaagaagagaacatggtaaagtcgctagttagcgccggtagtggcaaagtagacaattttactatgggagccctgtgtctagccattttgttcgaggaggtaatgcgaggaaaatttggcaagaaacatatgattgccggcgtattctttactttcgtcctacttctaagtgggcaaattacttggagagacatggcacatactctaataatgattggaagtaatgccagtgataggatgggaatgggtgttacttacttggcattgatagcaaccttcaaaatccaaccctttttagcattaggattctttctaaggaaactgacctctcgagagaaccttcttttaggagtaggtttagctatggccacgacattacaattaccagaagatatcgaacaaatggcaaatggtatagcacttggacttatggcactaaagctaataacacaattcgagacatatcagttatggaccgcattaatttccttaacctgctctaacacaattttcaccttaacagttgcttggcgtactgctacactaatccttgcaggagtgagtttactacccgtatgccaatcatcttcgatgcgaaagaccgattggttgccgatgaccgtagctgcaatgggagttcccccgctcccgcttttcatcttctcgttaaaggatacattgaaacgacgaagctggcccctaaatgaaggtgtaatggctgtaggccttgtgagcatactggcctcaagtttattacgcaatgatgttcccatggctgggccattggtcgcaggaggactcctaatagcctgttacgtcatcaccggcacaagtgctgatctaacagttgaaaaagcagcagatgtcacatgggaggaagaagccgaacaaacaggtgtctcgcacaatttaatgataacagtcgatgacgacggaacaatgagaattaaagacgacgaaaccgaaaatattctgactgtcttgctcaaaacagcccttcttatcgtctcaggaatttttccatatagcattccggccacccttcttgtatggcatacctggcagaaacaaacacaaaggagcggagtattatgggacgttccttccccacctgagacacaaaaggccgaattggaagagggcgtttatcggatcaaacaacagggaatattcgggaagacacaggtaggtgttggtgtacaaaaagaaggggtttttcatacaatgtggcatgtaactcgaggtgctgtactaacatacaacggaaaaagactagaacctaattgggcaagtgtcaagaaagacctcatcagctacggaggcggatggaggctctcggcgcaatggcaaaaaggcgaagaagttcaagtaattgcagttgaacctggcaaaaatcccaaaaatttccaaactatgcctggcacctttcaaacaacaactggcgaaataggagccatcgcattagacttcaaacccggaacatcggggagtccaattataaacagagaaggcaaagtggtgggactatatggaaatggagtagtaaccaaaaatggtggatacgtaagtggtattgctcaaaccaatgcggagcccgacggaccaacgccggaattggaagaagagatgttcaagaaaagaaacttaacaattatggatttacatccgggtagcggaaagacccggaaatacttaccagctatagttagggaagctataaaacgacgtttgagaacactcatattagcaccgacaagagtggttgcagctgagatggaagaagcattgaaagggttacccatacggtaccagacaacagccacaaaatctgaacatacaggcagagaaatagtagatttgatgtgtcacgcgactttcaccatgagattattatcaccagttagggttccaaattacaaccttataataatggatgaggcccattttactgatcctgcgtcgatagcggcacgaggttatatttcaacccgagtaggcatgggagaagcggctgcaattttcatgaccgctacaccacctggtacggctgatgcgtttccacagagcaatgctccgattcaagatgaagaacgtgatatacctgaaagatcctggaactctggaaacgaatggataacagatttcgcaggtaaaacagtttggttcgtaccttcaataaaagcagggaatgatatagcaaattgtttaagaaagaacggcaagaaagttatacagttgtcgagaaagacgttcgacacagagtatcagaaaacgaaacttaatgactgggactttgtagtaacaactgatatttcagaaatgggtgcaaactttaaagctgaccgagtcatagatccaagacgatgcttgaagccagtcattttaacagacgggcctgaacgtgtaattttagccggccctatgccagttactgcggcaagcgcagcacaaagaagaggacgagtaggtcgaaaccctcaaaaagaaaacgaccagtatatatttacaggccaaccgctcaataacgacgaagatcacgcacactggactgaggcaaaaatgttgttagataatatcaacaccccagaaggaataataccggcccttttcgaacctgaacgagaaaaatctgccgctatagacggagagtatagattaaagggtgaatctcgcaaaacatttgtagagttgatgaggagaggagacctgccggtatggctcgcacacaaagtcgccagcgaagggataaaatatacggataggaaatggtgcttcgacggccagaggaataatcaaatactagaagagaatatggacgttgaaatatggaccaaggaaggcgaaaagaagaagctcaggccaaggtggctcgacgcgcgaacctattccgatcccttagcgttgaaagagttcaaagattttgctgccggtagaaagtccattgcacttgacctcgtgaccgaaataggaagagttccatcgcacctagcgcaccgaacgaggaatgccttggacaacttagtcatgctccacacaagcgaacatggcggcaaagcatacagacatgccgtagaagagttacctgaaacgatggagacgcttttactgctcggattgatgatattacttacgggcggtgcaatgttattcctgatatcaggtaaaggaatcggtaaaacaagcattggactaatatgtgtgatagcatcgtcagggatgctgtggatggcagaaatacctctccaatggatcgcatcagcaattgtcttggagttctttatgatggttttactaattcctgaaccagagaaacaaaggacaccacaagacaatcaattagcatacgtagtaatcggcattttgacacttgcagcaataatagcagccaacgagatgggactactagagacgacaaaacgagatctaggtatgtctaaagaaccgggagtagttagtccaacttcttatctcgatgtagaccttcatcccgcttcagcttggacactttacgcagtagccacgacggtcataaccccgatgttacgccatacaatagaaaacagcacagcaaacgtatctctcgcagcaattgcaaaccaagctgttgtcttgatggggctggacaaaggttggccaataagtaaaatggacttaggggtcccgctactcgctctaggatgttacagccaagtaaatccactcactctcacagcagcagtactgctcttaatcacacattacgcaattatcggacccggtttacaagctaaagcaacgcgagaagcgcagaaaaggactgcagctggaataatgaaaaatccgacggttgatggtataatgaccattgacttagaccccgtcatatacgattcaaaatttgaaaaacagttaggacaagtgatgttactcgtcttatgcgctgttcagcttctgttgatgcgcacgtcatgggctttatgtgaggcgcttacgctagcaactggaccaataacaacgttgtgggaaggatcacctggtaaattttggaataccaccatcgccgtgtccatggcaaatatatttcgaggttcctatcttgccggtgcagggttagctttttcgataatgaaaagtgtcggtacaggaaaacgaggtactggatcacaaggcgagacattaggagaaaaatggaagaagaaattaaatcaactaagtaggaaagagttcgatctatacaagaaaagcggaataacagaggtagatcgaacagaagctaaagaaggcttgaaaagaggcgaaattactcatcacgcggtatcacgtggatcagcaaaacttcagtggttcgtcgagagaaatatggtgatcccggaaggtcgagtcatcgatctcggttgtggtcgaggtggatggtcgtattactgcgcaggtctaaagaaagtcactgaagtaaggggatatacaaaaggaggacctggacatgaagaacccgtaccgatgtctacatacgggtggaatatcgtaaagctaatgagcggcaaggacgtattctatttaccaccagaaaaatgcgataccctgctctgcgacataggagaatcatcccctagcccaacagttgaagagagccgtacgattagagtattaaaaatggtagaaccatggctaaagaataatcaattttgtatcaaagtgttgaatccgtatatgccaaccgtgattgaacacttagagcgattacaaagaaaacatggcgggatgttagtgcgaaaccccctctccagaaactccacacatgaaatgtattggattagcaatggaactggtaatatagtagcttcagtgaacatggtaagtcgacttcttctgaaccgtttcactatgacacaccgaaggccgaccatagagaaggacgttgatttaggggcaggtacacggcatgttaacgccgaacctgagacccccaatatggatgtaatcggagaaagaatcaaaagaataaaagaggaacataattcaacctggcactatgatgatgaaaatccttataaaacctgggcataccacgggtcgtacgaagtcaaggctaccggttctgcttcaagcatgatcaatggggtagtaaaactgctaactaaaccatgggatgtagtgccaatggtaacccagatggcaatgactgatactacaccttttggacaacagcgcgtatttaaggaaaaagttgatactcgtactccgaggtcaatgcccgggacgcgcagagtcatgggaattacagctgaatggctttggagaactttaggacgcaataagaaaccccgactatgtacccgagaagagttcacaaagaaagtacggacgaatgcagctatgggtgcagtgttcacagaagaaaatcaatgggatagtgcgaaagcggcagtggaggatgaggatttttggacccttgtagacagagaacgtgagttacacaaattaggaaaatgcgggtcatgtgtatataatatgatgggcaagagagagaagaaattgggcgaatttggcaaagcaaagggttcccgagcaatctggtatatgtggctgggggcgcggtacctcgagttcgaagcattaggatttttaaatgaagatcattggtttagcagagagaactcctattccggagttgaaggcgaaggtctacataaactgggatacattctaagagacatttcaaaaatcccaggaggggcaatgtatgcggacgatacagccggatgggatacgagaataacggaagatgatttacacaacgaggagaaaatcacccagcaaatggaccccgaacatcgacaattggcgaacgcaatatttaaactaacttatcaaaataaagttgtaaaggtacaaagaccaacgccaactggcacggtgatggatatcatctcacgcaaggatcaaaggggaagtggacaagtaggtacatacggtctaaatacattcactaatatggaagcgcaacttatcagacaaatggaaggtgagggagtgttatcaaaagccgatttagagaatccacatctgccagaaaagaaaatcactcaatggcttgaaacgaaaggtgtggaaaggcttaaacgcatggcaattagtggggatgattgcgttgtaaaacctatcgatgacagattcgccaacgcattactcgctcttaatgatatgggcaaagtcagaaaagacattccccaatggcaaccaagcaaggggtggcacgactggcaacaagttccgttttgtagtcatcactttcatgagttaataatgaaagacggaagaaaattagtggtcccttgcagaccacaagatgaactaataggcagagctcgtatctcacaaggagcaggctggtccctaagggaaactgcttgcctggggaaagcatatgctcaaatgtggagcctaatgtactttcacaggagagacttgcgtttagcatcaaacgcaatttgcagcgcagtcccagtacattgggtgcccacatcacgtacaacttggtcaatccatgcacaccaccaatggatgactacggaggacatgcttactgtgtggaatagagtatggatagaggataacccttggatggaagataaaacccccgttacgacttgggaaaacgtgccatatttaggaaaacgcgaagatcaatggtgtggcagcttaattggactaacgtcacgggccacttgggcgcaaaacataccaaccgcgattcaacaagtaagatctttaattggaaatgaagagttcttggactacatgccgagtatgaagagatttagaaaggaagaagaatccgaaggggctatttggtaa

SEQ ID NO: 23306 - RNA, 9873 nt, synthetic construct
  misc_feature 1..9873: note = derived and/or modified CDS sequence (opt6) from DENV-3__EU529703__SS-prME
  source 1..9873: mol_type = other RNA
acttccctctgtttgatgatgatattacctgctgcgttagctttccacctgacctccagggatggagaaccccggatgatagtaggtaaaaatgaaaggggaaaaagtctattattcaaaaccgcatcaggcataaatatgtgcaccctaatcgcaatggatctaggtgaaatgtgcgacgacactgttacctacaaatgtccacatattacggaagtagaacccgaagacattgactgttggtgtaaccttacgagcacatgggtaacatatggtacatgcaaccaagcaggggaacaccgacgcgacaaaagaagtgttgctttggcgcctcatgtagggatgggacttgatactagaacacaaacgtggatgagtgcagaaggtgcttggcgacaggtagaaaaagtagaaacttgggccctcagacacccaggattcacaatactagcattattccttgcacactacattggaacgtctcttacacaaaaagtagtcatatttatactattaatgctagtaaccccttcaatgacaatgagatgcgtaggagtagggaatagagatttcgtagaagggctgagtggtgccacctgggttgatgtcgtcttagaacatggtggatgtgttacaacaatggctaaaaacaaaccaactttagacatcgaactccagaaaacagaggctacacaacttgctacacttaggaaactctgcatcgaaggcaaaataacaaatatcactacagatagccgatgtccaacccaaggagaagcagcacttcctgaagaacaagaccaaaattacgtatgtaaacatacgtatgtagacagaggatggggaaatgggtgtggtttatttggaaaaggctccctagtaacatgcgctaaattccaatgcctagaacctattgagggtaaagtagtacaatatgaaaacttaaaatatacagtaataattacagttcatacgggagatcaacatcaagttggcaacgaaacccagggggtaacggcggaaataacaccacaagcgagtacaacagaagcgatattacctgaatacggcaccctcggactagagtgttcacctcggacagggctcgacttcaacgagatgatattattaacaatgaaaaacaaagcatggatggtccacagacagtggttctttgacctaccactaccatggacaagtggagcgacgacagaaacacccacatggaatagaaaagaactattagttactttcaaaaatgcccatgctaagaaacaagaagttgtcgtattaggtagtcaggaaggtgccatgcatacagccctaacgggcgcaacagaaattcaaaattcagggggaacatcaatctttgcaggtcatcttaaatgtcgactaaaaatggataaattagagttaaaagggatgtcctacgccatgtgtacgaatacattcgtcctcaagaaagaggtaagtgagacccaacatggtactattttaattaaagtggaatataaaggagaagatgcaccatgtaagataccgttttcaactgaagacgggcaggggaaagcacataatggaagattgataactgcgaacccagttgtcacgaagaaggaagaaccagtcaatatagaagcagagcccccatttggggaatcaaacatagtaataggaataggcgacaatgccctcaaaattaactggtacaagaaaggatctagtataggtaaaatgtttgaagctacagcgagaggggcccgcagaatggctatattgggcgacactgcgtgggatttcggtagtgtcggaggtgtcctaaactcacttggaaaaatggtgcatcaaatctttgggtctgcatataccgctttattttcgggtgtctcatgggtaatgaagatcggcataggggtattactcacatggatcggtttgaacagcaaaaatacaagtatgtcttttagctgcattgccataggaattattacactatatttaggtgcagttgtgcaagcagatatgggctgcgtgataaactggaaagggaaggagctaaaatgtggctctgggatctttgtaaccaatgaagtacatacatggaccgaacaatataaattccaagcagacagtcctaaacgtttggctacggcaattgctggtgcatgggaaaatggagtttgtggtattcgaagcacaacaagaatggagaatcttctttggaaacagatcgctaatgaactgaactacattttgtgggaaaataatattaaacttaccgtagtggtgggcgatataatcggcgtgttagaacaaggcaaacgaacattgacaccacaaccaatggaactaaagtattcttggaaaacatggggtaaggcaaaaatagtaacagcggaaacgcagaactcttcgtttataatagacggtccaaatacgccagagtgccccagcgcatctagggcctggaacgtgtgggaagtagaagactacggttttggagtttttactactaacatatggctaaaattaagagaagtatatacgcaattatgtgaccatcgactaatgagcgccgctgtgaaagatgaacgagccgttcatgctgacatgggctactggatagaatctcagaaaaacggctcgtggaagctagaaaaagcatcactaatagaagttaaaacgtgcacctggccaaaatcacacacgttatggtcaaacggagtcctagaaagcgacatgattatccctaaatcgttggccggcccaataagtcaacacaaccaccgtcctggctaccacacacaaactgctggaccctggcacctgggtaaattagagttagattttaactactgcgagggaaccactgtagtaataacagagaattgtggaacaagaggaccaagtttaaggacaacgacagtcagcggcaagttaattcatgaatggtgctgcagatcatgcacactaccccctttacggtatatgggcgaagatgggtgttggtatggtatggaaataaggccgataagcgaaaaagaagaaaatatggtaaagagtctggtctcagccggtagcggaaaagtcgataattttaccatgggcgtattatgcttagctatacttttcgaagaggtgatgcgaggtaagtttggcaagaaacacatgattgcgggagtattctttactttcgtgttactcctatctggtcagattacctggcgagatatggcgcacacactcatcatgataggatccaacgcaagcgataggatgggtatgggagtaacatacttagcgttaatcgcaacattcaagatccaaccatttctagcattgggatttttccttcgaaaactgacttcacgagagaatctgctccttggagtaggactagcaatggcaacaaccctacaattgccagaagacattgaacaaatggcgaatggaattgctttaggacttatggctctgaaactaattacccaattcgaaacgtatcagttatggacggctttaatatccctcacatgctcaaatacgatattcacattaaccgtagcctggcgcacagccacactaatattagctggggtaagtttattgccagtttgccagtcgtcgagtatgagaaagactgactggctaccgatggcagtagcagcaatgggagttcctccattaccattattcatcttcagtttgaaagacacgttaaaaagaagaagctggcccctaaacgaaggtgtgatggccgtaggcttggtaagtattcttgccagttccttacttagaaacgacgtgcccatggccggacctcttgtagctggaggtctattaatagcatgctacgtaataactggtacctccgctgatcttacagtagaaaaagcagctgacataacgtgggaagaagaagctgaacaaacaggggtctcacataatctaatgattacagtagacgatgatggcacaatgagaattaaagatgatgaaacggagaatatacttaccgtactccttaaaacggccctacttattgtaagcggaatatttccatacagcataccagcaacgctgttagtctggcatacttggcaaaaacagacacaacggagtggtgttctctgggatgtaccttcaccaccggagacacaaaaagcagaactagaagaaggcgtatatagaatcaaacaacaagggattttcggaaaaactcaagttggtgtgggggttcagaaagaaggagtgtttcacactatgtggcacgtcacacgaggtgcggtactaacatataacggaaagagattggaaccaaactgggcaagcgtcaagaaagaccttataagttatggtggaggctggcgattaagcgcacaatggcaaaagggtgaggaagtgcaagtaatagcagtagaaccagggaaaaaccctaagaattttcaaacgatgcctggaacctttcagacaacaacaggagaaataggtgccattgcgttagatttcaaacccggaactagcgggagtcccataattaatcgagaaggaaaagttgtagggttatatggaaacggtgttgtcactaaaaatggaggatacgtatcagggattgcgcagactaatgcagaaccagatgggccgacgccagaattagaagaagagatgttcaagaaacgaaatctaacgataatggatcttcatccgggctcgggaaaaacacgaaagtacctaccagcaatcgttcgtgaagctattaaaagaagattaagaacattgatcctcgctccaacccgagtagttgcggctgagatggaggaagcattgaaaggattaccaatccgttaccaaacaacggcgactaaatctgagcatactggccgcgaaatcgtagatctaatgtgtcatgcaaccttcacaatgagactccttagcccagttagagttcctaattacaacttaattatcatggatgaagcacattttacagatccagcatcaatcgctgctagaggctatatatcaacaagagtcggtatgggagaagcagccgcaatatttatgacagcaactccgcccggaacagcagacgcattcccgcagagcaatgctcccatacaggacgaagaaagagatattccggagaggagctggaacagcggtaatgagtggattacagacttcgctggaaagacagtatggttcgtacccagtataaaagctggcaatgatatagcaaattgtttaaggaagaatggtaagaaagtgattcaattaagtcgcaagacttttgacactgaatatcagaaaacaaaattaaacgattgggattttgtagttacaactgacatatccgaaatgggtgctaactttaaagctgatagagtaatagatccgcgcagatgtttaaagccagtaatcttgacagatggtcctgagcgagtgatccttgcaggacctatgcctgtaacagcagcaagtgcagcacaacgaagaggacgagttggacgaaacccacaaaaagaaaacgaccagtacatatttacgggacaaccactaaacaacgacgaagatcatgcacattggactgaagccaagatgttactagacaatatcaatactccagaaggcataatcccggcattattcgaacctgaacgagagaaaagcgccgcaattgacggagagtacaggttgaagggtgaatcaaggaaaacctttgtagagctaatgcgcagaggggacttaccagtttggctagcacacaaggtcgcgtctgaaggaataaagtataccgatagaaaatggtgtttcgatggccaaaggaataatcagattttagaagaaaacatggacgttgaaatatggaccaaagaaggagagaagaagaaactgcgtccgagatggcttgacgcccgaacttattcagatccgctggcactaaaagaatttaaagattttgccgctgggcggaaatcaatagcactagacttagtaacagagataggaagagtacctagtcatttagcacaccgaaccaggaacgcgttagacaacttagtaatgctacatacaagtgagcatggcggtagggcttacaggcacgccgtcgaagaactccccgagacgatggagaccctattactcctaggtttaatgatactgctaacaggaggggcaatgttatttttaatttcaggaaaaggtattggtaaaaccagtattggtctaatatgtgtaattgcttcatcaggaatgttatggatggcagaaataccattacaatggatcgcctcagctattgttctagaatttttcatgatggttctactaatacctgaaccagaaaaacaaagaacacctcaagataatcaattagcgtacgtagtgataggaatcctaaccttagcagcaataatcgccgcaaatgaaatgggccttctcgaaacgacaaaacgggacctaggaatgtcgaaagaacctggtgttgtatcaccaaccagctatttggatgtagacctacatcctgcaagtgcatggactttgtatgctgtagccacaaccgtaataaccccaatgttaagacacacaatagaaaattcaaccgccaatgtatcattagcagctatagctaaccaagccgtagtattaatgggactggataaaggttggccaatatctaaaatggaccttggcgtacccctactcgcccttggatgctatagtcaggtaaatcctctgacattaacggcggcggtcctgctactaattacacactacgccataataggacctggattgcaggctaaagctacgagggaggcacaaaaacggacagctgcaggcataatgaaaaatccaacagtagacggtatcatgactatcgacctagaccccgtaatatacgactcaaaatttgaaaagcaactaggccaagtaatgctcctagtcttgtgtgcagtacaacttctccttatgagaacatcttgggcgctttgcgaagccttaacgctagctacggggcccattacgactctgtgggaaggttcacctggcaaattctggaatactacaatagcggtaagcatggccaacatctttagagggtcctacctggctggtgcaggccttgcattcagtataatgaaaagcgtagggactggcaaacggggcactggatctcagggagagactcttggtgaaaaatggaagaagaaattaaatcaattgtctagaaaagaatttgatctgtacaagaaatcaggaataacagaagtggatcgaactgaggcaaaagaaggtctaaaacgaggagaaataacacatcatgctgtcagtagaggatcggctaaattacaatggttcgtggaacgtaacatggtaataccagaaggaagagtaatagatctcggttgcggtcgcgggggctggtcatattactgcgctggtctaaagaaagtcactgaagtaagaggatatacaaaaggtggaccaggtcatgaggaaccagttccgatgtcaacttatggttggaatatagtcaaactaatgtcagggaaagacgtattttacctgccccctgaaaaatgtgatacattattatgtgatataggcgagagttcaccatcgccgaccgtcgaggaaagtcgtaccattcgcgtcctgaaaatggtcgaaccgtggttgaaaaacaaccaattctgtataaaagttctgaatccttatatgcctacagtgatagaacacctggaacgtttgcaaagaaaacatggaggtatgctcgtaagaaacccattaagccgtaattctacgcatgaaatgtattggatatcaaacggaaccgggaacatagtggcatctgtgaatatggtatcacgattgttgctaaatcgctttacaatgacccatagaagacccacaatcgagaaggatgtagacttgggagcgggaacacgacatgtaaatgctgaacccgagacccccaatatggacgtaataggagaacgaataaaacgaataaaggaagaacataatagtacatggcattacgatgatgaaaatccatacaagacatgggcataccatggttcgtacgaagtcaaggctacaggttcagcaagtagcatgataaacggtgtagtaaaactcttgactaaaccctgggatgtggttccaatggttactcaaatggccatgacagatacgactccgttcgggcagcagagagttttcaaagaaaaagtagatacgagaactcctagatcaatgcctggaactagaagagtaatggggataacagccgaatggctctggagaacactaggtagaaataagaagccccgactctgtactagagaagaatttactaagaaagtaagaacaaacgcagctatgggtgctgtgtttactgaggaaaatcaatgggattcagctaaagcagcggtggaagatgaggatttttggaaacttgtcgaccgtgaacgtgagctgcataaattaggaaaatgtggttcgtgcgtatacaacatgatgggaaaaagagagaagaaattaggtgagttcgggaaagcaaaaggatccagagctatatggtatatgtggttaggtgcgagatacctagaatttgaagcgctcggctttttaaatgaagaccactggttcagcagagagaatagttactcaggtgtggaaggtgaaggattacataaactaggatacattcttagggacatatcaaagataccaggaggagccatgtatgcagacgacactgcaggctgggatacgaggatcacagaggatgatttacataatgaagaaaagatcacccaacaaatggacccagaacatagacaattagcgaatgctatatttaaattaacttatcaaaataaggtagttaaagtccagaggccaacaccgacaggcacagttatggatattatcagtagaaaagaccaaagaggatccggacaggttggcacctacggtttgaatacgttcacaaacatggaggcccaattaattcgccaaatggaaggcgagggagttttaagtaaagcagatttagagagtcaccaccttcccgagaagaaaataactcagtggcttgaaacaaaaggagttgaaagactgaagagaatggcaatatccggggatgactgcgttgtaaagccgatagacgacaggtttgcaaacgcattactagcgttaaatgatatgggaaaagtacgcaaagacataccacaatggcaaccgtcaaagggatggcatgattggcaacaagttccgttctgttcacatcattttcatgaattgatcatgaaagacggccggaagttagtagttccgtgtcggccacaagacgagctaatcggtagagcaagaatctcccaaggtgcgggatggagtctaagagaaacagcttgtctaggaaaagcctacgctcaaatgtggtcactaatgtatttccataggagagatctacgactagcatccaatgctatatgcagcgctgtacctgttcactgggtacctacttcgagaaccacttggagtatacatgcccaccaccaatggatgactaccgaagatatgctaacagtttggaatagagtatggatagaagacaacccttggatggaggataaaacgcctgtcacaacttgggagaacgtaccttacctaggaaagagggaagatcaatggtgcggctccctgataggtttgacctcacgtgcaacatgggcacagaatataccaaccgctatacaacaagtcagatcgctcatcggaaatgaagagttcctagactatatgccatctatgaagcgattcagaaaagaagaagaaagcgaaggggcaatatggtaa

SEQ ID NO: 23307 - RNA, 9873 nt, synthetic construct
  misc_feature 1..9873: note = derived and/or modified CDS sequence (opt6) from DENV-3__EU529705__SS-prME
  source 1..9873: mol_type = other RNA
acatctttatgcttaatgatgattttacctgcggcactggcgtttcacctaacaagtagggacggagaacccagaatgatagtcggcaaaaacgaacgcggaaaatcactattatttaaaacagcgtccggtataaacatgtgtactttaatagctatggatcttggtgaaatgtgtgatgatactgtaacatataaatgcccacacataacagaagttgaaccggaagacatagactgttggtgtaacctgacatcaacgtgggtgacttatggaacttgcaatcaagcaggagaacatcggcgtgacaaacggagtgtggccctagctccacatgtcggaatgggtttagacactcgcacacaaacgtggatgagtgctgaaggagcatggcgtcaggttgagaaagtggaaacatgggctctaaggcatccaggatttacgattttagccttatttctggcacactacattggtacatctctaacacaaaaagtagtaatattcattttactaatgctagttacacctagtatgactatgcgttgcgttggaatcgggaaccgagatttcgtagaaggtttgtcgggtgcgacatgggttgacgtggtgctagaacacggtggatgcgtaactactatggccaaaaacaaaccgacactagatattgaactacagaaaacagaagcaacacagttagcaacgctaaggaaactatgcatcgagggtaaaattacaaatatcacgacagactcccgatgtccgacgcaaggggaagccgttttgcccgaggaacaagaccagaattacgtttgcaaacacacgtatgtagaccgtgggtggggaaacggctgcggtttgttcggaaaaggatcattggtaacatgcgctaaattccagtgcttagagccaatagaaggcaaagtagtgcaatatgagaaccttaaatatactgttataatcacagttcacactggtgaccaacatcaagttggaaacgagacacaaggcgtaactgcagaaatcacaccacaagcaagcactactgaagcaattttacctgaatatggcacactcggcttagagtgttcacctcgtactggcctagattttaatgaaatgattttgttaactatgaaaaacaaagcctggatggtgcaccgacaatggttcttcgatttaccactcccgtggacctcaggcgcaacaactgaaacaccaacatggaatcgtaaagaacttctagtcacatttaaaaacgcacacgccaagaaacaggaagttgttgttctaggttcgcaggaaggtgccatgcacacggcgttaaccggcgctacagaaatacagaacagtggcggaacgagtatttttgcagggcacttgaaatgccgcttaaaaatggataaactggggttgaaaggtatgagctacgcgatgtgcacaaacacttttgttctcaagaaagaagtgtctgaaacacaacatggcacgatcttaataaaagtagaatataaaggggaggacgtcccgtgtaaagtcccattcagtacagaagatggacagggtaaagcacactctggacgcttaataactgccaatcccgtagtaaccaagaaagaagaaccagtaaatatagaagctgaacccccatttggagagtcgaatattgtcatcggaattggagataatgcactaaaaatcaactggtataagaaagggagtagcatcggaaaaatgttcgaagcaacggcgagaggagcaagacgaatggcaatactaggagatacggcttgggattttggatcagtcgggggtgttctaaatagtctagggaaaatggtgcaccaaatcttcggtagtgcatacacagccctattttcaggagtttcttgggtaatgaaaataggtataggaatcctactcacatggataggactaaatagcaaaaatacttccatgagcttttcatgcattgtgataggcataatcactctatatctaggagcagtcgtacaggcagatatgggatgtgtaattaattggaaaggaaaagaattaaaatgtggttcgggaatatttgtcacaaatgaagtacacacatggaccgagcagtataaatttcaagccgacagtcccaaaagattggcaaccgccatcgcaggggcttgggaaaacggcgtatgtggaatacgtagcactacccgaatggaaaatttattatggaaacaaatagcgaatgaattaaattatattctatgggaaaacaatataaaactaacagttgtagtcggcgacataattggagtattagaacaaggcaaacgcacacttacaccccaaccaatggaattaaaatatagttggaaagcatggggtaaagcgaaaatcgtaaccgcagaaacacagaacagcagcttcataatcgatggaccaaacacaccagaatgtccaagtgcctcacgagcatggaacgtatgggaagttgaagactacggattcggagtatttaccacgaacatttggctaaaattgcgcgaagtctacacgcaattatgcgatcataggctcatgtcagccgcggttaaagacgaaagagcagtccatgctgatatgggctactggatagaatctcagaaaaacggtagctggaaactagaaaaagcaagtctcatagaggttaaaacatgtacttggccaaaaagtcatacactttggtcaaatggggtattggaatctgatatgattatacctaagagcttggcaggacccataagtcagcataactatcgtccgggatatcatactcaaactgcgggaccgtggcacctaggtaaactggaacttgattttaactattgtgaaggcacgacagtcgtcataactgaaaactgcggaactcgtggccctagtttacgaaccactacagttagcggcaaactgatacatgaatggtgttgtagatcctgtacgttacccccactgcgatacatgggagaggatggatgttggtacggtatggaaatacggcctattagcgaaaaagaagaaaacatggttaaatctctagtatccgcgggttcgggcaaagtagataactttacaatgggtgtattatgccttgcaatcctttttgaagaagtcatgagagggaaatttggcaagaaacacatgattgccggagtgttctttacattcgtcctcttgttatcaggacaaatcacatggagagacatggcacacacattaataatgattggtagtaatgcgtctgacagaatgggcatgggagtaacatacctggcacttatcgcaacattcaaaatccaaccatttctagcactggggttcttcttacggaaactaacatcccgagaaaatcttctattgggggtaggactagcgatggccaccacgcttcaacttcccgaggacattgagcaaatggccaatggtatagcgctaggtctcatggctctaaaattgataacacaattcgaaacttatcagctatggactgcgctcatttcgctaacatgttcaaataccatttttacgctaacagtggcatggaggacagcaacattaatacttgctggggtatcattattaccagtttgtcaaagctccagcatgagaaaaacagattggttacctatgacagtcgcagcaatgggcgtaccaccattaccgttatttatcttctcactaaaagatacactaaaacgtagaagttggcctctaaatgaaggagttatggctgtggggttagtctcaatactagctagctccctcttaaggaatgacgttccaatggcaggacccctagtagccggaggtctcctaatcgcctgttatgttattaccggcacgagcgcagatctcacggtcgagaaagcggcagacgtgacctgggaagaagaagctgaacaaactggcgtatcacacaacctaatgataaccgtcgatgatgacggaaccatgcgtataaaagacgatgagaccgaaaatatcttaacagttcttctaaaaacagctttactaatagtgagtggtatatttccatattccattcccgcgactctcttagtatggcacacttggcaaaaacaaacacaaagaagtggcgtcctctgggatgtgccgagcccacctgagacccagaaagcagagctggaagaaggtgtatatcgtatcaaacaacaaggaatattcggaaaaacacaggtaggagtcggagtacaaaaagaaggtgtattccatacgatgtggcatgtcacacgaggagcagtactaacttacaatggtaagagacttgagccaaattgggccagcgttaagaaagaccttatctcatacgggggaggatggcgcctaagtgcacagtggcagaaaggtgaagaagtccaagtaattgctgtcgaacctggaaagaaccccaaaaacttccaaacgatgcccggaacgttccaaacaacgacgggtgaaataggagctatagctctcgactttaaacctggaacatctgggagcccaataataaatagggaaggcaaagttgtaggtctatacggaaatggtgttgttaccaaaaatggaggatacgtttccgggatagctcaaactaacgctgagccggatggcccaacaccggaactagaagaggaaatgtttaaaaagcggaatctaacaatcatggatctacacccaggaagcgggaagacccgtaaatacctaccagctatcgtacgggaagcaatcaaaaggaggttgcggactttaatcttagcaccgacgagagttgtagctgctgagatggaagaggctttaaaaggattaccaatcaggtaccaaaccacagctaccaaaagtgaacatacaggaagagaaatagttgatttaatgtgtcatgcaacctttaccatgcggctgttatcgccagtaagagttcctaattataacctcatcattatggacgaagcacactttactgatcctgcctccatagccgcacgtggctacatctcaacaagagtagggatgggggaggcagcagctatttttatgacagctacgccaccaggaacagcagatgcattccctcaaagcaacgcacctattcaggatgaagaaagagatataccggaaagatcatggaatagtggcaatgaatggataacagactttgcgggaaaaactgtctggtttgtccccagtataaaggcgggaaatgatattgcgaattgcttgcggaaaaatggtaagaaagtaatacaattaagcagaaaaacttttgatacggaataccagaaaactaagttgaatgactgggacttcgtcgttacaaccgacattagcgagatgggagctaactttaaagcagacagggtaatagatcctcggaggtgtctcaaaccagtcattctcaccgatggacctgagagagtaatattagctggaccaatgcccgtaacggctgctagtgccgctcaacgtagaggaagagtaggcaggaatccgcagaaggagaacgaccaatatatatttacaggacaacctctaaataatgatgaggaccatgcccattggactgaagcaaaaatgttgttagacaatatcaatactccagaagggataatacctgctctctttgaaccagaaagagaaaaatcggcagccattgatggagaatatcgacttaagggcgaaagtagaaaaactttcgtagaattaatgaggcgtggtgatttaccagtttggctggctcataaagtcgcatcagagggtataaaatacaccgaccgaaaatggtgcttcgacggccaacgtaataatcagattctagaagaaaacatggatgtagaaatatggacgaaagaaggagaaaagaagaaactacgcccgcgatggctagatgcaagaacctattcagatccattagcgttaaaagaatttaaagactttgctgcaggtagaaaatctatagcgctagacctcgtaacagagataggacgggtgccatctcatctcgcacatagaacaagaaacgctttagacaacttagtaatgctccacacttctgaacacggtggccgtgcctatcgtcacgctgttgaagaactccccgaaactatggagaccctgctgctactgggattaatgatcttattgactggcggagccatgttgtttttaatctctggtaaaggcataggtaaaacatctatcggattgatatgtgttatagccagcagtggaatgctatggatggcggagataccacttcaatggatagccagtgcaatagtattagaatttttcatgatggtcctattaatcccggagcctgaaaaacaacgtacaccgcaagataaccagttggcttatgtagtaatcggtattctgacactagcagcgataatcgccgctaacgaaatgggattattagaaacaactaagcgtgacctcggtatgagtaaggaacccggggtagtctcaccgacttcttaccttgacgtggatttacatccggcaagtgcctggacgttgtacgcagtagccacaacagtaataacacccatgttaaggcataccatagagaactcgacagctaacgtaagtttagcagcaatagcaaatcaggccgtagttttaatggggctagacaaaggttggccaatatcaaagatggatctgggggtgccactacttgccctcggatgctattcacaggtaaaccctttaacattaactgcggccgtattacttttaataactcactatgctataataggtccgggattgcaagctaaagcaactcgtgaggcacaaaaacgaacagctgcaggtattatgaaaaaccccaccgtagatggaattatgactattgatttagatccggtaatatatgatagtaaatttgagaaacaattagggcaggttatgcttttagtactatgcgcagtacaacttttacttatgcgaacgtcgtgggctttgtgcgaagctctaacgctcgctactggaccaataacaacactatgggagggaagcccgggaaagttctggaatacgacaattgccgtcagtatggcaaacatcttcagaggaagttatctcgcgggcgctggattggcgttcagtataatgaaatcagtaggaacaggaaaacggggcactggaagtcaaggtgaaacccttggagaaaagtggaagaaaaagctgaaccaattatcccgaaaggaatttgacttatacaagaaatcgggaataacggaggtagatagaactgaagctaaggagggtttgaaaagaggtgaaataacccaccacgctgtttcaaggggttccgcgaaactacaatggttcgtagaacggaacatggttattcccgaaggtcgggtcattgaccttggttgtggaaggggaggctggtcgtactattgcgccggtctaaagaaagttacagaggtgaggggctacacaaaagggggccccggtcacgaggagcctgtccctatgagcacttatggatggaatattgtcaaacttatgtcaggaaaggatgtattctatctcccaccagagaagtgtgatacactcctctgtgacataggagaaagttcaccaagtccgactgtagaagaatccagaacaattcgtgtgctgaaaatggtagagccttggttgaaaaacaatcaattctgtataaaggtgctaaacccttacatgccgacagtaattgaacatttagagcgcttacaacgaaaacatggagggatgctcgtacgaaatccactaagcagaaactcaacgcatgaaatgtactggatatctaacggcacgggtaatatcgtcgcatcagttaatatggtatctagattactacttaacagatttactatgacacacaggagacccactattgaaaaggacgtcgacctcggagcaggaacacgacatgtcaacgcggaacctgaaaccccaaatatggatgtcataggtgaaagaataaaaagaattaaggaggaacataacagtacatggcattatgacgatgagaacccttataaaacatgggcatatcacgggtcatacgaggtaaaagcaactggcagtgcatcctcaatgattaatggagtcgttaaattactcactaaaccatgggacgtggtgcctatggtaacacagatggctatgacagatacaacacctttcggacaacagcgcgtctttaaagagaaagtagacacccggacaccccgatcaatgccggggacccgacgggtaatgggaattacagcagaatggttatggcgtacattaggacggaataagaaaccacgactatgtactagagaagaatttacgaaaaaggtaagaacaaatgcagcaatgggtgcggtttttacagaagaaaatcagtgggactcagcaaaagccgcagttgaagatgaagacttttggatcttagttgatcgagaaagagaattacacaagttaggaaagtgtggatcttgcgtttataatatgatgggtaaaagagagaagaaacttggagaatttggtaaagctaaaggttctagagcaatatggtacatgtggcttggggcccgatatttagaatttgaagctctaggatttttaaacgaagatcactggtttagtcgagaaaactcttattccggagttgaaggggaaggattacataaactaggctacattttaagggacatatctaagatacctggtggagccatgtacgcggacgacacagcaggatgggatactcgtattacggaggacgatttgcataacgaagagaaaataacccaacaaatggaccccgaacatcgacaactggcttctgccatattcaaattaacttaccagaacaaagttgtcaaagttcaaagacccacaccaacgggcactgtaatggacattatttctagaaaggatcagagaggttccggacaggtcggaacttacggattaaatacgttcacgaatatggaggcgcagctaataagacaaatggaaggagaaggggttctcagtaaggctgatctggaaaatccacatcttcctgagaagaaaataacacaatggttagaaacaaaaggcgtagaacggctaaaaaggatggcaattagtggcgacgattgtgtggtaaaacccatcgatgacaggtttgcaaatgctttattggctctaaatgatatggggaaagttaggaaggacatacctcagtggcaaccatctaaaggctggcatgattggcagcaagtgcctttttgtagtcaccattttcacgagttaataatgaaagatggccgaaaacttgtagttccctgcagaccacaagacgaacttataggacgagccagaatctcacaaggagcagggtggagcttaagggaaaccgcatgcttgggtaaagcgtacgctcaaatgtggtcactaatgtattttcacaggcgggaccttcgattagcgtccaatgcaatctgctctgcagttccagtacattgggtaccgacaagccgaacaacatggtcaatacatgcacaccatcaatggatgacaaccgaagacatgttaacggtatggaatagagtttggattgaagacaatccttggatggaagataagacacctgtcacaacatgggaaaacgttccctatctcggaaaacgcgaagaccagtggtgtgggtcattaatagggttgacgagtagagccacgtgggcgcaaaatatacctacagcaatacagcaggtacgcagcctcataggaaatgaagaatttctagattacatgccgtcaatgaaaagattcagaaaggaagaagaaagtgaaggagctatctggtaa

SEQ ID NO: 23308 - RNA, 9873 nt, synthetic construct
  misc_feature 1..9873: note = derived and/or modified CDS sequence (opt6) from DENV-3__EU596492__SS-prME
  source 1..9873: mol_type = other RNA
acatcgctgtgtttaatgatgattctaccagcagcgttagcctttcaccttacctccagagatggcgaaccaaggatgatcgtaggtaaaaatgaacgcggcaaatctttactgtttaaaacagcaagcggaatcaacatgtgtacgttaatcgcaatggatttgggggaaatgtgtgacgatactgtaacatacaaatgtccacatattgcagaagttgaacccgaagatatcgattgctggtgcaatcttacgtcgacatgggtaacctatggcacatgcaatcaagcaggcgaacacagaagagataaaagaagtgtggcattagctcctcatgtaggtatgggattagacacacgaactcaaacatggatgtctgctgaaggggcctggagacaagttgaaaaagtagaaacatgggctctacgacatccaggatttacgatattagccttgtttcttgcacattacattgggacgagtttaacccaaaaagtggtcatttttgtcctacttatgcttgtaaccccatccatgacaatgagatgcgttggagttggaaacagagatttcgtagaaggattaagtggtgcaacatgggtcgacgtagttctggaacacgggggatgtgtcaccactatggccaaaaataaaccaacgttggacatcgaactacagaaaactgaagcaacacaactagcaacacttagaaaattatgtattgaaggaaaaataacaaatattacgactgatagtaggtgtcctactcaaggggaagcagccttgcctgaggaacaagaccaaaactatgtctgcaaacatacctacgttgacagaggttggggtaacggatgtggacttttcggtaaaggatccctagttacgtgtgcgaaatttcaatgtttagaaccaatcgaaggaaaagtagtacaatatgaaaacctcaaatacacagttataattacagtccacacgggtgaccaacatcaagtgggtaatgagacccaaggagttacagcagaaatcacccctcaggcgtccacaacagaagctatacttcctgaatatggtacattagggttagaatgtagccctcggactggtcttgacttcaatgaaatgattctcctaacaatgaaaaataaagcgtggatggtacacaggcaatggtttttcgaccttccattaccttggacttcaggggccacgacagaaacacctacgtggaatcgaaaagaactactcgtaacatttaaaaacgcacatgcaaagaaacaagaagtcgtcgtcttagggagtcaagaaggggcaatgcataccgccctaacaggggctaccgagattcaaaacagtggaggaacttcgatatttgctggacatctgaaatgccgcctaaaaatggataaactagagttgaaagggatgagttacgccatgtgtacaaatacatttgtactcaagaaagaagtatctgaaactcaacacggaaccatactcataaaagttgaatacaaaggtgaagacgctccctgtaaaatccctttttccacagaagatggtcaagggaaagcacataacggacgactcatcacagcaaaccctgtagtgaccaagaaagaagaaccagtaaacattgaggcggaacctcctttcggggaatcgaatatagtgatcggaataggagacaacgccctaaaaataaattggtacaagaaaggttcaagtataggaaaaatgttcgaggctactgcacggggcgctagacgaatggcaatcctaggtgacactgcttgggattttggttccgtagggggagttctaaattcactaggtaaaatggtacatcaaatatttggttctgcatataccgcacttttctcaggtgtatcgtgggttatgaaaataggtatcggtgttctactaacttggataggattaaatagtaaaaatacgagtatgagtttttcgtgcattgcaataggtataataactttatatctaggtgcagtagtgcaagctgatacagggtgtgttgtcaattggaaaggaaaagaattgaaatgcggaagtggaatatttgtaacgaatgaggtccatacatggacggaacaatacaaatttcaagccgacagtcccaaacgacttgcaactgcaatagcgggtgcatgggaaaatggagtttgcgggataaggtccacgacaagaatggagaatttattatggaagcaagttgcaaatgaattaaactatatattatgggagaacaatattaaattaacagtggtcgtgggcgacataatcggagttcttgaacaaggcaaaagaaccctaacaccacaaccaatggaacttaaatatagttggaaaacctggggtaaagcaaaaatcgtcactgcggagactcaaaattctagttttatcatcgatggccctaatacacctgagtgcccgtcagcatcaagagcatggaacgtctgggaggtagaagactacggctttggggtatttacaacaaatatttggctaaaattaagagaggtgtacactcaactctgcgaccacagattgatgtcagctgcagttaaagacgagcgcgccgtacatgcagacatgggatattggatagaatcgcagaaaaatggatcatggaagctagaaaaagcatctttaatagaggtaaaaacttgcacttggccaaaaagtcatacattatggtccaacggggttctcgaatcagacatgataattcccaaatcacttgcaggaccaataagtcaacacaactatagacccggctatcacacacaaacagccggaccatggcacctaggtaagttggaattagactttaactattgtgagggaaccacagtagtcataactgaaaattgtgggactagaggtccatcattacgcaccacaaccgtctctggaaaacttattcatgagtggtgttgccgatcttgcactttaccacccttacggtatatgggtgaagatggttgctggtacggaatggagataagaccaatatcagaaaaggaagaaaacatggtaaaaagccttgtttctgcaggatcaggtaaagtcgataattttactatgggagtactatgtttagctatactttttgaggaagtaatgagaggaaaatttgggaagaaacatatgatagctggggtctttttcacctttgtgctcttactatcggggcaaattacatggcgtgatatggctcatacactaattatgataggatcaaacgcttccgaccgaatgggaatgggggtaacatatttggcgcttattgccacattcaaaatccagccattcctcgcactaggattctttctcaggaaattgacatccagagaaaatttattattaggcgtaggtcttgcaatggcaacaacattacaacttccagaagatattgagcagatggccaatgggatcgcactaggcctaatggcattaaaactaataacacagtttgaaacttatcaactatggacagccctaatctcacttacctgttctaataccatattcaccctaaccgtagcatggaggactgccactctgattctggcaggcgttagtttgttaccagtatgccaatcctcgtcaatgcgaaaaagcgactggctacctatgactgtcgctgctatgggtgttccaccgctcccgctattcatattttcactaaaagatacgctaaaaagaaggtcctggcctttaaacgaaggggtaatggcagtaggattggtctcaattctcgcttcttcgcttttacgaaatgatgtaccgatggcaggtcccttagtagcaggaggtctgctaatagcgtgttatgttataactggaacctcagctgatctaacagtagagaaggcagcggatgtaacatgggaagaggaagcagagcaaacaggagtatcccacaacctaatgataacagtggatgatgacggaacgatgcgtataaaggatgacgaaacggagaacatactcacagttctactaaaaactgccctcttgattgtttccggtatctttccctatagcataccagcaacactgttggtatggcacacttggcaaaaacaaacccgccgatcaggtgttctatgggatgtgccgtccccacctgaaacacaaaaggctgagcttgaagaaggagtatatagaataaaacagcagggaatattcgggaaaacgcaagtaggagtaggcgtacaaaaagaaggcgtatttcacactatgtggcatgtgacaagaggcgcagtactaacctataacggaaaaagattagagcctaattgggcaagcgtcaagaaagatctaataagctacgggggcggttggaggctgagtgcccaatggcaaaaaggtgaggaagtgcaagtcatagctgtcgagccggggaaaaacccgaagaacttccagactatgcctggtacatttcaaactacgactggagaaatcggggcgatagcattagattttaagcctggtacgagtgggagtccaataataaaccgagaaggcaaagttgtggggttatacggaaacggtgtggtaactaagaatggcggatatgtaagtggaatagctcaaacaaacgcagaacccgacgggccaactcctgagttggaagaggaaatgtttaaaaagagaaatttgactataatggatctccatccaggttcaggaaaaacccggaagtatctccctgccattgttagggaggcgataaaacgacggttaaggacattgatattggcaccaacaagagtagttgctgcagaaatggaggaagccttaaaagggcttccgattcgatatcaaacaacagcaacaaaatcagaacatacaggtagggaaattgtcgacttgatgtgtcatgcgactttcacaatgcgactgttatctcctgtacgagtgccgaattataacctcatcatcatggacgaagcacactttaccgaccctgcttctatagcagccaggggatatatctctacgagagtcggaatgggtgaagcagccgcaatattcatgactgcgaccccgccgggaacagccgacgcatttccccagagcaatgcaccaattcaagacgaagaacgagatatacccgaacggtcttggaactcgggaaatgaatggataacagattttgctggaaagactgtttggttcgttccctcaattaaggccggcaacgacatcgcgaattgcttgcgaaagaacggtaagaaagtaatacaactgagcagaaaaacctttgacacagaatatcagaaaactaaactaaacgactgggactttgtcgtaactactgatatatctgaaatgggtgctaactttaaggcagatcgagttatcgatcctagaagatgcctgaagcctgtaatactgacagatggacccgaacgagtaatattagcaggccctatgccagtcacggctgcttccgcagcgcaaaggcgagggcgtgtgggtagaaatccacaaaaagaaaatgaccagtacatcttcacgggacaaccgttaaataacgacgaagaccatgcacactggactgaagctaaaatgctactagataacattaacactcccgaagggataatccccgcattattcgaaccagaaagggagaaatcagctgctatagacggagaatataggttaaaaggagaatcaaggaaaacttttgtagaattaatgagaagaggagacctaccagtatggcttgcacacaaggtcgcgagcgagggcattaagtacacggatcgaaaatggtgcttcgacggtcaacgcaacaatcagatcttagaagaaaacatggatgtggaaatctggactaaagaaggcgagaagaagaaattaagaccgagatggttggatgcacgaacatattcagatccactcgcattaaaagaatttaaagatttcgccgcggggcgtaagtcaatagcattagatttagttacagaaataggccgagtaccatctcatctagcacatagaaccagaaatgctttagataacctagtaatgctgcatacctcagagcatggagggaaagcgtacagacacgcagttgaagaacttcccgaaaccatggaaacactcttattattgggccttatgatattactaaccgggggagcaatgttatttctaataagtggcaaaggtatagggaagacgagcatcggattaatctgtgtaatagcgtcaagtggtatgttatggatggcagaaattccgctacaatggatagcctctgcaatagtattagaatttttcatgatggttcttctcattcccgaaccagagaaacaaaggaccccacaggacaaccagttagcatacgtagttataggtattttgacattagctgcaattatagcggcaaatgaaatgggtctcttggaaaccactaagcgcgatttaggaatgtcgaaagaacccggagtagtttcccccacgtcttatctagatgtagatttacacccagcatcggcatggactctatatgccgttgcgactacagtgatcacaccaatgctcagacatacgatagaaaactctacagcaaacgtttctttagcagcaatcgcgaatcaagcagtagtactaatgggacttaataaaggatggccaatttctaaaatggatttaggagtaccactacttgcattagggtgctactcgcaagtcaatccgctaacacttactgccgctgtgttacttttaattacgcattatgcaataataggaccagggcttcaagctaaagcgacaagagaagcccagaaaagaacagcagctggtataatgaagaatccaacagtcgatggaataatgacaatagatttagatccagttatttatgacagtaaatttgagaaacaactcggtcaggtcatgttattagtgctttgcgcagttcaattattgctaatgcggaccagctgggccttatgcgaggccttaacacttgcaacaggcccgataacaacgctttgggaagggtcgccgggaaagttttggaacaccaccatagcagtcagcatggctaatatatttcgtggatcctacttagccggcgcgggacttgcttttagtataatgaagtcagttggaacaggaaaacgcggaactggatcacaaggggaaactcttggagagaaatggaaaaagaaactcaaccagttgtcacggaaggagttcgatttgtataagaaatccggaatcactgaggttgataggacagaagcaaaagaaggactcaagcgaggagaaattactcatcatgctgtatcacggggatctgcgaaacttcaatggtttgtggaaagaaatatggtcattcccgaaggcagggtcatagatctaggatgcgggaggggcggatggagttattactgtgcgggtctaaagaaagttacagaagtccgaggttatactaagggtgggccagggcatgaggaacctgtaccaatgtcgacgtacggctggaatatagtgaaattaatgagtgggaaagatgtgttctacctaccaccagaaaaatgtgacacactactctgtgatataggcgaatcaagtccatcaccaacagttgaggaatcgagaacaattcgcgtcttaaaaatggttgaaccatggctgaaaaataaccaattttgcataaaagtactaaatccatatatgccgacagttatcgaacatctagaaagactacaacgcaagcatggaggtatgttggtcagaaatcctttaagtaggaacagtacccatgagatgtattggatcagcaacggaactggcaatattgtagcttcagtcaacatggtgtcaaggcttttgcttaatcgttttacaatgacgcaccgacggcccacgatagaaaaggatgtcgatctaggagcaggtacgcgccatgtaaatgcagaaccggaaactcctaacatggacgtaattggagaacgtattaaaagaataaaggaagaacacaattcaacatggcactacgacgatgagaacccttataaaacctgggcgtatcatggatcgtacgaagtaaaagcaacaggaagtgctagttccatgataaatggggtcgtcaagttactaactaaaccatgggatgtcgttcccatggttacccaaatggccatgaccgataccactccatttggtcaacaaagagtatttaaggaaaaagttgatactagaacgccaagaagtatgcctggaacacgtagagtaatgggaattactgctgaatggctatggcgaaccctaggtcggaacaagaagcctcgactttgtacaagagaagagttcacaaagaaggttcgcacaaacgcagcgatgggagcggtgttcactgaggagaatcaatgggattctgccaaagctgctgtagaagacgaagatttctggaaacttgttgatcgcgaaagggaactacataaactagggaaatgtggatcatgtgtatataatatgatgggtaaaagagagaagaaactcggtgagttcggaaaagcgaaggggagcagggcaatatggtatatgtggctcggtgcaaggtatttggaatttgaggcactcgggtttcttaatgaagaccattggtttagtagagaaaactcatactcaggtgtcgagggagaaggactccataagctaggatatatactgcgagatattagtaagataccaggaggggccatgtatgctgacgataccgctggatgggatactcgaataactgaagatgatctacataatgaagagaaaataacacaacaaatggatccagaacatcggcaactagcgaatgcaatttttaaactaacatatcaaaacaaagttgtaaaggtacaaagaccaaccccgactggtacagtaatggatataatctcgaggaaggatcagcgcggaagtggtcaagttggtacatacggacttaatacgtttacaaacatggaggcacaattaattcggcaaatggaaggtgagggtgtcctaacaaaagctgacctagaaaatccgcacctatcagagaagaaaatcacacagtggcttgagactaaaggcgtagaaagacttaaacgtatggcgattagtggagatgattgcgtcgtaaagccaatagacgatcgttttgctaatgccctgctagcactcaacgatatgggaaaggttcgaaaagacatgccacaatggcaaccttcgaagggatggcatgactggcaacaagtccccttttgttctcatcacttccacgagctcataatgaaagatggcagaaaacttgtagttccctgtagaccacaggatgaactaatcggcagagctaggatctctcaaggcgccggctggtctctgcgggaaacggcttgtcttgggaaagcatatgcacaaatgtggtcactcatgtattttcatcgacgggacttaaggttggcttctaatgccatatgttcagccgttcctgtgcactgggtcccaacatctagaacgacgtggagtatccatgcacatcaccaatggatgactactgaagacatgctcacggtgtggaaccgagtttggattgaagataatccctggatggaagacaaaactccagtaacaacgtgggaaaatgttccgtacctcggaaaacgagaagatcaatggtgcggcagccttataggattaacatcaagagcaacatgggcccaaaacattccaacggctattcaacaggtacgaagtctaataggaaatgaagagttcctagattatatgccttcaatgaaaaggttcagaaaagaggaagaaagtgagggtgctatatggtaa

SEQ ID NO: 23309 - RNA, 9873 nt, synthetic construct
  misc_feature 1..9873: note = derived and/or modified CDS sequence (opt6) from DENV-3__EU596493__SS-prME
  source 1..9873: mol_type = other RNA
acatctttatgcttaatgatgatattacctgccgcattggcattccatcttacatcacgtgatggtgaaccccgtatgatagtagggaaaaatgaacgtggaaaatcgttactcttcaaaacagcttctggtataaatatgtgcactttgatagcaatggatttaggcgaaatgtgtgatgacactgtgacttataaatgtcctcacatagcagaagttgaacccgaagatatcgattgctggtgtaatctgacgagtacatgggttacgtatggtacttgcaatcaagcaggagaacatagaagagataaaagatcagtcgccctggctccgcatgtgggaatgggcctggacacgcgtacgcaaacatggatgtccgctgaaggagcttggcggcaggttgaaaaagtagaaacctgggcactacgacatcctggtttcaccattttagcgctatttctagcgcactatataggcacatcacttacacaaaaagttgtgatatttgtgttactgatgctagtcactcctagtatgactatgcgatgtgtaggagtgggaaatagagactttgtggagggcttaagcggcgcaacttgggtcgacgtggtactcgaacatggaggatgtgtgacaactatggccaaaaataaacccacccttgacatagaactccagaaaaccgaagccacacagctcgcgacattgagaaaattatgtattgaaggtaaaatcactaatataaccacggactccagatgtcctacacagggagaagccgtattaccggaagaacaggaccaaaactatgtatgtaaacatacttatgttgatagaggatggggaaatggctgtggtctctttgggaaaggatcattggtaacgtgcgcaaaatttcaatgcctggaaccaatagaaggtaaagtggttcaatatgaaaatttaaaatatactgtaataataacagttcataccggcgatcaacatcaagttggaaacgaaactcaaggggtcacagcagaaataaccccgcaagcgtcaaccacagaagcaatcttaccggaatacggaacgttaggcctcgagtgctccccacgcacaggattggatttcaatgaaatgatacttttaactatgaaaaataaggcttggatggtgcatagacaatggttctttgatttaccacttccttggacctctggagcaacaactgaaacgccgacatggaatcgtaaagagctgctggtgacttttaaaaacgcacatgctaagaaacaggaagtggtagtacttggttctcaagaaggtgccatgcatacggcacttacaggagcaacggaaatacaaaattcaggagggacaagtatatttgcaggacacctaaaatgccgattaaaaatggacaaacttgaactcaaaggaatgagttatgctatgtgcacaaataccttcgtcctaaagaaagaagttagtgaaacccaacacggtacaatcttaattaaagtagaatataaaggtgaggacgctccatgtaaaataccttttagtaccgaagacggccagggaaaagctcataacggtaggttaataactgctaacccagtagtgaccaagaaagaagaaccagttaacatagaggctgaaccgccattcggggaatcaaatatagtaatcggaataggcgacaatgccctaaaaataaattggtacaagaaaggaagtagtattggaaaaatgttcgaagctacggccaggggagcacgcagaatggcaattctaggtgatactgcctgggactttggatccgtagggggagtactaaattctttgggaaaaatggtgcatcaaatattcggttctgcctatacggcgctttttagtggagtatcgtgggtgatgaaaattggtatcggagtgctcctgacttggattggattaaacagtaaaaacacgtctatgtccttcagctgtatagcaataggtatcataacactatatttaggagccgtagtacaggcagatacaggatgtgtaatcaactggaaaggtaaagaactgaaatgcggatctgggatttttgtcacaaatgaggtacacacctggaccgaacagtataaattccaagcagacagcccaaagcgacttgcgacggccatagctggtgcatgggagaatggtgtatgtgggatcagaagcaccacacggatggaaaatctgctgtggaaacaagttgcaaatgagctgaactacatactatgggaaaataacataaaattaaccgtcgtcgtcggagatattattggggtgttagagcaaggaaaacgaacattgaccccacaacctatggaattaaaatatagctggaaaacctggggaaaagcaaaaatcgtaacggcagagacacaaaacagctcttttattatagatggtccgaatacacccgaatgtcctagtgcatcgcgagcttggaatgtgtgggaagtagaggattacggctttggcgtgtttactactaatatctggttgaagttacgagaagtatacacacaattgtgtgatcacagactaatgagtgcggctgtaaaagacgaaagagctgtgcatgcagacatgggctattggattgaatcacagaagaatggatcatggaaactggaaaaagcctccctgatcgaagttaagacctgcacgtggccaaagtcacatacgttatggagtaacggagtcctagaaagtgacatgataatccctaagagtttagccgggcccataagtcaacacaattatcgacctggataccacacacagacagccggaccatggcatcttggaaaactcgagttggatttcaattattgtgaaggtacgacggttgtcataacagaaaactgcggaactagagggccaagtttgaggaccacaaccgttagcggtaaattaattcatgagtggtgttgtagaagctgtacattaccaccgcttcggtatatgggtgaagatggatgctggtacggcatggaaatacgacctatttcggaaaaggaagaaaacatggtaaaaagcctagtttcggccggatctgggaaagtagacaatttcaccatgggcgtactatgcctcgcaatattatttgaagaagttatgagaggaaaattcggaaagaaacatatgatagctggtgtattctttacttttgttctcctcctaagtggtcagatcacttggagggacatggcccacactcttataatgataggttcgaatgccagcgatagaatgggtatgggagtgacatatctagctttaatagcaacgtttaaaattcaacctttcctagcactaggctttttcttaagaaaattgacaagccgcgaaaatttgcttctaggggtcggtctagcaatggctaccaccctgcaattacccgaagacatagagcaaatggctaatggtatcgcattgggattgatggcccttaaattgataacacagtttgagacataccaactctggactgctctaatttcactaacgtgttcaaacacaatctttacccttacagtggcatggcggacagcaacactaatattagctggagtaagcctcctcccggtatgtcagtcatcgtcaatgcgcaaaagtgactggttgccgatgacggtagcagccatgggagtgccaccactaccactgttcatattttcactaaaagacactttaaaaaggcggtcttggcctttaaatgaaggagtaatggctgtgggtctagtatcaattttagcgtcatcccttttgagaaatgacgtcccgatggcgggacctttagtagcaggagggcttttaatagcttgctatgttatcactggaacgtcagccgacttgactgtcgaaaaagcagctgatgtcacatgggaagaagaagcagaacaaacaggtgtatcgcataaccttatgataacggtagacgatgatgggacgatgagaataaaagatgacgaaacggaaaacatcttgacagtattactaaaaactgctttactcatcgtcagtggcattttcccttattctataccagcaacgcttctcgtttggcatacatggcaaaaacaaactagaaggagcggggtactctgggatgttccgtcaccaccggaaacacaaaaagccgaattggaagagggtgtatacagaattaaacagcaaggcatatttggaaaaacccaggtcggagtaggggtacagaaagaaggtgtcttccatacgatgtggcatgttacgcgaggagctgtcttaacatacaacggaaagagattagaacccaactgggcgagtgtcaagaaagatttgatttcgtatggaggtggttggagacttaatgcacaatggcaaaaaggagaggaagttcaagtaatagccgtggagccgggcaaaaaccctaaaaatttccaaacaatgccagggacatttcaaactactacaggggaaataggcgcaatagcgttagattttaaaccgggcacgagtggatcacctatcattaatagagaagggaaagtagtcgggttgtacggtaatggcgtggtaacgaaaaatggaggatatgtgagtggaatagcgcaaaccaacgctgaacctgatgggcctacacccgaactggaagaggaaatgttcaagaaaaggaacttaacaatcatggatctacatcctggctccggtaaaacaagaaagtatttgcctgctatcgtacgagaggccataaaaagaagattgcgaacattaatactagcacccactagagtagtcgctgcagaaatggaagaggccctaaaaggcctaccaatacgctaccaaactactgctaccaaaagtgaacatacggggagagaaatcgtagatctaatgtgccacgccacctttaccatgagattactttcaccagtccgcgtgccaaattataatttaataataatggacgaagcgcacttcactgatcccgccagcatagcagcccggggatacatcagtacaagggtcggaatgggagaggccgcggcgatattcatgacagcaacgcccccagggactgcagatgcatttccacaatcaaacgcaccaattcaagacgaagaaagggatattccggaacgctcgtggaactcaggtaacgaatggatcacggattttgctggtaaaacagtctggttcgttccctccattaaggctggaaatgatattgcaaactgtctacgtaagaacgggaaaaaggtcatacaactttccagaaaaacctttgatacggaatatcagaaaacaaaattaaacgattgggactttgttgtcaccacagacatatcagaaatgggagcaaatttcaaggcggaccgagtaattgatcccaggagatgtttgaagcctgttatacttacggacggacctgaacgtgttatactcgccggtccaatgccagttaccgctgcttccgcggcacaaagacgtggtcgagtcggtaggaatccacagaaggaaaacgatcagtatatatttacaggacaaccccttaacaatgatgaagaccatgcacactggactgaggcaaaaatgttactagataatatcaacacaccagaaggtataattccagcattattcgagcctgaaagagagaaatccgcggcaatagatggggaatatcgattaaaaggggaatcaaggaaaacgttcgtagagctcatgaggagaggtgatcttcccgtatggctagctcataaagtagcgagcgagggtattaaatatactgatagaaagtggtgctttgatggacaacgtaataatcagatattggaagaaaatatggacgtcgaaatctggacaaaagaaggagagaaaaagaaattgcgaccacgatggctagacgcacggacttactcagatccgttagctctaaaagaatttaaggattttgcagctgggcgaaaatccattgcactagacttagtcactgaaataggccgcgtcccatctcacctggcgcatcgaactcgtaacgcactagataatcttgttatgctacatacttcggaacacggtggtaaagcgtaccggcatgctgtagaagaactaccagaaacaatggaaactctacttctgctaggattaatgatactgctcactggtggcgcaatgctctttctaataagcggaaaaggcataggaaagacaagtatcggtcttatatgtgtaattgcgtcttctgggatgttatggatggcagaaattccactgcaatggattgcatcagctatagtactggagttctttatgatggtcttacttattccagaacccgaaaaacagagaacaccgcaggataaccagctagcttatgtagtaattggaattttaactttggctgcaataatcgcggccaatgaaatgggactactagaaacaacgaaacgagacttaggaatgtctaaagaaccgggagtggtcagccctacttcctaccttgatgtggacttgcaccctgccagtgcgtggacactttatgcggtggctacaacagtaatcacacctatgctacgacacacaattgaaaactcaacagctaacgttagtctggcagcgatcgcaaaccaagcagtagttctaatgggactagataaaggttggccaatttccaaaatggatctaggagtacccttattagccttgggatgttatagccaagtaaatccactgacattgaccgcagccgttttattattaatcacccattatgcgatcattggaccaggcttgcaagcaaaggcaactcgagaggctcaaaagagaacagccgcaggaataatgaaaaatccaactgtcgatgggataatgacaattgatctggatccagtaatctacgattctaaatttgaaaaacaactcggacaagtaatgctactcgtcttatgcgcggtccaattattacttatgagaacatcctgggcattgtgtgaagcgttaaccctagcgacaggcccgataactactctatgggaaggcagcccaggaaagttctggaacaccacaattgcagtatctatggcaaatatttttcgcgggagttacttagccggagcaggtctagcattcagcataatgaaatctgtaggtacggggaaaagaggaacaggttcacagggagaaacgttaggggaaaaatggaagaagaaactcaaccaactttctagaaaagagtttgatctatataagaaaagcggaataactgaagttgatagaacagaagccaaagaaggtttgaaaagaggagagataactcatcacgccgtctcgagggggtcagccaaactacaatggtttgtggaaagaaatatggtaataccagaaggaagagtaatcgatttaggatgtggaagaggagggtggagttactattgtgcgggacttaagaaagtaacagaagtaaggggctataccaaagggggaccgggacatgaagaacccgttccaatgtctacttacggttggaacatagtgaaattaatgagcggaaaggatgttttctacctaccgccagaaaaatgcgatacccttctgtgtgacatcggagaaagctctccttcccctacagtcgaagaatctaggaccatccgcgttctaaagatggtagaaccatggcttaagaacaatcaattctgcatcaaggtattaaatccctatatgccgacagtgattgaacatttagagagacttcaaagaaaatatggaggaatgctagtccgaaatcctttaagccgaaactcaacgcacgaaatgtattggatttctaatggaacgggaaatatagtagccagtgtgaacatggtctcaagactgctattaaatagattcacaatgacacaccgtcgacctacgatagaaaaagacgttgatttgggagcgggcacaagacatgtaaatgcagaacctgaaactccgaacatggatgttatcggagaacggattaaaagaataaaagaagaacataactctacatggcactatgacgacgagaacccatataaaacctgggcatatcatggctcctatgaagtgaaagcgacgggcagcgcatcatctatgattaatggggtggtaaaattattgactaaaccatgggatgtcgttccaatggtgactcaaatggccatgactgatacaaccccgttcggacagcagagagtcttcaaggaaaaagtagataccagaactccaagatcaatgccaggcacaaggcgggtaatgggtataactgccgaatggctatggagaacattaggaaggaataagaaaccccgactgtgtacacgcgaagagttcacgaaaaaggtaagaacaaatgctgcaatgggagcggtgttcaccgaagagaaccaatgggacagtgccaaagcagcagtggaagatgaagacttctggaaattagtcgatcgagaaagagaattacataaactgggcaaatgcggatcctgcgtatataatatgatgggaaaaagagagaagaaactgggcgagtttggtaaagcaaaaggctccagagctatatggtacatgtggctaggagctaggtatttggagttcgaagcgctcggcttcttaaatgaagatcattggtttagccgtgagaatagttactcgggggttgaaggtgaaggtctacacaaactaggctacatattgagagatatttcaaagatcccagggggagccatgtatgcagatgatacggctgggtgggatacccgcataacagaagacgatctgcacaatgaggagaagattacacagcaaatggacccggaacataggcaattggcgaacgctatatttaaattgacctaccaaaataaagtggtgaaagtgcaacgaccgacaccgactggtacagtaatggatataatttcccgaaaagatcaaagaggaagcggacaagtaggaacttatggactaaacaccttcactaacatggaagcccagctcataaggcaaatggaaggagaaggcgtcctgacaaaggcagacttagagaatccacatttaagcgagaagaaaataacccaatggttggaaacgaagggtgtagaaagactaaaaaggatggctatatctggcgatgattgtgtagtcaaaccaattgacgatagattcgcaaacgcattgctagcactcaacgatatgggtaaagtaagaaaagatataccacagtggcagccatcaaaaggctggcatgattggcagcaagtacctttttgctcacatcatttccacgaactcataatgaaagacgggagaaagttagtcgtaccgtgtagaccacaagatgaactcataggaagggccagaatttcgcaaggcgcaggttggtctctgagggagacagcctgtctaggaaaagcatatgcccaaatgtggtcgttgatgtacttccatagaagagacctacgcctagctagtaatgcaatatgcagcgccgtacctgtgcattgggtgccaacatcaaggacaacatggtctatacacgctcaccatcaatggatgactacggaggatatgctaacagtatggaatagggtatggattgaagataatccctggatggaagataaaaccccagtgactacctgggaaaatgttccttacttaggaaaacgggaagatcagtggtgtggttcactcatagggttgacatcacgtgccacatgggcccaaaacataccaacggcaatacaacaggtgagatcactaatcggcaacgaagagttcctagactacatgccatctatgaagcgtttcaggaaagaagaagaaagtgaaggcgcaatttggtaa

SEQ ID NO: 23310 - RNA, 9873 nt, synthetic construct
  misc_feature 1..9873: note = derived and/or modified CDS sequence (opt6) from DENV-3__EU596494__SS-prME
  source 1..9873: mol_type = other RNA
accagcttatgcttgatgatgatattaccggcagcactggctttccacttaacatcccgagacggagaacctagaatgattgtaggcaaaaatgaacgtggtaaatcgcttttatttaaaacggcatcagggataaacatgtgtactcttatagcaatggatctaggagaaatgtgcgatgatactgttacatataaatgccctcatatagcagaagttgaacccgaagacatagattgttggtgcaatcttacatccacatgggtaacatacggaacttgtaaccaagcaggagaacatcgaagagacaaacgatctgttgcactcgcaccccacgtgggtatgggactcgacacaaggacacaaacatggatgtccgccgaaggagcttggcggcaagttgaaaaagtggaaacctgggcgttaaggcatccaggattcacaatactcgcattatttctagctcactatataggtacaagtttaacacagaaagtagtcatcttcgtgttgctaatgctcgttaccccttctatgactatgagatgtgtcggtgtgggtaatcgtgattttgtggaaggcctatcaggggcgacttgggtagatgtagttttagaacacggtggctgtgtgaccaccatggccaaaaacaaaccaacacttgacatagaactacagaaaactgaagctactcaacttgctacattgagaaagctatgcatcgaagggaagataacaaatataaccacagattcacggtgccctactcaaggagaagcggtactaccagaagaacaggaccagaattatgtttgtaaacacacatatgtagaccgtggatggggaaatgggtgtggcctattcgggaaagggagcttagtaacatgcgctaaattccaatgccttgaaccaatcgaaggaaaggtggtgcaatacgaaaacttaaaatataccgtaataataactgttcacacaggtgatcagcatcaagtaggaaatgaaacccaaggagtaactgcagaaattacaccacaagcatcaaccacagaggcgatattgcctgaatacggaacgctcgggttagaatgcagtcctaggacaggtctagacttcaacgaaatgatacttttaacaatgaaaaataaggcttggatggttcataggcaatggttctttgatttgcctctcccctggacaagcggagctactaccgaaactcctacatggaacaggaaggaactattggtaactttcaaaaatgcacatgccaagaaacaggaagtagtagtgctaggaagtcaagagggggctatgcatacagctctaactggctcaacagaaattcaaaattctggaggcacatcaatattcgctggccatctcaagtgcagactaaaaatggacaaattagaattaaagggcatgtcctatgcaatgtgtaccaacacctttgtactaaagaaagaagtttcagagacacaacatggcacaatcttgataaaggtggaatataaaggggaagacgccccttgtaaaataccttttagcaccgaagatggacaaggcaaggcccataacgggaggctaattaccgctaatccggtagtaacaaagaaagaagaacctgtaaatatagaggcagagccgccttttggtgagtccaacattgtcattgggataggggataatgctttaaagataaactggtacaaaaagggaagctcaattggcaaaatgttcgaggcgacagctagaggtgcgaggcgaatggctatactgggagacacagcgtgggatttcggaagtgtcggtggagtactaaattcacttggtaaaatggttcatcaaatatttggatcagcgtatacagctcttttcagcggcgtatcgtgggtaatgaaaattggcataggtgtgttgctgacatggattggactaaatagcaaaaatacgagtatgagcttttcatgtattgcgataggtatcataacattatacctaggagccgtcgtacaagctgataccggttgtgttattaattggaaaggtaaagaacttaaatgcggatctggaatatttgtaacaaatgaggtacatacatggacggaacagtataaatttcaagctgattcacctaaaagacttgcaacagcgatagctggcgcgtgggaaaatggggtttgtggtattagatcgacgacgaggatggaaaatttgctttggaaacaggtagccaatgagttaaattatattttatgggaaaataacataaaactcacagtagttgtgggtgatataataggtgtgttggaacaaggtaaaaggaccttgacccctcagccaatggagctcaagtatagttggaaaacttggggaaaagcgaagattgtcacggcagaaacacaaaactcgtcttttattattgatggaccaaacacgccagagtgtccgtctgccagcagagcatggaacgtatgggaagtagaagattacggatttggggttttcacaacaaatatttggttgaaattgagagaagtatatactcagttatgtgatcataggttaatgtctgcggctgttaaagatgaacgtgcagtacacgcagatatgggatactggatagagagccaaaagaacggcagttggaagctggaaaaggcgagcctcatagaagtgaagacatgcacatggccaaaaagtcatacactttggagcaatggcgtactagagtcagatatgataataccaaagagtttagctgggccaatatcccaacataattataggccaggttatcacacacaaacagctggaccttggcacctcggcaaactagagttagatttcaattattgtgaaggtacaacagtagttattacagagaactgtggaacgagaggcccatcgctacgaacaactaccgtttcggggaaacttattcatgaatggtgctgtcggtcgtgtacactaccacccttaaggtatatgggtgaagacggctgctggtatggtatggaaataaggcctatcagcgagaaggaagagaacatggttaaatccctggtgtccgctggaagtggtaaagtggacaatttcactatgggagttctttgtttagcaatcttatttgaagaagttatgaggggtaagttcggtaaaaagcatatgatcgctggtgtgttctttacatttgtactactactaagtggacaaatcacatggcgagacatggcgcacaccttaatcatgattggtagtaatgcatcagatcgaatgggcatgggagttacgtatttagctttaatcgcgacgtttaaaatacagccgtttctcgccttaggcttctttctaagaaagctaaccagtagagaaaatctgctactaggcgtcggacttgccatggcgacaaccttacaattgccagaagatattgaacaaatggcaaatggtattgcattagggttaatggccttaaagctaataacacagtttgaaacctaccaattatggacggctttaatttcactaacctgttcaaacacaatcttcactctcacagtggcgtggcgtacggctacactcatacttgcgggggtaagtttattaccggtatgtcaatcatcttccatgagaaaatctgactggctaccgatgacggtagcagcaatgggtgtcccaccactcccattattcatattttcattaaaagatacattgaaacgcagatcatggccccttaatgaaggagtaatggcagtaggactcgtcagtattttagcgtcatcactacttagaaacgacgtcccaatggctggacctttagtcgcaggaggattgttaattgcatgttatgtgatcacaggtacatcggccgacctcacggtagaaaaagccgctgatgttacttgggaagaggaagccgaacaaacaggggtaagtcacaatcttatgataacagtggatgatgacggaactatgagaatcaaagatgacgaaacagagaatatcctcacggtccttttaaagaccgctttactgatagtatcaggaatatttccttattcaattcctgctacactattggtttggcacacgtggcaaaagcagacgaggaggagcggagtcctgtgggatgttcccagcccgccggaaacccaaaaagcagaattagaagaaggcgtatatcgaataaagcagcaaggaatttttggcaaaacacaagtaggggtaggagttcaaaaggaaggcgttttccatacaatgtggcacgtaacccgtggtgcagttttaacctacaatggaaagcgactagagccaaactgggcatcagtcaagaaagatttaatatcctatggtggagggtggcgtctatcagcacagtggcaaaagggtgaagaagtccaagtaattgcagttgagccaggaaagaaccctaaaaattttcagacgatgcctggaacattccaaaccacaacgggagagataggagcaattgcattagattttaaacctggtaccagcgggagccctataataaaccgcgagggtaaagttgtcggactatacgggaacggggtcgttacgaaaaatggtggctacgtgagtggcatcgcacaaacaaacgcagagccagatggtccaacgcccgaattagaggaagaaatgtttaagaaaagaaacctaaccattatggacctgcatccaggaagtggtaagacaagaaaatacctaccagcaattgtaagagaagctattaagcgacgattaagaacactaattcttgctccgacaagagtagtggctgccgagatggaggaggcacttaaaggattaccaatacgataccagacgacggctacacgatctgaacacacgggtagagaaatagttgacttgatgtgtcatgcaacatttacaatgaggctattatcacccgtaagagtacccaattacaatctcattataatggatgaggcacattttaccgatccagcgtctattgcagctcgcggttacattagtacaagagtgggaatgggagaagcggctgctatcttcatgacagccacacctccgggtacagctgacgcgttcccacaatccaatgcccctatacaagatgaagaaagagatataccagaacggtcctggaacagcggaaatgagtggattacagactttgcgggaaaaactgtatggtttgttcctagcatcaaggcgggaaacgacatagcaaactgcttaaggaaaaatggtaagaaagtaatacaattgtcaaggaaaacgtttgacacagaataccagaaaaccaaactcaacgactgggattttgttgtgacaactgatatcagcgaaatgggagcaaattttaaagcagaccgggtaattgatccacgaagatgtctgaagccagtcatactaacagatggacccgagcgtgttattttggctggccctatgccggtgactgcagcttcagcggcacaaaggagggggagagtcggaaggaatccacaaaaagaaaacgaccagtacatttttactggtcagccattgaataacgatgaggatcacgctcattggactgaggcgaagatgttactagataacataaatacccctgaaggcatcattccagccttgttcgaaccagaaagggaaaaatcagccgctatagacggggaatatcggttgaaaggagaatcacgtaaaacattcgtcgaacttatgagaaggggcgacctgccggtttggttggcccataaagttgctagtgaaggaataaagtacacagatagaaagtggtgctttgatggtcaaaggaataatcagattttggaggaaaacatggacgtcgagatatggacgaaagagggagagaagaagaaattaagaccacgatggttagacgcacgaacttatagcgatcctcttgcattgaaagaatttaaagatttcgcagctggacggaaaagtatcgctcttgatttagtaactgagataggccgagttccatctcatttggcacataggacacgaaatgcattagataatctcgtaatgcttcacactagcgaacacggcggtaaagcatatagacatgccgtcgaggaattgccagagaccatggaaacactcctgttattaggcttgatgattcttctaactggtggagctatgttatttttaatttctggaaagggtataggtaagacgtcaataggattgatatgtgtaattgcgtcatcaggtatgctatggatggccgagatcccgttgcagtggattgcatcagctatagtcctggagttctttatgatggtattactaataccagaacctgaaaaacaacgtaccccacaagataaccaattagcatatgtagtaataggtatcttaactttagctgcaataattgcagcgaacgaaatgggactcctggaaactacaaaaagagatttgggtatgagtaaggaaccgggtgtcgtttctccgacaagttatcttgatgtagacctacacccggcatcagcctggacattgtatgcagtagctacaacagttattactccgatgttacggcacacaatagaaaactcaactgccaacgtgtcacttgcagctattgcgaaccaggccgtagtgctaatggggctagataaaggatggccgataagcaaaatggacttaggcgttccactgttagccctcggttgttactcacaagtgaacccactaaccttaacagccgctgtactgctcctaataacccattatgctattataggtcctggactccaagctaaagccacacgggaagcccagaaaagaacagctgctggaatcatgaaaaatcctacagtagatggaataatgacaatcgatttggatccagttatatacgatagtaaattcgagaaacagctcggacaagtaatgctgcttgtactttgtgcagtacaattactgctgatgaggacatcgtgggcactctgtgaagcactaactttagcaactggtcccatcaccactctatgggaaggcagccccggcaaattttggaatacgacaatagccgtaagtatggctaatattttcagagggagctacctagcaggcgcaggattggcctttagtataatgaagagtgttggtacaggaaagcgcggaacaggaagtcaaggggaaaccttaggtgagaagtggaagaagaaattaaatcaactctctcgaaaggagttcgacttatacaagaaatctggaataactgaagtcgatagaaccgaagcaaaagaagggttaaagagaggtgaaataacacaccatgcagtaagtcgaggtagcgcaaaattacaatggtttgtcgaacgaaatatggtcataccagaaggtagggtgattgatctaggttgcggccgtggaggatggtcttattactgtgctggtttgaaaaaggttacagaagtacgcggatatacaaagggaggccctggacacgaagaaccggtacccatgagtacatatggatggaatatcgttaaattaatgtccggaaaagacgtattctacctaccacccgaaaaatgtgataccctgttgtgtgatataggagaaagctcaccctctccaactgtagaagagagtagaacaatcagagttctaaaaatggtagaaccttggctcaaaaataaccagttttgtataaaagtactaaatccttatatgccaactgtcatagaacacttggagcgcttgcaaagaaagcatggcggtatgttagtaagaaacccactcagtaggaactctactcacgagatgtactggattagcaatggtacagggaatattgtggcttccgtaaacatggtgagtaggctattgctaaatagattcactatgacacacagaagacctacaatagaaaaggatgtagatttaggagcgggaacacgtcacgttaatgctgaacctgaaacacctaatatggacgtcattggagaaaggataaaacgcataaaagaggaacataactcaacatggcattacgacgatgagaacccatacaaaacctgggcatatcatggttcgtacgaagtaaaagctacggggagtgcaagttctatgattaacggagtcgtgaaacttctaacaaaaccttgggatgtagtaccgatggtaacacaaatggcgatgactgatactacaccttttgggcagcaaagggtgtttaaagaaaaagtggacacccgtacccctcgtagcatgcccggcacacgaagagtcatggggataactgcagaatggctgtggagaacactaggtagaaacaaaaagccgagactatgtacacgcgaagagttcactaagaaagttagaacaaacgcggcgatgggagccgtttttacagaggagaaccaatgggatagcgcaaaagctgcagtggaagacgaggacttctggaaattagtggatagagaaagagaattacataaattaggtaaatgcggatcatgtgtctacaatatgatgggtaagagagaaaagaaactaggagagtttggaaaagcaaagggaagtcgggctatatggtacatgtggttgggggctagatacctagaatttgaagcattaggatttctaaatgaagatcattggttctcaagagaaaacagttatagcggagtagaaggtgagggattacataagctcggatacatactaagggatatttccaagatacccggcggtgctatgtacgccgatgatacagcaggatgggatacaagaataacggaagatgacttgcataacgaagagaaaatcacgcagcaaatggacccagagcaccgtcagcttgccaatgccatttttaaattgacataccagaacaaagtagttaaagtacagagaccaactccaacaggcactgtaatggatataataagccggaaagaccaaagagggagcggacaagtgggtacctatgggttaaatacatttacgaacatggaagcccaactgataaggcaaatggaaggtgaaggcgtccttactaaagcggacctggaaaacccccatctaagtgagaagaaaataacgcagtggctagaaacaaaaggcgtagaacgattgaaacgaatggcaatttcaggtgacgactgtgtcgtgaaaccaattgatgatcgattcgcaaacgcattattagcactaaatgacatgggcaaagtcagaaaagacattccacaatggcagccctctaaaggatggcacgattggcagcaagttccgttctgcagtcaccactttcacgaactgataatgaaagacggacgaaaattagtggtcccatgtagaccacaagatgagctgattgggagagcaaggattagccaaggagctgggtggtcacttcgagaaacagcatgtctgggaaaagcatacgcacagatgtggtcgttgatgtattttcatagaagagaccttcgactcgccagcaatgcaatttgcagcgccgtacccgtacactgggtgccgaccagtagaactacatggagtattcatgcacatcaccagtggatgacgactgaggatatgttaacagtatggaacagggtctggatagaggataacccatggatggaagacaaaactcctgtgacaacttgggagaacgtgccatatttagggaaacgagaagatcagtggtgcggttcactcattggactgacaagcagagccacctgggcacaaaacataccaacggcgatacaacaagtacgatcgttgatcggaaacgaagagttcttagattatatgcccagcatgaaaagatttagaaaagaggaggaaagcgaaggcgctatatggtga

SEQ ID NO: 23311 - RNA, 9873 nt, synthetic construct
  misc_feature 1..9873: note = derived and/or modified CDS sequence (opt6) from DENV-3__EU687218__SS-prME
  source 1..9873: mol_type = other RNA
acttcgctttgcctcatgatgattttaccggcagccttagcatttcatttaacctcacgcgacggtgaaccgcgtatgatcgtagggaaaaatgaaaggggaaagagcttgctctttaaaactgccagcggaatcaacatgtgtactttaattgcaatggacctgggagaaatgtgcgacgatacagtcacatataaatgcccccacataacagaagttgaaccggaagacatcgattgctggtgcaacttaacatctacgtgggttacctatggcacttgtaatcaagcaggagagcacagaagggataaacgttctgtagcactagcaccacacgttggtatgggattagacactaggacacagacatggatgtcggcagaaggagcgtggcgccaagtagaaaaagttgaaacatgggcactccgacatccaggatttacaatactagcattatttttagcgcattatatcggtacatcattgacacaaaaagtagtaatctttattttactaatgttagttaccccgagcatgactatgcgatgtgtgggagtaggaaatagagattttgtcgaaggattgagcggagcaacatgggttgacgtagtattggaacacggtggatgtgtaacaacaatggctaaaaataaacctacactcgacatagaattacagaaaaccgaagcaacgcaattagcaacactacgaaaattatgcatagaaggcaaaataaccaacataactactgactcacgatgtccaacgcaaggtgaggcagtcttacctgaagaacaagatcagaattatgtttgcaaacacacttatgtagatcgaggctggggaaacggatgtggattatttgggaaaggttcactcgttacttgcgctaaatttcaatgtttagaacccatcgaaggtaaagtggttcaatatgaaaatttaaaatatactgtaattatcacagtgcatacaggagatcaacatcaagtcggaaatgaaactcaaggtgtaacagctgaaattacgcctcaggcctctacaacagaagcgatcttaccagaatacggaactctcgggctagaatgctcaccgcgaactggcctagactttaacgaaatgattctgttaacaatgaagaacaaagcatggatggtgcacagacaatggttctttgatcttccactaccttggacaagtggcgctaccacagaaacacctacatggaatcgtaaggagttgcttgtaacatttaaaaacgcccacgcaaagaaacaggaagtcgtagtacttggatcacaagagggcgctatgcacacagcactcacaggggcaacggaaatacaaaattcgggcggcacaagtatttttgcaggccacttgaaatgtcgattaaaaatggataaactagaattgaaaggaatgagctatgcgatgtgcaccaacacatttgtactcaaaaaggaagtttcggagacacaacatggtacaatattgattaaagtcgaatacaagggtgaagacgtaccgtgcaaaataccatttagtacagaagatggccagggaaaggctcataacggacgattaatcaccgcaaacccagttgtgacaaagaaagaggagcctgttaatattgaagctgaaccaccctttggtgaaagcaacatagttattggaattggagacaatgccttgaagattaattggtataagaaaggaagttcaataggtaagatgtttgaagcaaccgctcgaggcgcacggagaatggctatactgggagatacggcatgggacttcggaagtgtgggcggtgtattaaattcattaggcaaaatggtacatcaaatattcgggtcggcttacactgccttatttagtggagtgagttgggtgatgaaaattggtattggggtattactaacgtggattggcctaaattccaagaacacgagtatgtccttctcgtgtattgccatagggattataaccttatatctcggtgcggtagttcaagcagacatgggttgtgtgattaattggaagggtaaggaattaaagtgtggatcaggaatattcgtaacaaacgaagtccatacatggaccgaaaagtataagtttcaggccgatagtccgaaacgcttggccacagctattgctggagcatgggaaaatggtgtttgcggcattagatcaacaacaaggatggaaaacctattatggaagcaaattgctaatgagctaaattatatattgtgggagaacaatataaaactgacagtagtcgttggtgatataattggagtattagaacaaggaaaacgtacgctaacaccacaaccaatggagcttaaatatagttggaagacctggggaaaagctaagatcgttacagcggaaactcaaaattcatcgtttataattgatggacctaacacacccgaatgtccttctgcctcaagagcatggaatgtttgggaagtcgaagactatgggtttggggtatttactactaatatttggcttaagttacgagaagtctatacacaattgtgtgatcatcgacttatgtcagctgcagtaaaagacgaacgtgctgtgcatgcagacatgggatactggatcgagagtcagaagaacggcagctggaaacttgaaaaggcttcattgatagaagtgaaaacgtgtacctggccaaaatctcacacgttgtggtccaatggcgtacttgaatcagatatgatcatccctaaatcgttagcaggtccaattagccaacataactataggccaggataccatacccaaacagcaggaccgtggcacttaggcaagctagagctggactttaattactgtgaaggtactacggttgtgatcacggaaaactgcgggaccagaggtccgtctctcagaacaaccacagtatcaggtaaattgatacacgaatggtgctgtcgttcttgcacacttccacctttaagatacatgggtgaagacggctgttggtatggaatggaaatacgacctatttctgaaaaggaagaaaatatggtaaaaagtctagtatctgccggaagcggtaaagtagataatttcacaatgggagttttatgtctagctatacttttcgaggaagtgatgcggggtaagtttggtaagaaacacatgattgccggggtgttcttcacttttgtgttattattaagcggacaaataacttggcgagacatggctcatacattaatcatgattggttcaaacgcaagtgatcgcatggggatgggagtcacatacctagcgcttatcgcaacgttcaagatacagccattcttagcgttaggcttctttctacgaaaattgaccagcagggaaaatcttttattgggagtaggtctcgccatggctaccacactacaattaccagaagacattgaacaaatggcaaacggaatagcactgggactcatggcattaaaacttattacgcaatttgaaacataccaattgtggacagctttaattagcttaacctgcagtaacacaatattcacgctcacagtcgcatggcgtacagcgacgttgatccttgccggtgtaagtttactgcccgtgtgtcaatctagtagcatgcgtaaaacagattggctcccgatgacggttgctgcaatgggagtacccccgctacctcttttcatattttcgctgaaagacaccttaaaacgtcggagctggccgcttaatgagggggtcatggctgttggtcttgtgtctatcctagcgagttcacttctccgcaatgatgttcctatggccggccctcttgtcgccggtggactcctgatagcctgctatgttataactggaacttcggccgacttaactgtagaaaaggcagcagacgtaacatgggaagaagaagcagaacaaacgggcgtatctcataatttaatgattactgtagatgatgatggcacaatgagaataaaagatgacgagacagagaacatattaaccgtattactaaaaacagctctactaatagtgtccggaatttttccgtattcaatacctgctactttgctggtatggcacacttggcaaaagcaaacacaacgcagcggtgtgctgtgggacgtaccatcgcctccggaaacccaaaaagcagaattagaggaaggcgtttatagaattaaacaacagggaatatttggaaaaactcaagtaggtgtgggggtacagaaggaaggagtatttcatacaatgtggcacgtaacaagaggagcagtattaacctataatggtaaaagacttgagccaaactgggcgtcagtcaagaaagacctaatatcatatggcggcggttggaggttgtccgctcaatggcaaaaaggcgaagaagtacaagtcatagccgtggagccaggcaaaaatcccaaaaactttcaaactatgccaggaacatttcaaacaactacaggcgaaattggagcaatagccctagatttcaagcctgggactagcggaagccccattatcaaccgagaaggcaaagtcgtaggattgtacggcaacggagttgtcactaagaacggcggctacgtttccggtatagcgcaaacgaacgcagaacctgacggtcctactcccgaattggaagaggaaatgtttaaaaagagaaatctaacaataatggatttacatcctggatcaggcaaaacacggaaatacttaccagccatagtgagagaagctatcaaaagacgactacggacactaatattagcaccgactcgtgtagtggctgctgaaatggaggaagctctgaaaggactacctatcaggtatcagaccaccgctacgaagtcagaacacacaggtcgagaaattgtagacttaatgtgtcacgctacttttacgatgcggcttttaagcccagtcagagtccctaattataatctcataataatggatgaagcacattttacggacccagcatcaattgcagcaaggggttatattagcacaagagtgggtatgggagaagctgcggctattttcatgacggctactcctccagggactgcagatgctttcccccaaagcaacgcccccatccaggacgaagaacgagacataccagaaagatcatggaactcggggaacgaatggattaccgattttgcaggtaaaaccgtgtggttcgtgccctctattaaggcaggaaatgacattgctaactgtcttaggaaaaatggcaagaaagttattcagctaagtaggaaaacgtttgacacggaatatcagaaaactaagctaaacgactgggattttgtagtaacgactgatatttcagaaatgggtgctaattttaaagccgacagagtaatcgatccacggagatgtttaaaacctgtcatactaacggatggtcctgaacgtgtaatactagcgggaccaatgcctgtaacggcagcatctgccgctcaaagaagggggagggttggacgtaacccacagaaagaaaacgatcaatatatctttacaggtcaacctttgaacaacgacgaagatcatgctcattggacagaagctaagatgctattggataatataaatacgcctgaaggtattataccagctttatttgaacccgaacgagaaaaatccgcagccatagatggggaatatagactaaaaggcgaatctagaaaaacctttgtggaactgatgagacgcggcgacttgccagtatggctcgctcataaagtagcatcagaggggataaagtatacagatagaaaatggtgttttgatggacaacgaaataatcaaatacttgaagaaaatatggatgttgagatatggacaaaagaaggtgagaagaagaaactaagaccgcgatggctcgacgctaggacttactcagatcctctagcgttgaaagagtttaaggactttgccgctggcagaaaaagcattgcactagacttagttacggaaatcggtcgagttccatcacacctagcccatcgcactaggaacgctctagataatcttgtaatgctgcataccagtgaacacggagggaaagcatacagacacgctgttgaagaactcccagagactatggaaactttattgcttttgggtctgatgatattacttacaggcggagccatgcttttcctaataagcggaaaaggaataggaaaaacatcgattggacttatctgtgttatagcttcgtcaggcatgctatggatggcagagatacctctccaatggatagccagtgctatagtcctggagttctttatgatggtattattgattccggaaccggaaaagcaacgaactccacaagacaatcaattagcatatgtagttataggcatacttacacttgcagcaataatagccgctaacgaaatggggctactagaaactacaaagcgagatttgggcatgagtaaagagccgggcgtggtctcacctacatcgtacttagacgtggacttacatccagcttcagcgtggactttatatgccgttgccacaacagtaataaccccaatgctaagacatacaatcgaaaatagtacagcaaatgtatctttggccgcaattgcaaatcaggcggttgtgctaatggggctcgacaaaggatggcccatatctaaaatggacctgggagtacctttgttagcattaggttgctatagccaagtaaacccactgactcttacggctgcggtcttgctattaataacacattatgctataataggtccgggattgcaggctaaagcgacccgcgaggcacagaagagaacagcggcaggtataatgaagaatccgacagtagatggcattatgacaatagatttggaccctgtgatatatgactccaaatttgaaaaacaactaggccaagtgatgctgctagtgctatgtgcagtacaattactcttgatgaggaccagttgggccttatgtgaagcgctcaccctagctacgggaccaattactaccttatgggagggaagtccgggaaaattttggaacacaacgattgccgtatccatggcaaacatatttcggggttcatatttagcaggagccggacttgcattctcaataatgaaaagcgtaggcacaggcaaaagaggtacagggtcgcaaggcgaaacgctgggagaaaagtggaagaagaaattaaatcaactgagtcgcaaagaatttgacttatacaagaaaagcggaattactgaggttgaccgaaccgaagccaaagaaggactaaagaggggagaaataacacatcacgcggttagtcgaggtagtgccaagttgcaatggtttgtagaaagaaatatggttattcccgaggggagagtcatagaccttggctgtggccgaggtggatggtcctattactgtgctggattgaagaaagtaacggaagtaagaggatataccaaaggaggtcccggacacgaggaacctgttcctatgtctacatacggttggaatatagtaaaattgatgtcaggaaaagacgtgttttatctgccacctgaaaagtgtgacactttattgtgtgatataggcgaatccagtccttctccgaccgtagaagaatcacgaacaataagagttctaaagatggttgaaccgtggcttaaaaataaccaattttgtattaaagtgttaaacccttacatgcctacggtgatcgaacatcttgaaagattacaacgcaaacatgggggaatgctagtaagaaaccccctaagtagaaattctactcatgaaatgtattggatctcgaacggaacaggtaatatagtcgccagtgttaacatggttagcaggctcttgctgaacagatttacaatgacacacaggcgtcccacgattgaaaaagatgtagatttaggggcaggtactagacacgtaaacgctgaaccagaaactccaaatatggatgttataggggaaagaataaagagaattaaagaagaacacaacagtacatggcactacgacgatgaaaacccatataagacgtgggcgtaccacggtagttacgaagttaaggcaacagggagtgctagcagcatgataaatggcgtagtaaaactcctaacgaaaccgtgggacgtcgttcccatggtgactcaaatggctatgacggatacaaccccgttcggacagcaacgtgtatttaaagaaaaagtagacacccgcacaccacgtagcatgcctggtaccagaagggtaatgggaataactgctgagtggttatggcgaacgttaggaagaaataagaaaccacgattatgtaccagagaagaatttactaagaaagttaggactaatgcggcaatgggcgcagtatttactgaagagaatcaatgggattctgcaaaggcggcagtagaggatgaagatttctggaaattagttgatcgagagcgagagttacataaactaggaaaatgtggatcttgtgtttataatatgatggggaaacgggagaagaaactaggtgagttcgggaaagccaaaggttcacgtgcaatttggtatatgtggctaggtgcaagatatttagaatttgaagcacttgggttccttaatgaagatcactggtttagcagagaaaatagttattccggggttgaaggcgaaggtctccataaattgggatacatactcagagatataagtaaaatacctggaggagctatgtatgctgatgacacggctggttgggatacacgtatcacagaagatgatttacataatgaagagaaaatcacacagcaaatggatccagaacatagacaactagcgaatgcaatttttaaattaacatatcagaataaagtagtcaaagttcagagaccaactccaacaggtactgtaatggatataatctcaagaaaagaccagagaggatcaggacaagttggaacatatggactgaatacctttacgaatatggaagcacagctaattagacaaatggaaggtgaaggtgtgttatcaaaagccgatttagaaaacccacatttacccgagaagaaaatcacacagtggttagagaccaaaggcgtcgaacgactgaaaaggatggcaatcagtggcgatgactgcgtcgtcaaaccgatagacgatagatttgctaatgccctacttgcattaaacgatatgggtaaagtgagaaaggacataccgcaatggcagccctcaaaaggctggcatgattggcaacaagttccgttctgttcacatcacttccatgagttgataatgaaagacggtcgaaaactcgtagttccttgtagacctcaagatgaattgattggacgtgcaagaatcagccagggtgccggatggagtcttcgagaaaccgcgtgtttaggtaaagcatacgcgcagatgtggagcctgatgtatttccatcgtagggatttgagacttgcaagtaacgcaatatgttctgcagtgcccgtacattgggttccaacctcgagaacaacctggtcaatacacgctcaccaccaatggatgacaaccgaagatatgttaacggtttggaatcgtgtttggattgaagataatccgtggatggaggacaaaacgccagttactacatgggaaaacgtaccttatttaggtaaaagagaagatcaatggtgtggcagtctcataggactgacctcgcgtgcaacgtgggcgcaaaacatacccactgcgatacaacaagtacgttcattgatcggtaatgaagaatttctcgactacatgccatcaatgaagagatttagaaaagaagaggagtctgaaggagcaatatggtaa

SEQ ID NO: 23312 - RNA, 9873 nt, synthetic construct
  misc_feature 1..9873: note = derived and/or modified CDS sequence (opt6) from DENV-3__EU726772__SS-prME
  source 1..9873: mol_type = other RNA
acatctttatgcttaatgatgatattgcctgcagcactggcatttcatttaacatcgcgagatggagaacctcgaatgatagtaggtaaaaatgaaagaggtaaaagtctactttttaaaacggcttctggaatcaatatgtgcacattaatagcaatggacctaggggaaatgtgtgacgatacggtgacttataaatgccctcacattacggaagtggaacctgaagacatagattgttggtgcaatctaacatcaacatgggttacctacggaacatgtaatcaagctggagaacataggagagacaaaagaagcgtagctctagcgccgcacgtgggaatgggactggatacacgtacgcaaacttggatgagcgcagaaggtgcttggcggcaagtagaaaaagtagaaacgtgggcactaaggcatccgggatttaccattctggcgctatttcttgcacactatatcggaactagcttaactcaaaaagttgtaatctttatattgttgatgttagtaacaccctcaatgacgatgcgctgcgtaggagtaggaaacagggactttgtagaaggactatcaggagcaacatgggttgatgtagtcctagaacatgggggttgcgtaaccactatggccaaaaataaaccgacacttgacatagaattacagaaaacagaagcgactcaactagcaaccctccgaaaactatgtatagaaggtaaaataactaacattactaccgattccaggtgtccgacgcaaggcgaagcagtactcccagaagaacaagatcaaaactatgtatgtaaacatacctatgtagaccgtggatggggtaacgggtgtggactgtttggaaaaggcagcctagtcacatgtgcaaaatttcaatgtttggaacctatagaagggaaagtcgtgcaatatgagaacttaaaatatacagtaattataactgtacacactggagatcagcatcaagttggcaatgaaacacaaggagttacggcagaaatcaccccacaagcaagtacgaccgaggctattttgccagagtacggaactctcggattagaatgtagtccgcggacaggcttagactttaatgaaatgattctgttaactatgaaaaacaaagcatggatggtgcacagacaatggtttttcgatttacccctaccttggacatctggtgcgactacggaaacgccgacttggaatcgtaaagaactattagttacctttaaaaatgctcatgcaaagaaacaggaagtcgtagtactgggctcacaggaaggagccatgcacactgcattaaccggtgcaactgagattcaaaatagcggaggcacaagtatatttgctggacatttaaaatgtagattgaaaatggacaaactagaactcaaaggaatgtcatatgcgatgtgcacgaacacttttgttttaaagaaagaggtctcagaaacgcagcatggcacaattttaataaaagtagaatataaaggtgaagacgtgccctgtaagatacctttctcaaccgaagatggtcagggaaaagctcataacggtagactaattactgctaatccagtcgtaactaagaaagaagaacccgttaatatagaggccgaaccgccatttggcgaatcgaacattgtaataggaatcggggataacgccctcaaaattaactggtataagaaaggatcttcgattgggaaaatgtttgaagccaccgcgcgaggagcacgtagaatggctatactgggggacactgcgtgggactttggttcagtagggggtgtacttaatagtcttggaaagatggtacaccaaattttcggttcggcttacacggcacttttcagcggggtatcatgggtcatgaaaataggcataggagttctgttgacatggataggtttaaactccaaaaatactagcatgtcattcagttgcatagctataggcataataaccctttatctaggtgcagtagtgcaagcagatatgggttgcgttattaattggaaggggaaagaactcaaatgtgggagtggaatcttcgtaacaaatgaagtccatacgtggactgagcaatacaaatttcaagcggatagtcctaaaagacttgctacggcaatagccggtgcctgggagaatggagtttgtggtataagatctactacaagaatggaaaatttattgtggaaacaaatagcaaacgaactaaattatattctatgggaaaataacattaaacttacggttgtcgtaggtgacataattggtgtattagaacaaggtaagcggactttaaccccacaaccaatggaactgaaatactcctggaaaacctggggaaaggccaaaatagtgacagcagagacccaaaactcctcgttcataattgatggccctaacacgcctgaatgcccttctgccagcagagcatggaatgtatgggaggtagaggattatggcttcggcgtgttcacgacaaatatatggcttaaacttcgcgaggtatatacacaactttgcgaccaccgtttaatgagcgcagcagttaaagatgaaagggcagtccatgcggacatggggtattggatagagagccaaaagaatggatcgtggaagttggaaaaagcgagtttgatagaagtaaagacctgtacatggcccaaatcgcataccttatggtcgaatggcgtcctcgaatcagacatgatcatacccaaaagtttagctggaccaatatcacagcataattatagacccgggtaccacacacaaaccgccggcccatggcacctcggcaaacttgaattagatttcaattattgcgaaggcacaactgtggtaataactgaaaattgtggtacaagaggcccatccttacgtactacaaccgtcagtggtaaattaatacatgaatggtgctgtaggtcttgcactttgccacccctaagatacatgggagaagacgggtgttggtatgggatggaaatacgacccattagtgagaaagaggaaaatatggttaaatcccttgtgagcgcgggaagtggcaaagtcgacaattttacaatgggagtcctctgcttagcaatattgttcgaggaagttatgcgaggtaaattcgggaagaaacatatgatcgcgggagtcttctttacgttcgtattgttactgagtgggcaaataacttggagagatatggcacatacactgatcatgattggctcaaatgcatcagatagaatgggaatgggagtcacatacctagcattaatcgctacgtttaaaattcaaccttttctcgcgttgggattctttttgagaaagctcaccagtagagagaatctccttcttggtgtaggtctagcaatggccaccactctacagttgccggaagacatagaacaaatggcaaatggtatagctctaggactcatggcattaaagctgattacacaatttgagacatatcaattatggacagcactaatcagtttgacatgtagcaataccatcttcaccttgactgttgcctggaggacggcaactttaatattggccggtgtaagtttactaccagtttgccagtcttcttctatgcggaaaacagactggttacctatgactgttgccgcaatgggtgtaccacctttacctttatttatattctcgttaaaagatacgctaaagcgtagatcatggccattaaatgaaggtgtaatggctgtagggttagtgtctatcctggcgtcttcgctattaaggaacgatgtacccatggcaggaccattagtagccggaggcctgttaatcgcatgttatgttataacagggacatcggctgatttaaccgtcgaaaaggccgccgatgttacatgggaagaagaggctgagcaaacaggggtatcgcataacctcatgattactgtggatgacgatggcaccatgcggataaaagatgatgaaaccgagaatatattaacagtattactaaaaactgctctactgatagtgagtggcatttttccttattctatacccgcaacgctgcttgtttggcatacttggcagaaacagacacagcggagcggggtcctctgggacgtgccttccccaccggaaactcaaaaggcagaattggaagaaggagtttacagaataaagcaacagggaatattcggaaaaacacaagtgggagtcggagtgcaaaaagagggagtcttccatactatgtggcatgttacgcgtggcgcagtcttaacttataatggtaaaaggttggaacctaactgggccagtgtcaagaaagacttaataagttatgggggtggatggcgactttccgcacaatggcaaaaaggagaagaagtccaagttatcgcagtcgaaccgggcaaaaatcctaagaacttccagactatgcctggaacatttcaaacaaccacaggggaaattggagcaattgccctggattttaagcctggaacctcaggttctccaataattaacagggaaggtaaagtcgttggtttatatggaaacggggtggtaacgaagaatggaggctatgtttcagggatagcacaaaccaatgcagagcccgacggacctacaccagaattggaagaggagatgttcaagaaacgtaacttgacaatcatggacttacatcccggcagcggtaaaacaagaaaatatttgcccgcaattgtacgtgaagcgatcaaacgaagacttagaacgcttatcctagcacccacaagggttgttgccgcagaaatggaagaggctttaaaaggactgccaattaggtaccaaactactgcaactaaatccgagcatactggacgtgaaatagtcgatcttatgtgccatgcaaccttcacgatgcgactgctatctcccgtaagagtcccaaactataatctcatcataatggacgaggcacattttacagatccagctagcatagccgcacgaggttatatatctacaagagttggaatgggagaggcagcggcaattttcatgacagcaaccccaccaggaactgctgatgcatttccacaaagcaatgcgccgatccaagacgaggaacgagatattccagagcgatcatggaactcaggcaatgaatggataacagattttgctggtaagacagtatggtttgtaccatcaataaaagcaggtaacgatattgcaaattgtttgcgtaaaaatgggaagaaagtaatacaactttcccgcaaaactttcgataccgaatatcagaaaacgaaactaaacgattgggacttcgtcgtaacaactgacatttcggaaatgggtgcaaactttaaagccgatcgagttatagatccaaggagatgtttgaaaccagttatattgacagacggacctgagagggtgatattagcaggacccatgcctgtcactgcggcttctgctgcgcagagaaggggaagagtaggaagaaacccacagaaggaaaacgatcagtacatttttacgggacagccattaaacaatgatgaggaccatgctcattggacagaggcaaaaatgttgcttgacaatattaacacaccggaaggcataattcccgcacttttcgaacctgaacgagaaaaatctgcagcaatagatggggagtatcgacttaaaggggaatcacggaaaacctttgtagaactaatgcgtcgtggcgatttaccggtttggctagcgcataaagtggcgtcagagggcataaaatatacggatcgaaaatggtgttttgatggacaaagaaacaaccagattcttgaggagaacatggatgttgaaatatggaccaaagaaggagagaagaagaaactgagaccacgatggcttgacgcaagaacgtactccgatccattggcactcaaagaatttaaagatttcgccgccggtcgaaaatcaatagctttagatctagtaaccgagataggaagagtcccttcgcatctagcccatagaactagaaatgctttggacaacctagtgatgctccatacaagtgaacatggtggtaaagcatacagacatgcagtggaagaactacccgaaacaatggagactttgttgctattagggctaatgatactcctaacaggtggtgcaatgctgtttctaatatcaggtaaagggataggaaagacgagtataggcctaatatgcgtgattgcttccagcggtatgttgtggatggcagagattccactccaatggatcgcaagtgccatagtcttagagttcttcatgatggtgctccttattcctgaacctgaaaaacaaaggacacctcaagacaaccagttagcatatgtagtgatcggcattcttaccctagcagcaataattgctgctaacgaaatgggactcttagaaacaaccaaaagagatctcggcatgagtaaggagccgggtgtggtaagtccaacatcatacctagacgtagatctacatccagcatccgcgtggacgctatatgccgttgcaacaacagtcataacacctatgttacgccatacgattgaaaattcaactgcaaatgtttccctagcagctatagccaatcaagcggttgtcttaatgggactagacaaaggatggccaatcagtaaaatggatctcggtgtcccgttgttagctcttggttgttacagtcaagttaacccgcttacattgactgctgcagtcttactcttaataacgcactatgcaatcataggtccaggtctccaggccaaggccacaagagaagcacaaaaacggacagcggctggcatcatgaaaaacccaacagtagatggaatcatgaccatagatctagatccggtaatatatgactctaaatttgaaaaacagctcggacaggtaatgttgttagtcctttgtgctgttcagttattgcttatgcggacgagctgggcactttgtgaggccttgactctagcgacaggtccgataaccactttatgggaaggatcaccaggcaaattctggaatacaaccatagctgtatccatggcaaacatttttagagggagctacctcgccggtgcaggactagcgttttcaataatgaaatcagtaggaacgggcaaaaggggtacaggatcgcaaggggaaacactaggagaaaaatggaagaagaaattaaatcaattgtcacggaaagagttcgatctatataagaaatcgggaatcacggaagtggacaggactgaagccaaagaaggactgaaacgtggtgaaataacacatcatgctgtgtcccgtggctcagcaaaattacaatggttcgtagaaaggaatatggtaataccagaaggcagagtaatagatttagggtgtggtaggggcgggtggagctattactgtgcagggctaaagaaagtaactgaagttcgagggtacacaaaaggtggacccggacacgaagaaccggtaccaatgtcaacctacggctggaacatcgtaaaacttatgtcaggtaaagatgtattctatttaccgccagaaaaatgcgatacgctattgtgtgacataggtgaatcgagtccctcacccacagtagaagaatcacgtaccatacgggttctgaaaatggtcgaaccatggctcaaaaacaaccagttttgtataaaagtgctgaatccatacatgccgacagttattgaacacttagaaagattgcaaagaaaacacggaggaatgttagttcgaaacccactgagtagaaatagtactcatgaaatgtactggatatcgaacgggacagggaatatcgtagctagtgtgaacatggtatcaagattactattgaacagatttacgatgacgcacagaaggcctactatagaaaaagatgtggacttaggagcaggaacaagacatgttaatgctgaacctgaaacgcctaatatggatgtaattggagaacggataaaaagaataaaagaggaacataatagtacatggcactacgatgatgaaaacccatacaaaacatgggcatatcatggatcatacgaagttaaagccacggggtccgcatcatcaatgataaacggggtagttaaattactgacaaaaccgtgggatgtagtaccaatggtaacacaaatggcaatgacggatacaacgccctttggccaacaaagggttttcaaagaaaaagtagacacaagaactccgcggtccatgccgggaactagacgagtaatgggaataacagcagagtggctttggagaacactgggtaggaacaagaaaccaagactttgtacaagggaggagtttacaaagaaagttcgcacaaacgctgcgatgggagctgtatttactgaagaaaatcagtgggatagcgccaaagcggcggtagaggatgaagatttttggaaattagtcgatagggaaagggaacttcataaactggggaagtgtggtagctgtgtgtataacatgatgggaaagagagagaagaaacttggagaatttggcaaagccaaaggctccagggccatttggtatatgtggttaggtgctagatacttagagtttgaagcattaggcttcctgaatgaagatcactggttctctcgtgaaaacagttattcaggcgtcgaaggcgagggattgcacaaattaggatatatactaagagatatctctaagataccaggaggagcaatgtatgcagacgataccgccggatgggataccaggataacagaagatgatctacacaatgaagagaaaataacacaacagatggaccctgaacatcggcaactagcgaatgcaatttttaagctaacctatcaaaataaagtagttaaagtgcaaagaccaacacctaccgggacggtcatggatattatatcacgtaaggatcaaagaggaagtggacaagttggaacctatggattaaatacgtttaccaacatggaagcccagcttatacggcaaatggaaggtgaaggggtgctatcaaaggcggacctagagaatccacacctaccagagaagaaaattacacaatggctagagacaaaaggcgttgaacgtctgaaaaggatggcaataagtggagatgattgcgttgtaaagccaattgacgacagatttgctaatgccttattagctttaaatgacatgggtaaaggtcggaaagacatcccacaatggcaaccctcgaaaggatggcacgattggcaacaggtcccattttgttctcatcattttcatgaactcataatgaaagatggaagaaagctcgttgtgccatgtagaccgcaagacgaactaatagggagagccagaatatcacagggcgcaggttggtcactgcgtgagaccgcatgcctagggaaggcttacgctcagatgtggtcactcatgtattttcaccgaagagatcttagattggcaagtaatgccatctgctctgcagtacccgtccattgggtacccacctcgaggacaacgtggtcgatacatgcacaccatcaatggatgacgacagaggatatgctgacggtgtggaatagagtctggattgaagataacccttggatggaagataaaacccccgtaacaacctgggaaaatgtaccatatttaggaaaacgtgaagatcaatggtgtggctcattgataggtttaacatctcgcgctacgtgggcacagaatataccgaccgcgatacaacaagtccgatctttaataggtaatgaagaatttctggactacatgccatctatgaaacgcttccgcaaagaagaagaatctgagggcgccatttggtag

SEQ ID NO: 23313 - RNA, 9873 nt, synthetic construct
  misc_feature 1..9873: note = derived and/or modified CDS sequence (opt6) from DENV-3__FJ182013__SS-prME
  source 1..9873: mol_type = other RNA
accagtttgtgcttaatgatgattttaccggcggcattagcatttcacctaacttcccgggacggagaaccccggatgatagtaggcaaaaatgaacgcggaaaaagtctcttattcaaaacagctagcggtatcaatatgtgcacgttaattgccatggatttaggtgaaatgtgtgacgatactgtgacatacaaatgcccccatattacagaagtggaaccagaagatatagactgctggtgcaatttaacgtctacatgggtaacctacggtacatgtaaccaagcaggagaacacaggagggataaaagatcagtagcactagctcctcatgttggtatggggcttgatacccgcacacaaacttggatgtccgcagagggagcctggcgccaagtagagaaagttgaaacctgggccttacgacatcctggttttacaatattagctttgtttcttgcccactatgtaggaacatcactgacacaaaaagtcgtaatcttcatactattaatgctagtgacaccgtcaatgacgatgcgttgtgttggtgtaggaaatcgagacttcgtagagggactcagcggcgctacttgggtcgacgtggttctagaacacggtggctgcgttacaacgatggccaaaaacaaaccaactttagacattgaactccagaaaacagaagcgacacaactagcaacactgagaaaattatgcatagaaggcaaaattacgaatatcacaacagattctagatgtcctacacaaggagaagctgtgttacctgaggaacaagatcaaaattacgtttgcaaacatacttacgttgacagaggttggggcaatggctgcggtctatttggtaaaggttcattagtaacatgtgcaaaattccaatgtctagaaccgatagaaggcaaagtcgtacaatatgaaaatctaaaatacacggtaataataaccgtccacactggcgaccaacaccaagttggaaatgagacacaaggtgtaacagctgaaatcaccccacaagcgtcaaccacagaggcaatactacctgaatacggaacacttgggcttgagtgctcgcctcgtaccggtctagattttaatgaaatgatattgctcaccatgaaaaacaaagcgtggatggtgcatagacaatggttctttgatctacctcttccatggacttcaggagctaccactgagacacctacctggaatcgaaaagagctattagttacgttcaaaaacgcgcacgcgaagaaacaggaagtggtagtactaggatcacaagaaggcgcaatgcatactgcattgaccggcgcgacagaaatacaaaattcaggtggaacaagtatcttcgctggccatcttaaatgccgattaaaaatggacaaacttgagttaaaaggtatgtcatatgctatgtgtaccaataccttcgtactgaagaaagaagtatcagaaacgcagcatggaactatattgataaaagtcgagtataaaggtgaagacgtaccatgcaaaatccccttctcaacagaagacggtcaaggaaaagctcataatggtagactaataacagctaatccagtcgtaacgaagaaagaagaacccgtgaatattgaagcagaacctccatttggcgaaagcaatattgttatagggattggagataatgcattaaaaatcaattggtataaaaagggttcttcaatcggaaaaatgttcgaggcgacggcgagaggtgcacgcaggatggcaatacttggggataccgcatgggattttggaagtgtgggaggagtactaaattcattgggaaaaatggtacaccaaatatttggaagcgcatacacagcattattttcgggtgtgtcctgggttatgaaaataggtatcggtgtgttattaacatggataggattaaattccaaaaatacatcaatgagttttagttgtattgcaatagggattataacactatatttaggagccgtagttcaagccgatatgggttgcgtcataaactggaagggcaaagaattaaaatgcggctcgggaattttcgtcacaaatgaggttcatacatggacagaacaatataaattccaggcggatagtccaaagaggttggcaaccgctatagcaggcgcgtgggaaaacggtgtttgcggtattagaagtacaaccagaatggaaaatttattgtggaagcaaattgcaaatgaattgaattatatcctttgggaaaacaatataaaacttaccgtagtggtaggcgatataataggagtattagagcagggtaaacggacgcttactcctcaaccgatggaattaaaatactcatggaaaacttggggaaaggccaaaatagtaaccgcagaaacccagaacagctcttttataatagatggtccaaatactcctgagtgtccgagtgcatctcgcgcatggaatgtttgggaagtcgaggactatggctttggagtgtttactaccaatatttggctaaaactacgtgaggtatacacccagctatgtgaccatcgtcttatgagcgccgcagtaaaagacgaaagagcagtccatgcggatatgggatattggatcgagtctcaaaagaacggaagttggaagctagaaaaggcatccttaatagaggtaaaaacgtgcacgtggccaaaatctcacacgctctggagcaacggtgtattagaatctgatatgataataccaaaaagtctcgctggtccaatttcgcaacataactaccgacccggttatcacacacagactgcaggcccctggcacctaggcaaattagaactggactttaactattgcgaaggtaccacagttgttataacggagaattgcggaacaagaggcccttctttaagaacgaccactgtttctgggaaacttatccatgagtggtgctgtcgttcctgtactttaccaccgcttagatatatgggagaagatggatgttggtacggtatggaaatcagacctattagcgaaaaagaagaaaatatggtgaagtcattggtatctgcaggtagcggaaaagttgataattttacaatgggcgttctctgcctagcaattctcttcgaagaagtaatgcgagggaagttcgggaagaaacacatgatagctggagtgttctttacattcgtattattgctatcggggcaaatcacatggcgtgacatggcacacacgttaattatgatcggatcaaatgcctcagatcgcatgggtatgggtgtcacttatcttgcattgatagctacatttaaaatacagccatttctcgcactaggatttttcttgcgtaaattaacatcgcgagaaaatctattactaggagtgggccttgccatggcaacaactctacaattaccagaagacatagaacaaatggcaaatggtattgcacttggattaatggctctcaaactaataacacagttcgaaacataccaactctggaccgcgttaatctctttaacttgttcaaatacgatttttacgcttacagtggcctggaggacagcgacattgattctagcgggagtaagcctccttccagtatgccaaagctcatctatgagaaaaactgattggcttccaatggcagttgccgcaatgggtgtccctccattaccgttgtttatcttttccctaaaagatacacttaaacgtagatcatggccgctaaatgaaggtgtgatggctgtgggattggtaagcatcttagcaagtagtctgctacgcaatgacgtaccaatggcaggaccgttagttgcagggggattattaatagcgtgttatgtgataacaggaacttctgctgacttaacggtggaaaaagccgcggatgtaacatgggaagaggaggctgaacagaccggggtttctcacaatcttatgattacagtggacgatgacggcactatgagaataaaagacgatgaaacagaaaatatactgacagttttattaaaaactgcactcctaatagtatctggtatattcccgtatagtatccctgcaacattgctagtctggcacacatggcaaaaacaaacccaacgaagtggagttttgtgggacgtaccttcaccgcccgaaacacaaaaggccgaattagaagaaggagtttatcgcattaaacaacagggaatatttggtaaaacacaggtcggagtaggcgtacaaaaagaaggggtatttcatacaatgtggcatgttacaaggggtgctgtattaacctataacggtaaaaggttagagccaaactgggctagcgtgaagaaagacttaataagttatgggggagggtggagattatctgcacagtggcaaaaaggagaggaagtccaagtgatagctgtcgaacccggcaaaaatcctaaaaattttcagacgatgccaggaacttttcagacaaccacgggagagataggggctatagctcttgattttaagccgggaacatctggctccccgattattaatagggagggaaaagtagtcggcctttacggaaacggggtcgtcaccaagaacggcggatacgtttcaggcatcgctcaaacgaacgccgagccggacggcccgacgcccgaattggaagaagaaatgtttaagaaaaggaatttaacaattatggacttacatccaggatctgggaagactcgcaagtacttaccagcgatcgttagagaagctattaagcgacggttacgaacccttatcctagccccgacgagagtagttgcagctgaaatggaggaggcacttaaaggtttacccataaggtaccaaacaacagctacaaaatcggaacatacaggcagagaaatcgtagacctcatgtgccacgcgacattcaccatgcgactcctatcgccagttagagtcccaaactacaatctgatcataatggacgaagcacatttcacggacccagcgagcatagctgcgagagggtacataagcactagagtaggaatgggagaagcagccgcaatttttatgacggcaacaccacccggcactgctgacgctttcccgcaatccaatgcgccaatacaagacgaagaaagggatataccagaacgttcgtggaactcaggaaatgaatggataacagattttgccggaaaaaccgtgtggtttgtacccagtataaaagctgggaacgacatagcaaactgcctaagaaagaacggcaagaaagtaatccaattgagcagaaaaacttttgatacagaatatcagaaaacaaagttaaatgattgggactttgtagtcactactgatataagtgaaatgggtgcaaatttcaaagcagacagagtcatagacccacggaggtgtcttaagccagtgatacttacggatgggcccgaacgagtcattttggccggccctatgcctgtaactgcagcatctgccgcacaaagacgaggcagagtaggtagaaacccacaaaaagaaaatgaccaatacatatttactggccaacccttaaacaacgatgaagaccacgcgcattggactgaagcaaaaatgttattagacaacataaatacaccagaaggtattatacccgctttatttgaacccgaacgagagaaaagtgcggcaatcgatggtgaatatagactcaaaggtgaaagtaggaaaacattcgtagagttaatgagaagaggtgatctgccagtatggctagcacataaagtcgcctctgagggaataaagtacacagatcgcaaatggtgttttgatgggcaaagaaacaaccaaatattagaggaaaatatggacgtggagatctggacaaaagaaggcgagaagaagaaactacgtccaaggtggcttgatgcacgtacatatagtgatccacttgctttaaaggaatttaaagatttcgccgccggaagaaaatcaatagcactagatctcgtcacagaaatagggagagtaccatcgcatttagcacatagaacgcgcaacgctctagataatctggtaatgctacatacatcggagcatggcggcaaagcatacaggcatgctgtagaagaattaccagagacaatggaaactttattactcttagggctgatgatattactgacgggcggagccatgctatttctaatctcaggtaaaggaataggaaaaacgagtataggcctcatctgtgtaatagcgagcagtgggatgctttggatggccgagattccattacaatggatcgccagtgcgatagtactggagttctttatgatggttttgctaatacccgaacctgaaaaacaacggacacctcaggataaccaactcgcctatgtggttattggtatattaacattagcagctataatagcagccaatgaaatgggattattagagaccacgaaacgtgacttaggtatgagtaaagagccgggtgtagtcagtcctacaagttacttagatgtagatctccaccccgcgtccgcatggactctctacgcagttgcgaccacagtaataacacccatgcttcgacatacaattgaaaacagcactgcaaacgtatccttagctgccatagcaaatcaggccgttgtgcttatgggattagacaaaggttggccaataagtaagatggatttaggagtcccgctcttagcactaggttgctatagtcaggtaaatccattaaccctgacagcagccgtacttctcttaattacgcactatgcaataataggccccggacttcaagccaaagcaacgcgagaagcgcaaaaacgtacggcagctggtataatgaagaatcctaccgtagatggtatcatgaccatagatttagatccggttatttatgactcaaagttcgagaaacagcttggacaagtcatgttgctagtattgtgcgctgtacaattgctgcttatgcgaaccagttgggctctgtgtgaagctcttactctagctactggacctataacaaccctctgggaaggcagtcctggtaaattttggaatacaacgattgcagtttcgatggcaaatattttcaggggtagctacttagctggagctggccttgcctttagtattatgaaatccgtaggtacaggaaaacgaggcacaggaagccaaggtgaaaccttaggtgaaaaatggaagaagaaactaaatcaactatcaagaaaagagttcgacctatataagaaatccggaatcacggaagtagaccgaactgaagcgaaggaaggtttaaaacgaggcgaaatcactcatcacgcagtatcaagaggatcagctaaactacagtggttcgtggaacgtaacatggtcattcctgaaggaagggttatagacttgggctgtggaagaggagggtggagttattactgcgcaggacttaagaaagtcacagaagtaagaggttatactaaaggagggcccgggcatgaagaacccgtcccgatgtctacttatggttggaatatagtaaaactcatgagtggcaaggacgtattttatttaccaccggagaaatgtgacacattattgtgcgatataggagagtcctccccaagtcctactgtcgaagagtcaaggacaatacgcgtactcaaaatggtagaaccctggctcaaaaacaatcagttttgtatcaaagttttaaatccttatatgccaacggtgatagaacatttggaacgattacaaaggaagcacggagggatgctggtcagaaatcccctatctagaaattccacccatgaaatgtactggatatccaacggaaccgggaatatcgttgcttctgtaaacatggtcagtcggctattactcaacaggtttacgatgacccaccgcagacctacgatagagaaagatgtggacttaggagcaggtaccaggcacgtgaatgcagaaccggaaactccaaatatggatgttataggggagagaatcaagcgtataaaagaagaacataatagtacatggcattatgacgatgaaaacccttacaagacatgggcttaccatggttcatacgaagtgaaagcaactgggtcagcgtcttctatgataaatggagtagttaaactgctaacgaaaccatgggacgttgtaccaatggtgacgcaaatggcaatgacggacacaacaccattcggccagcaaagagtcttcaaagaaaaagtagatacaaggactcccaggagcatgccgggtactcgccgtgttatgggaataactgctgaatggctctggaggaccctcggacgtaacaagaaaccaagattatgtactagagaagaatttactaagaaagtaagaacaaacgctgccatgggagctgtgttcacagaagaaaaccaatgggattcagccaaagccgcagttgaagacgaagatttttggaagttagtagacagggagagagaattacataaactcggaaaatgtggaagttgcgtgtataacatgatgggaaaaagggaaaagaagttgggagaatttggaaaagccaaaggttcaagagctatatggtacatgtggttaggtgcacgttatttagagtttgaagccctagggtttcttaacgaagaccattggttttcgagggaaaactcttatagtggagtagaaggtgaaggactgcacaaactcggatatattctgcgagacatttctaaaatcccgggcggagctatgtatgccgacgatacagctggatgggataccagaatcactgaggatgacttacacaatgaagagaaaataactcaacagatggacccagaacatcgtcaactagctaacgcaatctttaaactaacctaccaaaataaagtcgtgaaagttcaacgtccgacaccaactggaacagtaatggacataatcagtagaaaagatcaacgtggatctggccaagtcgggacttatggacttaatacatttaccaacatggaagcccaactaataagacagatggaaggagaaggggttctcagcaaggctgatttggaaaacccacatttgccagagaagaaaataacacagtggctagaaactaaaggagttgagagactaaaaagaatggccataagtggagatgattgcgttgttaagcccatagacgaccgatttgctaatgctttgttggctctaaatgatatgggaaaagtcagaaaggacataccacaatggcaaccctctaaaggttggcatgactggcaacaagtaccgttctgcagtcaccatttccatgaacttatcatgaaagacggccgaaaacttgttgtgccctgccgtccccaagacgaactaatcggtagagcaagaatctcacaaggagccggttggagtttaagagaaactgcatgtttgggaaaagcatacgctcagatgtggtcccttatgtattttcatcgtagagacttaaggttagctagtaatgccatatgcagtgcagtgcctgttcactgggtacctacttcgcgcactacgtggagtattcatgcacatcatcaatggatgactacagaagacatgctaacagtatggaacagggtttggattgaagacaatccttggatggaagataaaactccagttacgacatgggagaacgttccatacctcggaaaacgcgaagaccaatggtgcggaagtctgataggcctaacttcacgtgctacatgggcacaaaatatacctacggccatacaacaagttaggagcctaattggtaatgaagaatttttagattacatgccaagtatgaaaagatttcgtaaagaagaagagtctgagggagcaatctggtga

SEQ ID NO: 23314 - RNA, 9873 nt, synthetic construct
  misc_feature 1..9873: note = derived and/or modified CDS sequence (opt6) from DENV-3__EU781136__SS-prME
  source 1..9873: mol_type = other RNA
acttcactttgtcttatgatgatcttacctgcagcgctggcttttcatctaaccagtagggatggtgaacccagaatgatcgtcggtaaaaacgaaaggggaaaatcccttctatttaaaacagcatcggggatcaatatgtgtacactaattgcgatggatttaggagaaatgtgtgacgacactgttacgtacaaatgtccccatataactgaagtagaaccagaagatattgattgctggtgcaatcttacaagtacatgggtcacatacggaacctgtaaccaagctggtgaacatagacgtgacaaacgttctgttgcactagcaccacatgtcggaatgggattagacacaagaacacagacctggatgagcgcagaaggtgcatggcgacaagtggaaaaagtagaaacttgggccttacgacaccctgggttcacgattctagcactgtttctcgcacactacattggaactagcttaactcaaaaagtcgttatatttatcttactgatgttggttacccccagtatgactatgcgatgcgtaggagtgggaaaccgtgatttcgtcgaaggactgtctggggcaacatgggttgatgtggtcctcgaacacggagggtgtgtcactacaatggctaaaaataaacctacactcgatattgaacttcagaaaacagaagctacacaacttgcaacactacgcaaattatgtatagaaggaaaaataactaatatcactacagacagtaggtgcccaacgcaaggtgaagctgtcttaccggaagaacaagaccagaattacgtttgcaaacacacatatgtagatagaggatggggaaatggatgtggattatttgggaaaggttcactcgtcacatgtgctaaatttcaatgcctagaaccaatagaaggaaaagtagttcaatatgaaaaccttaaatatacagtcataatcacagttcacacaggggatcagcatcaagtaggaaacgaaacgcaaggagtcactgctgagataacaccacaagcaagtaccacagaagctatactcccagagtatggcaccttaggattagaatgtagcccccgaacaggtctggattttaatgaaatgattttgttaacaatgaaaaacaaagcatggatggtccacagacaatggtttttcgatttgccactaccttggacatctggagccacgacagaaacaccgacatggaaccgtaaggagctattagtcacatttaagaatgcccacgccaaaaagcaagaagttgtcgtactaggttcacaagaaggagctatgcacacagctctaaccggcgccaccgagatacaaaattctggtggaacatccatatttgctggacatttaaaatgtcggcttaaaatggataaattagaactgaaaggaatgtcatacgcgatgtgtacaaatacttttgtgctaaagaaagaagtatcggagactcagcatgggactatactcataaaagttgaatataaaggtgaagatgtaccatgtaaaattccattctcaacagaagatggtcaaggaaaggcccacaatgggagactaataactgctaatccagtggtaaccaagaaggaagaaccagtcaatatagaagctgaaccccctttcggagaaagcaatatagttatcggaatcggagataatgctctcaagatcaactggtataagaagggttcatcaataggaaagatgttcgaagccacagccagaggcgcccgtagaatggcaatcctaggagatactgcttgggatttcggaagcgtaggtggagtccttaattccctaggaaaaatggtgcatcaaatctttggatcggcatacactgcacttttcagtggtgtttcatgggtaatgaaaattggaattggcgttctcctgacttggatagggcttaatagcaaaaatacgtccatgtcattcagttgtatcgcaataggtataataacgttatatcttggagcggtggtgcaggctgacatgggttgcgtagtaaactggaaagggaaagagttaaaatgcggttcaggcatatttgtaacaaatgaagtccatacttggactgagcagtacaaatttcaagcagactcccctaaaagactggcaactgcaattgctggcgcgtgggaaaatggagtatgtggaataaggtccacaaccagaatggaaaatttactatggaaacagatagccaacgaactcaactacatactctgggaaaataatataaaattaactgtggtagttggagatataataggggtccttgaacaagggaagaggactttaactccccagcccatggaattaaaatattcatggaaaacttggggaaaagcgaagatagtaactgcagaaactcagaacagttcatttattatagatggaccaaatactcctgaatgtcccagtgcttcacgagcctggaacgtatgggaagtagaagattatggattcggagtcttcactacaaatatttggttaaagctacgagaagtgtatacacagttatgtgatcatcgattaatgtcagcagctgtgaaagacgaacgagcagttcatgccgatatgggttactggatagaatctcagaaaaacggttcatggaaactggaaaaggcttcattaattgaagtaaaaacatgcacatggccaaaatctcatactttatggtcaaacggtgtactagaatcagatatgattataccaaaatctctagcagggccaataagtcaacataactataggcccggataccatacgcaaactgctggtccatggcatctaggcaagctagaattagattttaactactgcgaaggcacaacagtagtaataacggaaaattgtggaacaaggggtccatctctccgcacaacgactgtttccgggaagctaatacacgaatggtgctgtaggtcatgcaccttaccaccactacgatacatgggcgaggatggatgctggtatgggatggagataaggcccataagtgaaaaggaagaaaatatggtaaaaagtctggtaagcgcagggtctgggaaggtagacaactttactatgggagtactctgtttggcaatcttatttgaagaagttatgagagggaaattcggcaagaaacacatgatagctggcgtattctttacattcgttctgctactatcagggcagataacatggagagatatggcgcacaccttaatcatgataggctccaatgcctcggaccggatgggaatgggagtgacgtatttagccttaatcgccacattcaaaatacaaccgtttttagcccttggtttcttcctgagaaagttgaccagtagagaaaacctattacttggtgttgggcttgcaatggcaaccactttacaactacccgaagacatagaacagatggcgaacggtattgctctgggcttaatggcgctaaagttaataacgcaatttgaaacgtatcagttatggacggcattaatatcattaacatgtagcaacacgatattcactttaacggttgcgtggcgaacagcgacgctcatactcgccggggtctcactgttgcccgtgtgccaatcaagtagtatgaggaaaaccgattggttacccatgacagtagcagcgatgggggtgcctcctttaccgctgttcatattttcattgaaagatactctaaaaagaagatcatggccacttaatgagggagtaatggcagtcgggttagtaagcatattagccagctcacttctgcgaaacgatgtccccatggctggacctcttgtagccggtggactgttaatagcatgttacgttattactggaactagcgcggatctaacagttgaaaaagctgccgacgttacttgggaagaggaagctgagcagacaggtgtctctcataatcttatgattacagttgacgatgatggaacgatgagaataaaagatgatgagacggaaaatatccttaccgttcttttgaaaacggctctgttaattgtaagtggaatcttcccctatagcatacctgctacacttctcgtctggcacacatggcaaaaacagacacaaagatctggagttctatgggatgtgcctagtccacccgaaactcaaaaggccgaactcgaagaaggtgtatatcgaataaaacagcaaggcatctttggaaaaacacaagtgggtgtgggagttcaaaaagagggagtattccatacaatgtggcacgtaacgcgcggtgctgttcttacctacaatggaaaacgtttagaacccaattgggcaagcgttaaaaaggacctgatatcctatgggggtggttggcgattatctgctcaatggcaaaagggtgaagaagttcaggtaatagcagttgaaccaggcaaaaaccccaagaatttccaaacgatgccaggcacatttcaaacaactactggtgagataggagctattgcactggattttaagccagggacttcagggagtccgataataaaccgagagggtaaagtagtaggcttatatggaaacggcgtggttacgaaaaatggtggatatgtcagtggaatagcacaaacaaacgccgaaccagacggacctacaccagagctggaagaggaaatgtttaagaaacgaaatctcacgatcatggatttgcaccctggcagtggcaaaaccagaaagtatctcccggcaatagtaagagaagcgatcaaaaggcgtttgaggacgcttattctagcgccgacaagagtggtagctgccgagatggaagaagcattaaaaggtctccccattcgctaccaaaccaccgctacaaaatccgaacatactggaagagaaatcgtcgacttaatgtgtcacgcaacctttactatgcgactcttaagtcctgtaagagtgccaaattacaatctgataattatggatgaagctcattttacggatcctgcatcgatagcggcacgaggatatataagcacacgagtaggtatgggagaagcggccgctattttcatgaccgctacgcccccaggtacggccgatgcattcccccaaagtaacgccccgatccaagatgaagaacgagatataccagagagatcatggaactctgggaatgaatggatcacagacttcgctgggaagacagtttggtttgttccttctataaaggcagggaatgatatcgccaactgtctaagaaagaacggcaagaaagttatacagttatcgagaaaaacatttgacacagagtatcagaaaacaaaattaaacgactgggatttcgtggtaacaacagatattagtgaaatgggggcaaattttaaggcagaccgagtcatagatccaaggagatgtctgaaacccgtgatcctcaccgatggtccggaaagagtaatattagctggtccgatgccagttacagctgcatctgcggcccaacgaagggggagagtaggtaggaacccacaaaaagaaaacgatcaatacatcttcactggacagccgcttaacaacgatgaagaccacgcccactggacagaagccaaaatgttactagacaatatcaacaccccagaaggcataataccagcgttgttcgaaccagagcgggaaaaatcggcagccatcgatggggaatatagattaaaaggagaatcaaggaagacatttgtagaattgatgagaagaggcgatttacctgtctggctagcgcacaaagttgcaagcgaaggtataaagtacaccgaccgaaaatggtgttttgacggtcaaaggaataatcaaattttagaagaaaatatggacgtcgaaatatggacgaaagagggcgagaagaagaaattaagaccgagatggctagacgcccgaacgtacagcgaccccctagcacttaaagagttcaaagacttcgcagctggaaggaaaagcatcgcactggacttagtaactgaaattggaagagtcccatcccacttggcacatagaacaagaaatgccctagataacttagtaatgctacatactagcgaacacgggggaaaagcctataggcatgcggtcgaggagttgcctgaaacaatggagactcttctattactaggtctcatgatactactcactggtggtgcaatgctgttcctaattagtggcaaaggaatcggaaaaacaagcatcggactaatttgtgtgattgcatcgtccggaatgctctggatggctgaaataccattacaatggatcgctagcgctatcgtactggagttcttcatgatggttttgctaataccggaaccagaaaaacagagaaccccacaagacaaccaattagcatacgtggttataggtatactaacgctagcagcaataattgctgcaaacgaaatgggattacttgagacaactaaacgagatctcggaatgtcgaaagaaccaggggttgttagccccaccagctatctagacgtagacctccatccagcctcagcctggactttgtacgctgtcgcaacgactgtaatcacgcccatgcttagacatactattgaaaacagcaccgctaacgtatctctggctgctattgccaaccaggcagtcgtattaatgggtctcgataagggatggcccatatccaagatggatcttggtgtacctcttttggccctaggatgttactcacaagttaatcccttaacattaacagcagcggtactacttcttatcactcattatgcaataattggcccaggactacaggcaaaagcgacaagggaagcgcaaaaacgaaccgcagcggggataatgaaaaatccgacagttgatgggataatgactatagatttggatcctgtaatttatgattcaaaatttgaaaaacaattaggacaagtgatgctcctagttctttgcgccgttcaactcttacttatgagaacatcatgggctttgtgtgaagccttaactttagcaacaggtccaatcacaacgttatgggaaggatcgccgggaaagttttggaataccacgattgcagtgtctatggctaatatttttagaggttcttacctagctggggcaggactcgctttcagtattatgaaatccgtaggaactggaaagcgaggtactggatcccaaggagaaacgttaggggaaaaatggaagaagaaattaaatcaactttccaggaaagagttcgatctgtacaaaaagtctggaataactgaagtggatagaacggaagcgaaagagggcttgaaacgcggagagattacccatcacgcagtaagtcgtggcagtgcaaaattacagtggtttgttgagagaaatatggtcataccagaaggacgcgtcatagacttaggttgtgggaggggaggttggagctattattgtgccggactaaagaaagtaacagaagtgaggggatataccaagggcggcccaggtcatgaagaaccagtacctatgagcacctacggttggaatattgtaaaactcatgagcgggaaggatgtattttacctacctccagaaaaatgcgacactcttctttgcgatataggtgaatcctcaccatccccgacagtagaggaatcaaggacaatcagagttttaaaaatggtagaaccttggcttaaaaataatcagttctgtatcaaagtcttaaatccatatatgccaacagtaatagaacacctagagaggctacaacgaaaacatggaggaatgctagttcgcaacccactatcaagaaattctactcatgaaatgtattggatttccaacggaacagggaatattgtagcgtcagtaaatatggttagtcgcctccttcttaatagattcaccatgactcatcgaagaccaacgattgaaaaagacgtagatctgggtgctgggacacggcatgttaacgcagagccagagacaccaaatatggatgttataggagaaagaataaagagaataaaggaggaacacaactcaacctggcattatgatgacgagaacccatataaaacttgggcctatcatggaagttatgaagttaaagctacaggttcagcgtcttccatgatcaatggagtagttaaactccttactaaaccttgggacgtggtgccaatggttactcaaatggccatgactgacaccacacccttcggacagcaacgagtatttaaagagaaagtagatacaaggactcccaggtcaatgccgggcaccagaagggtaatgggaataactgctgagtggttatggaggacattagggagaaataagaaaccgcggttatgtactagagaggagttcacaaagaaagttcgtacgaacgctgctatgggagctgtctttacggaagagaatcaatgggattctgccaaagccgctgtggaagatgaagacttttggaaacttgtagaccgtgaacgcgaactgcacaaattaggtaaatgtggaagctgtgtttataacatgatggggaaaagagagaagaaactaggtgaatttgggaaagccaagggatcaagggcaatttggtatatgtggctcggtgcaagatacctagagttcgaggccttaggattcctaaatgaagaccattggttcagcagggaaaactcatacagtggagtagaaggggagggtctccataagttaggctatatcttgagggacatatcaaagatacccggaggcgcaatgtacgcagatgatacggcaggttgggacacacgaattacagaagacgaccttcacaatgaagagaaaattactcaacaaatggaccccgaacacagacaattagcaaatgctatattcaagttgacctatcaaaacaaagtagtcaaggtacagcgaccaacaccaacaggcacagtaatggatataattagcagaaaggatcaacgagggtccggacaggtcggtacatatggactcaatacctttacaaatatggaagcacaacttatccgacaaatggaaggagaaggagtcttgagcaaagcagatctggaaaacccgcatctacctgagaagaaaatcacacaatggttagaaacaaaaggtgtcgaaaggcttaaacgtatggcaataagcggagacgactgcgtcgtgaaaccaattgatgaccggttcgccaacgcattactagcactaaacgatatggggaaagtaagaaaggacatacctcaatggcaaccgagtaaaggatggcatgattggcaacaggttccgttttgtagccaccacttccatgagcttataatgaaagatggaagaaaattagtagtaccatgtaggcctcaagatgagttaataggacgagctaggatcagccaaggggccggatggtcgcttagagaaactgcctgtcttggaaaagcgtatgcacaaatgtggagcctaatgtacttccacagaagagatttgcgattagcatcgaacgcaatatgttcagctgtgccggtccactgggtcccaacatctcgcaccacatggtccatacacgcacatcatcaatggatgactaccgaagatatgctgaccgtctggaatcgtgtatggatagaggacaacccttggatggaagacaaaacccctgtgactacctgggagaatgtcccctatttaggtaaacgcgaggatcaatggtgtggaagtcttattggactaaccagcagagccacatgggcgcaaaatatacctaccgcaatacaacaggtaagatcactgattggcaatgaagagttccttgactatatgcctagcatgaaaagattcaggaaggaagaagaaagcgaaggggcaatctggtag

SEQ ID NO: 23315 - RNA, 9873 nt, synthetic construct
  misc_feature 1..9873: note = derived and/or modified CDS sequence (opt6) from DENV-3__EU781137__SS-prME
  source 1..9873: mol_type = other RNA
acgtctttatgtttaatgatgatccttccagctgcactagcctttcatctaacatcacgagacggtgaaccgcgaatgattgtaggtaaaaatgaaagaggtaaaagtctattatttaaaaccgcgtcaggaattaatatgtgcactttgatcgccatggacttaggtgaaatgtgcgatgataccgttacatataaatgtcctcatattacagaagtggaaccagaagacatagattgttggtgtaacttaacaagcacctgggtaacttatggaacatgcaatcaagcaggagaacatagacgtgataaaagaagtgttgcgcttgcaccccatgttggcatgggattggacaccaggacacaaacgtggatgagtgcagaaggagcttggagacaggttgaaaaagtcgaaacatgggctcttagacatccaggatttactatactagccctttttcttgcccattatataggcacaagtctaactcaaaaagtcgtcatcttcactctactaatgcttgtgactcccagtatgacgatgcgttgcgtaggagttggaaacagagattttgtagaaggtctttcgggcgctacatgggtggacgtagttttagaacacggaggatgcgttactaccatggcgaaaaacaaacccaccttagatatcgaactccagaaaacagaagcaactcaactcgcaacattaaggaaactttgcatagaaggcaaaataacaaacattaccactgatagtcgttgtccaacacaaggagaagcagttctacctgaagaacaagaccaaaattacgtatgcaaacatacatatgtcgatagaggctggggtaatggttgtgggcttttcgggaaaggatccttagtaacatgtgctaaatttcaatgtttagaaccaattgaaggaaaagtcgtacaatacgaaaacctaaaatataccgttataatcacagttcataccggagaccaacatcaagtcgggaatgaaacgcagggggtaactgcagaaataactccacaagcgagcacgaccgaagcgatactacccgaatacgggacactcggtctggaatgtagtccacggacaggactggatttcaacgaaatgattttattaacaatgaaaaacaaagcctggatggtgcatcgacaatggttctttgatttaccgcttccatggacatcaggtgcgactaccgagacgccaacatggaacagaaaagaactattagtaactttcaaaaacgcacacgctaagaaacaggaagtagttgtactaggaagccaggaaggcgccatgcatactgcacttactggagccacggaaattcaaaacagtggaggcactagcatctttgccggtcacttgaaatgtaggttaaaaatggacaaattagagctcaaaggtatgagttatgcgatgtgcacaaacacgttcgtactcaagaaagaagtttccgaaacccaacatggcaccatattaataaaagttgaatacaaaggagaagatgtaccttgtaaaattccattttcaacggaagacggacagggaaaagctcacaacggcagactgataacagctaatccagtagtaactaagaaagaagaaccagtaaatatcgaggcagaaccaccatttggggaaagtaatatcgtgatagggataggcgataacgccctaaaaataaactggtacaagaaaggttcaagtatagggaaaatgttcgaagcgactgccagaggtgcacgtaggatggcaattctgggggatacagcatgggacttcgggagcgtaggaggagttttaaattcactcggaaaaatggttcatcaaatctttggaagtgcttacactgcactattttctggtgtgagctgggttatgaaaatcggaataggtgtcttattaacatggattggacttaatagcaaaaatacaagcatgtcatttagctgtatagcgataggaataattactctatatctaggagcagtagtgcaggccgatatgggatgcgtcataaattggaaaggaaaagagctgaaatgtggctcgggaatctttgtcaccaacgaagttcacacatggaccgaacaatacaaatttcaggcggacagcccgaaacgattagcaactgcaatagcaggagcgtgggaaaacggagtgtgtgggatacgatcaacaactagaatggagaatctcctttggaaacagattgccaatgaactaaattatatactctgggaaaataacataaaactaactgtagtagtaggcgacatcatcggggttttggaacaaggaaaaagaactttgacacctcagcctatggagttgaaatactcttggaaaacatggggcaaagcaaaaatagttaccgccgaaacccaaaattcgtccttcataatcgacggaccgaacacaccagaatgcccatcagcatcccgcgcctggaatgtatgggaggtggaggattatggttttggtgtgttcactaccaacatttggttaaaactacgtgaagtttatacgcaattgtgtgatcatcgactaatgtcagctgctgtaaaggacgaacgagccgtgcacgcggatatgggctattggattgagtcgcagaaaaacggatcatggaaattggagaaagcgtcattaattgaagtaaagacgtgcacgtggccaaaatcacacactttatggtctaatggcgtattagagtccgatatgataattcctaaaagtttagccggaccgatatcgcagcacaattaccggccagggtatcatacacaaacggctggtccatggcacttaggtaaattagaactggactttaactattgcgagggtacaactgtcgtaataactgaaaattgcggtacgcgtggtccgtcattacgcaccactacagtatctggaaaactaatacatgaatggtgttgcaggtcatgtactctacccccattacgatacatgggggaagacggatgttggtatggaatggagattagacctatatcggaaaaggaggagaacatggttaaatctttggtttcagcggggtcaggaaaagtagataactttacgatgggcgttctctgtctggcgatattgttcgaggaagtgatgagggggaagtttggcaagaaacatatgattgccggtgtattctttacatttgttttgcttcttagtggacaaattacatggcgcgatatggcgcacactttaattatgattggatcaaatgcatcagacaggatggggatgggcgtgacttatttagcgctgatagcgacatttaaaatccaaccattcttagcgctgggattctttctgcgaaaattgaccagtcgggaaaatcttctattaggcgtaggactggccatggctacaaccttgcaactcccagaagacatagagcaaatggccaacggaatagcgttaggattgatggctttaaaacttataacacaatttgagacttatcaattatggactgctctaatttctttgacctgttcaaacacaatatttacattgaccgttgcatggagaaccgccacccttatactagctggcgtaagtctattaccggtatgtcaaagttcaagtatgagaaaaacagattggctacctatgactgtcgcagctatgggagttccacctttacccctattcattttctcattaaaagatacgctaaagcgcagatcatggccactaaatgagggggttatggccgtcggtcttgtgagtatattggcttcatcattactaagaaacgatgttccgatggcaggtcctcttgtagcaggcgggttattaattgcctgttatgtcatcactgggacaagcgcggacttaacagtagaaaaagctgcggatgtaacttgggaggaagaggcagaacagacaggtgtatcccacaacttaatgataacggtagacgacgatggcacaatgaggataaaagatgacgagacggaaaacatattgacagttctgctcaaaaccgccttactaatagtatcaggaatttttccgtatagcataccagcaactctattagtttggcacacctggcaaaagcaaacacaaagatccggagtgctatgggatgtcccatcaccaccggagactcagaaagctgaactagaagaaggtgtatataggattaaacaacagggaatcttcggcaaaactcaagtgggggtaggcgttcaaaaagaaggagtatttcacaccatgtggcacgtgactcgtggagcagtccttacttataatggaaaacgccttgaacctaattgggcatcagttaagaaagacttgatatcctacggaggcggatggcggctatcagcacaatggcaaaaaggagaggaagtgcaggtaatagcagtggaacccggcaaaaaccctaaaaattttcaaacaatgccagggacatttcaaactactactggggaaattggagcgatcgctctcgacttcaaaccaggaacttcaggcagtccgattataaatagagaaggaaaagttgtaggtctttatggaaacggagtcgtaactaaaaacggtggatatgtttcgggcattgcccaaaccaacgctgaaccggatggaccaacgcctgaactagaagaggaaatgttcaagaaaagaaatttaactatcatggatctacatcccggtagcggaaaaacgagaaaatatttgccagccattgttagagaagcaataaagcgaagacttaggacattaatactcgcgccaaccagagtggtagctgctgaaatggaggaggcccttaagggacttcctatcaggtatcaaacaacagccactaagtctgaacataccggtagagaaatagttgatctgatgtgtcatgctacctttacaatgagattattatctcctgttagggtcccaaattataatctcataataatggatgaagcgcactttacagaccctgcttcaatagcagcccgagggtatattagtactagggtggggatgggagaagctgcggctatttttatgacagctacacctcccggcacagcagatgccttcccacagtcaaatgcgccaatacaagatgaggagagagatatacccgaaagaagctggaacagcggtaatgaatggatcacagattttgctggtaagacagtgtggttcgtacctagtatcaaggcgggcaatgatattgctaattgtctaaggaaaaacgggaagaaagtcatacaactaagtagaaagacatttgataccgaatatcaaaagactaagttgaatgattgggactttgtggttacaacggacatttcagaaatgggcgcaaacttcaaagcagatcgtgtaattgatcctagacgatgtctaaagccagtaatacttacagacggtccggagagagtgatattggctggacccatgcccgtaactgccgccagtgcagcccagagaagaggaagagtaggaagaaacccacaaaaagagaatgatcaatatatttttacaggacagccactcaataacgacgaagatcacgcgcactggactgaagcaaaaatgctgctagataatattaataccccagaaggtatcatacccgctttattcgagccggagagagaaaagagcgccgctatagatggagaatatagattgaaaggagagagtagaaaaacattcgtagagttgatgagacgtggtgatttaccagtttggttggcacataaagtcgcatcagagggaatcaaatacacagataggaaatggtgctttgatggccagaggaataatcagattcttgaagaaaacatggatgtagagatatggacaaaggagggtgagaagaagaaactaagaccgcgatggcttgacgcaagaacatactcggatccactagctttgaaagaatttaaagactttgcggcaggcaggaaaagtatcgccttagatttggtcacggagatcggaagagtaccttcacatttggcccacagaacacgcaacgcactcgataatttggtaatgctacacacaagtgaacacggaggcaaggcttataggcacgctgtagaagaactccccgagacaatggaaaccctattactcctcgggttaatgattctacttactggtggtgcaatgttattcttgatatcaggaaaaggcattgggaaaacgtcaatagggctaatttgcgtaattgcatcatctgggatgctatggatggccgaaatcccattgcagtggatagctagcgctatagttctagagttcttcatgatggttcttttgattcctgaaccggagaagcagcggacaccacaggacaaccaactagcgtacgtggtaataggaatactcaccttagcagcaataatagcagcaaacgaaatgggtttgctcgagactaccaaacgagatcttgggatgagcaaagaaccgggtgtagtaagtccaacgagctaccttgatgtcgatttgcatcctgcttcggcttggacgttatatgcagtagcgacaacagtaataactccgatgcttcgacacaccatagaaaattcaacggcaaatgtatcgctcgcggcaatcgccaatcaagcggttgttcttatgggtctcgacaagggatggccaatttctaaaatggacctaggtgtacccctactggcattaggctgctattctcaggtgaatcccctgactttaacggcagcagtgctgctactcataactcactatgctattatcggtccagggcttcaagcgaaagcaactagagaagcacaaaagaggacagcagcaggaataatgaaaaatcctactgtagacggaatcatgactatagacttggacccagttatatatgattcaaaatttgaaaaacaattaggtcaagtaatgctgttagttctatgtgccgtgcaacttctattaatgcgaacttcttgggccttatgtgaggctttaactttagcgacaggaccaataactactctctgggaaggaagccctggcaagttctggaatacaacaatagctgtctcgatggctaacattttccgaggttcctatctggccggagctggcctggctttttctataatgaaatcagttggcactggaaagagaggtacaggttcacaaggagaaacattgggtgaaaaatggaagaagaaactgaaccaattgtcacgcaaagaatttgatttatacaagaaatcaggaataaccgaagtagaccgaacggaagcaaaagagggtttgaaacggggagaaataacgcaccatgcggtttcacgtggctcagccaaattgcagtggttcgtcgaaagaaatatggttataccagaaggcagagtcatcgacctaggatgtggtcgcggaggatggagctactattgcgcaggtctaaagaaagtaacagaggtaaggggttatacgaagggaggtccaggacatgaagaaccagtccctatgtccacatatggatggaatatagttaagttaatgtctggcaaagatgttttctatttaccaccagagaaatgcgatacgttactatgcgatattggagaatcctcaccatcaccgacagtagaagagtccagaactattagagtcctgaaaatggtggagccatggctaaagaataaccaattctgtataaaagtgttaaacccttacatgcccaccgtaatagagcaccttgaacgacttcaaaggaaacacggaggaatgttggtaagaaacccactatctcgcaactccacacatgaaatgtattggatttcaaatggtacgggtaacattgtcgctagtgtaaacatggtcagtagattattattaaatagatttacaatgacacatagacgaccaaccatcgaaaaagatgtagatctgggtgcaggaacacgtcatgttaacgccgaaccagagacaccaaacatggatgtaatcggggaaagaataaaaagaataaaagaagaacataactctacttggcactatgatgacgaaaatccatataaaacatgggcatatcatggttcttatgaagtaaaagcgacaggtagcgcctcctcaatgataaatggagttgtaaaattactgacgaagccatgggacgtagtacctatggttacacagatggcgatgacagatacaactccatttggccagcaaagagtatttaaagaaaaagtggatacgagaacgcctcgctccatgcccggaaccaggcgtgttatgggaattacagccgaatggttatggagaacgttgggaagaaataagaaaccgcgactatgcactcgcgaagagttcacgaagaaagtgagaacaaacgccgcaatgggtgctgtatttacagaggagaatcagtgggactcagcaaaagcagcagtagaagatgaagatttctggaagttagtcgatagggagcgtgaactccataaattggggaaatgtggatcttgtgtatacaatatgatgggaaaaagagagaagaaattaggtgaatttggcaaagcaaaaggtagcagggcaatttggtacatgtggttgggggccagatatctagagtttgaagccctagggtttcttaatgaagaccattggttttcaagggaaaacagttattccggagtggagggagaaggactacataaactcggatatattctccgggacataagtaaaattccaggcggcgcgatgtatgcagacgataccgcgggatgggatacaagaatcacggaggatgacctgcacaatgaggagaaaattacgcagcagatggatcctgaacaccgccaactagccaatgcgatttttaagctcacttatcaaaacaaagtagtcaaagtacaaagacccacaccgactgggacggtgatggacattatctcgcgaaaagatcaacgtggatctggacaagtagggacctacggtttaaacaccttcactaacatggaagctcaattgattcgacagatggagggggaaggcgtcctcagtaaagcagacttagaaaacccgcatcttcctgagaagaaaattactcaatggttggaaacaaaaggagtagaacggttaaaaaggatggcaatatcaggagacgactgcgttgtaaaacctatcgatgacagatttgccaatgccttgcttgcgttaaatgatatgggtaaggtacgtaaggatataccacaatggcaacccagtaaaggttggcatgattggcaacaagtccctttttgctcgcaccattttcatgaattagtaatgaaagacggtcgaaaattagtagtaccatgtaggcctcaagacgaactcataggccgagctaggatatcacaaggagctggttggtctttgcgtgaaaccgcctgcctaggcaaggcttacgcgcaaatgtggagtttaatgtatttccatcgtagagaccttcgtttagcgtcaaatgcgatatgttcggccgttccagtacattgggtaccgacttcacgtacaacatggtcgatccatgcacaccaccaatggatgactacagaagatatgctaacagtgtggaatagagtatggatagaggacaacccgtggatggaagataaaacgccggttacgacatgggagaatgtcccatatctaggaaagagagaggatcagtggtgtggatcgttgatagggctaacatcgcgggcgacctgggctcaaaatattccaacagctatacagcaggtccgatctttgataggaaatgaagagttccttgattacatgcctagtatgaaacgcttcaggaaagaagaagagagtgaaggagctatatggtaa

SEQ ID NO: 23316 - RNA, 9873 nt, synthetic construct
  misc_feature 1..9873: note = derived and/or modified CDS sequence (opt6) from DENV-3__EU726773__SS-prME
  source 1..9873: mol_type = other RNA
acgagtttatgtcttatgatgatactcccagctgcactggcatttcacttaacctcaagggacggcgaaccacgcatgatcgtaggcaagaacgaaagaggtaaatccttattattcaaaacggcatcaggaatcaatatgtgtacgcttatagcgatggatctcggtgagatgtgtgatgatacagttacatacaaatgtccacacataacggaagtcgagccagaagatatagactgctggtgtaacctgacgagcacctgggtaacctatgggacctgtaaccaagcgggggaacatagacgagacaaaagatctgttgcacttgccccgcacgtgggaatgggccttgatacaaggacccaaacatggatgtctgccgaaggggcttggcgacaagtcgaaaaagttgaaacctgggccttacgacacccaggatttacgatactggcattgtttttagctcattatattggtacttcactcactcagaaggtagttatctttattctactaatgctcgtaactccgtcaatgaccatgaggtgcgtaggcgttggaaacagagatttcgtcgagggactttccggcgctacttgggttgatgtcgttctagaacacgggggctgtgtcacaacaatggctaaaaataaacctacactggatatagagttacaaaagactgaggcaacacagttagcaacgctaagaaaattatgtattgagggtaagatcacaaatattactacagattcacgttgtcctactcagggagaagctgtactaccggaagagcaagatcaaaactatgtgtgtaaacatacgtacgtagatagagggtgggggaatggatgtggattattcggaaaggggtcgttagttacgtgtgcaaaattccaatgtctagaaccaattgaaggaaaggtagttcagtacgaaaatttaaagtatacagtgatcataaccgtacataccggtgaccaacaccaagtaggaaatgaaactcagggagtaacagcagaaataacaccacaggctagtactacggaagcaatccttccagaatacggtactctaggactggaatgttctcctcgaacaggcttagactttaatgaaatgatacttttaacaatgaaaaataaagcttggatggtacatagacagtggttttttgacttaccgctaccgtggacatctggtgctacaactgaaactccaacgtggaataggaaagaattacttgttacattcaagaatgcgcacgcgaagaaacaggaggttgtggtactgggctcccaagagggtgcaatgcatactgcactaaccggggcaactgaaattcaaaattccggtggaacctccatatttgcagggcacttgaagtgtaggctcaagatggacaaattagaactcaagggaatgagctacgctatgtgtaccaatacattcgtcctaaaaaaagaggttagtgagacccagcacggcacaatattaatcaaagttgaatacaaaggagaagatgttccatgcaaaataccctttagtacggaggatggccaaggaaaagcgcacaacgggagactgattacggcgaatcctgtcgtaaccaaaaaagaagaacctgtaaatatagaagctgaacccccgtttggagaatctaatattgtgattgggataggggacaacgctctaaagataaattggtataaaaaaggaagctctatcggaaaaatgtttgaagctacagctcggggtgccagaagaatggcaatattaggtgacacagcatgggactttggtagtgttggtggtgtccttaattctttaggtaaaatggtacatcaaatctttggcagcgcatacacagcactttttagtggtgtatcatgggtgatgaaaatcgggattggagttctcctgacatggatcgggttaaattcaaagaatacatcaatgtccttcagctgtatcgtcattggaataataactctatatctaggagctgttgttcaagcagacatgggctgtgtcattaattggaagggaaaggaactaaaatgtggaagcggaattttcgttaccaacgaagtccatacatggaccgagcaatataagtttcaagcagactcccctaagaggctagccacagcaattgcaggagcttgggaaaatggggtttgcggaattagatccacgactagaatggaaaatttattatggaaacagatagctaatgaattaaactacatattatgggaaaacaatataaaacttactgtagtcgtaggtgatataataggagttctggaacagggaaaacgtacactcacgccgcaacctatggaactaaagtactcatggaaaacttggggtaaggcaaaaatagtaacagcagaaacacaaaattcctctttcataatagatggcccgaacacgccggagtgtcctagtgcaagtcgagcgtggaatgtctgggaagttgaagattatgggtttggggtttttaccaccaacatctggctgaagctcagagaggtatacacacaattatgtgatcacagactaatgagcgccgcggttaaagatgaaagagcggtccacgctgatatgggttactggatagaatcgcaaaaaaatggatcttggaaactagaaaaggcgtcactcatagaagttaagacttgcacatggcctaaatcacacacattgtggtctaacggggtgctcgagagcgatatgataattcctaaatcactcgcgggtccaatatcacaacacaattaccggcctggataccacacgcagaccgcaggaccatggcacctcggcaaacttgagctcgatttcaattattgcgaaggaacgactgttgtcattacggagaactgtgggacaagaggtccgagtcttagaaccacgaccgttagcggaaagctaatccacgagtggtgttgcagatcttgcactttacctccactgcggtacatgggagaagatggttgttggtacggtatggaaattaggccgatatcagaaaaagaagaaaatatggtaaaatcattagttagcgcaggatccggcaaagtggataattttactatgggagtcttatgcttagcaattttattcgaagaagtaatgagaggaaagtttggaaaaaaacatatgatcgctggtgtattttttacctttgttttattgctcagtggccaaattacttggagagacatggctcataccctaattatgataggaagcaatgcatctgacaggatgggcatgggtgtaacttatttagccctaatagcaacttttaaaatacaaccttttttagcactcgggtttttccttcgcaaactaacaagtagggaaaatctgctactaggggtaggtttagcaatggcaactacgctccaactccctgaggatatagaacaaatggcaaatggaatagccctaggcctaatggcgctaaaactaattacccaatttgaaacgtaccagctctggacagcgctaatcagtctgacttgcagtaacacgatattcacattaacagtcgcatggaggacagcaacattaatcctggcaggagttagccttctaccggtatgtcagtcatcatcaatgagaaaaactgactggctccctatgactgtagctgctatgggagtaccaccgcttccactatttatcttttccctgaaagacactttaaaaagacgaagttggccccttaatgaaggggtaatggctgtaggtttagtttcaatactagcttctagcctcctacgaaatgacgtaccaatggcaggacccctagtagcgggtggcctcttaatagcttgctacgttatcaccggaacatctgcggacctcactgtagaaaaagcagctgatgtcacatgggaggaagaagcggaacaaacaggagtcagccataacctaatgataacggtagatgacgatggcaccatgcgtatcaaagacgatgagacggaaaatattctaactgtgttgcttaaaactgctttattaatagtttcgggaatattcccttactctataccggcaactttactagtatggcatacatggcaaaaacaaactcagagatcaggggttttatgggatgtcccatccccaccagaaactcaaaaagccgaactggaagaaggtgtctaccgtattaaacaacaaggaatctttggtaaaacccaagtaggagtaggagtgcaaaaagaaggtgtatttcataccatgtggcacgtaactcgaggcgcagtccttacatataacggtaaaaggttagagcctaattgggcttctgttaagaaagatctaataagttatggtggcgggtggagactttctgctcagtggcaaaaaggagaggaagtacaagttatagcagtggaaccggggaaaaacccaaaaaattttcagacgatgccaggcacttttcaaacaactacgggggaaataggggcaatagctcttgacttcaaaccaggaacaagtgggtcacccattatcaatcgagagggtaaagtggtaggcctttatggtaatggtgttgttactaagaatggagggtatgtatcaggcatagcacaaacaaacgctgagcccgacggtcctactccagaattagaggaggaaatgttcaaaaagagaaacctgacgattatggaccttcacccaggatcaggtaagacaagaaaatatcttcccgcaatagtcagagaagctatcaaaaggagattgaggacacttatattggcaccgaccagggtcgtggcagcggaaatggaagaagcattaaaaggcctaccaattaggtaccagacaaccgctactaagtcagagcacactggaagagaaatagtggatctcatgtgccatgcaacctttactatgagattattatctcctgtcagagtaccaaattataatttaataataatggatgaagctcattttacagatcctgcatcaattgcggcgagagggtatattagtactagggttggaatgggcgaagcggctgcaatttttatgactgcaacgcctcctgggacagcagacgcttttcctcaaagtaatgcacctattcaagatgaagagaaagatattcctgagaggtcatggaacagcggaaatgaatggataacggacttcgccggcaagacggtttggttcgtgccatcaataaaggcaggtaatgatattgctaattgcctacgaaaaaacgggaagaaagtcattcaactatcccgaaaaacttttgatacagaatatcaaaagactaaactcaatgactgggatttcgtcgtaactacagatatatcagaaatgggagcaaactttaaagccgatcgggtaattgatccacgccgatgcttaaaaccagtaattttaactgacggaccggagagggtgattttagcaggacctatgccagttacagctgcaagtgccgctcaacgaagaggaagagttggaagaaatccgcagaaagagaatgaccaatatatctttacgggacaacctttaaacaacgacgaagatcatgctcattggactgaagctaagatgctattagacaacatcaatacccctgaaggaataatacccgccttattcgagcctgaaagagaaaaaagcgcagctatagatggagaatatagactgaagggcgaatcaagaaaaacatttgtcgaattgatgcgaagaggcgatctcccagtctggttggctcataaagtcgcaagcgagggaataaaatatacagatcgtaaatggtgttttgacggacaacgtaacaatcaaattctagaggaaaacatggatgtagaaatatggacaaaagaaggcgaaaagaaaaagttaaggccaagatggctggatgcgagaacatactcagaccctctggcattaaaagaatttaaagactttgcggctgggagaaaatcaatagcactagatcttgttacagaaatcggaagggtaccttcccacctcgcccaccgaaccagaaatgcattggataacttggtaatgctccatacctctgaacacggaggtaaagcctacagacacgctgtggaggaactaccggaaaccatggaaaccttattgctgttgggacttatgattttgttaacaggaggagctatgctttttctgatttccggcaaaggaattgggaagactagcattggcttaatatgtgtcatagccagttcaggtatgctttggatggcagaaataccccttcaatggatagcttcggccatcgtgctggaattcttcatgatggtattacttatccctgaacccgaaaaacaacgtacaccacaggacaatcagttagcttatgtagtcattggaattttgaccttagctgcaataatcgcagcaaacgaaatgggacttttagagactaccaagcgagatctaggcatgtcaaaggaaccgggagtcgttagccccacttcatatttagacgtcgacttgcatcccgcttcagcctggacactatatgctgttgcaacaacagtaataacacctatgttgcgtcatacaatagaaaatagcacggcgaatgtatcactggcagcgatcgcaaatcaagcggtagtgttaatgggattggataaaggatggccaatatcgaagatggacctaggggtgcccttactagctttaggctgttatagtcaggtgaatccgctaaccctgaccgcagcagtattacttttaattactcattatgccataattggtccagggcttcaggccaaagctactcgagaagcccaaaaaagaactgcagcagggataatgaagaatccaacagtagacggcattatgacgatagacctagatccagtcatttacgactcaaagtttgaaaaacaactaggtcaggtaatgttactcgtactctgtgcggtacaactactcttaatgcgcaccagttgggcgctatgtgaagccttaacgttggctactggtccaattacaacgttgtgggaggggtcacctggaaaattctggaatactacaattgctgtatccatggcaaacatattccgtggaagttatttagcgggagcggggctagcatttagtataatgaaaagtgtaggaacaggcaagcgtggaactgggtcacaaggagaaaccttaggcgaaaagtggaaaaaaaagttaaaccagctcagccgaaaagaatttgatctctacaagaagtcaggaataacagaagtagatcgaaccgaagcaaaagaaggtttgaagagaggagaaataactcaccatgcagtaagtagaggttcggcaaagctacaatggtttgtcgaaagaaatatggtaataccagaaggtagggtaatagaccttggctgtggaagaggaggttggtcttattactgtgccggactaaagaaagttaccgaagtcagagggtacacaaaaggaggaccggggcacgaagaacccgtcccgatgagtacatacgggtggaacatagtaaaactaatgagcggaaaagacgtgttctacttgccgcctgaaaaatgtgacacattactttgtgatattggggaatcctctccctcaccaacagttgaagaaagtcgaaccatacgagtcctaaagatggtcgagccctggctaaagaataatcaattctgcatcaaagttttgaacccgtatatgcccactgtaatagagcatttagaacggcttcagcgtaaacatggaggaatgttggtaagaaatcctttgtcaagaaattccacacacgaaatgtactggataagtaatgggactggaaatatagtggcgtccgtaaatatggtaagtaggcttttattaaatcggtttacgatgacgcatcgtaggcctacgatagaaaaggacgtggatcttggagcaggtactcgtcatgttaacgcagaaccagagactccaaatatggatgtcattggagaaagaattaaaagaattaaggaagaacataactctacatggcactatgatgatgaaaatccctataaaacatgggcctaccatggttcatacgaagtcaaggcaacaggctctgcatcaagcatgatcaatggagtagtgaaattattaaccaagccctgggatgtggtacctatggtaacacaaatggctatgacggatacgacaccgtttggtcagcaacgtgtatttaaagagaaagtagatactcgaacaccaaggagtatgccgggaacgagacgagttatgggaataacggcggaatggctatggcgaaccctaggtcgcaataagaaacccagactatgcaccagagaagaatttactaaaaaagttcgtacaaatgcagccatgggggctgtttttacggaggaaaatcaatgggactctgcgaaggccgccgtagaagacgaagacttctggattttagtagacagagaaagggaactccacaaacttggaaagtgtggatcctgcgtttataatatgatgggcaaacgggaaaaaaaactcggggaattcggcaaagccaaaggaagcagagcaatatggtatatgtggctaggagcaaggtacctcgaatttgaagcactcggattcttaaacgaagaccattggtttagccgcgaaaatagctacagcggtgtagaaggcgagggattgcataagctagggtacattctaagagacatttcaaaaataccaggaggagcaatgtacgcagacgacaccgcgggatgggatactcgcataacagaggatgatcttcataacgaagagaagattacacaacaaatggacccagaacacagacagctggccaacgccattttcaaactaacctaccaaaataaggtagtaaaagttcaaagaccgacaccaaccgggacagtaatggacataatatcacgaaaggaccaacgtggctctggtcaagttggaacgtatggtttgaacaccttcactaacatggaagcacaacttatacgacaaatggaaggtgaaggtgtactaagtaaagcggacctggaaaacccccacttacctgagaaaaaaatcacacaatggttagaaacaaagggagtagaaagactaaaaagaatggcaattagcggagatgattgtgtagtaaaaccaattgacgatcgatttgccaatgcactattagccttaaatgacatgggtaaagtacgaaaggacataccgcaatggcaaccgtctaagggatggcatgactggcaacaagtgccattctgtagccaccatttccatgaactaatcatgaaagacggccgaaagttagtagtcccatgtaggcctcaagatgaattaataggcagagcaagaataagtcaaggtgctggatggagtttaagggaaacagcctgcctcggcaaggcgtacgcacagatgtggtcactcatgtacttccatagacgtgatctgagactagcaagcaatgctatatgctcagcagttccagttcactgggttcctacttctcgcaccacctggtcaatacacgcccaccatcaatggatgactacagaagacatgttaactgtttggaaccgtgtctggatagaagataatccttggatggaagataaaacaccagtaacaacgtgggaaaacgtgccatacctaggaaagcgagaagatcagtggtgcggtagtctcatcggacttacatcaagagccacatgggcacagaatattcctaccgccattcagcaagtccgtagcttaattggaaatgaagaatttctcgattatatgcccagtatgaaacgattccgcaaggaagaagagtccgaaggagctatatggtag

SEQ ID NO: 23317 - RNA, 9873 nt, synthetic construct
  misc_feature 1..9873: note = derived and/or modified CDS sequence (opt6) from DENV-3__EU726774__SS-prME
  source 1..9873: mol_type = other RNA
acgagtttgtgtttaatgatgattttaccagcagcactagcctttcatttaacttcacgagatggagaaccaagaatgatagtagggaaaaatgaaagaggtaaatccttgttatttaaaacggcctctggtataaacatgtgtactctgatcgccatggatttaggcgaaatgtgtgacgataccgtcacatataaatgtcctcatataaccgaagtcgagccggaagacatagattgctggtgcaatttgacaagtacatgggtcacatacggtacctgtaaccaagcaggcgaacatagacgtgataaaagaagtgtggcactagcaccacatgtgggcatggggttagacacgagaacacaaacttggatgtcagccgaaggtgcatggcggcaggtagaaaaagtagaaacttgggccttgagacaccctggatttacaatcttagccttatttttagcgcattatatcggtaccagtttaacacaaaaagttgttatttttatcctattaatgcttgtcacgccttcgatgacaatgagatgcgtaggcgtcggaaatagagatttcgttgaaggattatctggagctacttgggtagacgtcgtattagaacatggagggtgtgtgaccacaatggccaaaaacaaaccaacactagacattgaattgcagaaaacagaggctacacaattagctacacttagaaaactatgcatagaaggtaaaataactaacataacaactgacagtcggtgtccaactcagggagaagcggtgctcccggaagaacaagatcaaaactacgtctgtaaacacacatacgtcgatcgtggatggggaaatgggtgtggtctattcgggaaagggagcttagtcacttgcgcaaaattccagtgtttagaaccgatagaagggaaagtggtgcaatatgaaaatttgaaatatacggtaataataacagttcatacaggtgaccaacatcaagtggggaatgaaacacaaggagtcacagcagagattacacctcaagcctcaactacagaagcaatactacccgaatatggtactctagggttagaatgcagtcctagaacaggtctggacttcaacgagatgattctactaactatgaaaaacaaagcatggatggtccatagacagtggttctttgatttaccattgccatggactagcggggccactactgaaacacctacttggaataggaaagaactattagttaccttcaaaaacgctcatgctaagaaacaagaggtcgtagtattaggcagtcaggaaggggcgatgcacaccgccttgactggtgcaaccgaaatacaaaactccggtggaacgtctatctttgccggacacttaaaatgtcgtctgaaaatggataaacttgaattaaaaggtatgtcatatgcaatgtgtacaaacacatttgttcttaagaaagaagtaagtgaaactcaacacggcacaattttaataaaagtagaatataaaggagaggatgtgccatgcaagataccctttagtacagaagatgggcaagggaaagctcataacggacgtcttataactgctaatccagttgttactaagaaggaagaaccggttaatatagaggccgaaccacccttcggagagagcaacattgtgattggcattggggataatgccttaaaaataaattggtataagaaaggaagttcgattggcaaaatgttcgaggccacagctagaggagcacgcaggatggctatccttggagatacagcctgggattttggcagtgttggaggagtactaaattcactaggcaagatggttcaccaaatatttggatcggcatatacagcgttgttttcaggtgtttcatgggtaatgaaaatagggataggagtattgctaacgtggatcggactaaatagcaaaaatacctcaatgtctttcagttgtatagcaattgggatcatcacactttacctaggagcagtagtacaagcagacatggggtgtgtaataaattggaaaggtaaagaattaaaatgtggtagcggaattttcgtaacaaacgaagttcatacatggacggagcaatacaaattccaagcggactcaccaaaaagattagcaactgccatagctggggcatgggaaaatggtgtatgtggaattagatcaacaacacggatggaaaatctcctttggaaacaaatagcaaatgagctaaattatatcttatgggaaaacaatatcaaactcactgtagtagttggagatactataggcgttttagagcaagggaaaagaacattgacaccccagccaatggaactgaagtatagctggaaaacctggggtaaagcgaaaatcgtgacagctgaaactcaaaactcaagttttataatagatggaccgaataccccagagtgtccttcagcatcgagagcatggaatgtatgggaggtagaagattacggattcggagtattcactacaaatatatggttaaagttgagagaagtatatactcagctctgtgatcatcggcttatgtcagcagctgttaaagacgaacgggccgtacatgcagatatgggctattggattgagagtcagaaaaatggtagttggaaattagagaaagcatcattaattgaagtgaagacatgtacatggcctaaaagtcatactttatggagcaacggagtactagaaagtgatatgatcattcccaaaagcctagccggacccatctcacaacacaattatcgacctggttatcatactcaaacagcgggaccctggcacctgggaaaattagaattagacttcaattactgtgaaggcactactgtagtaatcacggaaaactgcgggacacgggggccatcattaagaacaactactgttagtggtaaattaattcacgaatggtgttgcaggagttgtaccctcccgccactacgatatatgggcgaagatggatgctggtacgggatggagattagaccaatttcggaaaaagaggaaaacatggtgaaaagtttggtgtcagccgggtctggaaaggtagacaactttacgatgggagtactctgcttagcaattctattcgaagaagtcatgagaggaaaatttggcaaaaagcacatgatagccggagtattcttcacgttcgtgttgctattatctggtcaaattacatggagagatatggcgcacacactcataatggtcggctcaaacgcctcagacaggatgggtatgggagtaacttatctagccttaatagctacatttaaaatacaaccatttctcgcattaggattctttctaagaaaactgacatcgagagaaaatctcctattaggggttggactcgcaatggcaactacactacaactaccagaagatatcgaacaaatggcaaatgggatagccttaggtctaatggctttaaaacttacaacacaattcgaaacttatcaactttggaccgctttaatatccctcacatgctcgaatacaatatttacattaacagtagcttggagaaccgctactttaatcttagccggtgtctcattgttaccagtttgtcagtcctcatcaatgcgtaaaaccgattggttaccaatgactgtagcagcaatgggcgtgcccccactaccgctatttatattttcattaaaagacacattaaaaagaaggtcatggcctctaaacgagggtgtaatggcagttggtcttgtatctatacttgcaagttccctcctgaggaacgacgtcccaatggcaggtcctcttgtggcgggtgggttattgatagcatgttacgttatcactggaacttctgcagacctcacagtagaaaaggcagctgacgttacatgggaagaggaagccgaacaaacgggtgtaagtcacaacctaatgattactgtggacgacgatgggaccatgaggattaaagacgacgagactgaaaatattcttactgttctgttgaaaacggctttgctaattgttagtggaatcttcccgtattcgatacccgctactctattagtgtggcatacgtggcaaaaacaaacgcaaaggagtggggtgctctgggatgtcccgagtccgccagagacccagaaggcagagctagaagaaggtgtgtaccggattaagcaacaaggaatcttcggaaaaacacaggtgggcgttggggtgcaaaaggaaggggtgtttcatactatgtggcatgtaacaagaggtgccgtgctaacatacaacgggaagaggcttgagcccaactgggcaagcgttaaaaaggatctaatatcctatggaggaggatggcgattgtccgcccagtggcaaaaaggtgaagaagttcaagtaattgcggttgaaccgggcaaaaatcccaaaaatttccagactatgcccggtacattccaaaccactacaggggaaataggagctatcgctttagatttcaaaccggggacgtctggttccccaatcattaacagagaaggaaaagtagtaggtttgtatggcaatggagtggtcacaaagaatggtggctacgtttcagggatagcacagacgaacgctgaaccggatggaccgacgccggaacttgaagaagagatgtttaagaaacgaaatttaacaataatggatttgcaccctgggagcggaaaaactcgaaagtacttaccagccattgttagggaagcaattaaaagaagattgcggacactcatattagcaccgacgagggtcgtagctgctgagatggaagaagccttaaaaggcttaccaatcagatatcaaaccaccgcgacaaagtcagaacatactggcagagaaatagtagacctgatgtgtcatgctacattcacaatgagactcctaagcccagtaagggttccaaattacaatctaataataatggacgaagcgcacttcacggacccggcatctatagctgcccggggatacatatcaacacgggttggaatgggagaagcagccgccatctttatgactgcaaccccaccaggcactgcagatgcatttccgcaaagcaacgcaccaatacaagatgaagaacgagatataccggaaagatcgtggaacagtggaaacgaatggataacggactttgctggaaaaactgtttggtttgttccaagtatcaaagcaggaaatgatatcgccaactgcttaaggaaaaatgggaaaaaggtcatacagctgtcaagaaaaacattcgatacagaatatcaaaagacaaaacttaatgattgggatttcgtggtaacgacagatatatctgaaatgggcgctaatttcaaagcagatagagttatagatccgcgcagatgtctaaaacctgttatactaacagatgggccagaaagagtcattttagctgggccaatgcctgttacagccgcgtcagctgctcaacgacgaggtcgagttggacgtaacccacaaaaagaaaacgatcaatacatattcacaggccaaccacttaataacgatgaagaccacgcacactggacggaggcaaaaatgttactggacaatatcaatacacccgaggggattatcccagcgctatttgaacccgaacgagaaaaatccgctgcaattgacggtgaatatagacttaaaggggaaagtcgaaagacatttgttgaattaatgaggcgaggcgacttaccagtatggctagcacacaaagttgcatcggaaggtataaagtatactgatcgtaagtggtgtttcgatgggcagagaaataaccagatacttgaggaaaatatggatgtagaaatctggactaaagagggggaaaagaagaaacttagaccacgttggctagacgcacggacctatagcgatcctctagcactaaaagaatttaaagattttgctgcaggaagaaaatccatagctctagatttagttactgaaatcggaagagttccatcccacctcgcacatagaacgcgtaacgcattagacaatttggtcatgctacacacaagcgagcatggagggaaagcatatcggcatgccgtggaagaattaccagaaacaatggagacattactattgctcggtttaatgatactgcttactggtggtgcaatgctatttctaataagtggaaaagggattgggaaaacaagtatagggctgatatgcgtaattgcatcttcaggcatgctttggatggctgaaatacccctccaatggatagcttcggcaatagtattagagtttttcatgatggttctattgataccagaaccagaaaaacagcgtacacctcaagataatcagttagcttatgtcgtcatcgggatattgacacttgccgcaattatcgctgctaatgaaatgggattactagagacaacaaagcgtgacttagggatgagtaaagagccaggagttgttagtccaacgtcctatctggacgttgacttacatcctgcaagtgcgtggacgttgtacgctgtagctactaccgtgattacacccatgttacgtcacacgatagaaaattctaccgcaaatgtctcgttagcggcgattgcgaaccaagcagtggtactaatgggattagacaaaggatggcctatctcaaagatggatcttggggtccccttattggccttgggatgttatagtcaagttaaccccttgacccttacagcagcagtgcttttactaattacgcattatgcaattatagggccgggtttgcaagctaaggccacccgggaggcacagaaaaggaccgcggcaggaatcatgaaaaacccgacagtcgacggcataatgaccattgacttggacccagtaatctatgacagcaaattcgagaagcaattaggacaagttatgctactggtactatgtgctgtgcagttattactcatgaggacatcttgggcgttatgtgaggcgctaactctagcaaccggccccataactacattatgggaagggtcaccgggtaaattctggaacactacaattgcagtgagcatggcaaacatattccgaggatcttatcttgccggggccggattagctttcagtatcatgaaatcagttggaacagggaaaagaggaacgggctctcaaggcgaaacgttgggagagaaatggaagaagaaattaaatcaactaagtcgaaaagaatttgatttatataagaaaagtggcataactgaagtggaccgcactgaggccaaggagggattgaagcgaggggaaataacacatcacgcagtatctaggggatctgctaaactacaatggtttgtagagagaaacatggtgataccagaagggagagtaatagatttaggctgcggacgtggagggtggtcatattattgtgcgggtctcaagaaagtgacggaggtcaggggctacacaaaaggaggaccaggtcacgaagaaccggtacctatgtcgacatatggctggaacattgtaaaactaatgagtggaaaagatgtcttttacttaccaccagaaaagtgtgatactttgttatgcgacataggagaaagttcacccagtcctacagttgaagaatcaagaacaataagggtactgaaaatggttgaaccttggttgaaaaacaatcaattttgcattaaagtactgaacccatatatgccaacagtcatagaacatctggaacgtctacaacggaaacatggtggtatgttagttagaaatccactttcccgaaacagtacacacgaaatgtattggatatctaatggaacaggcaacatagtagcttcggttaatatggtgtcaagactattgttaaataggtttacaatgacgcacaggcgacccacaatagaaaaggacgtagatctcggcgccggaacacgccatgtaaatgctgagccagagacacctaatatggatgtgataggagaaagaataaaaagaataaaagaggagcataacagcacgtggcattatgacgacgaaaacccatataagacttgggcctatcatggatcttacgaagtgaaagcaaccggatcagctagtagcatgataaacggggttgttaaacttctaaccaagccatgggacgtggtaccaatggtcacacagatggccatgacggacactactccttttggccagcaaagggtgttcaaagagaaagtagataccagaactcctcgaagtatgccagggactagaagagtgatgggaataactgcagaatggctatggcgcacacttggacgcaataagaaaccaaggttatgtaccagagaagaatttacaaagaaagttcgcactaatgcggccatgggggcagtgttcactgaggaaaaccagtgggatagcgcgaaggccgctgtagaagacgaagacttttggaaattagtggaccgcgaacgagaactacacaaattgggaaaatgtggaagttgtgtttataacatgatggggaaaagagagaagaaattaggagagtttggaaaagcaaaagggtcaagagcgatatggtacatgtggcttggcgcaagatatctggagttcgaagctcttggattcctcaatgaagaccactggttttctagggaaaattcatattcaggggtggaaggcgaaggccttcacaaattaggatacatcctcagagatatcagtaaaatcccaggtggagccatgtatgcagacgataccgcaggttgggatacacgaataacagaagatgacctacacaatgaagaaaagatcacacagcaaatggatcccgagcatcgacaactagcgaatgcgatttttaaattaacctaccaaaataaagtagttaaagtacaacgaccaacaccgaccggaaccgtaatggatattataagcaggaaggatcaacgaggatcaggtcaagttggtacatacggcctcaatacgtttacgaatatggaggcgcaattaatcagacagatggaaggagagggagtactatcgaaggcggaccttgaaaacccacacctaccggaaaagaaaataactcaatggctcgaaactaaaggtgtggagcgtttaaaacgtatggcgataagtggagatgactgtgtagttaagccaatcgatgatagattcgcaaatgcattactggcattgaatgatatgggaaaagtaaggaaggatataccccagtggcaaccctcaaaagggtggcacgactggcagcaagtcccattttgcagtcaccactttcacgaacttattatgaaggacggaagaaaattagtagttccatgtaggccgcaagatgaattgatcgggagagcacggatttcacaaggtgctggatggtctttaagggaaacagcatgtctcggaaaagcatatgcacaaatgtggagcctaatgtatttccatagaagggacctaagactcgcatctaacgccatttgtagcgcagtaccagttcactgggtaccaacctctaggacaacttggtcaatacacgctcatcatcagtggatgaccacagaagacatgctcaccgtatggaacagagtctggatagaggataacccctggatggaagataaaaccccagttacaacatgggagaatgtaccttacttaggaaagagggaagaccagtggtgcggtagtttaataggtttaacaagcagagcgacatgggcccagaatatacccacggcaattcaacaagtgaggtcactaatcgggaacgaagagtttctagattatatgccatctatgaaacggttcaggaaagaagaggaatcagaaggagcaatttggtaa

SEQ ID NO: 23318 - RNA, 9873 nt, synthetic construct
  misc_feature 1..9873: note = derived and/or modified CDS sequence (opt6) from DENV-3__EU687219__SS-prME
  source 1..9873: mol_type = other RNA
acctcactatgtttaatgatgattctaccagcagctctggcgtttcacctaacatcgagagacggtgaaccacgaatgatagttgggaaaaacgaacgggggaaaagcctcttatttaaaacggcaagtgggataaatatgtgcacgttaatagcgatggacctaggtgaaatgtgcgatgatacggtaacatataaatgtccacatatagcagaagtagaaccagaagatatagactgttggtgtaacttaacgagcacatgggtgacatatggaacgtgtaatcaagcgggtgaacacagaagagataaacgttctgtagcactcgcaccgcacgtgggaatgggattagacacaaggactcaaacgtggatgtcagcagaaggagcgtggagacaggtggagaaagtggagacatgggcgctaagacaccccggcttcacaatcttagcgttgtttctagctcattacattgggacgtcattgactcaaaaagtagtaatatttattttgttaatgttggtaacaccatcaatgacaatgcgatgtgtaggagtcggtaacagagactttgtggaaggtcttagtggcgctacgtgggttgatgtggtattagaacacggagggtgcgtaactaccatggccaaaaataaaccgactctcgatatcgaactccagaaaactgaagcaacacaacttgcaaccttacgtaaactatgtatagagggcaaaataacaaacataaccacagacagtagatgccctacacaaggggaagcagtacttccagaggagcaagaccaaaattacgtatgtaaacatacatatgttgacagaggatggggaaatgggtgtggactgttcggaaaaggctctctggttacgtgtgcaaaattccaatgtttagaaccgattgagggaaaagttgtacaatacgaaaatctaaaatatacagtgatcatcacagttcatacaggcgatcaacaccaagtaggcaatgaaacacaaggcgtaacggcagaaattacaccacaagcaagtacaactgaagctatccttccagaatacggtacattaggtttggaatgttcccctagaacaggattagatttcaatgagatgatactgctcactatgaaaaataaggcttggatggttcacagacaatggttctttgatctacctctcccatggacatcaggagcaacaaccgagacacctacttggaaccgaaaagagctcctcgtcacattcaaaaatgctcacgccaagaaacaagaagtcgttgtactaggttcgcaagaaggcgcgatgcataccgctctaactggcgcaacagaaattcaaaattcagggggtacatcaatatttgctgggcatttaaaatgtagattaaaaatggacaaattagaattaaaaggcatgtcttacgcaatgtgtactaataccttcgtattaaagaaagaagtttcggaaacccaacatggcactatactcataaaagtagagtataaaggggaagacgtgccctgtaaaatcccattcagcactgaagatgggcaaggaaaagcacacaacggaagactaattacagccaatccggtagtaaccaagaaagaagaaccagtcaatattgaagccgaacctcccttcggagagagtaatatagttattggaatcggagacaatgctttaaaaattaactggtataagaaaggaagcagtatagggaaaatgtttgaagctaccgcaagaggagctaggcgaatggcgattttaggtgacacagcatgggatttcggttcagttggaggtgtacttaacagcttaggcaaaatggtacaccaaatatttggatcggcgtatactgcattattcagcggggtttcttgggtaatgaaaataggaataggggtactcctcacatggataggtttaaatagtaaaaatacatcaatgtccttttcctgcatagctataggaatcataaccttatacctaggtgctgtggttcaagcagatatgggttgtgtgattaattggaaaggaaaagagctaaaatgtggcagcggtatttttgtcaccaacgaggttcatacttggacggagcaatataagtttcaagcagacagcccgaagagactggcaacagccattgcaggagcttgggaaaacggggtttgcggaatccgtagtactacacgaatggagaatttactgtggaaacaaatagctaacgaattaaattacatactttgggagaacaacataaaattgacagtagtcgtcggcgacatcataggagtattagaacaaggtaaacgtaccttaaccccgcaaccaatggaactaaagtattcctggaaaacatggggtaaagccaaaatagtaacagctgaaacgcaaaatagtagcttcataatagatggacctaatacccctgaatgtcccagtgtcagtcgtgcatggaacgtttgggaagtcgaggattatggctttggcgtattcacgacaaatatctggttgaaactccgcgaagtttacacccaactttgtgaccatagactaatgtcagctgctgttaaagatgaaagagccgttcacgctgacatggggtattggatagaatctcagaaaaatggaagttggaagctagagaaggcttcattaatagaggttaagacgtgtacatggcctaaatctcacaccctatggtcgaatggagtattagaatctgacatgatcatcccaaaatccttagcaggacccatctctcaacataattatagaccaggttaccatacacaaaccgctgggccctggcacttaggtaaattagaacttgattttaattattgtgaagggactacagtagtgattacagagaactgtggaacaagagggccttcacttcgtacaacaactgtctcaggtaaattgatacacgaatggtgttgtagatcttgcacactacctccgttacgctatatgggtgaagatggttgttggtacggcatggaaattcgcccgatttccgagaaggaagaaaatatggtcaaatcgcttgttagcgccggtagtggcaaagtagataactttactatgggtgtactgtgtttagcaattctctttgaagaagtcatgagaggtaaatttggcaagaaacacatgatagcaggcgtattctttacatttgtcttactgttatccggtcaaataacgtggagagacatggcccacaccttaataatgatagggtctaatgcaagtgaccgtatgggcatgggcgtaacatatcttgcactaatcgcaacttttaaaattcagccgttcctagctttaggattctttttaagaaaattgacatcccgagagaaccttctcttaggcgtagggctggctatggcaacgacgctacaattaccagaagatatagaacaaatggccaacggaatcgcgttaggcttaatggctttaaaacttatcacgcaattcgagacttaccaactttggacagctctaataagcctaacatgttctaatacaatttttacattgacagtagcatggagaacggcaactttgatcttagcgggagtaagtctactaccagtctgccaaagcagctcaatgcggaaaactgactggttacctatgacagtggccgcaatgggcgtacctcccctcccactttttatattttccctgaaagacactctaaaacgacggagttggcccctaaatgaaggagtaatggctgtgggtttggtatccatactcgcatcatcacttttgcggaatgacgtgccaatggctggccctctggttgccggtggtttgttgatagcatgttatgtaattactggtacaagtgcagacctaaccgtggaaaaagcagcagacgtaacctgggaagaagaagctgaacagacaggagtatcccataacctcatgataacagtagacgatgatggaaccatgcggataaaagacgatgagacagaaaatattttgaccgtcttacttaagacagcactgctaatagtctctgggatattcccctattcaatccccgcaacattgttagtgtggcatacttggcaaaaacaaacccaaagatcaggggtattatgggatgtaccgagccctccagagactcaaaaggcagaattggaggagggcgtatatcgcataaagcaacaaggtatctttggaaagacacaagttggcgtcggagtgcagaaagagggcgtctttcacacaatgtggcatgtaacacgcggagcagtcttgacatataatggcaagagactcgagccgaactgggcaagtgtaaagaaagatctaatctcatatggaggaggatggagattatctgctcaatggcagaaaggagaagaggttcaagttatagccgtggaaccgggcaaaaatccgaaaaatttccagacaatgccgggcacctttcaaacaacaacgggcgaaataggggcaatcgccctagactttaaacctggcacgagtggaagtccgataattaatcgagaaggaaaagtagtcggattatacgggaatggagtaattaccaaaaatgggggctatgtctcgggaattgcgcagacaaatgcagaaccagacgggccaaccccagaactcgaagaagaaatgtttaagaagcgtaacttgaccataatggatctacatcctggaagcgggaagacacggaagtatttacccgcaatcgtcagggaagcaatcaaacggagactacgcaccctgattttagcaccaacacgcgtcgtagcagctgaaatggaagaggcactaaaagggttgccaatcagataccaaaccacagcaacaaagtcggagcatacaggtagagaaatagtggatttaatgtgtcatgccacatttactatgcgattattaagcccagtaagggtacccaactataatctgataattatggatgaagcccactttactgacccggcatcgattgccgcgcgaggatacatcagcacaagggtgggaatgggtgaagcggctgcaatattcatgactgccacaccccctggtactgcagacgcatttccccaatcaaatgcacctatacaagatgaagagagagatattccagaaaggtcctggaactcaggaaacgaatggataacggacttcgcaggtaaaactgtatggtttgtaccaagcataaaagcaggtaatgatatagccaattgtcttcgtaaaaatggaaagaaagtaatccaattaagtaggaagacattcgacaccgagtatcaaaagacaaaattaaatgactgggactttgtagttacaactgatatcagtgagatgggagcaaactttaaagcagatagagtgatagatccaaggcgttgtctcaaaccagtaatactaactgacggaccggaaagagtaatcctcgccgggcccatgcccgtaacagcggcaagcgctgcccagagacgagggcgagtggggagaaatccacaaaaagaaaacgatcaatatatatttacaggacaaccattaaacaacgatgaagaccatgcccattggaccgaagcaaaaatgttattggataatattaatacaccagaaggtatcatacccgcactgttcgaaccagagagagagaaatcggcggcaatcgacggagaatatagattaaaaggcgagtcaaggaagacttttgtagaactgatgagaaggggagatttaccggtgtggctcgcgcacaaagtagcgtctgagggaataaagtatactgacagaaaatggtgcttcgatggtcaaagaaataatcaaatattagaggagaatatggatgtcgaaatttggactaaggaaggagagaagaagaaattgaggccccgttggcttgatgcaagaacatactcagatcctttagctctgaaagagtttaaagattttgcagctggcaggaaatcaattgcgctagacttggtcactgaaataggacgagtcccatcacacctggcccatagaactagaaatgcactagacaatttagtaatgctccatacaagcgaacatgggggaaaagcatatcgtcatgctgtagaagaactgcctgaaacaatggaaacacttctgcttttaggacttatgattttgttgacaggaggagctatgttgttcttgatatcagggaaggggatagggaaaacgtcaattggcttaatctgtgtaatagcatcgtcagggatgttatggatggcggaaattcctttgcaatggatagccagtgcgatcgtactcgaatttttcatgatggtgctattaattccagaacccgaaaaacaaagaacacctcaagataaccaactagcctacgttgtaataggcatccttacgttggccgctataatagccgcaaacgaaatggggttgttagaaacgaccaaacgagacttgggcatgtctaaagaacctggagttgttagcccgacatcctacttagatgtagatctccacccagcatctgcttggacgttgtacgcggtcgcaacaacagtaattacacctatgttacggcacactatagaaaattctacggcaaacgtctccctcgcggcaatagcaaatcaggcagttgtattgatgggattagacaaaggatggccaataagtaagatggacctaggggtaccattactggcattaggatgttacagtcaagtcaacccattaaccttgactgccgcggttctcctcctaattacacactacgctataataggtcccggccttcaagctaaggccacacgagaagctcagaaacggacggcagcaggaattatgaagaacccgacggtagatggaattatgaccatagacctagatcctgttatctatgactcgaagttcgaaaagcaattaggccaagtaatgctcttagttttatgtgccgtacaactcctgcttatgcgtacaagttgggctttatgtgaagctctcaccttggccacaggaccgatcacaacgttatgggaagggagtccgggaaagttttggaacacaacaattgccgttagcatggctaacattttcagagggtcttatctagccggcgccggtttggcatttagcatcatgaaaagtgttgggactggaaaaagaggcacaggttcacaaggcgaaacattgggagaaaaatggaaaaagaaactaaaccaattaagtagaaaagaatttgacctatacaagaaatcaggaatcaccgaggttgatcggacggaggctaaagaaggtctcaaacgaggcgagattacacaccacgccgtttctcgaggttcagctaaactgcaatggtttgtagagcgtaatatggttataccagaaggtcgagttatagatttaggatgtgggcgcggtggatggtcttactattgtgcaggacttaagaaagtcactgaagtaagaggatacactaagggaggaccggggcatgaagaaccagtaccaatgagcacatacggttggaacattgtaaaattaatgtccggtaaagacgtcttctacttacctcctgaaaaatgtgatacccttctttgtgatataggagaatcatcaccgagtccaactgtggaggagagtaggacaataagagtattaaaaatggtagaaccatggttaaagaacaaccagttttgcataaaggtattaaacccttatatgcctacagtcatagaacatctagaacgattacaaagaaaacatggaggaatgctagtgcgaaatccgttgtcaagaaattcgacacatgaaatgtactggatttctaatggaacagggaacattgttgcctctgtaaacatggtgtcgagattactactcaatagatttacaatgacgcacagacgtccaaccatagagaaagatgtggacctcggagcgggtactagacatgtcaatgcagaacctgaaacacccaacatggacgtgataggtgagcgaataaaaagaataaaagaagaacacaatagtacgtggcactatgatgatgagaatccgtataaaacatgggcgtatcacggctcttatgaagtaaaagcaaccgggtcagcctcctctatgataaatggagtagtcaaattattgacaaaaccatgggatgtagtgcccatggtaacgcaaatggcaatgactgatactacaccatttgggcagcaacgtgtgttcaaggagaaggtcgacacaagaacaccacggtcgatgccaggaactcgtagggtaatgggcattacagctgaatggttatggagaacgctgggaaggaataagaagcctagattatgcacaagagaagaatttaccaagaaagtacgcacgaatgctgcgatgggcgctgtgttcacggaagaaaatcaatgggacagtgcgaaagcggctgtagaagatgaggatttttggaagctagttgacagagaaagagaattgcataaattgggaaagtgtggatcctgtgtatataatatgatggggaaacgcgagaagaaattaggagagttcggtaaagcaaaaggatccagagccatatggtatatgtggttaggagctagatatctcgagtttgaagcgctaggtttcttgaacgaggaccattggtttagtcgtgaaaattcatatagcggtgtggagggcgaaggattacacaaacttgggtacatcttaagagatattagcaagattccaggaggcgcaatgtacgccgacgatactgccgggtgggatacaagaattactgaagatgatctacataatgaagagaaaatcacccaacagatggaccctgagcatagacaactggcaaatgcgatatttaaactcacctaccagaataaagtagtaaaggtacaaagaccaacaccaaccggtacagtaatggacattattagtagaaaagatcaacgaggaagcggccaagtaggtacttatggtcttaacacgtttaccaacatggaagcacagttaataaggcagatggagggagagggagtactttctaaagctgatttggaaaatccacatctgccagagaaaaagattacacaatggctggaaacaaaaggggtagaaagattaaaaagaatggcaatatctggagatgactgcgtagtaaaaccaattgatgaccggtttgctaatgcattactagcactcaatgacatgggaaaagtcagaaaagatatcccacaatggcaaccttctaaaggttggcatgattggcaacaagtccctttttgcagccaccactttcatgagctaataatgaaagacggccgaaagctagtagtgccctgtaggccacaggacgaactaatagggagggcaagaatatctcagggggccgggtggagtttacgggaaactgcatgtttaggaaaagcatatgcccaaatgtggtcattaatgtatttccataggcgagatctgagactggcatccaatgcaatttgctctgcagttcccgtccattgggtaccaactagccgtacaacatggtcgatccacgcccatcaccaatggatgactacagaggatatgttaactgtttggaatagagtctggatagaagataatccctggatggaagataagacgccggtgactacctgggaaaatgtaccctacttaggcaaacgagaagaccaatggtgcggtagtcttattggattaacttcacgtgcaacgtgggcgcaaaatattcctacagctattcaacaagtccgatcgctcatcggaaacgaagaatttctagattacatgccatcgatgaagagattccgaaaagaagaagaaagtgagggtgcaatatggtag

SEQ ID NO: 23319 - RNA, 9873 nt, synthetic construct
  misc_feature 1..9873: note = derived and/or modified CDS sequence (opt6) from DENV-3__EU726768__SS-prME
  source 1..9873: mol_type = other RNA
acttccctatgcctaatgatgatattaccggcggcattggcattccatctaacatctcgagacggagaacccagaatgatagtagggaaaaatgaaagaggtaaatccttactatttaaaacagcttccgggataaatatgtgtacactaattgcgatggacctcggtgaaatgtgtgacgatacggtaacatacaaatgcccacacattacagaagtagaaccagaagatatagattgttggtgcaacttaacctcgacttgggttacgtacggaacatgtaatcaagccggtgaacacagaagagataaaagatccgtagcactggctcctcatgtaggaatgggtcttgataccaggacacagacatggatgtccgctgaaggtgcttggagacaagtagaaaaagtagaaacttgggctcttaggcacccaggattcacgatattagcactgttccttgcccactacattggaacatctttaacacaaaaagttgtgatattcatcttgctaatgctagtcacacctagtatgactatgcgttgtgttggtgttggaaatcgagacttcgtggaaggattgtctggggccacatgggtagatgtagtactggaacatggaggatgcgtaactacgatggccaaaaataaacctacactagatattgaactacagaaaaccgaagcaacccagttagctacattacgaaaactctgcatcgaaggaaaaataacaaatattaccacagattcccgttgcccgacacagggggaagcggttttacccgaagaacaagaccaaaactacgtctgcaaacatacttacgtagaccgtggatggggaaacggttgcggcctgtttggaaaaggatcattggtcacttgtgcgaaatttcaatgtcttgaaccaatagaaggaaaagtggttcagtacgaaaatttgaaatacacggtgataataacagtacacactggagaccaacatcaagtaggaaatgaaactcagggggtcactgccgagattactccacaggcaagtacaacagaagccatcttaccagaatatggcaccctaggcctagaatgcagtccgagaacaggactggacttcaacgaaatgatactcctaacgatgaaaaacaaagcgtggatggtacatcgtcagtggttcttcgatctaccactcccttggacgagtggagccaccacggaaacgcctacttggaaccgaaaagaattgcttgtaacatttaaaaatgcacacgcgaagaaacaagaagtcgtggttctgggctcacaagaaggcgcaatgcacactgcactaactggtgcaaccgaaatacaaaattctggcggtacatctatattcgccggtcatctaaaatgtcgattaaaaatggataaattagaactaaaaggtatgagttatgcaatgtgtaccaatactttcgtactaaagaaagaggtatcagagacacagcacgggacaattcttattaaagtagaatataaaggggaggacgttccatgcaaaattcctttctcaacagaagacggccaaggtaaagcacataacgggaggcttattacggcaaatccagtagtcacgaagaaagaggaaccggtaaacatagaggctgaaccaccctttggtgaaagtaatatcgtaattggaataggagacaatgctctgaaaataaattggtacaagaaaggctcatctattggaaaaatgtttgaggctacagctcgcggtgcacgacgaatggctatcttgggagacactgcttgggattttggttccgttggcggagtgcttaattcattaggcaaaatggtgcaccagatctttgggagtgcatataccgctttattttcaggagtatcttgggttatgaaaattggcattggggtgttgttaacctggataggattaaattcgaaaaacaccagcatgtcattctcatgcatcgtaataggaatcattactctatacctaggtgcggttgtacaggcagatatggggtgtgtaataaactggaaaggcaaagaacttaaatgcggttccggtatatttgtgacaaacgaggtacatacatggactgaacagtacaaatttcaagccgattctccaaaaaggcttgcaacggccatcgccggagcatgggagaatggggtttgtggaatccgttcgaccactagaatggaaaatcttctctggaaacagatagcaaatgaattaaattatattctttgggaaaataacataaaattaacggtagttgttggagatataataggagttttggaacaaggaaaaaggacactgacacctcaacctatggaattaaaatactcgtggaagacatggggcaaagcaaaaatcgttacggcagaaacacagaatagttcatttattattgacggtccaaatacgccagaatgtcctagcgcaagccgagcatggaatgtatgggaagttgaagactacgggtttggcgtatttaccactaatatatggcttaaactacgggaggtttatactcagctttgtgatcacagactgatgtctgcagcagtaaaagatgaacgggcggtccatgctgacatgggctactggatagaatcgcaaaagaatggttcatggaaattggaaaaggcgtcactaatagaggtaaaaacatgcacatggccaaaaagtcacactctatggtcgaacggagttttagaatccgatatgataatacccaaatccttggccggccctataagtcaacacaactacagaccaggttaccatactcaaacagcggggccttggcacttaggaaaactagaattagattttaattattgtgagggcactacagtagtcataacagaaaattgcggtactcgaggaccttcactcagaacaacaactgttagtggaaaactcatccacgaatggtgttgcagaagttgtacattgccacccctccggtacatgggagaagacggctgttggtacggaatggaaataagaccgatttcggaaaaagaagagaacatggtgaaatccctggtaagcgccggttcaggtaaagttgacaactttacaatgggcgtactatgtctagcgatactatttgaagaagtcatgcgtgggaagtttggtaagaaacatatgatagcgggggtattctttacatttgttttattacttagtggacaaattacctggagagatatggcgcacactctaatcatgatcggatctaatgcaagcgatagaatgggtatgggagtaacgtatttagcgttaatcgcaacatttaaaatacaaccttttctcgcattaggatttttcttgcgtaaattgacatcacgcgagaatctgctactgggcgttggactcgcaatggctacgaccctacaattaccagaggatattgagcaaatggcgaacggaatagcactcggactaatggctcttaaattaataacacaatttgaaacgtaccagctatggacagccctcatctcactaacatgttcaaataccatattcaccctaactgtagcctggagaactgcaaccttaatacttgcgggggtttccttattaccagtgtgccaatcatcttccatgcgcaaaacagattggttgcccatgactgtagctgcaatgggggttccaccgttacccttatttatattctcactaaaggacactctaaaacgaagatcatggcccttaaatgagggggtgatggccgtaggtttagtttcaatactcgcatcaagtttactaaggaacgatgtacctatggctgggccattagtagctggaggtctccttattgcatgttacgtaataacaggcacgtcagctgatttaactgttgagaaagccgcagatgtgacttgggaagaagaagcagaacaaacgggagtgtcacacaacctcatgataacagtagacgatgatggaaccatgcggataaaggatgatgagacagaaaacatcttaacagtgctactaaaaacagcactactaattgtatcaggtattttcccctactcgatccccgccacattgttagtttggcatacctggcaaaaacaaacgcagaggtctggtgttctttgggatgtcccttcgccaccagaaacccaaaaagctgagttagaggagggagtatatcgaataaaacagcaaggaattttcggcaaaacacaagtaggcgttggagtacaaaaagaaggtgtctttcacaccatgtggcatgtaaccagaggagcagtactcacatacaatggaaagagattagaaccaaactgggcttcagtaaagaaagatcttataagctatggaggaggatggcgcctttcagcccagtggcaaaaaggagaagaagttcaggtaatagcagtcgaaccgggcaaaaaccctaagaattttcaaactatgccgggaacatttcaaacaactacaggtgaaatcggagctattgcactggattttaaaccgggaacctctggcagtcccataatcaatagagaaggcaaagttgtaggactttatggtaatggtgttgtaaccaaaaacggcggctatgtatcaggaatagcacaaacgaatgctgaaccagacggtcctacaccagagcttgaagaagaaatgtttaagaaaagaaatttaacaatcatggatctacacccaggttcaggaaaaacaagaaaatacttaccagcaatcgtccgagaagcgataaagagacgcctaagaactcttatattagctccaaccagagttgtcgcggctgaaatggaagaagcactaaaagggttacccataaggtatcaaacaacggcaacaaaatcagaacacaccggcagggagatagtagatttaatgtgtcatgccacatttaccatgcgtttattgtcgccagtccgtgttccaaactacaatcttataatcatggatgaagctcacttcacagacccagcttcaattgcagcaaggggatacatttctacgcgagtcggcatgggggaagcggctgcaatattcatgactgctactcctccagggacagcggatgcctttcctcagtcaaatgctccaattcaagacgaagaaagagatatcccagagcgcagttggaactcgggtaacgaatggattactgatttcgcagggaaaacagtatggtttgttcctagtataaaggctggtaatgacatagctaactgtctcaggaaaaatggcaagaaagttatacaactcagtaggaagacttttgatacagaataccaaaagaccaaattaaatgactgggactttgttgtgactacggatataagcgaaatgggtgctaatttcaaagctgatcgtgtcatcgaccctaggcgttgcttaaagccagttatactaacagacggacctgaacgcgtcatattagccggaccaatgccggttacggcagcatcagcagctcaaagacgcggccgcgtgggtcgcaaccctcagaaagaaaatgaccaatacatattcactggtcaaccactgaataacgacgaagatcatgcacattggacggaggctaaaatgctacttgataacattaacacccccgaaggcataattcctgcgttgttcgagccagagagagaaaaatcggccgctattgatggagaatatcgactaaaaggggaaagtcgtaagacctttgtggaattaatgcgaagaggcgatcttcctgtatggttagcgcacaaggtagcctccgaaggtatcaagtataccgataggaaatggtgttttgacgggcaaaggaataatcaaatactcgaggaaaacatggatgtagagatatggactaaagagggcgagaagaagaaactaagacccagatggttggatgcacgaacctattcagacccattagccttaaaagagttcaaagactttgccgcaggaagaaaatctattgcactagatttagttacggaaataggtcgagtaccttcgcacctggcccacaggacaagaaatgctttagacaacctagtgatgttacacacaagtgaacatggaggaaaggcgtaccgtcatgcagttgaagaattaccggagaccatggagacattactacttttagggctcatgatactactgaccggcggtgctatgttatttttgatctcgggaaaaggtatcggaaaaacctcaataggacttatatgtgtgatagcaagctctggtatgctttggatggctgagataccccttcaatggatagcaagcgcaatcgttttggagttctttatgatggtactattgataccagaaccggaaaagcagcgcaccccgcaagataatcaactagcctatgtggtgataggtattctgactctggcagctattatagcggcaaacgaaatgggattactagaaactacaaaaagagacttgggaatgagtaaagaaccaggagtagtgtcaccaacatcatacctagacgtagatttacatccagcctcagcctggacactatacgcagtcgccacgaccgtgatcacacccatgttaagacacactatagaaaattcgacggcaaacgtgagcctggccgcaatagctaatcaagctgtcgttttaatgggtttggacaaaggttggcctattagcaaaatggaccttggagtccctttgcttgcactaggctgttacagtcaggtaaatccattgactctaactgctgctgttttgttattaatcacacattatgcaattataggtccgggactacaagcaaaagccacacgtgaagcccaaaaacgcactgcagccggaataatgaagaaccccactgtggacggaataatgaccatagacctagacccagtcatatacgactcaaaattcgagaaacaattggggcaagttatgctcttggtactctgcgccgtccagcttctccttatgaggacctcgtgggctctctgtgaggcgttaactcttgcaacaggcccaatcacaacgttgtgggaaggatcgccagggaaattttggaacaccacaatagcagtaagtatggcaaatatcttccgtggcagttatctggctggcgcagggttagctttttcaataatgaaaagcgtaggaacaggaaaaagaggaactggatcgcagggcgaaacactaggagaaaaatggaagaaaaagttaaaccagctaagtagaaaggaatttgacttgtacaaaaagagcggaataactgaagtagaccgcacagaagcaaaagaaggattaaaacgtggggagattacacatcatgcggtaagtagggggagtgcgaaattacagtggtttgtagaacgaaatatggttataccagaaggacgggtaatagacctaggctgcggcagaggaggatggagttattactgtgcaggattaaagaaagttactgaggttaggggttatactaaaggaggtccaggccatgaagaacctgtacctatgtcaacctacggttggaatatagtaaaactcatgagtggaaaagatgtattttatttgcctccagaaaagtgcgatacgctattatgcgatataggagaaagtagtccaagtcccaccgtagaggagagcagaactatacgagtcctaaaaatggtagaaccatggctcaaaaataatcaattttgcataaaagtactaaatccatacatgccgacagtgatagaacacttagaaaggttacaaagaaaacacggtggtatgctagtgcgaaaccccttaagcagaaactccactcacgaaatgtattggatttcaaacggaacaggaaatatagtcgccagcgtgaacatggtttcgcgtctacttttaaatagatttacgatgactcatagacgaccaacaatagaaaaagatgttgatttaggtgcaggaaccaggcatgtaaatgcagaacccgaaacaccaaatatggatgtaattggagaacgtattaaacgaataaaagaagaacataattccacatggcattatgacgatgaaaacccttataagacgtgggcatatcatggatcttacgaggtaaaagcaactgggtctgcttcaagtatgataaacggtgtagttaaattgttaactaaaccttgggacgtagttcctatggtgacacaaatggccatgacggacacaaccccattcgggcaacaaagagtttttaaagaaaaagtagacacccgtactccacgatcaatgcccggcacacgtagagtaatgggcatcactgccgagtggttatggagaactttaggaagaaataaaaagccccgactgtgcacgcgagaggaatttactaaaaaggtccgaactaatgcagctatgggagctgtctttaccgaagaaaatcagtgggacagtgcgaaagctgcggtagaagatgaagatttctggatcctagttgatagagaaagggaactacataaacttggaaagtgcgggtcttgtgtttataacatgatggggaaaagagaaaagaaacttggggaatttggtaaggccaaaggctcacgggcaatatggtatatgtggctaggggccagatacctagagttcgaagctctgggtttcctaaatgaagatcactggttctcgagagaaaattcatactctggagttgaaggagaaggtctccacaaattagggtacatattgcgcgatataagcaaaattccaggaggtgcaatgtatgcagatgacacggctggatgggatacccgtattacagaggacgatctccataatgaggagaaaataacgcaacaaatggatcctgagcacaggcaacttgccaatgccatattcaagctcacataccaaaacaaagtcgttaaggtgcaaagacccacgccaacaggaactgtaatggatataatctctaggaaagaccaaagaggctctggccaagttggcacgtacggactcaacacgtttactaacatggaagcgcaattaatacgacaaatggaaggagagggagtactatcaaaagcagatctagagaatcctcatttaccggaaaagaaaataacgcaatggttggagacaaaaggggttgaaagactaaaacggatggccatttcaggagatgactgtgtagttaaaccaatagatgaccgttttgcaaatgcattattagcactaaatgacatgggcaaggtaagaaaggatatacctcaatggcaaccttcgaaagggtggcacgactggcaacaggtaccattctgttctcaccatttccacgagttaattatgaaggacggaagaaagctggttgttccatgcagacctcaagatgaattaattgggagagcacgcatctcacagggagcgggatggtcgttaagggaaacagcttgcttaggaaaagcatatgcacaaatgtggtctttaatgtattttcaccgccgcgacctacgtttagcttcgaacgctatatgctcagcggttcctgttcattgggttccgaccagcaggacaacttggtctatccatgcacaccaccaatggatgaccactgaagacatgctaactgtatggaatagagtgtggatcgaagataacccatggatggaagacaaaaccccggtgacgacatgggaaaatgtcccatatttagggaaaagggaagatcaatggtgtggatctctcataggcctaacctcgagagccacatgggcacaaaacattccaactgcaatacagcaagtgcgatcactaattggaaacgaggaatttttagattacatgccttcgatgaaaagattccgtaaagaagaagaaagtgaaggtgcaatttggtag

SEQ ID NO: 23320 - RNA, 9873 nt, synthetic construct
  misc_feature 1..9873: note = derived and/or modified CDS sequence (opt6) from DENV-3__EU687226__SS-prME
  source 1..9873: mol_type = other RNA
acatctctttgtctaatgatgattttacccgcggcacttgcatttcacctaacttcgcgagatggtgaaccacgcatgattgtaggtaaaaacgaaaggggaaaatccctattatttaaaacggcaagtggaataaacatgtgtactttaattgctatggatctaggtgaaatgtgtgatgacaccgtaacctataaatgtccgcatataactgaagtggaaccagaagatatagattgctggtgcaaccttactagcacatgggtgacgtatggtacatgcaatcaagcaggagaacacaggcgggataaacgttcggtagctctagccccacacgtaggaatgggtttagatacccgcacacaaacatggatgtcagctgaaggtgcatggaggcaagttgaaaaagtagaaacctgggccctacgacaccccggattcacaatactcgcactctttcttgcgcattacatcgggaccagtctgactcaaaaagtagtgatatttatcctattgatgttagtaactcccagtatgacaatgagatgtgttggagtaggaaatcgagatttcgtcgaaggactaagtggggcaacatgggttgatgtagtgctagaacatggaggttgcgtaactaccatggccaaaaacaaaccgacgttagatatagaattacagaaaaccgaagcgacgcaattggctacgctaagaaaattatgtatcgaaggcaaaataactaatattactaccgatagtagatgtcccacgcaaggagaggcggttttacctgaggaacaagatcaaaattacgtttgtaaacatacctacgtagatagaggctggggaaacggctgcggattattcggtaaagggtccctagtaacatgtgcaaaattccaatgtctggagcctatagaaggtaaagtagtgcagtacgagaatttaaaatataccgtcataataacggttcatacgggtgaccaacatcaggtaggaaatgaaacgcagggggtaacagcagagataaccccacaagctagtacaacagaagcgattttacccgagtatggcactctaggtctcgagtgctcgccacggacaggactagattttaacgaaatgatattactaacaatgaaaaataaggcttggatggtgcatagacaatggttctttgacttacctctaccgtggacttcaggggcaaccacggaaacacctacgtggaacagaaaagaacttctggtgacctttaaaaatgctcacgctaagaaacaggaagtcgtagtacttgggtcacaagaaggagctatgcacacagcacttacaggcgctacagaaatacaaaattctggaggcaccagcatttttgcaggccacttgaaatgcagactgaaaatggataaactagaactcaaaggtatgtcgtatgcaatgtgtaccaacaccttcgttttaaagaaagaggtgtctgagactcaacatggtactatacttataaaagtggaatacaaaggagaagacgtaccatgtaaaattccatttagtacggaagatggacaaggaaaagctcataatgggaggctaataacagcgaatcccgttgtaactaaaaaggaagaaccggtaaacatcgaagcggagccacctttcggtgaatcaaatattgtaataggaattggggacaacgctttaaagattaactggtacaaaaagggttcctcaattggtaaaatgtttgaggctacggctcgtggcgccagaagaatggcgatcctgggagatacagcctgggactttggttcagttggaggtgtattaaacagcctcggcaaaatggtgcatcaaatattcgggagtgcatacacagcgctgttttcaggtgtatcgtgggtaatgaagattggaataggtgttctgttaacatggataggcctgaacagcaaaaatacatctatgtctttctcctgcattgcaatagggatcatcactctatatttgggtgctgttgttcaggccgacatgggatgcgtaatcaattggaagggtaaagagttaaaatgcgggtcaggaatatttgtaaccaatgaagtacatacatggacagaacaatataagtttcaagctgacagcccaaaacggctagctactgcaattgcaggagcgtgggaaaacggtgtatgtggaataagaagcacaaccagaatggaaaacctattgtggaagcagatcgcgaacgaattaaactatatactatgggaaaataatattaaactaactgttgtagttggtgatattattggtgtcctcgagcagggaaaaagaactctaacaccccagcctatggaactaaagtattcttggaaaacatggggcaaagcaaaaatcgttacagctgaaacgcaaaattctagttttattattgatgggcctaatacacccgagtgcccttcagcctcaagagcatggaatgtctgggaagttgaggactacggatttggggtctttacaacgaatatatggctaaaactaagagaagtctatacacaactttgcgaccaccgactgatgtcagctgccgtaaaagacgaaagagcagtacatgctgacatgggttactggatagaaagtcagaaaaatggatcctggaagttggaaaaagcctctttgatagaggtgaaaacttgtacatggcccaaaagccataccctatggtccaacggagtacttgagagcgatatgattatacccaaatccctagccggaccaatctcacaacataattacagaccaggataccatactcaaaccgctggtccttggcaccttggaaagctcgaattagattttaattactgtgaaggtacgaccgtagtaataaccgaaaactgcggtacaagaggcccttccttacgaactacaaccgtgtcaggaaaactaattcatgagtggtgttgtcgtagttgtacgctaccaccgttaagatatatgggcgaagatggttgttggtacggtatggaaattagacctgtaagtgaaaaggaggagaatatggtaaagagcttagtatcagctggatctgggaaagttgacaacttcacaatgggcgtattgtgccttgccatcctttttgaagaagtaatgcggggaaaatttggtaagaaacacatgatcgccggtgtattctttacatttgtactcttattaagcggacaaataacttggagggatatggctcatacacttataatgattggaagcaatgcttccgacaggatgggaatgggcgttacctatctggcactaatcgcaacgttcaaaatacaaccttttctcgctctcggattctttcttcgtaaattaacgagccgagaaaatctactactcggagtagggctagcgatggctacaacattgcaactccccgaagatatcgaacaaatggcgaatgggattgctctaggactgatggcactcaaacttataacacaatttgaaacctaccaattatggacagctcttataagtttaacatgtagcaatactatatttaccctaactgtagcatggagaacagcaacactaatactcgcaggagtgtcgctcctaccagtgtgtcaaagcagcagtatgcgaaaaaccgattggttaccaatgactgtcgcagcaatgggagtacctcctctaccactcttcatattttcgctaaaagatacactgaaacgtagatcatggccactgaatgaaggagtaatggctgtaggtttggtatccatcttggcctcttcacttctaagaaatgatgtgccaatggccggaccgctagttgcagggggtctgttaatagcctgctatgtcataacaggtacatctgcagatttgacagtagaaaaagctgcggacgtgacatgggaggaagaagctgaacaaaccggggttagtcacaacctaatgatcactgtagatgacgatggtactatgcgcataaaagacgatgagacagaaaacattctcaccgtgttactgaagacagctttgctaatagtctcagggatctttccttactctattcctgccacgttattagtatggcacacatggcataaacaaacacaacgaagtggcgtcccgtgggatgtaccatccccgccagagactcagaaagcggagttagaagagggcgtgtacaggataaaacaacaaggaatatttggaaaaacccaagttggtgtaggagttcaaaaagagggggtctttcactcaatgtggcatgtaaccagaggggcagtattaacatacaacgggaagaggttagagcctaactgggcatcagtcaagaaagacttaatatcgtatggaggaggatggagattaagtgcacagtggcaaaaaggagaagaagttcaagtaatagccgtagaacccggcaaaaacccgaaaaactttcaaacaatgccaggtacatttcaaacaacaacaggggaaataggtgcgatcgctctagattttaaaccaggaacaagtgggagtccgatcataaatagagagggtaaagtcgttggtctttacggtaacggagttgtcactaagaacggtggatacgtatctggcatcgcacaaaccaacgccgaaccagatggaccgactccggaactggaggaagagatgtttaaaaagaggaacttaaccattatggatttacaccccggatctggaaaaaccaggaaatatttgccagcaattgtacgcgaagcaatcaaaaggcgcctcaggacattaattttagctccgacccgtgttgttgcagccgagatggaggaagcattaaaaggtctaccaattcgctaccaaaccaccgctactaaatctgagcataccggtagggaaattgttgacttgatgtgtcacgcaacattcacaatgagattgttatcaccggtaagggttcccaactacaatctaattataatggacgaagcacattttacggatccggcttcaattgccgctcgtggttacatctccacgcgagtcggtatgggagaagccgcggccatattcatgaccgctaccccgccgggtacagctgatgcatttccccaatcgaatgcacccatacaagacgaagaacgagatatccccgagagatcatggaatagtggtaacgagtggataacggactttgctggaaaaactgtctggttcgtaccaagtattaaagcgggtaatgacatcgcaaattgtctacggaaaaatggcaagaaagtaattcaactaagtagaaagaccttcgatactgaatatcagaaaacgaagttaaacgattgggatttcgtagttacgaccgacatttccgaaatgggagccaactttaaggcagaccgcgtaatagatcccagaagatgtttaaaaccagtcattcttactgatgggccagaacgagtgattttagctggtccgatgccagttacggcagcttcagccgcacaaagaagaggcagagtaggaagaaatcctcaaaaagaaaacgaccaatatattttcaccggacagccgctgaataatgacgaagatcatgctcactggacagaagcaaaaatgctattggacaacataaataccccagaaggtataattcccgctctatttgagccagagcgagagaaaagtgcggcaatagatggtgagtatagattaaaaggagaatcgcgaaagacgttcgtagagttaatgagacgaggagatctaccagtctggttagcacacaaagtggcttctgaagggatcaaatacacagatcggaaatggtgttttgacggacaaaggaataaccaaatactagaagaaaatatggatgtggaaatatggactaaagaaggtgagaaaaagaaattaagaccacgctggctcgacgctagaacatattcagacccactagcgctcaaagagttcaaagattttgcggcaggaagaaaatccattgcgttagatttagtaacagaaataggaagagttcccagccatctcgcccataggacacgcaacgctctggacaatttagttatgttacatacctcggaacacggcggaaaagcatacagacatgcagttgaagaactaccggaaacgatggagacgcttctattactagggctaatgatccttctaactgggggagccatgctattcctcatatctggaaaaggaatcggcaaaacgagtattggcctaatctgtgttatagcaagctccggcatgctatggatggcggaaatacccctacaatggatagcatcagcaatagtcctggagttcttcatgatggttcttctaatcccggagcccgaaaaacaacgcactcctcaggacaatcaattagcctatgtggtgatcggcattctaaccctagctgctataattgcagctaacgaaatgggattactagaaacaacaaagagagacttagggatgagcaaagaaccaggggtagtcagtccaacaagttatttagatgtcgatctccatccggctagcgcgtggacattatatgccgtagcaacaactgtaataactcctatgttgagacataccattgaaaattctacggctaatgtctcacttgcagccatcgcaaatcaggcggtggttctcatgggcttagataaggggtggccaatttcgaaaatggacttaggagttccattactggctctaggctgctattcacaagtaaatccgttaacacttacggcagcggtattgttattgattacccactatgcaattataggaccaggacttcaagcaaaagcgactagagaggcacaaaagcgaacagcagcgggcatcatgaaaaatccaacggtagatggtatcatgacaatagacttagatccagtgatatatgacagtaaatttgagaaacaattagggcaagtaatgctcctagtcctatgtgcagtccagctgctgttgatgcgaacgtcttgggcgttatgtgaagcactaacgttagcaaccgggcctataacaacattgtgggaagggagtccaggcaagttttggaatacaacgattgcagttagtatggccaacatatttcgaggtagttacctcgccggagcaggactagcattttcaatcatgaaatcagtcggaaccggtaagcgcggaaccggatcacaaggcgaaacgttaggagaaaaatggaagaagaaattaaatcaattgagtcgaaaagaatttgacttgtataagaaatcaggtataaccgaagtagataggacagaggctaaagaaggattaaaaaggggcgagatcactcaccatgctgttagtcggggatccgcaaagctccagtggttcgtagaaagaaatatggtaataccagaaggtagggtaatagatctaggctgtggccgaggcggctggagctactattgcgctggtttaaagaaagttaccgaagtaagaggatacaccaaaggtggcccgggacatgaagaacccgttccaatgagtacttatggctggaacattgtgaaactaatgtctggaaaagacgtattttatctaccacctgaaaaatgcgacacattactatgtgacatcggggaaagttcgccgtcacctacggttgaggagtctagaacgatacgagtcctaaaaatggtagaaccgtggctcaagaataatcaattctgcataaaagtattgaatccatacatgccaacagtaatcgaacatttagaacggcttcagcggaaacatggaggaatgttagtacgaaatccattaagcaggaacagtactcatgaaatgtactggatatctaatggaacaggaaatattgttgcttcagtaaatatggtcagcaggctgctccttaatagatttactatgactcatcgtcggccgaccatcgaaaaggacgtggatctcggagcaggcacaagacatgtcaacgcggaacccgaaacgcctaatatggatgttataggtgaacgaataaaacggattaaagaagaacacaattcaacctggcactacgatgatgaaaacccttataagacctgggcataccacggcagttatgaagttaaagctactggatcggcatccagtatgataaatggagtcgttaagttattaacaaagccttgggatgttgtcccaatggttacccaaatggcaatgacagatactactccgtttggacaacaacgtgtcttcaaagaaaaggtcgacacaagaactcccaggagtatgccgggtacaagacgtgtgatgggaattacagcagaatggttatggagaacacttggtagaaacaagaaaccaaggttatgtactcgagaagaatttactaagaaagtcagaaccaatgcagctatgggggcggtatttacggaagaaaatcagtgggattccgccaaggcagccgtagaagatgaggacttctggaaactcgtcgacagagaacgtgagctacacaagttagggaaatgcggaagctgcgtctataatatgatgggcaagagagagaagaaactaggcgagttcggtaaagcaaaaggatcaagagcaatctggtacatgtggttgggagctagatatcttgaatttgaagccctgggatttttaaatgaggaccactggttcagtagagaaaactcatattctggcgtggagggagaaggactccacaaactgggttatatactaagagacatcagtaaaatcccgggtggagcaatgtacgcagacgacacagcaggatgggataccagaattacagaagatgatttacacaatgaagagaaaatcactcaacagatggacccagaacataggcaattagcaaatgccattttcaagttaacttatcaaaacaaagtagtgaaagtccaaagaccaacacctacaggcaccgtgatggacattatcagcagaaaagaccaacgcggtagcggacaggtaggaacatacggtttaaatacttttacaaatatggaggcacaattaatacgacaaatggagggtgagggagtcttgtccaaagcagacttagagaatccacatctaccagagaagaaaattacgcagtggctcgaaactaaaggagtggaaaggttaaaacgcatggctatatcaggggatgattgcgttgtgaaaccaatagatgatagattcgcaaacgccttattagccctaaacgatatgggtaaagtaagaaaagatataccccagtggcagccgtcaaaaggctggcacgattggcagcaagttccattttgttcgcaccatttccatgaacttatcatgaaagatggacgtaagctagtggtaccatgcagacctcaagacgaactaatcggccgagcaaggatctcacaaggagcagggtggtcactacgggagacagcatgtctgggcaaagcatacgcccaaatgtggtccctgatgtactttcatcgtagagatcttcgactagccagcaatgcaatctgttcagctgtaccagttcattgggtaccaaccagtcgtaccacctggtcgatacatgcacatcaccaatggatgactactgaagatatgttaactgtatggaatcgagtatggatagaagataacccctggatggaagacaaaacacccgttaccacatgggaaaatgtcccttaccttggaaaaagagaggaccaatggtgcgggtctctaattggactcacaagtagagccacatgggcccagaacataccaactgctatacaacaagttagatcactaattggtaacgaagagtttttggactatatgccaagcatgaagcgttttagaaaagaagaggaatcagagggtgcaatctggtaa

SEQ ID NO: 23321 - RNA, 9876 nt, synthetic construct
  misc_feature 1..9876: note = derived and/or modified CDS sequence (opt6) from DENV-3__EU687233__SS-prME
  source 1..9876: mol_type = other RNA
acgagcctgtgcctaatgatgattctaccagcggcactggcatttcatcttactagcagagacggagaaccgagaatgatagttgggaaaaacgaacgcggaaaatccttactattcaaaacggcatctggaatcaatatgtgtacactaatagccatggacctaggtgaaatgtgcgatgacaccgtaacctacaaatgccctcatattgcagaagtagaacctgaagacatcgactgttggtgcaacttaacaagtacctgggtaacgtatgggacgtgtaaccaagccggcgaacacagacgagacaaaagatcggtagcattagcccctcacgtagggatgggattagatactaggacacaaacatggatgagcgcagaaggggcatggaggcaagtagaaaaagtagagacctgggctctacgacacccaggatttactatactcgcactttttctagcacactacataggaacgtctttaacccagaaagtggtgatattcattctgctaatgctagttacacccagcatgaccatgcgctgtgtgggtgtcggaaatagagacttcgtagaaggtctaagtggagcaacttgggtagatgtagttctagaacacggagggtgtgttaccacaatggccaaaaacaaacctacccttgacatagaattacagaaaacagaggccacccaactcgcgactctaaggaaactatgcatagaagggaaaataacaaacataacaacggacagtaggtgtcctacacagggtgaagcggtcttgccagaggaacaggatcaaaattatgtatgcaaacacacatacgtagatcgaggatggggaaatggatgcggattatttggtaaaggatcattagtgacttgcgctaaatttcaatgtttagaaccaatagaaggaaaagtggttcaatacgagaatcttaaatacactgtaataattaccgtccataccggagatcaacatcaggtaggtaatgaaacacagggagtcaccgcagaaataactcctcaagcatcaaccacagaagctattcttccagaatatggaaccttgggcctagaatgttcgccaagaacgggattagactttaacgaaatgattctcttaaccatgaaaaataaagcctggatggtacatcgacagtggttctttgatttaccactaccttggacaagcggagcaacaactgaaacgccaacgtggaatcggaaagaactcttagttacattcaaaaacgctcacgcaaagaaacaagaagttgtagtgctgggtagccaggaaggcgctatgcataccgcactaacaggcgctactgagatacaaaactcaggaggaacatctatattcgcagggcatctgaaatgccggcttaaaatggataagttagagttaaagggtatgtcgtatgccatgtgtacaaacacctttgttctcaagaaagaagtgtctgaaactcaacatggtactattttaataaaagtagaatataaaggagaggacgttccctgtaagataccatttagtacggaagatggacaaggaaaagctcataacggaagactcataactgccaaccccgtagtaacgaagaaagaagaacccgtaaacatagaagcggaacccccatttggtgagagtaatatagtgataggaataggagataacgccttaaaaatcaattggtacaaaaagggttcatcaattggtaaaatgtttgaagcaacagcgcgtggcgcacgtcgaatggctatactcggggatacagcgtgggattttggatccgtgggcggtgtgttaaattccctaggaaagatggtacaccagatttttgggagtgcgtacacggcactgttttcaggtgtatcctgggtcatgaaaatcggtattggagtactattaacctggattggactcaattcaaagaacaccagcatgtcattctcgtgtatagctattggtataattacattatacctaggagcagtggtacaagcggataccggctgcgtaattaattggaaaggcaaagaattgaagtgtggttcgggaatctttgtaaccaacgaagtacatacatggacagagcagtacaaatttcaagccgactcaccaaaacgattagctacagcaatagcgggtgcctgggaaaacggcgtatgcggaataaggagcacgaccaggatggaaaacttattatggaagcagattgccaacgaattaaactacattctgtgggaaaacaatataaaacttaccgtagttgtaggtgatataatcggtgtcctagaacagggcaaaaggaccttaactcctcagccaatggaacttaagtatagttggaagacgtggggaaaagcaaaaattgttacggcggaaacacaaaatagctcattcataattgatggacctaatacgccagaatgcccaagcgcgtctagagcatggaatgtctgggaagtagaagattatggttttggagtgttcacaaccaatatatggctaaaattacgagaagtctatacccaattatgtgaccacagactcatgagcgcagcagtcaaagatgagagagcagttcatgcagatatgggttactggatagaatcacagaagaatggatcttggaagctcgaaaaagcaagtttaatagaggttaaaacgtgtacctggcctaaatcccacacattatggagcaacggagtacttgaaagtgatatgatcatacctaagagtttggcagggccaatatcacaacacaactaccgtcctggttatcatacacaaacagcgggaccttggcatctcggaaaattagaattagatttcaactattgtgaaggtaccactgtcgttataacagagaattgtggaacaagggggccgtcattacgaaccacaaccgtatcgggaaaactaatccacgagtggtgctgtagatcgtgtacactacccccattgcgttatatgggagaggacggatgctggtatgggatggaaattcgtcccataagcgaaaaagaagaaaacatggtcaagtcattggtgagtgcgggtagtggaaaagtcgataacttcaccatgggagtcctttgtttagctatattatttgaagaagtaatgagaggaaaattcggtaaaaagcacatgatagccggagtgttctttacctttgtactgttgttgtctggccaaataacttggagggatatggctcacaccctaataatgatagggtcgaacgcttctgacaggatgggaatgggagttacatatcttgccttaatagctacgttcaaaatacagcccttcctcgcactaggattcttcttaagaaaattaacatccagagaaaacctattattgggtgtaggcctagcaatggcaaccacactccaactacccgaggatatcgagcagatggccaacggaatagcccttggtctaatggcactaaaacttattacacaattcgaaacataccaactgtggaccgcgctaatcagcttaacatgtagtaatacaatatttactcttacagtcgcatggcgaactgcaacactaattttggctggcgtttcgttactcccagtatgtcaatcgtcgtctatgagaaaaagtgattggctacctatgacggtcgccgcgatgggtgttccacccctgccactgtttatcttctctctaaaagacaccctaaagagacggagttggccactcaatgaaggtgtcatggccgtcggcttagtatcaatactagcaagctcactactcaggaatgacgtacccatggcaggacccttagttgcgggaggattacttatcgcgtgttatgtaattacgggtacatctgcagacttgaccgtagaaaaggcggcggatgtaacgtgggaagaagaagccgaacaaacaggggtatcccacaatttaatgataacagtggatgatgatgggacgatgcgaataaaagatgatgaaactgaaaacatcctaacagtcttactaaagacagcgttactaatcgtatcaggaatatttccatattcgatacctgctactcttttagtatggcatacctggcaaaaacaaacaagaaggagtggagtactttgggatgtgcctagtccgccagaaacccaaaaagctgaattagaagaaggcgtatatagaataaaacaacagggaatcttcggaaaaacacaagtaggtgtaggtgtgcaaaaagaaggagtatttcacacaatgtggcacgtaacacgcggcgcagtcctaacgtataacggaaaaaggctagaacccaactgggcatctgttaagaaagatcttatatcttacggtggtgggtggagactgtctgcacagtggcaaaaaggagaagaagttcaggtcatcgcggttgaacccggcaaaaaccccaaaaacttccaaacaatgccaggaacatttcaaaccactacgggggagattggcgcaatcgcattagacttcaagcctggtacttcagggtctcccataatcaatcgcgaaggaaaagtggtcggtttatatggcaacggtgtcgttaccaaaaacggaggatacgtaagcggaattgctcaaacgaatgctgaaccagatggacctactcctgaactggaagaggaaatgtttaagaaaagaaatttgacgataatggatctacatccaggatcaggtaaaactaggaaatacttaccagcgatagtcagagaagcaatcaagagaagactacgaacattaattctagcaccaactcgagtagtggcggccgaaatggaggaggcgttaaaaggactacctattagatatcaaacaacagcaacaaaatccgaacatactggacgcgagattgtagacttaatgtgtcacgcgactttcaccatgagattattaagcccagtgagagttcccaactacaatttgataatcatggacgaggcacactttacagatcctgcgtcaatagctgcaagaggatatatctcgacaagagtcggcatgggtgaggctgctgctatcttcatgacagcaactccaccaggcaccgcagacgcattcccacaatccaatgcaccaatacaagacgaagaacgggatataccagaaagaagctggaatagtggcaatgaatggataactgacttcgcaggaaaaaccgtttggtttgtgccttcaataaaagcaggcaacgatattgcaaattgtcttagaaagaatggtaaaaaggttattcagctgagtagaaaaacattcgatacagaatatcaaaagacgaaactaaacgactgggattttgtagtaactactgatatatctgaaatgggtgcaaatttcaaagcagatagagtcattgatccaagacgctgcctaaaaccggtcattttaacagacggccctgaaagggtaatactagcagggccaatgcctgtaactgctgcctcggcagcacaaagacgtggaagggtaggacgcaatccacaaaaagagaacgaccagtatatttttactggacaaccattaaataacgatgaagaccatgcacactggactgaagcaaaaatgctacttgataatataaacactcccgaaggaatcataccagccctatttgaacccgaaagagaaaagtccgcggcaatagatggagaatatcgacttaaaggtgaaagcagaaaaacctttgtagaattaatgcgaagaggtgatcttcccgtttggttagctcacaaagtagcaagcgaaggcataaaatacactgacagaaagtggtgctttgacggtcagcgaaataatcaaatactggaagagaatatggacgtagaaatttggacgaaggagggagagaaaaagaaacttcgtccaagatggcttgatgctagaacgtattcagacccactggcactaaaggaatttaaagattttgctgccggaaggaaatcaattgcattagacttggtgacggaaataggccgcgtgccgagtcacctagcgcatagaacaaggaatgcattagacaatcttgtgatgttacatacgtcagaacatgggggaaaagcatatcgacacgccgtagaggaactaccagagacaatggaaacccttttgctactaggtttaatgatcttactaacagggggcgcaatgctctttctcatatcaggaaaaggtatagggaaaacgtctatcggcttgatatgtgtaattgcatcatcaggaatgctatggatggcagaaatacccctacaatggatagcttcagccatcgtactagaatttttcatgatggtcttattaattccagaacctgaaaagcaacggacaccacaagataatcaattagcttacgtagtgataggcattctgaccctagccgcaattatcgcggcaaatgaaatgggattgctggaaacaaccaaaagagacctaggaatgtccaaagaaccaggcgtagtatcacctacatcctatttagatgtggatctgcacccagcttctgcctggacgctgtacgcggtagccactacagttataactcctatgttaagacatacaattgaaaactcaacggcaaacgtgtccttagcagcgatagcaaaccaagcagtggtcttgatgggtctagataaaggatggccaattagcaaaatggacttaggtgtaccgttacttgccctcgggtgttattcccaggtcaatccacttacactaacagcagctgtcctcctattgataacacattacgccatcataggacccggcctacaagcaaaggctacacgtgaagcgcagaagcgtacggcagctgggataatgaaaaatccgaccgtagacggaattatgaccattgacctagacccagtgatctacgacagtaagtttgagaaacagttaggccaagttatgctactcgttctatgtgcagtccagttgctgttaatgcgtacaagttgggcgctttgtgaagccttaacactagccacaggcccaattactaccctatgggagggctcacctggtaagttttggaacacaaccattgccgtttccatggctaacatatttagggggtcctaccttgcgggcgcaggcttggccttttctattatgaaaagcgtaggtacaggaaaacgtggaactggatctcaaggagaaacgctcggtgaaaaatggaagaagaaacttaaccagttaagccgaaaagaatttgatctttacaaaaagtcaggcataactgaggttgacagaactgaagctaaagaaggactaaaacgaggtgaaataacgcatcacgcagttagtagggggagtgccaagttgcagtggttcgttgaacgtaatatggtaataccagaaggaagggtaattgaccttggatgcgggagaggaggatggagctattattgtgctggactaaagaaagttacagaagtaagaggatatacaaaaggaggaccaggacatgaagaacctgtacctatgagtacatatggatggaacatagttaaacttatgtccggtaaagacgttttctaccttccaccggagaagtgtgatacacttctatgtgatattggcgagtcaagtccctctccaaccgtggaggaatcacgaacaataagggttttaaaaatggttgaaccttggcttaagaacaaccaattctgtataaaagtccttaatccgtacatgcctactgttatcgaacacctagaacgtctacaacgtaaacatgggggaatgcttgtacggaatccattatcacgcaattccactcacgaaatgtactggatatccaatggaactggcaacatagttgcctcagtgaacatggtatcccgcctattgcttaatcgcttcacaatgacacatagaagaccaactatagagaaagatgtagacttgggagccggtactcggcatgtaaacgcagaaccagaaacgccaaatatggacgttattggagaacgaatcaaaagaataaaagaagaacacaattccacctggcactacgatgacgaaaatccctacaaaacctgggcttatcatgggtcatatgaagtcaaagcgactggctctgcaagtagcatgataaatggagtagttaaattactcactaagccatgggatgtggtccccatggtcacacagatggcaatgactgatacaactccattcggacaacaaagagtattcaaagaaaaggtagatacacgaactcctagaagtatgcctggcacgcgtagggtaatgggaataacggcagaatggttatggcgcacactggggaggaataagaaacctagactctgcactcgtgaggaatttactaagaaagtaagaactaatgcggccatgggggccgttttcacagaggagaatcaatgggattcagcgaaagcagctgtcgaagacgaagatttctggaagttggtggacagggagcgagaacttcataaacttgggaaatgcggatcatgtgtatataatatgatgggtaagcgcgagaagaaactaggagagttcggtaaagctaaaggatcacgtgctatctggtatatgtggctgggagcaagatacttagagttcgaggcactcggtttcttaaacgaagaccattggttttcgcgggaaaacagctacagtggggtagaaggagaagggttacataaactagggtacatactacgcgacatttcgaaaattccagggggagcaatgtacgcagacgatacggccggatgggatacaagaataacagaagatgacctccacaacgaggagaaaatcacccaacaaatggatccagaacacagacagttagctaacgcaatattcaaattaacctatcaaaataaagtggttaaagttcaaagacctacaccgactggaaccgttatggatatcatttcccgaaaagatcaacgcggaagcggacaagtaggaacatatggtctgaatacatgccattctaacatggaggcgcagttaataagacaaatggagggtgaaggggtcttatcaaaagccgacttggagaaccctcatctatctgagaagaaaataacgcaatggctagaaacaaaaggtgtggaaagattaaaacgaatggcgatatctggggatgattgcgttgtgaaaccaatcgatgatagatttgccaacgcgttgctagctctcaacgatatgggtaaagtaagaaaagatataccacaatggcagccaagtaagggatggcatgactggcaacaagtcccattctgtagtcaccacttccatgagctgattatgaaagatgggagaaaattagtcgtaccttgtagaccacaagatgagttaatagggcgcgctagaatatcccagggcgcaggttggagtttacgagaaaccgcgtgcttaggaaaagcgtatgcgcagatgtggtctcttatgtatttccataggagagatctaaggctcgcatccaacgccatatgctctgccgtacctgttcattgggtccccacttcaagaaccacttggagtatacacgcacatcaccaatggatgaccacagaagatatgctaacagtttggaaccgagtgtggatcgaagataatccatggatggaagacaaaactccggttactacctgggagaatgtaccttatctgggcaagagagaagatcaatggtgcggtagtttgatcggcttaacgagtagagcgacgtgggcacaaaatatcccaacagctatacaacaagttaggtcccttatcggaaatgaagaatttctggactacatgcccagtatgaaacgatttagaaaggaagaggaaagtgaaggggcgatctggtag

SEQ ID NO: 23322 - RNA, 9873 nt, synthetic construct
  misc_feature 1..9873: note = derived and/or modified CDS sequence (opt6) from DENV-3__EU687234__SS-prME
  source 1..9873: mol_type = other RNA
acgagcttatgcctgatgatgattttaccagccgcacttgcatttcatctaacttcgagggacggggaaccgcgaatgatagtagggaaaaatgaaaggggaaaatctctactgttcaaaactgctagtggaattaatatgtgtactttaatagcaatggacttaggtgaaatgtgcgatgatacagttacatataaatgcccacatatcacagaggttgaaccagaggatattgactgctggtgcaacctaacttcaacttgggttacttacggcacgtgtaaccaagcgggagagcacaggcgagataaaagatccgttgctctagctcctcacgtaggcatggggctagacacgcgaacacaaacttggatgtcagcagaaggtgcttggcgtcaagtagaaaaagttgaaacgtgggccttaagacacccaggctttacaattttagcactatttcttgctcattatatcggcacctctttaactcaaaaagtagtcattttcattcttcttatgttagtaactccaagcatgacaatgaggtgtgtgggcgttggcaacagagattttgtcgaagggttgtcaggggcaacctgggtggacgtagttctagagcatgggggatgcgtcacgacaatggccaaaaacaaaccaaccttagatatagaattacagaaaactgaagctacacaattagcaaccttgcgaaaattatgtatagaaggtaaaattacaaatatcacaacggacagcagatgtccgacacaaggagaagcagtattaccggaagaacaagaccaaaattatgtctgtaaacatacgtatgtagaccgaggatggggtaacggctgcggcttattcggtaaaggctcattggtgacctgtgcaaaatttcaatgtcttgagcccatcgaagggaaagtagtacaatacgagaatctaaaatacaccgtgattattacagtacacacgggagatcaacatcaagtgggaaatgaaacacaaggcgtaaccgcagaaattacgccccaagcatctacgacggaggccatactaccagaatatggaactcttggcctagagtgtagcccaagaactggcctagatttcaatgaaatgatattattaacaatgaaaaataaagcatggatggtacaccggcaatggttcttcgatttaccacttccttggacatctggagcaacgactgaaactcctacatggaacagaaaagagttgctagtgactttcaaaaatgcacacgcgaagaaacaagaagttgttgttcttggatctcaagaaggtgctatgcatactgcactcacgggtgctactgaaattcaaaattcaggcggtacttcaatttttgcagggcacttaaaatgcagactgaaaatggacaaattggaactaaaaggaatgagctatgccatgtgtaccaacacattcgtactcaagaaagaagttagtgagacccaacacggtacaatactgataaaagtagagtataaaggagaagatgtaccttgcaaagtgcccttttccacggaggatggacaaggaaaagctcatagtgggcggttaataacagcaaatcccgtcgttacgaaaaaggaagaacctgtgaatatagaagcagaacctccttttggagaatccaacatagtgattggaataggagataacgcgcttaaaataaattggtataagaaaggctcctcgataggcaaaatgtttgaggcaacagcacgaggagccagacgtatggccattctaggcgatacagcctgggatttcggttcagttggcggcgtattgaacagcctaggaaaaatggtacatcagatttttggaagtgcttacacggctcttttctctggtgtatcgtgggtgatgaagataggaataggagtccttttaacatggatcggccttaatagtaagaatacatcaatgtcattttcttgtattgttataggaatcataactttatacttaggagcagtcgttcaagctgacatggggtgcgtgataaattggaaaggtaaagaactaaagtgtggaagcggaatattcgtaaccaatgaggttcacacatggacagaacagtacaaatttcaggcagactcaccgaagcgattggcaactgctatagcaggagcatgggaaaacggcgtttgtgggatacggtcgacaacaaggatggagaatctcctgtggaaacaaatagccaatgaattaaactacatcttatgggaaaataacataaagctcactgtggtggtcggagatattataggggtactcgaacagggaaaacgtactttgacaccccaacctatggaactcaaatatagttggaaaacatggggtaaagctaaaatagtaactgcggaaacccaaaattcgagctttatcatagatggtccaaatacccccgaatgtccttccgcatcccgtgcttggaacgtatgggaagtggaggattatgggttcggggtgtttactactaacatatggttaaaactcagagaggtatacacacaattgtgtgatcatagattaatgagtgcagctgtgaaagatgagagagctgtgcatgccgatatgggatactggatcgaatcccagaaaaacggaagttggaaactcgaaaaagccagtcttatcgaagttaagacgtgtacgtggcctaaatcacacacactatggagcaatggtgttctagaaagtgatatgataattcccaagagtctcgctggaccaataagtcaacataactacagaccgggttaccacacacaaacagccgggccatggcacttggggaaattagagctagactttaattactgtgaagggacaaccgttgtaatcaccgagaactgtggcacacgagggcctagtttaaggacgactacagtatctggtaaattaatacacgaatggtgctgtcgaagctgtacattaccacctcttaggtatatgggagaagatggatgctggtacggaatggaaatacggccaataagcgaaaaggaggaaaatatggtcaaatctctagtaagcgcaggcagtggtaaggttgacaacttcacgatgggtgttctttgtttagccattctatttgaagaggtgatgagaggaaaattcggcaaaaagcacatgatagcaggggtatttttcacattcgtgttgcttctctcaggacagattacatggcgagacatggcacacaccctcatcatgatcggctcgaatgcttcagaccgtatgggcatgggagtaacatacttagcactaattgccacattcaagattcaaccatttcttgcattaggctttttcctccgtaaactcacatcgcgtgagaatctactcctaggagttggactagcaatggcgaccacactgcaacttccagaagacattgaacaaatggcgaatggtattgcattaggtctaatggctctaaagttaattacccaattcgagacataccaattatggacagcacttatatcattaacatgtagcaatacaatattcaccctaaccgttgcatggcgtacagcgactttaatactagctggagtatctttgctcccagtgtgtcagtcatcatcaatgagaaaaaccgattggttacccatgactgtggcagctatgggagtcccgccactaccactttttatttttagcttaaaagacactctaaaaagaaggtcctggccactaaatgaaggagtaatggctgttggtctggtttctatcttagcatcatcattgttacgcaacgatgtaccgatggcgggccctctagtcgctggaggtcttctgatagcttgctatgtgataaccgggacctccgccgacctaacagttgaaaaagctgcggatgttacgtgggaagaagaagctgagcagacaggagtatctcacaatcttatgataacagtggacgatgacggaacaatgcgtatcaaagacgatgaaacagaaaatatactaacagtccttctgaaaactgcactattaatcgtttcaggaatatttccatacagtataccggcgactctattggtatggcatacatggcaaaagcaaacccaacgtagtggtgtgttgtgggatgtacctagtccaccagaaactcaaaaagcagaactggaagaaggggtatatagaataaagcaacaaggaatcttcggaaaaacgcaagtcggagtaggcgtacagaaggagggtgtctttcacaccatgtggcatgttacacggggcgccgtcctcacttataacgggaaacggctagaaccaaactgggcatcggtcaagaaagatctcatatcttacggtggcggttggaggttaagtgctcaatggcaaaagggtgaggaagtacaagttatagcagtggagccggggaaaaacccaaagaatttccaaaccatgccgggaacctttcagacaacgaccggagaaataggtgcgattgcacttgatttcaaacctgggacgagtggttcacccattattaatcgagaaggtaaagttgtagggctatatgggaatggagttgttactaagaacggaggttacgtttcaggaatagcacaaacaaacgctgaaccagacggtccaacacctgaattggaagaggaaatgtttaagaaaaggaatctcacaataatggacctacatccaggatctggcaaaactaggaaatatctaccggcgatcgtgcgagaagcaattaagcgccgactacgaactctcatcttagcaccaacacgagtcgtagccgcagaaatggaagaggcacttaaagggctaccaataagataccaaacaacggcgactaaatcagaacacaccggacgagaaatagttgatttaatgtgccacgcaactttcacaatgcgcttgttatcgccagtacgggtaccaaattataatctaattataatggacgaggcgcatttcacagatcctgcgtcaatagcagcaagaggctatatatctacacgagtaggtatgggcgaagctgctgctatattcatgaccgcaacaccacccggaacagctgatgcttttccacaatcaaatgctccaattcaagacgaagagagagacatacctgaaagatcatggaacagtggtaatgaatggataaccgattttgcggggaagacagtatggttcgtaccatctattaaggcaggaaacgatattgcaaattgcttacgtaaaaatggtaagaaagtgatccagctatccagaaaaacttttgatacagaatatcagaaaacgaaactcaacgattgggacttcgtcgtaactacagacatatccgagatgggagctaatttcaaagcagacagagtaattgaccccagacgttgcctcaaacccgttatattaacagatggaccagaaagagtaatcttagcggggccaatgcctgtcacagcggcatcagcagctcagcgaagaggaagggtcggacgaaatccgcaaaaggaaaacgaccaatatatattcactggacaacctttaaacaacgatgaagatcacgcacattggacggaagctaaaatgttacttgataacataaatactcctgagggtattattccagcattatttgaaccagaacgggaaaaatcagccgcgatcgatggggaatacagactcaaaggtgagtcgagaaagacatttgttgaattaatgcgaagaggtgaccttccggtgtggctagcacacaaggtagcatcagaaggaatcaaatatacagatagaaaatggtgctttgatggacagcggaacaaccaaatactagaagaaaatatggatgtagaaatatggacaaaagagggtgagaaaaagaagctcagacccagatggttggatgccagaacatatagcgacccactagcactcaaagaatttaaagatttcgctgcgggcagaaaatccatagcgcttgatctggtgactgaaataggtagagttccatcccatttggcacatcggacgagaaatgctctagacaacctagtaatgctacacacatcagaacatggaggccgagcctacagacacgctgtagaagaactaccagaaacaatggagacattattactcctagggctaatgattttattaacaggaggggcaatgctattcttaatatccggaaaaggaataggaaaaacttcaataggattaatttgtgttatagcaagctcagggatgttatggatggccgaaataccactccaatggattgcaagtgcaatagtcttggaatttttcatgatggtcttattgattccagaaccagagaaacaaagaacacctcaagacaatcaattagcatacgtggtaattgggatattaactcttgctgcaataattgcagcaaacgaaatgggattgttagaaaccaccaaaagagatttaggaatgtcgaaggaaccgggagttgtcagcccaactagctacctggatgttgacctacatcctgcatctgcatggacgttatacgccgtggccacgacggttatcactccaatgttaagacataccatagaaaatagtacagccaacgtcagcttagctgctatagcaaatcaagcggtagtcctaatgggtttggacaaaggatggccaatatctaagatggatctaggcgtccctctactcgcccttggctgctattcccaagtaaacccattaactcttactgctgcggtactattactaataacacattatgcaataatcggcccaggactacaagctaaagcgactcgagaagcccaaaaacgaacagcagcagggatcatgaaaaatcctaccgtagatggtattatgacaattgacttggatccagtaatatacgatagcaaattcgaaaaacaactaggacaggttatgttgctagtactatgcgcagtacaattacttttgatgagaacgagttgggccctatgcgaggcattaactttagcaacaggtccgatcacgacattgtgggagggttcaccaggaaaattttggaacactacaatagcggttagtatggcgaacatttttcgaggatcatatttagcaggagctggtctagcatttagcattatgaaatcagtaggtactggaaaacgtggaacagggtcccaaggagaaactttgggtgagaaatggaaaaagaaattaaatcagttgtcgagaaaagagttcgacttatataaaaagagtgggattacggaagtagacaggactgaggccaaagaaggactgaagcgaggggaaataacgcatcatgcagttagtcgaggatcagccaaattacaatggtttgtagaacgaaatatggtgatacctgaaggaagagtaatagatttagggtgcggaagaggcggttggtcatattactgtgctggactcaagaaagtaacagaagtaagaggatacacaaaaggcgggccagggcacgaagaacccgttcctatgagcacgtatgggtggaatatcgttaaacttatgtctggaaaagatgtattttacctgcctccggaaaaatgcgatactctactctgcgacataggagaatctagcccttcgcccacagtagaggaaagcagaacgatcagggtacttaagatggtagagccgtggttgaaaaataatcaattctgcattaaagtacttaacccatatatgccaactgtaatagaacacctagagcgattacaacgtaagcatggagggatgctagttcgaaatcccttgagtagaaattctacacatgaaatgtactggatttcaaacggaacaggaaatattgtagcaagtgtaaatatggtatcaagactcttattaaacaggtttacaatgacacatagaaggcctacaatagaaaaagatgttgacttaggtgcaggaactcgacatgtcaacgctgaaccagaaacacccaatatggacgttataggagaaagaatcaagcgcattaaagaagaacacaatagtacttggcattatgacgatgaaaacccttataaaacttgggcataccacggatcgtacgaggtaaaagccacgggatctgcctctagcatgatcaatggagtagtcaaacttctgaccaagccgtgggatgttgtgccaatggtaactcaaatggcaatgaccgatacgacaccttttgggcaacagagagtcttcaaggagaaagtcgatactcgcacgcctagaagcatgccagggaccaggcgtgtaatggggatcactgcggaatggttgtggaggacgctaggtagaaacaagaagccacgtctttgtacacgcgaagagttcaccaagaaagtcaggacaaacgcggccatgggtgcagttttcacagaagaaaaccaatgggattccgctaaagctgcagtagaagatgaagatttttggatattagtcgatagagaacgggagctccacaaactgggtaaatgcggaagctgcgtgtacaatatgatgggtaagagagagaagaaactaggagagtttgggaaagctaagggctcaagggcaatatggtatatgtggctaggtgcccgatatctagaatttgaagccttaggtttccttaatgaagatcactggttctcgagagaaaacagttacagtggagttgagggcgagggactgcataagttagggtacatattacgagacatctcaaaaatacctgggggcgcgatgtacgcagacgatacagcgggctgggacacaagaataacggaagacgatttacataacgaggagaagatcacacaacagatggatcctgaacaccggcaactagcaagcgcaattttcaagctaacttaccaaaataaagttgttaaggtacaaaggcccactcctactggaacagtaatggacataatatcacgaaaagatcaacgtgggtcaggtcaagtagggacttatggtctaaatacatttacaaatatggaggctcaactaattcgacaaatggagggagaaggcgtactaagtaaagcggacctagagaaccctcacttgccagagaagaaaatcacacaatggctggagacaaaaggcgtcgaacgtctaaaacgaatggcaatatctggcgacgattgtgtagtcaaacctatagacgatcggttcgccaatgccctgctagcgctaaacgatatgggtaaagtaagaaaagatattccgcaatggcagccttcaaaaggctggcatgattggcaacaagtacctttctgttcccatcacttccacgaattaattatgaaagatggaagaaagctagtggttccttgtaggccgcaagacgaacttatcggtagagcacgaatttcccaaggtgctggttggtcattacgagaaacagcgtgtttgggaaaagcatatgcacaaatgtggtctcttatgtactttcatcgaagagatctacgattagcatcaaacgctatatgttcagctgtaccggtgcactgggtgccaacctctcggacaacatggtcgattcatgcacaccaccagtggatgactacagaggatatgttaacagtatggaacagggtatggatagaagataatccttggatggaggataaaactcctgtaacaacttgggaaaatgtaccttacctaggaaagagagaggatcaatggtgtggctcgctgataggcttaacaagtagggcaacttgggcccaaaacattccaacagctattcagcaagtccgatctctaataggaaatgaggagttccttgactacatgccatcaatgaaacgatttcgtaaagaggaagaatcagaaggcgccatttggtga

SEQ ID NO: 23323 - RNA, 9873 nt, synthetic construct
  misc_feature 1..9873: note = derived and/or modified CDS sequence (opt6) from DENV-3__EU687196__SS-prME
  source 1..9873: mol_type = other RNA
acttccttatgcttgatgatgatattacctgctgcactcgcatttcacctaacttcaagggacggggaaccacgcatgatagtaggcaaaaatgaacggggaaaaagcctgctctttaaaaccgcatcaggtataaacatgtgtactcttatcgcgatggatttaggtgaaatgtgtgacgacacagtcacatacaaatgcccgcatataacggaggtagaacccgaagacatagactgctggtgcaatttgaccagtacgtgggtcacttacggtacttgcaaccaagctggagaacatagaagggataaaagaagtgtagccttagctcctcatgttggaatgggattagacaccagaacacaaacatggatgtccgccgagggagcttggagacaagtagaaaaagttgaaacttgggccttaagacacccgggatttacaatcctagctctctttttagcacattacatcgggacctccctaacacaaaaagttgtcatatttatccttctcatgttggtaactccatcaatgacaatgcgctgcgtcggagtgggcaacagggactttgtcgaaggattgagtggagcgacatgggtagacgtcgtgctagagcacggaggatgcgttactacaatggctaaaaataaaccgacgctagatatagaacttcagaaaaccgaagctacgcaattagcgacgctgagaaaactttgtatcgaaggaaaaataaccaacattaccactgatagtaggtgtcctacacagggtgaagccgtcttacctgaagaacaagaccaaaactacgtatgtaaacacacctatgttgatagaggttggggaaatggctgcggattatttgggaaaggatctctagtcacatgcgcaaaattccaatgtttggaacctatagaaggcaaagtagtccaatatgagaatctaaaatacacagtaatcattacggtgcatacaggagatcaacatcaggtgggaaatgaaacccaaggtgtaacagcagaaataacacctcaggcttccacaacagaggctatcctaccggaatatggcacattagggttagaatgctcaccccgaaccggattggactttaatgaaatgatactacttactatgaaaaacaaagcatggatggtgcaccgtcagtggttctttgatttacctttaccatggacaagtggtgcaactaccgaaacaccgacgtggaaccgaaaagaacttctagtaacatttaaaaatgcccatgcgaagaaacaagaagtggtagtactgggatcccaagaaggagcgatgcatacggcgctcaccggagcgacggaaatacaaaactcgggaggaacaagcatattcgccggacacctcaaatgtagacttaaaatggacaaattagaattaaaagggatgagttatgcaatgtgtaccaacactttcgtgcttaagaaagaagtaagtgaaacacaacatggaactatattaatcaaagtggaatataaaggagaggatgttccctgtaaaataccattctccactgaagacggtcaaggaaaagctcataatggaagactaataacagcgaacccagttgtgactaagaaagaagaacctgtcaatatagaagctgaaccaccattcggagaatccaatatagtaatagggataggggacaatgctctgaaaattaactggtacaagaaaggttcaagcatcggaaaaatgtttgaagctacggctagaggcgcaagaagaatggccatattaggtgacaccgcttgggattttgggagcgtcggcggagtactcaattcgctaggtaagatggtgcatcaaatatttggaagtgcatacacggccctgttcagtggtgtatcgtgggtaatgaagatcgggataggtgtcctcttaacttggattggcctaaatagcaagaacacctcgatgtcatttagttgtatagctatagggataataacattgtatcttggcgccgtagtacaagcagacatggggtgtgtaataaattggaaaggaaaagaattaaaatgtggttcagggatttttgtaacaaatgaagtacacacgtggacggaacaatacaaattccaagccgattcgcctaagcggctggctactgcgatagccggtgcatgggagaacggcgtgtgtggtatcaggtcgactacacgaatggaaaatttattgtggaaacaaattgcaaacgagttgaactatatactctgggaaaacaatataaaattgactgttgtggttggagatacgataggcgtgctggaacagggaaagcgaactctcactccacaaccaatggaactgaaatatagttggaaaacatggggaaaggccaaaattgtaacggcggagacacaaaattcctcttttataatcgatgggcccaacacgcctgaatgtccatcggccagtagagcatggaatgtctgggaagtagaagattacgggtttggtgtatttactacaaacatctggctaaaactaagagaggtctatacacaactatgtgaccacagactgatgtccgccgcggtcaaagatgaaagagctgttcatgcagatatgggctattggatcgaatcccaaaagaatggctcatggaagttagagaaggcttccctaatcgaagtgaaaacttgtacatggccaaaatcccatacgttatggagcaacggtgtattggaatctgacatgattatcccgaaaagtttggcagggcccatttcgcagcataactaccgccccggttatcatactcaaacagcaggaccgtggcacttaggaaaactggaattagatttcaattattgcgaaggtacaacggtagttatcactgaaaactgtgggacacgcggaccttcactaagaacgacgacggtcagcggcaagttgatccatgaatggtgttgtcgaagttgtaccctacccccacttcgttacatgggcgaggacggttgttggtacggtatggaaattagaccaataagtgagaaagaagaaaatatggttaaatctttggtaagcgccggcagtggcaaagtcgataattttactatgggagtcttatgcctcgcaattctattcgaagaagtaatgagaggcaaatttggaaagaaacacatgatcgctggagttattttcacattcgtcttgttactatcgggtcagattacgtggagagacgtagcacatacactcatcatgataggctccaatgcatcagatcgtatgggcatgggcgtaacttacttagcactaatcgctacttttaaaatacaaccctttttagccctaggcttctttttgagaaaactgaccagtagagaaaacttactactaggggtaggtttagctatggcaaccacgttacagctaccagaggatatcgaacaaatggctaacggtatagcactaggactaatggcactaaaactaacgactcaatttgaaacttatcaactatggacagcattaatatctttaacttgctcaaacaccatcttcactttaacggttgcatggcgtacggcaactctaatactcgcaggagtctctttactaccggtatgccaatcctccagtatgagaaaaacagactggttaccaatgacagtcgccgctatgggagtccctcctctccctctatttatatttagtctaaaagatactctcaaaagacgatcgtggccattgaatgagggcgtaatggcggtgggcttagtttctatattagcatcttcattgctgaggaatgatgtcccaatggctggtcccttagtagcaggcggtttactgatagcttgttacgtgattacagggacaagtgcagatcttacagtagagaaagctgctgacgttacgtgggaagaggaagcggagcagactggcgtatcacacaatttaatgataacagtagacgacgatggaacaatgcgcattaaagatgatgagacagaaaatatactaaccgttctattaaaaacagcattgttaatagtttctgggatatttccatactcaataccagctacgttattagtttggcacacatggcagaaacaaacacaacgtagcggcgtcctctgggacgtaccaagccctccagagacccaaaaagcagaattagaagagggagtataccgtatcaaacagcaaggaatattcggtaaaacacaagtaggcgtaggagtacaaaaagaaggggtttttcacactatgtggcacgtgactaggggtgccgtgctcacgtataacggtaaacgactagagccaaactgggcctcagtaaagaaagacctaattagttacgggggtggttggcggctatcagctcagtggcaaaaaggtgaagaagtacaagtaattgctgtggaacccggcaagaatcctaaaaattttcaaactatgccaggaatcttccaaaccacaactggggaaatcggagcaattgcgctagattttaaacctgggacaagtgggagtcccattataaacagagagggcaaagtcgtcggattatatggtaatggagttgtgacaaagaacggcggatacgtaagcgggattgcacaaacaaatgctgagccagacggtccgacgcccgaattggaagaagagatgtttaagaaacggaacttaacaataatggacttacatcccggaagtggtaaaacacgtaaatatttaccggcgatagtaagagaggctataaagcgtaggttgaggaccctaatcctcgcaccaaccagagttgtcgccgctgaaatggaggaagccctaaaaggattaccaatcagatatcaaactaccgcaacaaaaagtgaacacacagggagggaaattgttgatttaatgtgtcacgcaacgttcacgatgagacttttatcacccgtgcgagtcccaaattataatctaattatcatggatgaagcacactttaccgacccagcaagtattgcagcaagaggatatatatccacacgagtcgggatgggggaagcagcagctatatttatgactgccacgcctccaggaacagcggatgcctttccgcagagcaatgcacccatccaagatgaagaacgtgacataccagaaaggtcctggaactcaggaaacgagtggataacagatttcgctgggaaaacagtctggttcgttccttcaatcaaggccgggaatgatatagcaaactgtcttcgtaagaacggcaagaaagtaatacaactctccaggaaaactttcgatacagaatatcagaaaacgaaattgaatgactgggatttcgtagttactaccgatatatcggaaatgggggcaaatttcaaagcggatagggtaatagatccacggcgctgcttgaaacctgttatcctcactgatggaccagagagggtaatactagcagggccaatgcctgtgacagcagcgagtgctgcacagcgccgtggcagggtaggtcgaaaccctcaaaaagaaaatgaccaatatatctttactggccaaccactcaataacgatgaagaccatgcgcattggaccgaggcgaagatgctcctagataacatcaacacacccgaaggcataataccagcactttttgaacccgaacgtgagaaaagcgcggctatagacggtgagtatagattaaaaggcgagagtcgaaaaacctttgtggaactgatgagacgaggcgatttacctgtatggttagcacataaagtagcttcagaggggataaaatacacagacagaaaatggtgttttgatggacaaagaaacaaccagattcttgaggaaaacatggatgtagaaatatggacaaaagagggagaaaagaagaaacttcgaccgaggtggctcgacgcaagaacctatagcgatccactagcactcaaagaatttaaagattttgccgcaggacgcaaatccatagcattagatttagtgacagaaattggtagggtcccatctcatctcgctcacagaacgagaaatgctctagacaacttagtaatgcttcacatgagcgaacacggaggaaaggcttatcggcacgcagttgaagaattaccggaaactatggaaacactactgctcttaggactgatgatacttttaacgggaggggctatgctctttttaataagcggcaaaggtatagggaagacaagtatcggtcttatctgtgttatcgcatcatcagggatgttatggatggcggaaattccattacagtggattgcttcggccatcgtattagagttctttatgatggtattattgatacccgaaccagaaaaacagcgcactccccaagacaaccagttggcctatgtcgttattgggattttaactttggcggctataatcgcagcaaatgaaatgggactgctagagacaacaaaacgagacttaggaatgtcaaaagagcccggagtagtgagccctacctcatacctagacgtagacttgcacccagcaagtgcgtggacactctacgcagtggcaactaccgtaatcaccccaatgctgagacatactatagaaaactcaacagcaaatgtaagcctagctgcaatagctaatcaggccgtagtactcatgggtttggacaaaggatggcccataagcaagatggatttgggagttccgctattagcattaggatgctacagtcaagtcaaccctctcacacttactgcagcggtactattactaataactcactatgccataataggacctggactacaagcaaaagccaccagagaagcccagaaaaggacggcagcgggtataatgaaaaatccaacagttgatggaataatgacaatcgatctggatccggtaatatatgactcgaaatttgaaaaacaactaggacaggttatgttactggttttatgcgcagtccaattgctgctgatgagaacatcttgggcattatgcgaagcgttaacacttgcaaccggacccatcactacattatgggaaggatccccaggtaaattttggaatactacaatagccgtttctatggcaaacatatttagaggaagttacttagccggtgctggcttagcattttctataatgaagtcagtaggaactggaaagagagggactggaagtcaaggagaaacactcggtgagaaatggaaaaagaaacttaatcaactaagtcgtaaagaatttgacctctataagaaaagtgggataaccgaagtagacaggacagaagccaaagagggattaaagagaggtgaaataacccaccatgccgtaagtagaggtagcgcaaaattacagtggtttgtagaaagaaatatggttatacctgagggtcgtgtgatcgatttgggatgcggtagaggcggatggtcatattactgcgcaggcctaaagaaagtaaccgaagtaagagggtacacaaaaggaggacctggccatgaagaaccagttccaatgagcacatatggctggaacattgttaaattaatgtccggcaaggacgtgttctatctaccaccagaaaaatgcgataccttattatgtgacattggggaatcatccccgtccccaacggtcgaagagtctagaacagttcgcgttttaaagatggtcgaaccgtggctgaaaaataatcagttctgcataaaagttctaaatccttacatgcccacagtgatcgagcatctagaaagattacaaagaaaacatggaggaatgttggtaagaaatcccttaagcagaaattccacacacgaaatgtactggataagtaacggtactggaaacatagtggccagcgtaaacatggtaagcagattattattaaataggttcacaatgactcataggagacctacaattgaaaaagatgtagatttaggcgcgggaacaagacacgtcaacgcagagcccgagactccaaacatggacgtgattggagagcgaataaagagaataaaagaagaacatattagcacttggcattatgatgacgaaaacccgtacaaaacttgggcctatcacggtagttatgaggtgaaagctacaggtagcgcgagttcaatgatcaatggggtggtgaaactattgacaaaaccatgggacgtagtgcctatggttacacaaatggctatgactgatactaccccgtttggtcaacaacgtgtattcaaagaaaaagtcgatacgaggactccacgtagtatgcctggtacaagaagggtaatgggtataacagctgaatggctatggaggacactagggagaaataagaaaccacgcctgtgtacaagagaagaatttaccaagaaagttaggacaaacgccgcaatgggagcagtattcacagaagaaaaccagtgggattcagccaaagccgcggttgaagatgaagacttttggaaattagtggacagagaacgcgaactacataaacttggaaagtgcgggtcgtgcgtatataacatgatgggaaagcgagaaaagaaattaggggaatttggcaaggcaaaggggtctagagccatatggtacatgtggctaggtgcccgatatcttgaatttgaagcactggggttcctaaacgaggatcactggttttctcgtgagaactcgtattcaggagtcgaaggcgaggggttacataaactagggtatatattaagggacatatcaaaaatacctggaggggcaatgtacgcagacgatactgcaggatgggatactcggatcacagaagatgacctacataacgaagagaaaataacgcaacaaatggatccagagcaccgccaactcgcgaatgcaatattcaaattaacgtaccagaacaaagtcgtgaaagttcaaagacctacaccaacaggaacagtaatggacataatatccagaaaagatcaaaggggatctggacaagtaggaacatatggactaaacacatttacaaatatggaggcgcaactaataagacaaatggagggagagggggttcttagtaaggctgaccttgaaaacccacatcttcctgagaagaaaataacccaatggttagagacaaaaggagtggaacggttaaaaaggatggcgattagcggggacgattgtgtagtaaaacctattgatgaccggttcgctaatgcactactggctttaaacgatatggggaaggttcgcaaagacattcctcagtggcaaccaagtaaagggtggcacgattggcaacaagtaccgttttgcagtcatcattttcacgaactgattatgaaggacggaagaaagctagttgtaccatgtagacctcaagacgaattaattggtagggcaaggatttcccaaggggctggatggtcttttagggaaacagcatgcctaggtaaagcctacgcgcaaatgtggtctttaatgtatttccatagaagagacttaaggttggcatctaacgcgatttgtagtgcggtgccagtccattgggttccgacatctagaaccacatggtccatccatgcacatcatcaatggatgacgacagaagatatgctcacagtgtggaacagagtatggattgaagacaatccctggatggaagacaaaactccggtaaccacctgggaaaatgtgccatacttgggaaaacgcgaagaccaatggtgtggtagtctgataggactgacatctagagctacctgggcacaaaatatcccaacggcaatccaacaggtcaggagcttaattggaaacgaagagtttttggactacatgccatcaatgaaaagatttagaaaggaggaagaatcagagggagcgatatggtga

SEQ ID NO: 23324 - RNA, 9873 nt, synthetic construct
  misc_feature 1..9873: note = derived and/or modified CDS sequence (opt6) from DENV-3__EU854298__SS-prME
  source 1..9873: mol_type = other RNA
acaagcctgtgcttaatgatgattctacctgcagcattagccttccatttgacttcacgggatggtgaaccaagaatgatagtagggaaaaacgaaagaggaaaatccttacttttcaaaactgcaagcggaatcaacatgtgcacactgattgctatggacttgggagaaatgtgtgacgacactgttacgtataaatgtccacatatcactgaagtagaacccgaagacatcgattgttggtgcaacctgacatcaacatgggttacgtatggtacgtgtaaccaagccggtgaacatcgcagagacaaacgaagcgtagcattggcccctcacgtaggaatgggattagacacacgcactcaaacatggatgagcgccgaaggtgcttggcgacaggtagaaaaagtcgaaacctgggcactaagacaccctggatttacgatcctagcgttgtttcttgcgcattatatcggaacatccctaactcaaaaagttgttatcttcatcctactgatgttagttactccaagcatgaccatgagatgcgtaggtgtaggcaatcgggactttgtagaaggtttaagcggagcaacgtgggtagacgtcgtcctcgaacatggcggatgtgtcacgacgatggccaaaaataaaccaaccctcgatatcgaactccagaaaacagaagccactcaattagccactttaaggaaactttgtatagaaggtaaaataaccaatataaccactgacagccgatgccctacgcaaggtgaagcagtgcttccggaagaacaagatcagaactatgtttgtaaacatacatatgtagataggggatggggaaatggatgcggcctttttgggaaagggtcattagtaacctgtgcaaaatttcaatgcctagaacctattgaagggaaagttgtacaatatgaaaacctaaaatataccgtcattataacagtacacacaggtgatcaacatcaagtaggaaacgaaacacaaggggtaaccgcggaaataaccccacaagctagcaccacggaagctatcctaccggaatatggaacactgggattggaatgttccccgagaacggggcttgattttaatgaaatgatattattaacaatgaagaataaagcatggatggttcataggcagtggtttttcgacttaccactaccctggactagcggagcaacaactgagacgcctacatggaatcgcaaagaactacttgtaacgtttaaaaatgcacatgcgaaaaagcaggaagttgtagtgcttggctcccaagagggtgccatgcacacagctttgacgggagctactgagatacaaaacagcggcggaacaagtatttttgcaggtcatttgaaatgcaggttaaaaatggataaactagaactgaagggaatgagttacgcaatgtgcacaaatacgtttgtactaaagaaagaagtcagtgaaacacaacatggcacgatcttgataaaagtcgaatacaaaggagaagacgtcccatgtaaaataccgttttcaactgaggatggccaggggaaggctcacaacgggagattgattactgctaatccagttgtcacaaagaaagaggaacctgtcaatattgaagccgaacccccttttggcgaatcaaacatcgtaataggaataggtgacaacgcactaaaaattaattggtacaagaaaggatcttcgattggtaaaatgtttgaagcaacagcaagaggggctcgtaggatggcaatcctcggtgatacagcgtgggacttcggaagtgtgggtggagtattaaattcattgggtaaaatggtccatcaaatttttggtagtgcatacactgcgttattcagtggtgtatcatgggtcatgaaaataggcattggggttctcttaacttggattggtctaaatagcaaaaatacttcaatgagcttctcctgtattgccataggcataataactttatatttaggagctgtcgtacaggcagacatgggctgtgtaattaattggaaagggaaagagctaaaatgtggaagtggaatatttgtcacaaatgaagttcacacttggacagaacaatacaaattccaagcagacagtcctaagagattagctactgcaattgccggagcgtgggaaaatggtgtatgtggaataaggagtactacgagaatggaaaatttattatggaaacagattgccaatgagctgaattacattctgtgggaaaacaacataaaattgactgttgttgtaggtgatataattggcgtacttgagcaaggaaaaagaacgttaacaccgcaacctatggagctcaaatactcttggaagacatggggcaaagctaaaattgtgactgccgaaactcaaaattcatcatttatcattgatggtccaaacactcctgaatgtcctaatgcttcacgtgcctggaatgtgtgggaggtggaggactacggtttcggagtatttaccacgaatatatggttaaaattaagagaagtacatactcaactatgcgaccatagattgatgagtgctgccgtaaaagatgaaagagccgtacacgccgatatgggctactggatagagagtcagaagaatggttcatggaaattggaaaaggcttcgttaattgaagttaaaacttgtacatggcccaaatcacacactctttggagcaatggagttctcgaatcggatatgattatacctaagagcttggccggtccgatctcacagcacaactataggcctggatatcacacgcagacagcgggaccatggcatttaggcaagttagaactcgattttaactactgtgaaggtacaacagttgttataacagaaaactgtggcactagagggccaagtttacgcacaaccacagtaagtgggaaactaatacacgagtggtgctgcaggtcatgtacgctaccacctttaagatacatgggtgaagatggctgctggtatggaatggaaataagacctatatcagaaaaagaagagaacatggtcaaatcactcgtgagcgcaggatcgggaaaagttgataattttacgatgggagtattatgcctggccattcttttcgaggaagtaatgcgcggaaaattcggtaagaaacacatgatagcaggagttttctttaccttcgttctactacttagtggtcaaataacatggagagatatggcacatacattaataatgattgggagcaacgcttcggacagaatgggaatgggtgtcacatatctagcactgatcgcgacgtttaaaattcaaccgtttttagcgctcggatttttcctgcgaaaactaaccagtcgcgaaaatttattactaggagtaggattggcaatggcgacaaccttacaactaccagaagatatagagcagatggcaaatggtatagctctgggtctgatggcgcttaaactaataacacaattcgagacctatcaactctggactgcgctaatttcattaacgtgtagcaataccatatttaccctaactgtcgcgtggcgtacagctacactcatcctggctggagtgtcccttttaccggtatgccaaagtagtagcatgcgaaaaacagactggttaccgatgacggtagcagctatgggggtcccaccactaccgcttttcatctttagcctgaaagacacgcttaagcgaaggtcatggccactaaacgaaggagttatggcagtaggcttagtatccatattagcctcatctcttctcaggaacgatgttccgatggcaggaccgctagtggcagggggcctcttaatcgcgtgctacgtaataaccggcacatcggcggatctaaccgtcgaaaaagccgcagatgtcacgtgggaagaagaagcggagcagacaggcgtaagtcataacttgatgataacagtggatgacgatggtacaatgagaataaaagatgatgaaacagaaaatatattaaccgtgctcttgaaaacagcacttctcatagtctcagggatatttccttattctatacccgccacactattagtatggcatacgtggcaaaaacaaactcaaaggtctggggtattatgggacgtaccaagtcccccagagacacaaaaagcagaattggaagaaggggtgtaccgaataaaacaacaaggtatatttggtaaaacacaagtcggagttggtgtccaaaaggaaggggtgtttcacacgatgtggcatgttacacgaggggccgtattagcttacaatggtaaaagactagaacccaactgggcgtctgtcaagaaagacctaatttcgtacggtggaggctggcgtttgtcagcacaatggcaaaaaggtgaagaggtacaagtcatagcggtggaaccaggcaaaaaccctaagaattttcaaacaatcccaggtacttttcagacaactactggagagattggagctatagctctggatttcaaacctggtacatcaggttcaccaatcataaacagagaaggaaaagttgtaggattatacggaaacggagtcgtaactaaaaacgggggttatgtatcaggcattgctcaaactaatgccgaacctgatggccctacacctgaactagaagaggaaatgtttaagaaacgaaacttaacgataatggacttacatcctggatctggaaagacacgaaagtacttaccggcaatagtgagagaagcaataaagcgtcgattgaggacactgatattggcaccgactcgtgtcgtagcagcggagatggaagaagcgcttaaaggactacctataaggtatcagaccacagcaaccaaaagtgagcataccggaagggaaatagtggatctaatgtgccatgctaccttcacaatgagactattgagtccagttagggttccgaattataatttaatcataatggacgaagcccactttactgatccagcatcaatagcagcacgaggatacatcagtacacgggtaggaatgggtgaagcagccgcgatattcatgacagcgacacctccaggtacagctgacgcctttccacaaagtaacgcaccaatccaagacgaagaacgtgacattccagaacgaagttggaactcagggaatgagtggataacggacttcgcaggcaaaacggtttggttcgtaccgagtataaaagctggtaacgacatagcgaactgtttgaggaaaaacggtaagaaagtgatacaactgtcaagaaagacattcgataccgaataccagaaaacaaaactaaacgattgggatttcgtcgtcaccacagacatatcagaaatgggtgcaaactttaaagccgatagggtaattgatccgagacggtgtttgaaaccagtaattttaacagatggcccagaacgagtcatacttgctgggccgatgcctgttacagcagcgtctgctgctcaacgacgaggacgagttggccgtaacccccaaaaagagaacgatcaatacatatttacaggtcagccgctaaataatgatgaagatcacgctcattggaccgaagcaaaaatgttacttgataacattaataccccagaaggaataatccctgcattattcgaaccagaaagagaaaagtcagcagccatagatggagaatacagactaaaaggcgaaagtcgcaagacattcgtagaactcatgaggagaggagatctacccgtatggctcgcccataaagtcgcatctgaaggaattaaatacactgaccgaaaatggtgctttgacggacaacggaataaccagattttggaagagaacatggacgtagaaatatggaccaaagagggtgaacgaaagaaactgagaccacgttggctagacgctagaacatattcagacccattagctttaaaagagttcaaagatttcgcggctggtaggaaaagtatcgctttagatctagtaacagaaataggcagagttccaagtcatttagcacatagaacacgaaatgcactcgacaatttagtaatgttacatacatcggaacatggaggaaaggcttataggcacgcagtagaagaacttccagaaacaatggaaaccctactattgctaggtttgatgatactattaacaggtggcgcaatgttatttctaattagtggcaaaggtattggcaaaacgagtattggcctcatctgtgtcatcgcaagctccggcatgttatggatggctgaaatcccgctacaatggatcgcatcagctattgttctcgagttctttatgatggtgctattaataccagaacctgaaaaacaacggacacctcaagataaccaattagcgtacgtggtaattggaatcttaacccttgccgctataattgctgccaacgaaatgggtcttctcgaaactacgaagagagacttgggtatgtcaaaggagcccggggtagtgagcccaactagctatcttgatgttgatctacatcctgcttcagcatggacgttatacgccgttgctactacagtcatcactccgatgctcagacacactatagagaactcaacagccaatgtatcactagcagctattgccaatcaagccgtagtattaatgggtctcgacaagggttggcctatttcaaaaatggatcttggagtccctctcttagcactaggctgttactcacaggtaaatccgctaaccctaactgcagcggtattactgttaatcacccattatgccattattggaccaggactccaggcaaaggccacaagggaagctcaaaagaggacagcagcaggcatcatgaaaaatcctactgtcgatggtataatgactattgatctggacccagtgatctatgattcaaaatttgagaaacaactcgggcaggttatgcttcttgttttatgtgcggtgcaactactcctaatgcgtacatcctgggccttatgtgaagcactaaccctagcaacaggaccaatcacaacattgtgggaaggctctccaggtaaattttggaacactacgatagctgtgtctatggctaacatattcaggggcagctacttagcgggagctggattagcgtttagtatcatgaagtcggtcggcacaggaaaaagaggaacaggatcgcagggtgaaaccttgggagaaaagtggaagaagaaattaaatcaactaagccgaaaagaatttgacctatacaagaaatcaggaataacggaagtagatagaaccgaagcaaaagagggactaaaaaggggtgaaataacgcaccacgccgtaagccgtggaagtgcaaaattacaatggtttgtagaacgcaacatggttatacccgagggtagggttattgacttagggtgtggtagaggcggatggtcatattactgtgctggacttaagaaagtaacagaggttagagggtacacaaaaggtgggcctggacacgaagaacccgtgcccatgtctacctatgggtggaacattgtcaaactcatgtccggcaaagatgtcttttatcttccaccggaaaaatgtgatacattactatgtgatataggtgaaagtagcccttccccaacagtcgaagaatctcgtacgattagggtcttaaaaatggtggagccatggctcaaaaataatcaattctgtataaaagtactaaatccatacatgcctaccgtaattgagcacttggaacgactgcaacggaaacatggtggtatgttggttcgaaatcccctgtcccggaacagtacgcacgagatgtactggattagtaatggtaccggaaacatcgtggcgagtgttaatatggtttcgagattgttattaaatagatttaccatgacacatcgcagacctaccatcgaaaaagacgtagaccttggagctggaactcggcacgtaaacgcggaacccgaaacacctaatatggatgtcataggggagcgtataaaacgtataaaagaagaacataactccacatggcactatgacgatgaaaatccttacaaaacctgggcttatcatggttcttatgaagtaaaagcgaccgggagtgcatccagtatgattaatggagttgttaagctgctgacgaaaccttgggacgtagttcctatggtaacccaaatggcaatgactgatacgaccccatttggacagcaaagagtattcaaagagaaggttgacaccagaacgccacgtagtatgccaggaacgagaagggtaatgggaataacggcagaatggttgtggagaactcttgggaggaacaagaagccgaggctttgcacgagggaagaatttactaagaaagtaagaacaaacgcagcaatgggagcggtcttcacagaggaaaatcagtgggactcagcaaaagcagcagtagaggacgaagatttttggaaacttgtagatcgagagcgtgaactccataaattaggcaagtgcggaagttgtgtctacaatatgatggggaagagagaaaagaaattgggcgaatttggtaaagcaaagggtagtagggccatttggtatatgtggctgggtgccagatatttagagttcgaagcgttgggttttctcaatgaagatcattggtttagtagagaaaactcttactccggtgttgaaggtgaaggccttcacaagttaggatatatactaagggacatatctaaaattccgggaggagcaatgtacgcagatgatacggcagggtgggacacgcgcatcacagaggacgacttacacaatgaggagaaaataactcaacagatggatcctgaacacagacagttagcgaacgctatcttcaaattgacttatcaaaataaagttgttaaagtacaaaggcctaccccgaccggaacagtcatggatattataagtaggaaagatcaaagaggtagtgggcaagtcggcacatatggtcttaatacttttacaaatatggaagtacagttgatcagacaaatggaaggagaaggtgttctatctaaggcagatttagaaaatcctcatctgcctgagaagaaaataacacaatggttagaaactaaaggtgtcgaaagattgaaaaggatggctatctctggagacgattgtgtagtaaaacctatagacgatagattcgcgaacgctctcttagcattaaacgatatgggaaaagtacgcaaggatatccctcaatggcagccatcgaaaggatggcacgattggcaacaggtaccgttttgttcccatcactttcatgaattgatcatgaaagatggtcgcaaacttgtcgtcccttgtagaccccaagacgaattaattggtagagcacgcatatcacaaggcgctggatggtctttgagggagacagcctgtttaggaaaggcttacgcccaaatgtggagtctgatgtattttcaccgccgagacctacgacttgcatcaaacgcaatatgtagtgctgtaccagtacattgggtaccaacgtcaagaactacatggagcattcatgcgcatcatcaatggatgacaacagaagatatgttaactgtatggaatcgagtgtggattgaagataacccatggatggaggataaaacaccagtcaccacatgggaaaatgttccctacttaggaaaacgcgaggatcaatggtgtgggtctttgataggattaacatcgcgtgcaacatgggcacaaaacataccaacagcaatccatcaggtacgatcactgatcgggaatgaagagtttctagattatatgccatcaatgaaaaggttcagaaaagaggaagaactggagggtgctatatggtga

SEQ ID NO: 23325 - RNA, 9873 nt, synthetic construct
  misc_feature 1..9873: note = derived and/or modified CDS sequence (opt6) from DENV-3__FJ373306__SS-prME
  source 1..9873: mol_type = other RNA
acatcattgtgtctcatgatgattttgcctgcagccctcgcgtttcacttaacctcccgtgatggagaacctcgaatgatagtaggcaaaaacgaaagagggaaatcattacttttcaaaacggcttctggaattaatatgtgtaccctcatagcaatggacttgggagaaatgtgtgatgacacagtgacgtataaatgtccacacattacagaagtggaacctgaagatatagattgctggtgtaacttaacgtcaacgtgggtcacatatggtacctgtaatcaagcgggagaacatagacgagataaaagatcggtagctctggcgccgcacgttggaatgggattagacactagaacacaaacgtggatgtcagctgaaggggcttggagacaagtcgaaaaagtagaaacatgggcactgcggcaccccggttttacaatcttagccctgttcctcgctcactacgtaggtactagcctcacacaaaaagtagttatattcattttattaatgttggtgacaccaagtatgaccatgcggtgtgtaggagttggtaacagagactttgtggaagggctctccggagcaacctgggtagatgtagtgctagaacacggcggatgtgtaaccactatggccaaaaataaaccaaccctagatatcgaattacagaaaactgaagccactcaattagcaacactacgaaaattatgtatcgaaggtaaaatcacaaacattaccactgacagtagatgtcccacacaaggagaagctgtattaccagaagaacaagatcaaaattatgtatgcaaacatacatatgttgacaggggttggggtaatggatgcggtctattcggaaaaggaagtttggtgacatgtgcgaaattccaatgcttggaaccaatcgaaggaaaagttgtccaatatgaaaatttaaaatacaccgttattattacagtccatacaggagaccaacatcaagtaggtaacgaaacgcaaggagtaacagcagaaatcaccccacaagcatcaaccacggaagcaattttgcctgaatacggtaccttaggtttagaatgcagcccaaggacaggtttggatttcaacgagatgatattattaacaatgaaaaacaaggcttggatggttcaccgtcaatggttctttgatttgccattaccttggacatcgggagcgacgaccgaaacacccacatggaataggaaagaattattagtaacgtttaaaaatgcacatgcaaagaaacaagaagtggttgtactgggatcacaagaaggagcaatgcacacagccctaacaggggcaacagaaatccaaaactccggagggacatcaatcttcgcaggtcatctaaaatgtagattgaaaatggataaactggaattaaaaggtatgagctatgctatgtgtactaatacgttcgtactcaaaaaggaagtttccgaaacgcaacacgggaccattctgatcaaagtggaatataaaggagaggatgtgccttgcaaagttccttttagcaccgaagacggtcaaggtaaagcccataatgggaggctaattactgcgaatccagtagttacaaagaaagaagaacccgtcaatattgaagcggaacccccatttggcgaatcgaatatagtaattggaatcggcgataacgcattaaagataaattggtacaagaaaggcagctccatcggaaaaatgttcgaggcaaccgcacgtggcgcccggagaatggcaatccttggtgatacagcatgggacttcggttctgttggcggcgttttaaactcacttggtaaaatggtgcaccaaatattcggcagtgcatacacagcattatttagtggggttagttgggtaatgaaaataggtattggtgtactactaacgtggatagggttaaacagcaaaaacacttcaatgtccttctcttgtatcgtcattggtatcattacattatatctcggcgcagtagttcaagccgacatgggatgcgtgatcaattggaagggaaaagaacttaaatgcggtagcggcatttttgttacaaacgaagtacatacatggaccgaacaatacaaattccaggcggactctccaaaaaggctcgctacggcaattgcgggagcctgggaaaatggagtatgtggaataagaagcaccacgcggatggaaaaccttttatggaaacaaatagccaatgagctaaactatatcctgtgggagaacaacattaaattgacggtagtcgttggtgacatcataggtgttctagaacaaggtaagagaactctgactccacagcctatggaacttaaatattcctggaaaacttgggggaaagctaaaatcgtgaccgccgagacccagaatagtagtttcataatagatggtccgaatacaccggagtgtccttccgcaagtcgagcctggaatgtttgggaggtcgaggattacggattcggggttttcagtacaaacatctggcttaaattacgggaagtatatacccagctctgcgatcatagattgatgagtgcagcagtaaaagacgagagagctgtgcacgcggacatgggatattggatagaaagtcaaaagaacggaagttggaaacttgaaaaagcgtcactaatagaagtaaaaacatgcacttggcctaagtcccacacattatggagtaacggggtactagaatcagacatgataatcccaaaaagcctagcgggacccatatcgcaacataactaccgaccaggatatcacacacaaaccgcagggccatggcatcttggaaagctagagctcgattttaactattgtgaaggaactactgttgtcataacagaaaattgtggtactcgaggtccctctttacgaacgactacagtttcaggtaaattaatacacgaatggtgttgtagatcatgcacacttccaccacttagatatatgggcgaagatgggtgttggtatggaatggaaatcaggcccatatcagagaaagaagaaaacatggtaaagtcgctagtatcagcgggctccggcaaggtcgataatttcactatgggtgttctttgtttagcaatcttattcgaagaagtaatgcgaggtaaattcggaaagaaacacatgatagcaggcgtatttttcacttttgtattactactttcagggcaaatcacctggcgagatatggcacacactttaattatgatagggagtaacgcaagtgatcgtatggggatgggggtaacttatcttgcgctaatagccaccttcaaaatacaaccatttctcgccttaggattctttctaaggaaattaacgagtcgagaaaatctcctactaggagtgggattagctatggcaactacgctacaactacctgaggatatagagcaaatggcaaatggtatagccttaggacttatggcgttaaaactaatcacccaatttgaaacatatcaactttggacagcacttatttcactaacctgctccaatacaatatttactctaacagtcgcatggagaacagcgacgcttatacttgcaggggtctcgctactcccggtctgtcaatcaagttcaatgcgtaaaaccgattggttacccatgacggtggcagcaatgggcgtaccacccctcccattattcatcttttcactcaaagatacgttaaagaggcgtagttggcctctcaatgaaggcgtaatggcagtgggattagtttcaattttggcctctagtttgctcagaaatgacgttcctatggccgggccgctggtagcaggagggctgttaattgcttgctacgttataaccgggacaagtgcagatctaacagtagaaaaggcagccgatgtaacatgggaagaagaagctgaacaaactggtgtttctcataacttaatgattacggtagatgatgatggcaccatgagaataaaggatgatgaaacagaaaatattctaacagtcctactaaaaacagcattacttatcgtaagtggaatattcccatatagcataccagcaactcttttagtgtggcacacatggcaaaaacaaacacaacgaagcggcgtactctgggatgtaccttcccctccagaaacccaaaaagccgaattggaagagggggtctatcgaatcaaacagcaaggaatattcggcaaaacacaagtgggagttggggttcagaaggagggagtatttcacactatgtggcacgtcacgcggggtgccgtattaacatacaatggaaaacgcctagaacctaactgggctagcgtaaagaaagatctgatttcctacggaggaggatggagactaagtgcacagtggcaaaaaggagaggaagtacaagtgattgctgtagaaccaggtaagaatcctaaaaattttcaaacaatgcctggtacgttccaaacgacaacaggcgaaataggagccatagccctggactttaaacctggaacgtcaggttctccaataattaacagggaaggcaaagtagttgggctttatggaaatggagtagtaacgaaaaacgggggttatgtgtcaggtatcgcacagacaaacgctgaaccagatggaccaacgccagagctggaggaggagatgttcaagaaaagaaacttaaccataatggaccttcatcctggcagtggtaaaaccagaaaataccttccagcaatagtaagagaagcgataaaacgtcgacttcgaactttaattttagcgccaactcgcgtcgtagcagcagaaatggaggaagcattaaaaggcctacctattagataccaaactacggcaacgaaaagtgaacatactggacgcgaaatagtagacctcatgtgtcatgctacctttactatgcgactactatcgccagttcgagttccaaactacaatctgatcataatggatgaggcgcactttaccgatcctgccagcatagcggcaagaggttatataagtacacgcgtaggtatgggagaagcggccgctattttcatgacagcaactcctcccggcacagcggatgcgtttccgcagagcaacgcaccaatacaagacgaagaaagagacatacctgaacgatcttggaactcgggtaatgaatggataacagattttgcagggaaaacagtatggttcgtaccctcgataaaagcgggaaatgacatagccaattgcttaaggaaaaatggcaagaaagtaatacagttaagtagaaaaacatttgatacagagtatcagaaaacgaaactaaatgactgggacttcgtagtaacaacagatataagcgagatgggagcaaattttaaagcagacagagttatcgatcctcgacgctgcctaaagccagtcattttaacagatggaccagaacgtgtaattctcgcaggacctatgccggtaaccgcggcaagcgcagctcagcgtcgagggagagtaggccgaaatccacaaaaggaaaatgatcagtatattttcaccggccaacccctaaataatgatgaggaccatgcacattggacagaagcaaaaatgctattagataatattaacaccccggaagggataataccagctttattcgaaccggaaagggagaaatctgcagcaattgacggagaatatagactaaaaggagaatcacgaaaaacctttgtagagctaatgaggcgcggggaccttccagtatggctagctcataaggtagcatcagagggaattaaatatactgatcggaaatggtgcttcgacggtcagaggaacaatcaaattttagaagagaatatggacgtagagatttggactaaagaaggagagaaaaagaaactaagaccccgatggttagatgctaggacgtatagcgatccattagcattaaaggagtttaaggactttgctgcgggaaggaaatcaattgccctggatttagttactgaaataggaagagtaccttctcatttagcccatcgcaccaggaatgctctggacaacttagtcatgcttcatacgtctgaacatggcggcaaagcatatcgacatgccgttgaagaattgccagaaacgatggagacgctgttactcttgggtcttatgattttactaaccggcggagcaatgctattcttaatttcaggaaagggtattggcaaaacaagcataggacttatttgcgttatagctagttccgggatgttatggatggctgaaataccattgcagtggatcgcatcagcaatagtcttggaatttttcatgatggtcctgttaatacccgaaccagaaaagcaaagaaccccgcaagataaccaattagcatatgtggtaatcgggatattgacattagcagcaataatagcagccaatgaaatgggtctattagaaactacaaaaagagacctcgggatgagtaaagaaccaggagtagtttctccaaccagttacctcgacgtagatttacatcctgcaagcgcatggaccttgtatgcagtagctacaacggtgatcactccgatgttgaggcacacaatcgaaaattcaaccgcaaacgtatctctagcggccatagcgaatcaggctgtagtactcatgggattagataaaggctggcccatctcgaaaatggaccttggcgtaccgttattagctctaggatgttacagtcaagttaatcctctaactttaacagcagcagtactccttttaataacccattacgctataataggaccaggtctacaagcaaaagctacaagagaagctcaaaaacgaactgcagcaggcattatgaaaaatccaacagtggatggaataatgacaattgatttagatcccgtcatctacgattcaaaatttgaaaaacaattagggcaagttatgcttctggttctatgtgccgtgcaattactactgatgcgaacaagctgggctctctgtgaagcgctaacgcttgccacaggtccaataactacattgtgggaaggctctccaggaaaattttggaacacaacaatagcggtttcaatggctaacattttcagaggctcatatttagcaggcgctggtttggcatttagtatcatgaaaagcgtcggaactggtaaaaggggtaccggaagccaaggggaaacattaggagaaaaatggaaaaagaaactaaatcaactgtccagaaaagagttcgatttatataagaaatcgggtataacagaagtcgatcgaacagaagcgaaagaaggactcaaaaggggagaaataacccatcacgcagtaagtagaggatcggcgaagctgcagtggttcgttgaacgaaatatggtgatacccgaaggacgagtcatagacttaggatgcggtaggggtgggtggtcatactattgtgcgggactaaagaaagtgacagaggtaaggggatatacaaagggagggccaggacacgaggaacccgtaccgatgtctacttacggatggaatatagttaaacttatgagtggtaaagatgttttctatcttcctccagaaaagtgtgatacactgttatgtgatatcggcgaatcttcgccctccccaacagttgaagaatctaggacaattcgagtcctgaagatggtcgaaccatggttaaagaacaatcagttctgtatcaaagtcttgaatccgtacatgccaactgtgattgaacatttagagagattacaaaggaaacatgggggcatgttggtaagaaatccattatcacgtaattccacacatgaaatgtattggatcagtaatggtacgggaaacatagtggcatcagtaaacatggtctcaaggctcttattaaatagattcactatgacgcatcgccgtccgacgatagaaaaagacgtagatctcggagccggaacccgtcacgttaatgcagagcctgaaactcctaatatggacgtcataggagagagaattaaacgcataaaggaagaacacaattctacatggcactacgacgacgaaaacccttataagacgtgggcataccatggatcttatgaagttaaagctacaggatcggcctctagcatgataaatggtgtggtaaagttattaaccaaaccatgggacgtagttcccatggttacccaaatggcaatgaccgatacaactcccttcggccaacaacgcgtattcaaagagaaagtagatactagaacgccccgcagtatgcccggaacacgccgtgtaatgggcattaccgctgaatggctttggcggacactcggtagaaacaagaaacccaggctatgtacacgagaggagttcacgaaaaaggtaagaacaaatgctgccatgggtgcagtatttacagaagagaaccaatgggattctgcgaaggctgcggtagaggatgaagatttttggatacttgtggacagggaaagagaactccataaattaggaaaatgcggatcatgtgtctataacatgatgggtaaacgcgagaaaaagttgggtgagttcgggaaagctaaaggaagcagagccatatggtatatgtggttaggggcgagatatctggagttcgaagctcttggcttcctcaatgaagatcattggttttcacgagaaaacagctattccggagtggagggagagggactgcataaactcggatatatactaagagatatcagtaaaatacccggtggggccatgtacgcggatgatacagcaggttgggatactcgaatcacagaggatgatttgcataacgaagagaaaataacccaacaaatggatccagaacacagacaactagctaatgccatttttaaacttacatatcagaacaaagtagtaaaagtgcaacggccgacaccgacaggcacagtaatggacataataagcagaaaagatcaacgaggtagtgggcaagtgggcacatatggattaaatacctttacaaacatggaggctcaattaataagacaaatggaaggtgaaggagtgctctccaaagcagatctggagaaccctcatttacccgagaagaaaattacccaatggttggaaacaaaaggagtcgaaagattaaaaagaatggcgataagtggagatgactgtgtagtaaagcccattgatgatcgatttgcaaatgcattactcgcactaaacgatatgggaaaggtaagaaaagacattcctcaatggcaaccttctaaaggctggcatgactggcaacaggttcctttttgtagccatcacttccatgaattaattatgaaggacggccgcaaacttgtcgtaccctgccgacctcaagatgaattgattggacgagccaggatctcacaaggagccgggtggtcgttacgggaaactgcatgcctaggcaaagcctacgcacaaatgtggtctctaatgtattttcaccgtagggaccttcggttagcctcgaatgccatttgcagcgcagtgccagtccattgggtaccgacaagccgaacaacatggagtatacacgcacatcaccagtggatgacaacggaagacatgctaacggtatggaatagagtatggattgaagacaatccttggatggaagataagactcccgttactacgtgggaaaatgtaccctacttaggaaaacgagaagatcaatggtgtggtagtcttataggccttaccagtagagctacgtgggcacaaaacatccccactgcaatacagcaagtacgatcccttatcggaaatgaagagttcttggattatatgccaagtatgaaaagatttcgaaaagaggaagaatctgaaggagcaatatggtaa

SEQ ID NO: 23326 - RNA, 9873 nt, synthetic construct
  misc_feature 1..9873: note = derived and/or modified CDS sequence (opt6) from DENV-3__EU687197__SS-prME
  source 1..9873: mol_type = other RNA
acgagtctatgcctaatgatgatattaccagctgctctggcatttcaccttacatcgagagacggtgaacctcgaatgatagttggcaaaaacgagagaggaaaatctctactttttaaaacggcgtctggaataaatatgtgtacgctgatcgcaatggatttgggagaaatgtgtgacgacacagttacatacaaatgccctcacatcactgaagttgaaccggaagacatagactgctggtgtaacctaacttccacttgggtaacctacggtacttgcaatcaagcaggagaacacagacgtgataaacgaagcgtagctttagcaccacacgtagggatgggtttagacacaagaacacaaacttggatgtctgcagaaggtgcttggagacaagtagaaaaagtagaaacatgggccctacgtcacccgggatttacaatattagcgttattcctcgcgcactatataggaacgagtttaacacaaaaagtagttatttttatactacttatgttggttacgccttcaatgacaatgagatgcgtaggagtcggaaatcgagatttcgtagaaggtttgtctggtgcaacttgggtcgatgttgtgttagagcacgggggatgtgtaacaaccatggctaaaaataaacccaccttagacattgaactacagaaaacagaggcgacgcaactggcaactctaagaaaactgtgcatcgagggaaaaatcaccaacattaccacagattcaaggtgtccaacccaaggagaggctgtattacccgaagaacaggaccagaattacgtatgtaaacatacgtatgtagacagaggatggggaaatggttgcggacttttcggaaaaggtagtttagtaacatgtgccaaatttcaatgtttagaaccgatcgaaggtaaagtagttcaatacgagaatttaaaatataccgtaataattacagtgcacacgggtgatcaacaccaagttggtaatgaaacccaaggagtaaccgccgaaataactccacaagcgtcaacaacggaagccatattaccggaatatggaacattaggtctcgaatgcagtccgcggactggactcgacttcaatgagatgattctgttaactatgaaaaataaggcttggatggtacacagacaatggttctttgatcttccactaccctggacctctggtgctaccacagaaaccccaacatggaacagaaaagagttgttagttaccttcaaaaatgcacatgccaagaaacaagaagtcgtagtattaggaagtcaggaaggagcaatgcacactgcattaactggcgcaaccgaaatacaaaactcaggaggtacaagtatcttcgctggccacctaaaatgccgactgaaaatggacaaattagaattgaaaggcatgagctatgcaatgtgtacaaatacgttcgtcctcaagaaagaggtatcggagacgcagcatggcactatcttaatcaaagtggaatataaaggtgaagatgtaccgtgtaaaataccattctcgactgaagatggacagggaaaagcacataacggccgacttataactgcaaacccagtagtaacgaagaaagaagaaccagtcaacatagaggcagaaccacctttcggcgaaagcaatattgtaataggaattggagataacgcgcttaaaataaattggtataagaaaggcagtagtattggtaaaatgtttgaggcaactgcgagaggagctagaagaatggctatattaggagatacagcatgggattttggctctgttggtggagtgctaaattcattgggaaaaatggtgcatcagatatttggttcagcctatacggcattattttcaggggtttcgtgggtcatgaaaataggaataggagtcctgctaacatggattggattaaatagtaaaaatacctctatgagttttagttgtatagcaataggaataattacactatatttgggagcagttgtacaggcagatatgggctgtgtagtaaattggaaaggaaaagaattaaaatgtggatcaggaatatttgtgactaatgaagtgcatacatggacagaacaatacaaatttcaagcggatagtcctaaaagattagcgacggctatagccggtgcatgggaaaacggagtttgcggaatccgaagtaccacccgtatggaaaatttactatggaaacaaatagctaacgaactcaactatatactatgggagaacaatataaaactaactgtagtagttggagacattatcggagtgctcgaacagggaaaaagaacgctaactccccaaccaatggaactgaaatacagttggaaaacatggggaaaagctaaaatagttaccgcggaaacgcaaaattcatcattcatcatagacggtcctaacaccccagaatgccccaacgccagtagggcatggaatgtatgggaagtcgaggactatggatttggagtttttaccactaatatatggttaaaactacgggaggtatatactcaactgtgcgatcatcgtctaatgtccgcagccgtgaaagatgagagagccgtgcatgctgatatgggctattggatagaaagtcagaaaaacggctcttggaagctagaaaaagcgagtctaatagaagtcaaaacgtgcacgtggcctaagagtcatactctatggtccaacggagttctagagtcggatatgattataccaaagagtctagcaggacctatcagccagcataattatagaccgggatatcacacccaaaccgccgggccttggcatctgggtaaactagaactcgattttaattactgtgaaggaacgacagttgttatcacagaaaactgcggaacaagaggtccgtcattacgaactactacagtatctggcaaattgatacacgaatggtgttgcagatcgtgtaccctgcccccacttcgttacatgggtgaagacggctgctggtacggaatggaaataagaccaatttctgaaaaagaagagaatatggtgaaatctttggtatctgctgggtcgggcaaggtcgacaatttcacaatgggagttctatgccttgcaatcctattcgaggaagtcatgaggggcaaattcggcaagaaacatatgatcgcgggagtattctttacattcgttttactactgagtggtcaaataacatggcgtgatatggcccacacattaataatgataggatccaacgcgagtgatagaatgggtatgggagtaacatatctagcactgattgccacatttaaaatccagccttttcttgctcttggcttctttctgagaaaattaacatcacgtgaaaatctattattgggagtaggcttagcaatggcaacaaccctgcaattaccagaagacattgagcaaatggcaaatggcatagcgttaggcctaatggctctcaaactcattacccaatttgaaacgtatcaattatggactgctctaatttcgctgacctgtagcaacacaattttcacactcacagtagcctggagaactgccaccctaattctggcaggggtaagtctcctgcctgtatgtcaatcatcaagcatgagaaaaaccgattggttaccgatgacagtagcggcaatgggcgttccgcccctaccactgtttatttttagtctaaaagacactttaaaaagacgctcatggccccttaatgagggggttatggcagtggggctcgtaagcatattagcttcctctttacttcgcaatgatgttccaatggcaggacctctagtcgccggagggttgctcattgcatgttacgttatcactgggacatccgcagatttaaccgttgagaaagcggcagatgtgacttgggaagaagaggccgaacaaaccggagtgagtcacaatctaatgatcacggtagacgatgatggaacaatgcgtatcaaagacgatgaaactgaaaatattcttacagtcctcctcaaaacagcactcttaattgtatcaggcattttcccttatagtattccagcaacccttttggtatggcatacgtggcaaaaacaaactcaacgaagtggtgttctttgggatgtcccatctcctccagagactcaaaaagccgagctagaggaaggtgtatatagaataaaacaacaagggatttttggcaaaacacaagttggtgtgggggtccagaaagagggagtgtttcatactatgtggcacgtcactcgcggagctgtcttggcctacaatggtaaacgcctcgagcctaattgggcatctgtgaagaaagatttgataagctacgggggcggttggagactaagcgctcaatggcagaaaggtgaagaagttcaggtaatagctgtagaaccggggaaaaaccccaaaaacttccagacgatgcctggaacgttccaaactacaaccggggaaataggggctatagctctggattttaagccagggacgagcggctctcccattataaatagagaaggaaaggtagtcggattatacgggaacggagtagtaactaaaaacggaggatacgtaagtggaatagcgcagaccaatgccgagcccgatggtccaacccctgaactagaggaagagatgtttaagaaacgcaatttaacaataatggatttacacccaggaagcggcaaaactagaaaatacctacccgctatagtacgagaggctattaaaagaagactcagaaccttaatactcgcaccgactagggtggtagcagccgagatggaggaagcacttaaaggattaccaataagatatcaaacgacagctacaaaatcggaacacacaggtagggaaatcgtcgacctaatgtgccacgccaccttcacaatgagactattgtcacctgtccgagtaccaaattataatttaattattatggatgaagcacactttacggatccagcatcaatagctgccagaggctatatcagtacaagagtgggaatgggtgaggccgctgccatatttatgaccgctacaccacctgggactgcagacgcttttccacagtctaatgccccaattcaagatgaagaaagggacattccggagaggtcatggaatagcggcaatgaatggatcactgattttgcgggaagaactgtatggtttgttccttctataaaagcaggtaacgacatagctaattgcctcaggaagaatggaaagaaagtaatccaattaagccgaaaaacgttcgatacagagtaccagaaaactaaattaaatgactgggatttcgtagtgacgacagatatctccgagatgggagctaactttaaggctgatagagtaatagatcctcgtcgatgtttaaaaccggtgatattaactgacggaccggaaagggttatactagccgggcctatgcccgttacggccgcgtccgcagcacaacgacgtggacgggtcggtagaaacccccaaaaagagaatgatcaatatatattcaccggacagccactaaacaacgacgaagaccacgcacattggactgaagctaagatgcttctagataacattaatacgcctgagggaattatcccagcgctattcgaacccgaaagagaaaagtcagccgcgatcgacggcgagtataggcttaagggggaaagtagaaagacgtttgttgaactcatgagacgcggagatttacccgtgtggctggcacacaaggtagctagtgaaggtataaagtatacagatagaaagtggtgtttcgatggccaaagaaataaccagattcttgaggagaatatggacgttgaaatatggactaaagagggggaaaggaagaaattacgtccgagatggcttgatgctcgaacctactctgatccacttgctcttaaggaatttaaagattttgctgctggccgtaaatcgatagctcttgacctagttacagaaattggtagggtccctagtcatttagcacacagaacccggaatgctctggacaatctagtaatgctgcacaccagcgaacatggcggtaaagcatacaggcatgctgtagaagaactaccggaaacaatggaaacactattattactcggccttatgattttgctaacaggtggagcgatgttatttttaatttccggaaagggaataggaaaaacatctataggactaatatgcgtcattgcttcttcagggatgctttggatggcagaaataccgttacaatggatagcgagtgcaatagtactggaatttttcatgatggtactattaatccccgaaccagaaaaacaacgtacgccccaagataatcagctagcctacgttgttatagggatactaactttagcggccattattgccgcaaatgagatgggcttgttagaaactactaaaagggacttgggaatgagcaaagaaccgggtgttgtgagtcccacaagttacctcgatgtagatctacatccggcaagcgcgtggactctatatgccgtcgcaactactgttatcacgccaatgttacgacacacaatagaaaacagcaccgcgaacgtctctctagcggcaatagcaaaccaggcggttgtgctaatgggattagataaaggatggccgataagcaaaatggaccttggtgtgccactcctcgctcttggttgttattcacaagtaaatccactcacacttacagcggctgtgttactattaataactcattatgcaataataggtcctggactccaagcaaaagccaccagagaagctcagaaacgaacagcagcaggaataatgaaaaatccaactgtagacggtataatgacaattgatcttgatcctgtaatttacgactcaaagtttgaaaagcaactaggacaagttatgctcttagtactatgtgcggttcaattactgttaatgagaacctcttgggctctatgcgaagctctcacattagctacgggtcccattacaacgttatgggaaggaagtcctggcaaattttggaatacgaccatagcagtatccatggcgaatatatttcgaggatcatacctggcaggagctggtcttgcatttagtataatgaaatctgtaggaacaggaaaaaggggaactggttcccaaggtgaaacattgggtgaaaagtggaagaagaaattaaatcagttgtcacgaaaagagtttgacttatacaagaaaagcggaataacggaggttgacagaacagaagcgaaagagggcttaaaacggggagaaattacacaccacgctgtctctcgcgggagtgctaaattgcaatggtttgtcgaacggaacatggtaatacccgaaggcagagtaattgatctaggatgtggacgtggtgggtggagctactactgcgccggattaaagaaagttactgaagttcggggctatacaaaaggcggaccaggacacgaggaaccggttccaatgtctacgtacggttggaatatcgtaaaactgatgagcggcaaagatgtattttaccttccacctgagaaatgtgatacattactatgtgatatcggtgaaagctcaccatcaccgaccgtagaggaatcaagaacaattagggtccttaagatggtggaaccttggctgaagaataaccaattctgtataaaagtattaaatccctacatgcccaccgtcatagaacacctggaacgcctccaacgtaagcacggagggatgctagttcgcaatccattaagtcgaaattctacgcatgaaatgtattggatttcaaatggtacgggtaatatcgtagcgtcagtcaacatggtaagccgtctactcttaaacaggttcacgatgacacaccgtagaccaaccatagaaaaagatgtggacttaggcgcgggtactcgtcatgtcaatgctgagccagaaactccgaatatggatgtgattggagaaagaattaagagaatcaaagaagaacataacagtacttggcattatgatgatgaaaacccctataagacatgggcgtatcatggttcatacgaggtcaaagctaccggttcggcgagctcaatgattaatggcgtagtaaaacttctaactaagccttgggatgttgtaccaatggtaacgcaaatggcaatgacagacaccaccccttttgggcagcaacgagtgtttaaagagaaggtcgatacaagaacccctagaagcatgcctggaacaagaagggttatgggaataacagcggagtggttatggagaacgctaggacgcaataaaaagccccgactatgtactagagaagaatttaccaagaaagttagaacgaatgcagcgatgggcgccgtctttacggaagagaatcaatgggactccgcgaaagcagccgtagaagacgaagacttttggaaacttgtagatcgagagagagaactccacaaactaggtaaatgcggctcttgtgtgtacaatatgatgggaaaacgtgaaaagaaattaggagaatttggaaaagcaaagggttcacgggcaatttggtatatgtggctaggagctagatacctagaatttgaagcccttggtttcctcaatgaggaccattggttttcgcgcgaaaattcatacagcggagtagagggcgaaggtttgcataaattagggtatattttaagagatatatcaaaaataccgggcggtgcgatgtacgcagacgacacagccggatgggacacgagaataacggaagatgatttacataatgaagaaaagattacccaacaaatggatcccgaacatcgacaattagccaatgccatctttaaactaacatatcagaataaagtcgtaaaagtgcaaaggcctacacctactggtacagtcatggatataatatccagaaaggatcaaaggggcagtggacaagtagggacctatggtctaaatactttcacaaacatggaagtgcaattaattagacagatggaaggggaaggagttctttcgaaagctgatctggaaaaccctcacttacctgagaagaaaatcactcagtggttagaaacaaaaggcgtagaaagactaaaacgcatggccataagcggggacgactgcgtagtaaagccaatcgatgaccgttttgcaaacgcattattggcattaaatgacatgggtaaagtaagaaaagatattccacaatggcagccatctaagggctggcacgactggcaacaagtaccattctgttcacatcacttccatgagcttataatgaaagacggacgaaagctagtagtaccctgtaggccgcaggacgaattaatcggtcgagccagaatatctcaaggtgccggatggagtttaagggaaactgcatgcttaggaaaagcatatgcacaaatgtggagtcttatgtattttcataggagagatttaagactagcatctaatgccatttgttcagccgtaccagtacactgggtgccaaccagtagaaccacatggagtatccatgcacaccaccagtggatgacaacggaagatatgcttacagtatggaatagagtatggatcgaagataatccctggatggaagataaaacccctgtaacaacttgggaaaacgtaccttatctagggaaaagagaagatcagtggtgtgggtcacttataggacttacatctagagcgacttgggctcaaaacattcctaccgcaattcatcaagttagaagcctaataggtaatgaagaatttttggactatatgcctagcatgaaaaggttcagaaaagaggaagaactagagggggccatttggtaa

SEQ ID NO: 23327 - RNA, 9873 nt, synthetic construct
  misc_feature 1..9873: note = derived and/or modified CDS sequence (opt6) from DENV-3__EU687198__SS-prME
  source 1..9873: mol_type = other RNA
actagcttgtgcttaatgatgatattacctgcagctcttgctttccatctgacttcacgagacggggaaccccgtatgatagtagggaaaaatgaacgaggaaaatctttattattcaaaactgcatcaggaataaacatgtgtacgcttatcgctatggatcttggagaaatgtgtgatgacacagttacctataaatgtccgcatatcgcagaagttgaacctgaagatatagactgttggtgtaacttaacaagtacatgggttacatatggaacctgtaaccaagccggtgaacatcgtcgggacaaaagatcagtggcacttgcccctcacgtaggaatgggtttagatacccgaacgcaaacgtggatgagtgcagaaggagcatggcgacaagtagaaaaagtagaaacatgggcgttaagacacccaggtttcactatactagcattatttcttgcccattatattggtacttctttaactcaaaaagtagtaatcttcattctccttatgttagtaactccaagtatgaccatgcgctgcgttggtgtagggaacagagattttgtagaaggtctcagtggggctacatgggtagatgtggtgctagaacacggagggtgtgttacaacaatggccaaaaataaaccaacactagacatagagttacagaaaacggaagccacacaactagcaacattgagaaaattatgcatagagggtaaaataacgaatataactacagacagtcgttgtcctacgcaaggagaggcagtccttccagaagaacaagatcaaaactatgtttgtaaacatacttatgtcgacaggggatggggtaacggttgtggtctttttggaaaaggatcgttagtaacttgtgctaaattccaatgtctggagccgatagaaggtaaagtggtgcagtatgaaaacctgaaatatacagttattataacagtgcacacaggagatcaacaccaagtaggtaacgaaacacaaggagtcactgccgaaattactccacaagcctcaacaacggaggcaatcttgcccgaatatggaactcttgggttggaatgcagccctaggactggcctagattttaatgaaatgatattgttaacaatgaaaaacaaagcctggatggtgcacaggcaatggttcttcgatctgcctctgccctggacaagtggagctactactgagacacctacctggaatagaaaagagctattagtgacattcaaaaacgcgcatgccaagaaacaagaagtagtagtactgggaagccaagaaggtgctatgcacacggcactaactggtgccactgaaattcaaaacagcggtggaacaagtatatttgccggacacttaaaatgcagactcaaaatggataaacttgaacttaaaggaatgtcttatgcgatgtgtacaaatacattcgtactaaagaaagaagtgtcagagacacaacacggaacgattctcataaaagttgagtataaaggggaagacgtaccctgcaagataccattttcgacagaagatggtcaaggcaaagctcataatggaagattgataactgcaaaccctgtagtaactaagaaagaagaaccggtcaacatcgaggcggaacccccatttggagagagtaatatagttatcggcgttggtgacaatgctctcaagatcaactggtataagaaaggctcatctatcgggaagatgttcgaagctacagctagaggcgcgagaagaatggcaattctcggagataccgcttgggactttggtagcgtaggtggagtattaaattctctcggtaaaatggtccatcagattttcggaagcgcatacacagctttattttcaggtgtttcttgggttatgaaaataggaattggtgtacttctcacgtggattggcttgaatagtaaaaacactagcatgagcttcagctgcattgcaataggaataataactttatacctaggagcggtcgttcaagcagataccggttgtgttatcaattggaagggaaaggaactaaaatgcgggtccggaatctttgtaactaatgaagtccacacatggacagaacaatacaaatttcaagctgactctcctaaacgattagccactgcaatagctggtgcatgggagaacggagtatgtggtatacgctcgacaactagaatggaaaatctcctatggaagcaaatcgcgaatgaattaaactatatactttgggaaaataatatcaaacttactgtagtggtcggggacattataggagtcctagaacagggcaaaagaaccctaactccacaaccaatggagcttaaatattcctggaaaacctggggaaaagcgaaaattgtaacagcggagacacaaaactcaagttttattatagatggtccaaacacgcccgaatgtccctctgcatctcgagcttggaatgtgtgggaagtagaagactacggatttggagtttttaccacgaacatttggctcaagctcagagaagtgtatacgcaactctgcgaccacagattaatgtctgcagcagttaaagacgaaagagcagtacatgcagatatgggctattggatcgaaagccagaagaacggaagctggaaacttgaaaaagcgtctctaatagaggttaagacgtgtacctggccaaaatcgcacacattgtggtctaacggtgtccttgaatcagatatgatcatccctaaaagtctagctggcccaatctcacaacacaactatcgaccagggtatcatacacagaccgccggaccttggcacctaggtaaactcgaactagattttaattattgtgaggggacaacagtagtgataacagaaaattgcggcactcgaggaccgagtctaagaaccaccaccgtctcaggaaaattaattcacgaatggtgttgccgaagttgcacattaccacccttacgatacatgggggaagatgggtgctggtacgggatggaaatccgtccaatatcagaaaaagaagagaacatggttaaatccttggttagcgcggggtcgggaaaagtagacaactttacaatgggggtgctatgcttggcaatactcttcgaggaagtaatgagaggcaaatttggcaagaaacacatgattgcgggtgtattctttaccttcgttctactcttatcaggacaaatcacgtggcgtgacatggctcacacgcttattatgataggatccaacgcctcagatcgaatgggtatgggtgtcacttacttagcgctgattgcaacgttcaaaatccaaccgttcctagcactaggattctttctgagaaaattaacaagtagggaaaatttgttattaggagtagggttagcaatggcaaccactctacaactaccagaggatatagaacagatggccaacggcatagcacttggattaatggctttaaaactgataacacagtttgaaacataccaattatggacggcactaatatcgcttacatgcagtaatacaatctttaccctcacagtagcctggcgaacagccaccctaattcttgccggtgtcagtctcctcccagtatgtcagagctcaagtatgcgcaaatctgattggttgcccatgacggtcgcagcaatgggagtcccacccctacctttgtttatattttctttgaaagataccctaaagcgacgatcatggcctcttaatgagggtgtaatggcggttggacttgtgtctattctagcatcgagcttactgcgaaacgatgtccccatggccgggccattagtagcagggggattgctcatcgcctgttacgttataacaggcacatccgcggatttaacggtcgaaaaagctgctgatgttacttgggaagaagaggccgaacaaactggggttagtcataacttgatgataaccgtagatgatgatggcacaatgaggataaaagatgatgagactgagaatattttaactgttctgcttaaaactgcgctattgatagtaagcggaattttcccgtactcaatacctgccacactattggtgtggcatacatggcaaaaacagactcgtcgaagcggagtcctttgggatgttccatcgccgccagaaacgcaaaaagccgaactagaagagggtgtctatcgaatcaaacaacaaggtatttttggtaaaacacaagtaggtgttggtgtccaaaaagaaggagtatttcatacgatgtggcatgttaccagaggggccgtcctaacttacaatgggaagagacttgaacctaattgggcatcagtcaagaaagatcttatttcatatggcggaggatggagactgagtgcccaatggcaaaaaggagaagaggttcaagtgatagcagtagagccaggcaaaaaccctaagaactttcaaacaatgccagggacgtttcaaactacgactggagagattggggcgatagcattagactttaaaccaggaacttcgggcagccctataataaatagggaaggcaaagtagttgggttatacggaaacggcgtagtcactaaaaatggaggatacgtaagtggaatagcgcaaacaaatgctgaaccggacggaccaactcccgaattggaggaagagatgttcaagaaacgaaacttgactattatggatttacatcctggcagcggtaaaacacgaaaatacctgcccgcgatagttcgcgaagctattaagcgacgcctcagaacacttattttagcaccaacccgggtagtagcggcagagatggaagaagccctgaagggacttcctattagatatcaaacaacggcaactaaatctgaacacacaggtagagagatagttgatctaatgtgccatgctacctttacgatgagactattatcccctgtaagagttcctaattataatttaataataatggatgaagcccattttacagacccggccagtattgcagctcgtggttatattagtactcgagttggcatgggcgaggctgcagcaatcttcatgacagcaactcctcccggaacagcagatgcattcccacagtcaaacgcaccaatccaagatgaggagcgtgacatacctgaacgctcatggaactccgggaatgaatggataacagacttcgcgggaaagaccgtatggtttgtaccatcaataaaagctggaaatgacatagcaaactgtttaagaaagaacggcaagaaagtcatccagttgagtaggaaaactttcgatacagagtaccagaaaacccggttaaacgattgggactttgttgtaacaacagatatctcagaaatgggggctaattttaaagccgatagagtgatcgatccgagacgatgcctaaaacctgtaatactaacggacggaccagaaagagttatattagcgggtccgatgccagtcactgcggcatcggctgcacaaagaagaggaagagttggtaggaatccacagaaggagaacgaccaatatatcttcaccgggcaacctttgaataacgatgaagatcatgcacattggacagaagcaaaaatgttactcgacaatataaatacacctgaaggaatcatacccgcgttatttgaaccagaaagagagaaaagtgccgccattgatggtgaatacagacttaaaggggaaagccgaaagacatttgtagagcttatgcgcagaggagatttaccagtctggctggcacataaagtagcatctgagggaataaagtatactgatcgaaaatggtgctttgatggtcaacgcaataatcaaattcttgaggagaacatggacgttgaaatttggactaaggaaggagagaagaagaaactgcggccgagatggcttgatgctcgtacctactcagatccgcttgcattgaaagaatttaaagactttgcggctggaagaaagtcaatcgccctggatctcgtcaccgaaattggaagagtaccttcacatttagcacataggaccaggaatgcgctggacaaccttgtaatgttacacacgtccgaacacggaggcaaggcttataggcatgctgtcgaggaattaccagaaacaatggagactctactattattaggattgatgattttactaacaggaggggcaatgctgttcctgataagtggtaaaggaatcggaaaaacaagcattgggctaatttgcgttatagcgagtagcgggatgctatggatggccgagataccacttcaatggattgcgagtgcaatagtactagagttctttatgatggtgctactcattcctgaaccagagaagcaaaggacaccacaagacaatcaattagcgtatgtcgtaattggtattttaacactagcagcaatcatcgctgctaacgagatgggcttacttgaaaccactaaacgagatttaggtatgtcaaaagaaccaggcgtagtgtccccaacgagctacttagatgttgacctccatccagcatcagcctggactttgtatgcagtagcaactacagtaataacaccaatgttaaggcataccatagaaaattcaaccgctaatgtctctttagcggcaatagccaaccaagcagtagtactaatggggttggataaaggatggcccatctccaaaatggacttaggggtgccgctactcgcattaggatgttattcacaagtgaatcctttaactttgactgccgccgtgctattacttattactcattatgctataatcggccctggacttcaagctaaagccacccgagaagctcagaaaaggacggctgccgggattatgaaaaacccgacagttgatggtataatgacgatagatctcgatcccgtaatatatgattcaaaattcgaaaaacaactaggccaagtaatgctattagttttatgcgctgtacagctcctattaatgagaacaagctgggcactatgtgaagcacttacattagcaacggggcctataacaacattatgggagggttctccaggaaaattctggaatacgacaattgctgtttcaatggctaatatttttcgtggctcatatcttgcaggagcaggactagccttctcaataatgaaaagtgttggaacgggaaaaagagggaccgggtcacaaggcgaaactttaggagaaaaatggaagaagaaactcaatcaattgtcacgaaaagaatttgatctctacaaaaagtccgggattactgaagtagacagaactgaagcaaaagaggggttgaaaagaggagaaatcacccaccacgccgtaagccggggtagcgcgaagctacaatggtttgttgaaagaaatatggtaatcccggagggaagagtaatagatctgggatgcggtagaggaggttggtcttactactgcgccggtctaaagaaagtcacggaagtcagaggttatacaaaaggagggccgggtcatgaagaaccagtaccgatgagtacttatggttggaacatagttaaacttatgagcgggaaagatgttttctacctgccgcccgaaaagtgtgatactttattatgcgatatcggtgagtcatcaccctcacctacagtcgaggaaagcagaacaatccgtgtactaaagatggtagaaccctggcttaaaaataatcaattttgtataaaagtattaaatccgtatatgcctacagtcattgaacatttagaaagactacagagaaaacatggcggcatgcttgttagaaaccctctctcaaggaactccacgcatgaaatgtattggatctctaacggaaccggtaatatcgtcgcatcagtaaacatggtgagccgccttttgcttaatagatttacaatgacacatagaagaccaactatagaaaaagatgttgacctaggggcaggtacgaggcatgtaaatgcggaacccgaaactccaaacatggatgttattggggagaggatcaaaaggataaaagaagaacataacagtacttggcactatgatgatgaaaatccatataaaacatgggcatatcacggatcatacgaagtaaaagcgaccggtagtgcttcatcaatgataaatggtgtagtaaaacttttaacaaaaccttgggacgttgtaccaatggtgactcaaatggcaatgacagatacgacccctttcggacaacaacgggtattcaaagaaaaggtagatactagaacccctcgttcaatgccaggaacaaggcgcgtaatgggaataactgcagaatggttatggcggacgctcggacggaataagaaacctagactatgtacgcgagaagaatttacgaagaaagtacgtactaacgcagcgatgggagctgtgtttaccgaagaaaatcaatgggattcggcaaaagcagctgtagaagatgaggatttttggaaacttgttgacagagaacgtgagttacataagttaggaaaatgtgggtcatgtgtctataatatgatgggaaagcgagagaagaaactcggagaatttggcaaggcaaagggtagcagggcaatttggtacatgtggctaggtgcaagatatctagaatttgaagctctgggattcttgaatgaggatcactggttttcgcgagaaaattcatactcaggagtagaaggagaaggattacacaaattaggctacatactaagggacatatctaaaataccagggggtgcaatgtacgcagatgatactgctggctgggacaccagaattacagaagatgatttacataacgaagaaaagataacacaacaaatggaccccgaacataggcaattggcaaatgcaatatttaaattaacgtatcaaaataaggtagttaaggtacaacggccgacccctactggtacagtaatggacataatttcgagaaaagaccaaagggggagcggtcaagttggaacatatggactaaacactttcacaaacatggaagcccaactaatccgtcagatggagggggaaggagtattaagtaaagcagatttagaaaacccccacttgtcagaaaagaaaataacccaatggttagaaacgaaaggggtagagagactaaaaaggatggcaatatcgggtgacgattgcgtggtaaagccaattgatgatcgttttgctaatgcgttgctagccctcaatgacatgggaaaagtacggaaggatataccgcaatggcaaccatctaagggttggcacgactggcagcaagttcctttttgctcccaccattttcatgaactgataatgaaagatggtaggaagctagtcgtaccttgcagacctcaagatgaattaattggtagggcacggatctcccagggagccggatggtctcttcgagaaactgcatgtctgggcaaggcctatgcccaaatgtggagtctgatgtactttcatagacgcgaccttaggttagcatctaatgctatatgttctgctgtacctgtccattgggtacctacaagtcgtacaacgtggagtatccacgcgcatcatcagtggatgactactgaggacatgctgacagtctggaatagagtatggatcgaggacaatccgtggatggaagataagacgccggtaacaacgtgggagaatgttccttacctaggaaagagagaagatcagtggtgcggatcgctaattggactaacatcgcgcgctacctgggcacaaaacatcccaactgcgattcaacaggttcggagtttaattgggaacgaggaatttttagattacatgccatcgatgaaaagattccgcaaagaagaagagtcagaaggagcaatctggtag

SEQ ID NO: 23328 - RNA, 9873 nt, synthetic construct
  misc_feature 1..9873: note = derived and/or modified CDS sequence (opt6) from DENV-3__EU726769__SS-prME
  source 1..9873: mol_type = other RNA
acaagcctatgcctaatgatgattctaccagcagctctagccttccatttaacctcacgggacggagaaccacggatgattgttggcaaaaacgagcggggtaaatctcttctgttcaaaacagcaagcggcatcaatatgtgtactctaatagctatggacttaggagaaatgtgcgatgacactgtaacatataaatgccctcatattaccgaagtagagcctgaagacattgactgctggtgtaatctcacatcaacatgggttacatacggaacatgtaaccaagcgggcgaacacagacgagataaacgaagcgtcgcactagcaccccacgttggtatgggtctagacacacgtacacaaacgtggatgtctgctgaaggtgcctggcgacaagtagaaaaagttgaaacatgggctttaagacacccggggttcactatattagctttgtttttagcacattatataggaacttcattgacacaaaaagtagtgatcttcatactgctaatgcttgtaacccctagtatgacgatgcgttgtgtaggagtgggaaacagagattttgtagaggggttatcaggcgctacatgggtagatgttgtacttgagcatggcggctgtgttacaactatggccaaaaataaaccaacgttagatatagaactgcagaaaactgaagcaacacaattagcaacattaaggaaactatgtatagaaggtaaaataacaaacataactacagattcccgttgtccgacacagggagaagcagtactaccagaagaacaagaccaaaattacgtttgtaaacacacctacgtggatagaggatggggcaatggatgcggcctctttggtaaaggcagtctggttacttgcgctaaatttcagtgcttagaaccaattgagggtaaagtagtacaatacgaaaacttaaaatacactgtaatcataacagtacatactggagatcagcaccaagtaggtaatgaaacacaaggagtcactgctgaaattacaccacaggcatctacaacagaagcgatattgcccgagtacggtacattgggtctcgaatgtagccctcgaactggcctagatttcaatgaaatgattctattgacaatgaaaaacaaagcatggatggtgcaccgacaatggttctttgacctaccattgccgtggacctcaggggctacgacagaaacaccaacatggaatcgcaaagagcttcttgtaaccttcaaaaacgcacatgcaaagaaacaggaggttgtagttttagggagtcaggaaggggccatgcacacagcattaacaggcgcaaccgagatccaaaattctggagggacgagcatatttgcgggccacctcaaatgtagactaaaaatggataaattagaattaaaaggcatgtcgtacgccatgtgtacaaacactttcgtattaaagaaagaagtttccgaaacacagcatggaactatattgattaaggttgaatataaaggagaagacgttccttgcaaaattccattttctacagaggacgggcaaggaaaagctcataatggccgattaataacagctaatccagtcgtcacgaaaaaggaggaacctgtaaacatagaagcggaaccaccatttggagagtccaatattgtcattggaataggcgataacgcacttaaaattaactggtataaaaaggggtccagcattggaaagatgtttgaggcgacagcacgaggagctcgcagaatggcaattttaggagacacagcgtgggattttgggagcgtcggaggagttttaaactccttaggtaagatggtacatcagatatttggatcagcctatactgctcttttcagtggagtatcatgggtgatgaaaatcggcatcggagtcttgttaacgtggataggtctcaattctaaaaacactagcatgtcattttcttgtatagtaataggaataataacgctatacctaggcgccgttgtacaagccgatatgggatgtgtaataaactggaagggaaaagaattaaagtgcgggtcaggaatattcgtaactaacgaggttcacacttggacggaacaatacaaatttcaagctgattcgccaaaaagattggcaacagcgatagcaggcgcatgggaaaacggtgtgtgtgggatacgttccacgactcgaatggaaaatctcctctggaaacagatagcaaacgagttaaattacatactatgggaaaataacataaaattaacagtggtagtaggggacataattggagtgttggaacaagggaaaaggacactgacgccccaacctatggaattgaagtatagttggaaaacttggggcaaagctaaaatagtgactgctgagacgcaaaacagctcttttattatcgatggtccaaatactccagaatgcccgtctgcgagcagagcctggaacgtatgggaagttgaggattatggttttggcgtattcactactaatatatggttaaaactcagagaagtgtacacacaattatgtgaccacagattaatgagtgcagcagtgaaagatgaacgggctgttcacgccgacatgggatactggatagaatctcagaaaaatggtagttggaaattagaaaaggcttcacttattgaagttaaaacctgtacgtggcccaaatcccatacactatggagtaacggtgttttagaaagtgatatgataattcctaaatcgttagcagggccaatatcacaacataattatcgtccaggatatcatacccaaaccgcaggtccctggcacctagggaaattggaattagactttaactactgcgaaggcaccacagtcgtaatcacagaaaactgcgggacaagaggtccttcacttcgaacaaccacagtctctggaaaactcatacatgagtggtgctgtcgctcttgcacgctacctccattaagatacatgggggaagatggatgctggtacggtatggagatacgacccatttcagaaaaagaagaaaatatggtaaaaagcctagtaagcgcaggaagcggaaaagtagacaatttcacaatgggagttctgtgcctagctattttgttcgaagaagtcatgagagggaaattcgggaagaaacatatggttgcaggagtattctttacctttgtactattacttagcggtcaaataacgtggagggatatggcgcatacattaattatggtcggatcaaatgcttccgatagaatgggaatgggggtcacgtacttagcgctaattgcgacttttaaaatacaaccattccttgcactcgggttctttttgcgcaaattaacctcgagagaaaatctacttttaggtgtgggattagctatggcaaccactctccaactacctgaagacattgaacaaatggctaacggaatagcacttggactaatggccctaaagttaataacacagttcgaaacatatcagctttggactgcacttatcagtctaacgtgttctaacacaattttcacattgacagttgcgtggcgtaccgcaacattaatactggcaggagtgagcttactaccagtctgtcaatcatcgagtatgcgaaaaacagactggctgccaatgaccgttgccgcaatgggtgtacctccactacctctattcatattttcattgaaagacactctcaaaaggagatcgtggccattaaacgaaggagtaatggcagtagggctggtctctatacttgcatcctcgcttttacgcaatgacgtacctatggccgggcccctagttgcaggcggattacttatagcatgttatgtaataacaggaacgtctgctgacttaaccgtagaaaaggcagctgatgtaacctgggaggaggaagcggaacaaactggggtttcccacaacttgatgattacggtcgatgacgatggaacgatgcgtataaaagacgatgaaacagaaaacattttaactgtattattgaaaactgctctcttaattgtgtctggtatctttccttacagtattccagcgactttattggtatggcacacgtggcaaaagcaaacgcaacgttcaggagttctttgggatgtaccatccccacctgagactcagaaagcggaattggaagagggggtatatagaattaaacagcaaggaatattcggaaaaacccaagtcggtgtaggagttcagaaggaaggagttttccacaccatgtggcacgttactcgaggcgcggtattaacatataatggtaaacggttggaacccaactgggctagtgtcaagaaagatctgatatcatatggagggggatggagactatcagctcaatggcagaaaggagaagaagtccaagtcattgccgtggaaccgggtaagaatcctaaaaactttcagacaatgccaggaacattccaaacgacgactggagaaataggtgcgatcgcactggatttcaaaccaggaacgtcaggtagtcccatcataaatcgagaaggtaaggtcgttggactttatggtaatggcgtggtaactaaaaatggcggctatgtatctggcattgcacaaaccaatgctgaacctgatggcccaaccccggagcttgaggaagagatgtttaaaaagagaaacttaactatcatggacctacacccgggctccggtaaaacccgcaaatatttacctgctattgtcagagaagcaataaagagaagattgagaacgctaatattagctccgacgagggttgttgccgcagagatggaagaagcattaaagggattacctatacgctatcaaacaacagcaacaaaatcagaacatacaggacgtgaaatagtcgatctgatgtgccatgcaaccttcacaatgagactgttaagccctgttagagtgcctaattataatcttatcataatggatgaggctcatttcaccgaccctgcttctatagcggcaagaggatatatatcaacgcgagtaggtatgggagaggcagcagcaatatttatgactgctacaccgccaggtactgctgacgcatttcctcaatcgaacgcgcccatacaagatgaagaaagagacataccagagcggtcctggaactcaggcaacgaatggataacagatttcgccggaaaaactgtatggtttgttcccagtataaaagccggaaacgatattgctaactgtttaaggaaaaacggaaagaaagtcattcaactatcgagaaagacttttgatacggaatatcagaaaaccaagctaaatgattgggattttgttgttacaaccgacatctcggaaatgggagcgaacttcaaggccgacagggtcatcgatccacgtagatgtttgaaacctgtaatattaacagatggcccagaaagagtaatattagcaggtccaatgccagttactgccgcatcggcagctcaaagacgtggtagagtcggtcgaaatcctcaaaaggagaatgatcaatatatattcacaggtcaacctcttaacaatgatgaagatcacgcgcactggacagaggcaaaaatgctattagacaacataaatactccagagggaataattcccgcgctatttgaaccagaaagagagaaaagtgcagcaatagatggtgaatatagactaaagggcgaatcacgaaagacatttgtagagctgatgagacgaggcgatttaccggtttggctagctcataaagttgcaagtgaagggattaaatacaccgacaggaagtggtgttttgatggccaacgaaataaccaaattttagaagaaaacatggatgtagagatttggacaaaggaaggggagaagaagaaactccgacctagatggctagacgctagaacatatagtgatcccctagcgttgaaagagtttaaagactttgccgcagggcggaaatcaatcgctctagatcttgtgaccgagatcggaagagtcccaagtcacttagcccatcggacacgcaatgcgttagacaatctcgtaatgctccatacgagcgaacacggtggtaaagcgtacagacatgcagttgaggaattaccagagacaatggagacattacttctactaggattaatgatcctacttactggaggtgctatgctttttctaataagtggaaagggtatcggcaagacatcaatcggacttatttgtgtcattgctagttccggcatgctatggatagcagagatcccgttgcaatggattgcctctgctattgtactcgaatttttcatgatggttttattaataccagaacctgagaagcaaagaacaccccaggataatcaactagcctacgttgtcataggaattttaactctagcggctataatagcagccaacgagatgggcttactggagacaacaaaacgcgatctgggcatgagtaaagaaccaggggtagtatctccaacaagttacttagatgtggacttacatccagcctccgcatggacactttatgctgttgctacaacagtcattaccccaatgttacgtcataccatagaaaatagcaccgcaaatgtatcgctggcagcgatcgcaaatcaagcagtagttttaatgggactagacaaaggatggcctatatcaaaaatggatctcggtgttcctttacttgctttgggctgctatagccaagtaaatccactaacactgacagcggcagtcttactattaataactcactacgctattataggcccaggacttcaggcaaaagcgacaagagaagcgcagaaaagaacggccgcgggtataatgaaaaatccaacggtcgatggcatcatgacaatagacctcgaccctgtcatatatgacagtaaattcgaaaaacaactaggacaagtaatgctattagtcctatgcgcagttcaattactcctaatgagaacaagctgggcactatgtgaagccctcaccttggccacaggtccaattacaacattatgggagggaagtccgggaaagttttggaataccactatagccgttagcatggcaaacatatttcgcggtagttatctagcaggggcgggtctagctttttcgatcatgaaaagcgtaggaactggtaaacgaggtacaggttcgcaaggcgaaacactaggtgagaaatggaagaagaaactaaatcagctctcaagaaaagaatttgacttatataaaaagtcggggattacggaagtagaccgtacggaagccaaagaagggttgaaaagaggagaaattacacatcatgcagtcagtcgagggtcagcaaaactacaatggtttgtcgagagaaacatggtcatcccggaaggaagagtaatcgatttgggctgtggaagaggaggttggtcatattactgtgctggcttgaagaaagtgaccgaagtcaggggctataccaaaggaggaccaggacacgaagaacctgtaccgatgtctacatatggctggaatatcgtaaagctcatgtctggcaaggatgtattttacttgccacccgagaaatgcgacacgttactatgcgacattggtgagagttctccgtcaccaacagtagaagaatcaagaaccataagagttctaaaaatggtagagccatggttaaagaataatcagttctgtataaaagtccttaatccatatatgcctactgtaatcgaacatctagaacgactacaaagaaaacatggaggaatgctagtacgtaaccctctaagtcgtaacagtacccatgaaatgtattggatatcgaacggcaccgggaatatcgtagcatccgtgaatatggtaagtcgtcttctattaaaccgatttactatgacttacagacgtcccacaatagaaaaagacgtagacctgggggcaggcacccgccatgtgaacgcggaacccgaaacgccaaacatggacgtaataggcgaaagaataaaacgtataaaggaagaacacaatagtacttggcattacgacgatgagaatccgtataagacatgggcttatcatggaagttatgaggtaaaggccacaggtagcgccagctctatgataaatggagtagttaaactactgacgaaaccttgggacgttgtacccatggtaacgcaaatggcaatgacagatacaaccccatttgggcagcaacgtgtatttaaagaaaaggttgacacaaggacacccagaagcatgcctggaacccgaagggtaatgggtataacagctgaatggctatggcgtaccctaggtcgcaataagaaaccaagattatgtacgagagaagaatttaccaagaaagtgagaacaaacgcagcaatgggagctgtgtttacggaagaaaaccaatgggattcagccaaagcggcagtagaagacgaagacttttggattttagtagacagagaacgagagcttcataaagtagggaaatgcggaagttgcgtgtacaacatgatgggtaaacgagagaaaaagttaggcgaatttggaaaagctaaggggtcaagggctatctggtatatgtggttgggtgcacgctatctcgaatttgaggcactcggttttctaaacgaagatcattggtttagtagagaaaactcctattcaggggtggaaggtgaaggtctccacaaactagggtatatattacgagacatcagtaaaatacctgggggcgctatgtatgctgacgatacagccggatgggacaccagaatcacagaagacgacttacataacgaagagaaaattacgcaacaaatggatcccgaacatcgacaactcgcaaatgcaatatttaagctgacttaccaaaataaggtagttaaggtgcagcgtcctaccccaacgggaacagtgatggatataataagtcgaaaggaccagagggggtctggacaggtgggaacgtatggacttaatacatttactaatatggaagcgcaactgatcaggcaaatggagggcgaaggagtgcttagcaaagcagatttagaaaacccgcacctcccagagaagaaaatcacccagtggttagaaacaaaaggggtcgaacgactgaaaaggatggcaatttcaggggatgattgcgtagtcaagccaattgatgatagatttgctaatgccttattggcccttaatgatatgggtaaggtaagaaaggacataccacagtggcaaccttcaaaaggctggcacgattggcagcaagtccctttttgctcgcatcatttccacgagcttattatgaaagacggacgtaaattagtggtaccttgtagacctcaagatgagttaataggacgagcaaggatatcccaaggagctggatggtcattacgggaaacagcttgcttggggaaagcgtatgcccaaatgtggagtctcatgtattttcatcgaagagacttgcgattggcttccaatgccatatgctctgccgtccctgtacactgggtaccgaccagtagaactacttggtctattcatgcacaccatcaatggatgacaacagaagatatgcttaccgtttggaatagagtgtggattgaagacaacccatggatggaagacaaaacgccggtgacaacctgggaaaatgtaccgtatttaggcaaacgtgaagatcaatggtgtgggtctttgattggcctaacttcaagagcaacgtgggcgcaaaacattcccacagctatccaacaagtcagaagtctaataggaaatgaagaatttttggattacatgccaagtatgaaacgtttccgaaaagaagaggaatcagaaggtgcaatttggtaa

SEQ ID NO: 23329 - RNA, 9873 nt, synthetic construct
  misc_feature 1..9873: note = derived and/or modified CDS sequence (opt6) from DENV-3__EU687239__SS-prME
  source 1..9873: mol_type = other RNA
acttccctctgtttaatgatgatattgccagccgcattagcttttcacctaacgagtcgcgatggtgagccgcgaatgatagttggcaaaaacgaaagagggaaatctttgctttttaaaaccgccagtggaatcaacatgtgtaccttaatagcaatggatcttggtgaaatgtgcgacgacactgtgacatataaatgtccacatatcgcagaggtcgaaccagaggacattgattgttggtgtaatctaacatcgacgtgggtgacatacggaacgtgtaaccaagctggagaacatcgaagagataaaagatctgttgcactagcaccacatgttggtatgggactagatactagaactcaaacttggatgagtgcagaaggagcgtggagacaagttgaaaaagtcgagacatgggctctaagacatccaggatttacaatcttagccctatttttagcacactacataggtacttcactaacacaaaaagtagtaattttcatacttctaatgcttgtgactccttctatgactatgcgatgcgtaggtgtcggtaacagagacttcgtagaaggactctccggagctacgtgggtagatgtagtgttagaacacggcggatgcgtcactacgatggccaaaaacaaaccaaccctagatatcgaattacagaaaacggaggcaacacaattagcaacattgcggaaactgtgcattgaagggaaaataactaatataactacggatagtagatgtccaacccaaggagaagcagtccttccagaagaacaagatcaaaactatgtctgtaaacatacatatgtagatcgtggatggggtaatggttgtgggctttttggaaaaggttcccttgtaacatgtgcaaaatttcaatgcctagaaccaatcgagggcaaagttgttcagtatgaaaatcttaaatacactgtaataattacagtacatactggtgaccaacaccaagttggaaacgaaactcagggtgtaactgctgaaataacacctcaagcctcaactacggaggccatacttccagaatatggaacactaggtctcgaatgcagcccgagaactggcctagattttaatgaaatgatactccttacaatgaaaaacaaagcctggatggttcatcgccagtggttctttgatttacccctaccatggacatctggtgcaacaacggagactccgacttggaatagaaaagaactattagtaacttttaaaaatgctcatgccaagaaacaagaggtagttgtattgggaagtcaagaaggagcgatgcatacagctcttacgggcgctacagaaatacaaaattcaggaggaaccagtatattcgcaggtcacttgaaatgtagattgaaaatggacaaacttgaactgaaaggtatgtcttatgctatgtgcactaacacattcgtactaaagaaagaagtttcggaaacacaacacggaacgatactcattaaagttgaatacaagggggaagatgttccatgcaaaataccattctcaaccgaggatggccaaggcaaggcacataacggacgactaatcactgcaaatcccgtagtgacaaagaaagaggaacctgtcaatattgaagctgaaccaccgttcggcgaaagtaatattgtcatcggagtaggagataatgctttaaaaataaactggtacaagaaaggtagttcaataggcaagatgttcgaagctacagctaggggagcaaggagaatggcaatattgggagacactgcctgggactttggttctgtaggaggtgtccttaactcactaggaaaaatggtacaccagatctttggttcagcctacactgcacttttctcgggagtatcttgggtcatgaaaattgggataggagttctgcttacgtggataggcttgaatagtaaaaacacaagtatgagcttcagctgtattgcaatagggatcataactctgtacctaggggctgtagtccaggctgacacggggtgcgtaataaattggaaaggaaaggaacttaaatgtgggtcaggaatatttgtaactaacgaagtacatacatggactgagcaatacaaattccaagcagattcacctaagcgcttagctacagcaatagcaggggcctgggaaaatggggtttgtggtataaggtctacgacaagaatggaaaacctattgtggaaacagattgcaaatgaactcaattatatactttgggaaaataacatcaaattaacagtagttgtgggagatataattggagtattagaacaaggaaaaagaacactaacgccgcaacccatggaattaaaatattcatggaaaacgtgggggaaagcaaaaatagtaactgcggaaacgcaaaattcatcctttataattgacggtcctaacactcctgaatgcccttcagccagtagagcatggaatgtttgggaagtcgaagattacggattcggggtatttacgactaatatatggttaaagttacgcgaagtatacacccaactttgtgatcaccgtttgatgtcagcagcagttaaagacgaaagagcagtacatgcggatatgggatactggatagaaagtcaaaagaatggctcttggaaactagaaaaagcatctttaatagaagttaaaacatgcacatggccaaaaagccatacgttgtggtcgaacggtgtgcttgagtctgatatgataatacctaaatctcttgccgggccaataagtcaacacaattatagacccggataccacacacaaacagcaggaccgtggcatctaggcaaactcgaattagactttaattattgtgaaggaaccaccgttgttattacagaaaattgtggaacacgggggccctccttgagaacaacgacagtatcaggaaaactaatacatgaatggtgctgccgttcttgcacgctgccgccgctacggtacatgggggaagacgggtgctggtatggaatggaaatccgcccaatatctgaaaaagaggaaaatatggtaaaatcattagtttcagcaggatccggtaaagtcgacaactttacaatgggtgtgttgtgtctcgcgatattattcgaggaagtcatgagggggaaatttggcaagaaacatatgatcgctggtgtcttctttacattcgttctacttctaagcggacagataacttggagagatatggcccatacactgattatgataggttcaaatgcaagtgatagaatgggaatgggagtgacctacttagcattgatcgcaactttcaaaatacagccgtttcttgcattagggttctttctcaggaagttaacgtctcgagaaaacttattattaggtgttggtttagctatggcaaccactcttcaactccccgaagatatcgaacaaatggctaatggtatcgcactcggacttatggctctgaaattaataacgcagtttgaaacctatcaactttggacagcattaatctccctcacgtgcagcaacactatctttacgttgactgtagcttggagaactgctaccttgatattggccggtgtatcgttgcttcctgtttgtcagtcgagctccatgagaaaaagtgactggcttcccatgaccgtagcggcaatgggcgttccgcctttgcccttgtttatcttctcactgaaagacacattaaaaagacgttcatggccgctaaatgagggggtaatggcagtaggcctagtaagtattttggcatcgtccctacttaggaatgacgtaccaatggctggaccgttagttgctggtggattattgatagcttgttatgtaataaccggtacaagcgcagatttaaccgtggaaaaagccgctgatgtaacatgggaggaagaagctgagcaaaccggggtcagtcacaacttaatgattacagtcgatgatgatggaaccatgaggatcaaagatgacgaaactgaaaacatattgacagttttactaaaaacagctttacttatcgtatctggaatttttccatacagcattccagctaccctacttgtatggcatacgtggcaaaagcagacgcgtagaagcggcgtgctgtgggatgtaccatctccacctgagacgcaaaaagcagaactagaagagggagtgtatagaataaagcaacaaggcatttttggaaaaacacaagtcggtgtgggagttcagaaagaaggcgtctttcacacaatgtggcatgtaactagaggtgcagtgttaacgtataacggaaaacgactagaacctaactgggcatccgttaagaaagatcttatatcatatggtggcggatggcggctgagtgcccaatggcaaaaaggtgaagaggtccaagtaattgctgtggagccaggtaaaaaccctaaaaacttccagacaatgccagggacattccagacaaccacgggagaaatcggggccgtagcactagattttaaacctggcacgagcggcagtccaataattaaccgtgaaggaaaggttgtagggttgtatggcaatggtgtagttactaaaaatggaggatacgtatcaggaatagcacaaacaaatgcggagccggatggacctacaccagagctagaggaagaaatgtttaagaaaagaaacctaacaattatggacttacatccagggtctggaaagacgagaaagtatctcccagccatagtccgagaagccataaaaagacgacttcggacattaatactggctcctactcgtgtagtggccgctgaaatggaggaagcgctaaaaggcctacctataaggtatcaaaccaccgcaactaaaagtgaacatacaggacgggaaatagtcgacttgatgtgtcatgccacattcacaatgaggttattaagccctgtacgagtacctaactataatctcataattatggacgaagcacattttacggatccagcatctatagcggcgcgtggctacatatccactcgtgtgggcatgggcgaagctgcagcaatatttatgacggcaactccccctggtacagcagatgcctttccccagagcaatgcaccaatacaggatgaagaaagggatatccctgaacgtagttggaactctggtaatgaatggattactgattttgccgggaagacggtctggttcgtcccttcgataaaagctggaaatgacatcgcgaattgcttaaggaaaaacggcaaaaaggttatacaattgtccagaaaaacgttcgatacagaataccaaaagacgaaactaaacgactgggactttgttgttacaacggacatcagtgagatgggcgcaaactttaaggctgatagagtaatcgatccacgccgctgcctaaagcctgttatacttaccgacggtccagaaagggtaatattagccggaccaatgcctgtcactgccgcttctgcagcgcaaagacgtggacgagtcggacgcaatcctcaaaaagagaacgatcaatacatatttactgggcaacctctgaacaacgacgaggatcacgcacattggacagaagcaaaaatgcttcttgacaatattaatacccctgaagggataattccagccttatttgagcctgaaagggagaaaagcgcagcgatcgatggagagtatcgattgaaaggcgaatcgagaaaaacctttgtagaattaatgagacgtggggatttaccagtatggcttgctcacaaagtagcttcggagggtataaaatacacagaccgaaagtggtgttttgatggacaaaggaacaaccagatattagaggagaacatggatgtagagatctggacaaaagaaggagagaagaagaaactacgtccacggtggttagatgcaagaacttactcagacccacttgccctcaaagagtttaaagactttgcagcaggaagaaaatcaatagcactcgacctagtcactgagattggaagagtaccttctcacctcgcacatcgtactagaaatgccctcgataatctagttatgctacacacgtccgagcatggagggaaagcctatcgtcacgccgtggaagaactccctgaaaccatggaaacactactattgttaggcctaatgatcctcctaacaggtggagccatgctctttttaatctcggggaaaggtattggaaaaacaagtattggtctaatctgcgtgatcgcaagttctgggatgttgtggatggcagagatccctctacagtggatagcgagtgctatagtattggaatttttcatgatggtacttctaatcccagagccagaaaaacaacgtaccccacaggataatcaactcgcttatgtggtgattggaatattaaccctggccgcaataatagcagcaaacgaaatgggactcctagaaacaactaaacgcgatctcggaatgtcgaaagagccgggcgtagtttctccaacgagttatttggacgtagacctccatccagcttccgcctggacactttacgctgtagctactacagttattacaccaatgttacgccatactatcgaaaattcaacggcaaatgtaagtctagcagctattgctaatcaagcagtcgttctgatgggattggataaaggatggcctatctccaaaatggatctaggagtcccactactagctctaggttgctatagtcaagtaaatcctttaacattaacggcagccgttttattattaataacacattacgcaataattggccccggacttcaagctaaagctacccgagaggcacagaaaagaaccgcagcaggtattatgaaaaatccaacagtggatggcataatgactattgacttagatccagtcatatatgactcaaaatttgaaaaacaacttggacaagtaatgctgctagtactttgcgcggttcaacttttattaatgcgaacaagttgggctttgtgtgaggcattgacactggctactggaccaataacaacactatgggaaggtagtccgggtaaattttggaatactacaattgccgtgagtatggcaaatatattcagaggcagttacctcgcaggcgcagggctcgcttttagtatcatgaagagtgtcggaactggaaaaaggggaacaggctcgcaaggtgaaacattgggggaaaaatggaagaagaaactaaatcaattgtccagaaaagagtttgacctttacaagaaaagcggaataactgaagtagatcgcacggaggcaaaagaagggttaaaaagaggtgaaattacccaccatgcagtttcaagaggatctgcaaaactacaatggtttgtagaacggaacatggtaataccggaaggaagagtaatagatctaggatgcggtagaggcggctggagttattactgcgcaggcctgaagaaagttactgaggtaagaggatacacaaaaggaggaccgggacacgaagaaccagtaccaatgtctacttatggatggaacatagttaaactaatgtccggcaaagacgtattttatctacctccagagaaatgcgatactttattgtgcgacataggtgaaagttctcccagtcctacagttgaagaatcacgaacaatccgcgtccttaaaatggtcgaaccatggttgaaaaacaatcaattttgtattaaagtactaaacccatatatgccaacagtgatagaacacctagaaagactacaaaggaaacatggtggaatgttagttagaaaccctttatcccgaaattccactcacgaaatgtattggatatccaacggaacaggaaatatagtcgcctccgtgaacatggtaagtagacttctattaaatcgattcacgatgacacacagacgaccaacaatagaaaaagacgtagacttgggagctggaactagacatgtaaatgcagaaccagagacacctaatatggacgtcataggagagaggatcaaacgaatcaaagaagaacacaactcgacatggcactacgatgatgagaacccatacaaaacctgggcttaccatggtagctatgaagtaaaagcaacgggaagtgccagctccatgataaatggtgtggtcaaactactcacaaaaccatgggatgtagtgcctatggtaactcaaatggcaatgacagacacaactccattcggtcaacaacgagtcttcaaagagaaagtggatactcgaacccctcgctctatgccaggaacaagaagagtaatgggaataactgcagagtggctatggcggaccttgggcagaaacaagaaacctcgactttgtacacgcgaagagttcactaagaaagtgagaacaaacgctgcaatgggagctgtatttacggaggaaaaccaatgggatagcgcaaaagctgctgtggaggatgaggacttttggaaactcgtagatagagagcgggagcttcataaactagggaaatgtggatcgtgcgtgtataatatgatgggaaaaagagagaagaaattaggagaatttggaaaggcaaagggatcacgtgccatatggtatatgtggttaggcgcacggtacctcgaatttgaggctctaggctttttgaacgaggatcattggttctcgagagaaaatagttattcaggagttgaaggagaaggtttacataaactaggctatattttgagggatatttcaaaaatacctgggggcgcaatgtatgccgatgatacagctggctgggacacaagaatcacggaagatgatttgcataatgaggaaaagataacacaacaaatggacccagaacacagacaattggcaaacgctatctttaaacttacctaccaaaataaggtagttaaagtgcaacgaccaactccaaccggcacagtgatggacattatttcacgtaaagatcagagaggttcaggccaagtgggcacatatggtttgaacacttttacgaatatggaagcccaattaattagacagatggaaggtgagggcgtactttcaaaagctgacttggaaaatccccatctatcggagaaaaagataacccaatggcttgagacaaaaggggtcgaaagattaaaacgaatggctattagtggcgatgattgtgtagttaaaccgatcgatgatcgatttgcgaatgccctcttagctttaaacgatatgggtaaagtgagaaaagatatcccacaatggcaaccaagtaaaggatggcatgattggcaacaggttcctttttgttcacaccattttcatgagcttatcatgaaagacggtcggaaattggtcgttccttgtcgtccacaagacgaactgattggtagagcaagaatttcgcaaggcgcagggtggtctctcagagaaactgcttgcttggggaaagcgtacgcacaaatgtggtcgttaatgtacttccatagacgtgatctgcgcctcgcaagcaacgccatttgctcagcagtgccagtacactgggtaccaacttcacgtactacatggagtatccatgcacaccatcaatggatgacgaccgaagatatgctaaccgtctggaatagagtgtggatagaggataacccatggatggaagacaaaacgccggtcactacatgggaaaacgtcccatatttaggaaaacgcgaggatcaatggtgtggtagcctaattgggttaacatcccgtgcaacatgggcacaaaacattccaaccgccatccaacaagtgcgttcactcataggtaatgaagaatttcttgattatatgcctagtatgaaacgcttccgtaaagaagaggaaagcgaaggagtcatttggtaa

SEQ ID NO: 23330 - RNA, 9873 nt, synthetic construct
  misc_feature 1..9873: note = derived and/or modified CDS sequence (opt6) from DENV-3__FJ182004__SS-prME
  source 1..9873: mol_type = other RNA
acgagcttatgtctcatgatgatattacccgcagctttggctttccatctaacatctagagatggtgaacctcggatgattgtaggcaaaaacgaaagaggtaaatccctattatttaaaacggctagtggcataaatatgtgtacactcattgcaatggatcttggcgaaatgtgtgacgacaccgtaacttataaatgtcctcacattgctgaagtagaacccgaagacatagattgctggtgcaatcttacaagcacatgggttacatacgggacttgtaatcaagcaggggaacatagaagagacaaacgatccgtggcattagctccccatgtgggtatgggcttggatacgcgcacgcaaacatggatgagcgcagaaggagcatggagacaagtagaaaaagtagaaacatgggcattgcgacaccctggattcactattctagcgctgttcctagcacattacattggaacctcattaactcaaaaagtagtaatattcattttattaatgttagtgacaccttccatgacgatgcgatgtgttggtgtaggaaatagagattttgttgaaggattaagtggagcgacgtgggttgacgtagttctggaacatggtggatgcgtaacaacaatggctaaaaataaacccacactcgacatagaactacagaaaaccgaagctacgcaactggcgacattaaggaaactttgtatagaaggaaaaataacaaatataactactgatagtcgatgtccgacacaaggagaggcagtgttaccagaagaacaagaccaaaattatgtttgtaaacatacgtacgtagacagaggatggggaaatggatgtggacttttcggaaaaggttctttagtcacatgtgctaaatttcaatgtttggaaccaattgaaggaaaagttgtccaatatgaaaatttgaaatatacagttataatcacagtacataccggagaccaacatcaagtaggcaatgagacccaaggtgttacagcagagataacccctcaagcatcaactactgaagctatactacccgagtacggcaccctggggttagagtgctctccgaggacaggactggattttaacgagatgatattgttaacgatgaaaaataaagcatggatggtgcatcgccaatggtttttcgatcttcctctaccttggacttcaggtgctacaacagaaaccccaacctggaacaggaaagaattgcttgtgacatttaaaaatgcccacgcaaagaaacaggaagtcgtagttttgggcagccaagaaggggcgatgcacacagccctaacaggtgcaacagaaatacaaaattccggaggaacctcaattttcgcaggacatctcaaatgtagactgaagatggacaaacttgaactaaaaggcatgagttacgctatgtgtaccaacacattcgtcctaaagaaggaagtaagtgaaacacaacatggaactatactaataaaagttgagtacaaaggcgaggatgctccatgtaagattcctttcagtaccgaagacggacaaggtaaagctcataacgggcgtttgataacagcaaatccagtagttactaagaaagaggaacctgttaatatagaagctgaaccaccctttggtgagtcaaacatagtcatcggaattggagataatgcattaaaaataaactggtataaaaagggctcaagcattggcaaaatgtttgaggcgacagcgagaggtgctcggagaatggcaatattaggcgatacagcttgggactttggcagtgtaggaggagtcttaaactcattaggtaaaatggtccaccaaattttcggcagcgcctatacagcattgttttcgggcgtatcctgggtaatgaaaataggaatcggtgtattacttacatggatcggattaaacagtaaaaatacgtcaatgagctttagctgtattgccattggtataatcacactgtatctaggagcagtagtgcaagcagacacgggatgtgtaataaattggaaaggaaaagaattgaagtgcggtagtggaattttcgtcacaaatgaagtacacacatggacagagcagtacaaatttcaagcagatagtccaaaacgtttggccacagccatcgctggagcatgggaaaatggagtatgtggtattagatccacaaccaggatggaaaacttactttggaagcaagtggcaaatgaactcaattatattctatgggaaaataacataaaattaactgtcgtagtaggagacataatcggtgttctcgaacagggcaaacgaactctaacacctcagcccatggaactaaaatactcatggaaaacatggggaaaggctaagattgttactgcagaaactcagaactccagcttcattatagacggacctaacacaccagagtgcccttccgcgtcccgcgcatggaacgtatgggaagtggaggattatggattcggtgtattcacaacaaacatttggcttaagttgagagaagtctacactcaattgtgtgatcacagattaatgtcggcagcggtaaaagacgagcgggcagtgcacgccgacatgggatactggatagaatctcagaaaaatggatcctggaagttagaaaaggcatccttaatcgaagtaaagacgtgtacgtggccgaaaagtcatacactatggtcaaacggtgtattagaatcagatatgatcataccaaagtctttagctggacctatttctcagcataactataggccaggatatcatactcaaacggcaggaccgtggcaccttggaaagttagaattagattttaattactgtgaaggaacaacagtagtaatcacagaaaattgcgggacccgagggccctcacttagaacaacaacggtttctggaaaactaatccatgagtggtgctgcagaagttgtactttaccgccattaagatatatgggcgaggacggctgttggtatggaatggagattcgacccatcagtgaaaaggaagaaaacatggtcaaatcattagtttccgcgggatcaggaaaagtcgataattttaccatgggggttttgtgcttggccattctgttcgaggaagtaatgagaggaaaattcggtaagaaacacatgatagcgggtgttttctttacgttcgttctactgttgagtggacaaattacctggagggatatggctcatactttgattatgataggatctaacgcttctgaccgcatgggaatgggcgtcacatatctcgcgcttattgcaacctttaagattcaaccattcctagcactggggttcttccttcgaaaacttacatcgagggaaaatttgctgttgggagtcggactagcaatggcaacgactctccaattaccagaagatatcgaacaaatggcgaatggaatagcactaggtctaatggcgttgaaacttataacacaattcgaaacctatcagttatggacagcactgataagcctaacatgctctaataccatctttacgttaaccgtcgcatggcgtaccgcgacgctcatcctagcaggagtatcattactgccagtttgtcaaagcagcagcatgcgaaaaagcgattggctaccaatgacagtagcagcgatgggcgtaccacccttaccattatttatatttagtctgaaagatactctcaagaggagatcctggccgttgaacgaaggcgttatggctgttggcctagtatccatactcgcgagttctttgttacgcaatgatgtaccaatggcgggtcctctcgtcgcagggggcttgttaatagcatgctatgttataaccggaacaagtgcagatttaacagtggaaaaggctgcagacgttacgtgggaagaagaagccgaacaaacgggagtaagccataacttaatgataacagtagatgacgacggcactatgagaataaaagacgatgaaactgaaaatatattaacggtccttttgaaaacagctctactgatcgtgagcggtatattcccctactcaatcccagccactctgttagtctggcacacatggcaaaaacaaacaagacgttcaggagttctttgggatgtcccgtcaccacctgaaactcagaaagctgagttagaggagggtgtataccgaataaaacaacagggaatctttggaaagactcaagtcggagttggcgtacagaaagaaggagtatttcatactatgtggcacgtaaccagaggagctgttctgacatacaatgggaagaggctagaacctaattgggcgagcgttaagaaagacttaatctcttatggcggtgggtggagattatctgctcaatggcagaaaggcgaagaggttcaagttattgccgtggaaccgggcaaaaaccctaaaaactttcagactatgcctgggacatttcaaactaccactggtgagatcggagccatcgcacttgatttcaaaccaggaaccagtggatcacctataatcaatcgagaaggaaaagtagtaggattatatggaaacggtgttgtcactaagaatggcggttatgtatcgggtattgcacaaacaaatgctgagccggacggaccaaccccagaacttgaagaagagatgtttaagaaaagaaacttaacaataatggacttacatccaggctcgggaaaaacaaggaaatatttacctgcaattgtaagagaggccatcaagcgtaggctaaggacattgatacttgcacccacgcgcgtagtcgccgcagaaatggaggaagctctaaagggcttgccaattcgttaccagacaactgccaccaagtcagagcataccgggagggaaatcgtagatttgatgtgccacgcgacgttcaccatgagattgttgtcacccgttagagttcctaactataacctcattattatggacgaagcgcactttactgacccagcatcaatagcggcaagagggtatatatcaactagagttgggatgggagaagccgcagctatattcatgacagcgactcctccaggaactgcagacgccttcccccaatcaaatgccccaatccaagatgaagaacgggacataccggaaagaagttggaacagtggtaacgaatggataactgattttgcaggaaaaaccgtctggtttgtcccctcaatcaaagcaggaaacgacattgcgaactgccttaggaaaaacggcaagaaagtcattcaattgagtcgtaaaacgttcgataccgaataccagaagacaaaattaaatgattgggatttcgttgttacaacagatatatctgaaatgggagccaacttcaaagcagacagagtaatagatccaagaagatgtctcaagccggtcatcttaacagatggtcctgaaagagtaatattagctggaccaatgcctgtcacagcagcctctgctgctcaacgccgtggccgtgtaggtagaaatccccagaaggaaaacgatcaatacatattcacaggacaacctcttaataacgacgaggatcacgcacattggacagaggcgaaaatgctattagataatattaacactccggaaggcatcataccggcactttttgaaccagagcgagagaaatcagcagcaattgacggagaataccgtttgaaaggagaaagtcgcaaaacatttgttgaattaatgcgtaggggagatctaccggtatggctcgcgcataaagtcgcttcagagggaataaaatatacagaccgaaagtggtgttttgacggacaacgaaacaatcaaatcttggaagaaaacatggacgtggaaatctggactaaagagggagagaagaagaaacttagacctagatggttagatgcacgaacttacagcgatccactagcgctaaaagagtttaaagactttgccgctgggagaaaatcaatcgctttagacttggttacagaaatcggccgagtcccatctcatttagcacatagaacacgaaacgctttagacaatttggtaatgttacatacctctgaacacggtggcaaggcttatagacacgctgtagaagagttaccggaaactatggagacattgttgttactggggctaatgattctcctaactggcggggccatgctattcctaataagcggtaaaggtatagggaaaacgagtatcggactcatatgtgtaatagcgtcaagcggaatgctttggatggctgagataccgttgcagtggatagcatccgcgattgtgttagagttctttatgatggtattgctgatacccgaacccgaaaagcaacgtactccacaagacaatcaattagcatatgtggtaattggcatacttacgctagcagccatcatagcagcaaacgaaatgggattgttagaaacaacaaagagggacctaggcatgtcaaaagaacccggagtagtatcaccaacaagttacttggatgtagacttacacccggcttcagcatggacactatatgctgtagccacaacggtaatcactcctatgctcaggcacacgatagagaacagcaccgcaaacgtctcactcgctgcaatagcaaatcaagcagtagtgttaatgggcctagacaaaggttggcctatatcaaaaatggatttaggcgtcccactgcttgcccttggatgctactcgcaagtcaatcctcttactctaacggctgccgtattgctacttataacacattacgccattataggaccaggattgcaagctaaagctactcgagaggcacagaaaagaacggcggcgggaataatgaagaaccccacggtggatggaataatgacaatagacttggatccagtcatttatgacagtaaattcgaaaaacagttgggacaggtaatgttactggttctgtgtgccgttcagttattattaatgaggaccagttgggccctatgtgaagcgttaacacttgccacggggcccataacgaccctctgggaggggagcccaggaaagttctggaatacgactatagcagtatccatggcaaacatatttcggggttcgtaccttgccggtgctggtcttgctttctctataatgaagagtgtaggaacaggaaagagaggaacgggatcacaaggagaaactcttggcgagaaatggaagaagaaacttaaccagctatcacgtaaagaatttgacttatacaaaaagagtggcataacagaggtcgatcgcacagaagccaaggaaggattaaaaagaggagaaataacacatcacgctgtatctcgagggtcggcaaaactccaatggtttgttgagagaaatatggttattcccgaaggacgcgtaattgacctcgggtgcggcagaggtggctggagttattactgcgcaggtcttaagaaagtcacggaagttagaggctatactaaaggagggcctggacatgaagaacctgtaccgatgagtacctacggttggaatattgtgaagctcatgagtggaaaagacgtattttacttgccgccggaaaaatgcgatactctattatgtgatataggggaatcatcaccatctcctacagttgaagagtcaagaactatccgcgttttaaaaatggtagagccttggttgaaaaataaccaattctgtataaaggttttaaatccatatatgccaacggtaatagaacatttggaacgtctgcaaaggaaacatggagggatgctagttcgaaacccattaagccgtaattcgacccatgaaatgtactggataagtaacggaaccggaaacatagtagctagtgtcaacatggtaagtagactattattaaatagatttacaatgacccatagacgcccaactattgaaaaagacgtagacctaggggctggaaccagacacgtcaacgccgaacccgagactccaaatatggatgtaattggagaacgtattaaaagaataaaggaagaacataatagcacatggcattacgacgatgaaaacccatataagacctgggcatatcatggtagttacgaagtgaaagcaactggcagtgcatcctcgatgattaatggcgttgtaaaactattaaccaaaccatgggacgtcgtcccaatggtaacacaaatggctatgaccgacaccactcccttcggacaacaacgcgtttttaaggaaaaagtagacactcgaactccgcgttctatgccgggtacccgtcgagttatgggtatcaccgcagaatggttatggagaactctaggacgaaataaaaagccacgcctatgtactcgagaagaatttaccaagaaagtcagaactaacgccgcaatgggcgcagtttttacagaagaaaatcagtgggattctgcgaaagcggcagttgaggacgaagatttttggaagttagtcgaccgcgaacgtgagctgcataaattaggaaaatgcgggtcttgtgtttataacatgatggggaaaagggagaagaaattaggagagttcggcaaagcgaaaggttccagagcgatatggtacatgtggctaggagccagatatcttgagttcgaagcactggggtttctgaacgaagaccactggttttcaagagagaacagttatagtggagtcgaaggtgaaggcctacacaaattaggatacattttgcgagacataagtaaaatcccgggtggagctatgtatgctgatgacacagcaggctgggatacaagaattacagaagatgacttacataatgaagagaaaatcacacaacaaatggacccagaacatagacaactagctaatgcgatattcaaattgacataccaaaataaggtcgttaaagtacaacgacccactccaactggtacagtaatggacattatatctcgcaaggatcagcgaggatcaggtcaagtaggtacatacggccttaacacattcactaacatggaggcgcaattgataagacaaatggagggagaaggagtattaaccaaagctgacctagaaaatccgcatttaagtgaaaagaaaattacgcagtggttggagactaaaggagtggaaaggttaaaacgtatggcaatatctggggacgattgcgttgtaaaacctattgacgacagattcgcgaacgcattactcgccttgaatgatatgggtaaagtaaggaaggacatcccacaatggcaaccgagtaaaggatggcatgactggcaacaagtgccgttctgtagtcatcactttcatgaattaataatgaaagatggaagaaagctggttgtaccgtgtagaccacaagatgagctaataggtagagcgagaattagtcagggtgcgggctggtctttgagagaaacagcctgtctaggcaaagcgtacgctcagatgtggtccctcatgtacttccatagacgtgacttaagattagcttctaacgcaatatgttcagctgtaccggttcactgggttcctacaagtagaactacttggtcaatacacgcgcatcaccagtggatgaccacggaagacatgcttacagtgtggaatagggtgtggatagaagataatccgtggatggaggacaaaacaccagttactacttgggaaaatgtgccatatctcggcaaaagagaagaccaatggtgcggaagccttataggattaacaagtcgggcaacctgggcccaaaatatccctaccgcgatacaacaagtaaggtctcttattgggaacgaagagttcctagactatatgcctagcatgaaaagattccgcaaagaggaggaatcagagggagctatttggtaa

SEQ ID NO: 23331 - RNA, 9873 nt, synthetic construct
  misc_feature 1..9873: note = derived and/or modified CDS sequence (opt6) from DENV-3__FJ024465__SS-prME
  source 1..9873: mol_type = other RNA
acatcactatgtctcatgatgatattaccggcagcgttagcgtttcatttgacgagtagggacggagaaccacgaatgattgttggtaaaaatgagagaggtaagagccttttatttaagacagcctcaggtataaacatgtgtacattaatagctatggacctcggcgagatgtgcgacgacacagttacgtacaaatgtccacacatagcggaagtagaaccagaagatattgattgctggtgtaacttaacttccacatgggtaacgtacggaacttgtaatcaagccggagaacaccgaagagataaacggtcagtagccttagctccacacgttggtatggggcttgatactcgaacccagacgtggatgtcagcagagggcgcatggcgacaagttgagaaggttgaaacatgggcacttaggcaccctggattcacaatacttgccctatttttagcacactacattggtacgagccttacacaaaaagtagtcattttcattctactcatgctagtaactccaagtatgacaatgcgatgcgttggagttggaaatagagactttgtggaagggttatccggtgcaacatgggttgatgtggttctcgaacacggtggatgtgtaaccaccatggcaaaaaacaaaccaactcttgatatagaattacagaaaacagaagcgacgcaattggccactttgcgaaagctctgtatcgagggaaaaatcacaaacataacgacagacagcaggtgtccgacacagggcgaggcggtattacccgaggaacaagatcaaaactacgtttgcaaacatacttatgtcgaccgaggatgggggaacggatgtgggttatttggcaaaggctcattggtaacctgtgctaaattccaatgtttagaaccaatcgaaggaaaagttgtccaatacgaaaacttaaaatatacagtgattattaccgtacacacaggcgatcaacatcaagttgggaatgaaacccaaggagtaactgcggaaataacaccacaagctagcaccacggaagcaatattgccggaatatgggacgttaggtttagaatgttccccgcggacaggactagattttaatgagatgatcttattaacaatgaaaaataaagcttggatggttcacagacaatggttttttgacttgccactaccgtggacgtcaggagctacaacagaaactccaacttggaacagaaaagagctactagtaacattcaaaaatgcccatgcgaagaagcaagaagtcgtcgtcttaggctcgcaggagggtgcgatgcatactgcattaaccggagcaacagaaattcagaacagtggagggacttctatattcgcaggacaccttaaatgccgcctcaaaatggataaattagaactcaaaggaatgtcatacgccatgtgcacaaacactttcgtcttaaaaaaggaggttagtgaaacccaacatggaacaatattaattaaagtagagtacaagggagaagatgtcccttgcaaaatacccttttcaacggaggatggtcaaggaaaggcacacaacggaagactaattacggccaatccggtagtaacaaaaaaagaagaacccgtaaacatagaggctgaaccaccgtttggagagagtaacatcgttataggtataggagacaatgcgttaaagattaactggtataagaaaggcagttcaattgggaaaatgttcgaagctacagcgcgaggagcacgccgtatggctatcctaggtgacaccgcatgggattttggcagtgtcggtggggtattaaactcgttagggaagatggtgcaccagatattcggttcagcgtatactgctttgtttagtggtgtatcctgggtgatgaaaatagggattggagtactattaacatggatcggcctaaattccaaaaatacatcaatgagcttttcatgtattgcaattggaattataacactatacttaggtgcagtcgtgcaagcggacacagggtgcgttattaactggaagggtaaagaattaaaatgtggatccggcatattcgtaaccaatgaggtccatacatggacagaacagtacaaatttcaagcagacagcccgaaacggctagccacagccatagcaggcgcttgggaaaatggggtctgcgggatacggtctaccactagaatggaaaaccttctttggaaacaaatagcaaacgagctaaactatatactttgggagaataacataaaactgacggtggtagtaggagatatcatcggagttttagagcagggcaaaagaacattgacaccacaaccgatggagttaaaatattcttggaagacatgggggaaagctaaaatagtcacagcagagactcagaacagctctttcattatagatggaccaaatactcctgaatgccctagtgcaagtagagcatggaatgtgtgggaagtagaagattatggttttggagtcttcacaaccaacatctggttgaaactgcgagaagtatacacccaactatgcgaccaccgtttaatgagtgcggcagtaaaagacgaacgagccgtacacgcggatatgggatactggattgaaagccaaaaaaacggatcgtggaaactagaaaaagcatcgctaattgaagtgaagacctgcacctggccaaaatctcatacattatggagtaacggagtactagaaagtgacatgatcataccaaagagtctcgctggtcccatatcacaacacaattatagacctggatatcatacacagactgccggaccatggcaccttggcaaattagaattagacttcaactattgtgaaggaacgacagtcgttattactgaaaattgtggaacgcgcggtccttcactaaggacgactactgtgtcggggaaactgatacacgaatggtgttgtcggtcctgtacacttccaccactacgttatatgggagaagacggatgctggtacggaatggaaataaggccaatttctgagaaagaagaaaatatggtcaaaagtctggtatctgccggtagcggtaaagttgataattttaccatgggcgttttgtgcttggcgatattatttgaagaagttatgcgagggaaatttggaaagaagcacatgattgccggggtattttttacatttgttcttttattaagtggccagataacttggagggatatggcacatactctgattatgatcggcagtaatgcgagtgacagaatgggaatgggtgtcacttatttagcactaatagcaacctttaagatccaaccattcctcgcactggggttcttcctaagaaaactaacaagtcgagagaatttattactgggtgtcggtttagctatggcaacaacgttacaattaccagaggatattgaacaaatggctaatggaatcgcactaggtttaatggcattgaaattaataacccaattcgaaacttaccaactctggacggcattgatatcactgacttgtagtaacacaatttttacattaacagtagcgtggcgaacggcaactttaattctagcaggtgtttccttgttaccagtatgtcagagttcaagcatgcggaaatctgattggttaccaatgacggtagcagcaatgggggtaccaccattgccactatttattttcagtctcaaggacacattaaagcggagatcatggccattgaatgaaggcgttatggcggtaggtctggtttcaatattagcaagcagtttgctaagaaacgacgtccctatggccggacccctggtggccggaggactactaattgcatgctatgtaataacaggcactagtgctgatcttgcagtagaaaaagcggctgacgtgacgtgggaagaggaagcagaacaaaccggcgtctctcacaatttgatgatcacagtcgatgacgatgggactatgaggattaaagatgacgaaacagaaaatatactgacggttttactaaagaccgcattattaattgtctctggcatatttccatattcaataccagcaactttattggtttggcatacatggcaaaaacaaactcaaagatccggagtattatgggatgtgccatcaccacccgaaactcaaaaagcagagctcgaagaaggagtgtatcgaattaaacaacagggtatttttggaaaaacacaggttggcgtgggggttcaaaaagaaggtgtcttccacacgatgtggcacgttacacgaggcgcggtgttaacatacaatggaaaaaggctagagccaaattgggcctcagtgaaaaaagacctaatcagctacggaggtgggtggagattatcagcacaatggcaaaaaggcgaagaggtgcaggtgattgcagtagagcccggaaagaacccaaaaaatttccaaacaatgccgggcacgttccaaacaacaacaggagaaataggagctatagcgttagattttaaaccaggaacatcgggaagtccaatcataaatagggaaggcaaagtagtaggtctatacggtaatggtgtagtaacgaagaatggaggttatgtgtcaggaatagcacaaaccaacgctgagccggacggaccgacgcctgaactagaagaagaaatgtttaaaaaacgaaacctcaccataatggatttacatcctgggtcaggtaaaacaaggaaatatttgcccgccattgttagagaagcgataaaacgtcgtctcagaaccttgattctggcgccaactagagttgtcgccgctgaaatggaggaggcattgaagggtctgccgattcgctaccaaaccactgctacgaaaagtgaacatacaggcagggaaatagtagatttgatgtgtcatgcaacttttacgatgcgactcctttcccctgtccgggttcctaactataacctaataataatggatgaagcacatttcacagatccggcttcaatagccgcgagaggatacatctcaacccgtgttgggatgggcgaagccgcagcgatcttcatgacagcgactccgcctggaactgctgatgcatttcctcaaagcaatgccccaattcaagacgaagaacgtgatatcccagaaagatcgtggaactcagggaacgagtggataacggacttcgccggaaaaaccgtctggtttgtaccgtccataaaagccggtaacgacatagcaaactgtttacgaaaaaatggaaaaaaagtgatacagttgtcaagaaagacctttgacactgaatatcaaaaaactaaactaaatgattgggactttgtcgttacgactgatatctcggaaatgggcgcgaattttaaagctgacagagtcatagatcctcgaagatgcctcaaacctgtaatacttacagatggtcccgaaagggtaattttagcgggacctatgccggtaacggcggcaagcgcagcgcaaagaagaggtcgagttggtagaaatccacagaaagaaaatgatcaatatatcttcaccggtcaaccattaaataacgacgaagatcatgctcattggacagaagctaaaatgctactagataatattaatacacccgaagggattatccctgccctctttgaaccggaaagggaaaagagtgctgcaattgacggggaataccggctcaaaggtgaatcaagaaaaacgtttgtagaattaatgcgaagaggcgaccttccagtatggttagcacataaagttgcgtctgaaggaattaaatatacagatagaaaatggtgctttgatggtcaacgcaataaccagatcttagaagagaatatggacgtagagatatggacaaaggagggagaaaaaaaaaaattaagaccaagatggctggatgcccgaacatattcagacccattggcactaaaagagtttaaagactttgcagccggtagaaaatcaatagcattagatctggttacggaaatcggaagagtaccgtcacatttagctcatagaaccagaaatgcattagacaatctcgtcatgttgcatacaagtgaacatggtggaaaggcatatagacatgcagtagaagagctgccagagacaatggagacgttattacttttaggcctaatgatattattaacaggtggagctatgttattcttgatatcagggaaaggcattgggaaaacatcgatagggctaatttgtgtaatcgcttcgtctggaatgctctggatggcagaaatccctctccaatggatagcttctgcaattgttttggagttttttatgatggtactcttgattcccgaaccagaaaaacaaaggacacctcaagacaatcagctcgcatatgtggttattggtatactaacactagccgcgataatagcggcaaatgagatggggttacttgagacaacaaaacgcgatctaggaatgagtaaggaacctggagtagtaagtcctacaagctatttagacgtagatctacaccctgcgtccgcatggactctttatgctgtggcaacaacggtaattacaccgatgttgcgacacaccattgaaaatagtacagccaacgtttcactagcagcgatcgctaatcaggcagtagtacttatgggactagataagggttggcccatatcaaaaatggacctaggagtgccactacttgcactcggatgttattcccaggtcaatccacttacactaacagcagctgtattgctattaatcacacattacgcaataatcgggccgggcttacaagctaaagctacgcgcgaagctcaaaaaagaaccgcagcggggattatgaaaaaccctacagttgatggtataatgacaatagatttagacccggttatatacgattcaaaatttgaaaaacaacttggacaggtaatgctccttgtactctgtgctgtacaactactattgatgagaacatcatgggccctctgtgaagctctcactttagcaactggccctataacaactctatgggaaggtagcccgggaaaattctggaatacaactatagcagtaagtatggcaaacatctttcgcggtagctacctagcaggtgctgggttagctttttccattatgaaatcggtcggaacgggaaaaaggggaacaggaagccaaggtgagactctgggcgaaaagtggaaaaagaaactcaatcaactaagtaggaaagagttcgatctgtataaaaaatcagggattacggaagtagacagaacagaagctaaggaaggacttaagagaggtgaaattacacatcatgctgtatcacgaggatcagctaaactccagtggtttgtggaaagaaatatggttatccccgagggccgagtaatagatttaggatgtggacgaggcgggtggagttattactgcgcaggtttgaaaaaagtaaccgaggttcgcgggtacactaaaggagggcctgggcacgaagaaccagttccaatgagtacgtatggatggaatatagtaaagttgatgtctggcaaggatgtgttttacctacctccagaaaaatgtgatacgctattatgcgatattggagagtcttcaccgtctcctactgttgaagaatcacgcactattcgagtacttaaaatggtggaaccctggttaaagaacaaccaattctgcataaaagtgttgaatccatatatgccaaccgtcatagagcatctcgaacgcttgcagcgaaaacacggtgggatgttagttaggaaccctctatctcgaaattcaacacatgaaatgtattggatatcaaatggtacggggaacatagtggcgtctgtaaacatggttagtcggttattacttaaccgttttacaatgacacaccgaagacctaccattgagaaggatgtggacttaggcgcgggaacccgtcatgtgaatgccgaaccggagaccccaaatatggacgtaatcggtgagagaataaagagaattaaagaagaacacaacagtacgtggcactatgacgatgaaaacccgtataaaacctgggcgtaccatggtagttacgaagtaaaggctacgggatccgcctcatccatgataaacggtgtggtaaagctgctcaccaagccatgggatgtagtcccaacagtaactcagatggcaatgacagatacaaccccttttggacaacagagagtatttaaggaaaaagtagatacaagaacaccaaggtccatgccgggtacaagaagagtaatgggaataacggcggaatggttatggcgcacattgggtcgtaacaaaaagcctcgattatgcaccagggaagagttcacaaaaaaggtaagaactaacgcagcgatgggggctgtatttacagaagagaatcaatgggatagtgcaaaagctgctgttgaggatgaggacttctggaaactggttgacagggaacgagaactacataaacttggtaaatgcggtagttgcgtctataacatgatgggcaaaagggaaaaaaagctcggagaatttggaaaagctaaagggagtagagcaatctggtacatgtggctaggggcccggtatttggaatttgaggctttaggctttctaaatgaggaccattggttttccagggaaaattcatattcaggtgttgagggggaaggattacacaaattgggatatatactaagggatataagcaaaataccaggtggagctatgtatgcagacgatactgctggctgggataccaggataacggaagatgacttacacaatgaagaaaaaatcacacaacagatggatcccgaacatcgtcaactagcgaacgctatattcaaattaacctatcagaataaagtcgtaaaagtccaacgaccaacccccacaggaactgtaatggatatcatatcaaggaaagatcaaaggggaagtggacaagtagggacttatgggttgaacacctttacaaacatggaagcacagcttatacggcaaatggaaggggaaggggtactgtcgaaggcagacttagaaaacagtcatctatcagaaaaaaaaattacgcaatggttagaaaccaaaggcgtagaaaggttaaagaggatggctatttcaggagacgattgcgtagtcaaacctatagatgatagatttgccaacgccttactagcgcttaacgacatgggaaaggtacgcaaagatataccgcaatggcaaccttctaagggatggcacgattggcaacaggttcctttttgctcgcaccatttccatgaactaattatgaaggacggaagaaaattggtagttccgtgtagaccccaggacgaactaatcgggagagctagaatatcacagggggcaggctggtctcttcgtgaaacagcatgtttaggaaaggcatacgctcaaatgtggtctctaatgtatttccataggagagacttgcgtctcgcttccaacgctatatgctccgctgtgccagtgcattgggttcccactagccgaaccacctggtcaattcacgcccaccatcagtggatgaccaccgaagatatgttaacagtatggaacagagtgtggattgaagataacccttggatggaagataagacaccagtaaccacttgggaaaacgtgccatatctgggaaagagagaggaccaatggtgtggatccttaataggattaacttcacgagcaacttgggcgcaaaacataccaacagcaatacaacaagtgagatcgcttatcggaaatgaagaatttcttgattacatgccaagcatgaagagatttagaaaggaagaagagtcggaaggtgccatatggtga

SEQ ID NO: 23332 - RNA, 9873 nt, synthetic construct
  misc_feature 1..9873: note = derived and/or modified CDS sequence (opt6) from DENV-3__FJ024466__SS-prME
  source 1..9873: mol_type = other RNA
acatctctctgcttgatgatgatattaccggcagcactagcatttcatcttacaagtcgtgatggagaaccgagaatgatagttggcaaaaatgaacgtggtaaatccctactattcaaaacagcgtctggtattaatatgtgcacgttgattgcaatggacctaggagaaatgtgtgacgacactgttacttataaatgcccacacatagctgaagttgaaccagaagatatagactgttggtgtaatttaacatcaacatgggtaacatatggaacgtgcaaccaagcaggagaacatcggcgagacaaaagatcggtagcgctagctccgcatgtagggatgggattagatactagaacccaaacgtggatgtcagctgaaggagcatggagacaagtcgaaaaagtagaaacatgggcattacgacatccgggattcacaatattagcactatttctcgcacattatattggcacctcactaactcaaaaagtcgtaatcttcatcctcttaatgctagtcacaccttccatgacaatgcgctgtgtcggagtaggaaatagagactttgtggaaggattatctggagccacatgggtcgatgtagtattggaacacggaggatgtgtaacaacaatggctaaaaacaaaccaaccttagatatagaactacagaaaacagaagcgacgcaattagcgaccctacggaaattatgcatagaaggcaaaataacgaacatcacgacggatagtcgatgcccaacacaaggtgaagctgtgctccccgaagaacaagatcaaaactatgtgtgtaaacacacatatgttgaccgaggatggggaaacggatgcgggttattcggcaaaggttcactggtcacatgcgcgaaattccaatgtctagaaccaatcgaaggtaaagtagtacagtacgaaaatttaaaatataccgtaatcatcactgtccatacaggcgatcaacatcaagtagggaatgaaacacagggcgttaccgcggaaataactccacaggcatccacaactgaagcaattctacccgaatatggtacactaggacttgaatgtagcccacgcaccggtttggattttaatgagatgatcttactaaccatgaaaaacaaagcatggatggtacatcgacaatggttctttgatctgccattgccttggacttcaggcgcaactacagaaaccccaacgtggaatcggaaagagctacttgtgactttcaaaaatgcacatgccaagaaacaagaggtcgtagttcttggcagtcaagagggagcaatgcatacggctctaactggtgcgacagaaattcaaaattcagggggtacaagtatatttgcaggccacctaaaatgccgattaaaaatggataaactcgagttgaaagggatgtcatatgcaatgtgtacaaacacttttgtattgaagaaagaagtatctgagactcaacacggtactatattaatcaaagtagagtacaaaggtgaggacgcgccgtgtaaaataccattttctaccgaggatggacaaggcaaagcacacaatggtagacttataacggcaaacccagttgtgacaaagaaggaggaaccagttaacattgaagctgaaccacccttcggtgaaagtaatatagtaataggaattggggataatgcattgaaaattaattggtacaagaaaggaagttcaataggtaagatgtttgaggccacagcccggggagcacgaagaatggcaatattaggggataccgcatgggattttggttcagtcggaggagtattaaactcactaggaaaaatggtccatcagatatttggaagcgcatacactgcattatttagtggagtgagctgggtcatgaaaataggtatcggagtactattgacctggattggtttaaacagtaaaaatacgtcaatgagcttttcctgtatcgcaatcggcattattacgctatatcttggcgctgtcgtacaagccgatacaggatgtgtgataaattggaaaggaaaggaactaaagtgtggaagcggaatatttgtgaccaatgaagttcacacatggacagaacaatacagattccaagccgactcaccgaagagactcgcaactgctattgcaggagcttgggaaaatggagtctgcggcatacgttcaactactagaatggaaaatttgttatggaaacaaattgcaaatgaactaaattacatactttgggagaacaatataaaactaactgtagtagtaggcgatataataggagtactggagcagggaaaacggacattgaccccgcagcccatggaattaaaatactcatggaagacctggggtaaagccaagattgtaacagcagaaacacaaaattccagttttattattgacggccccaataccccagaatgcccgagcgcaagcagagcttggaacgtatgggaagttgaggattatggatttggggtctttacaacaaatatttggttaaaactaagagaggtatacacacaactttgtgaccaccgactcatgtccgccgccgtaaaggacgaaagggccgtacatgcagacatgggatactggattgagagtcagaaaaacgggtcttggaaattagaaaaggcttcattaattgaagtaaagacgtgtacatggcccaaaagtcacacactttggtccaacggagtactagaaagcgacatgataatacctaaatctctagcgggcccaatatcccaacacaattatagaccaggatatcatacacagacagcgggaccttggcacctgggaaaattagaactagacttcaattattgtgaagggacaacagttgttatcacagataactgcggcactcgcggtcctagccttcgaactactacggtatcaggaaaactgatccacgaatggtgttgcaggagctgtacacttccgccgctgcgctatatgggagaagatggatgctggtatggtatggaaatacgcccaatatctgaaaaggaagaaaatatggtaaaatcattggtaagcgcaggaagtggaaaagttgataatttcactatgggtgttctttgtttagcaatattgttcgaagaagtcatgaggggaaagtttggtaagaaacacatgatagccggagtattctttacgtttgtactacttttatcaggccaaataacttggcgagacatggcgcacacattaattatgataggtagcaacgcaagtgatcgaatgggtatgggcgttacttatctagcattgatagctacttttaaaattcagccttttctggccttagggtttttcctaaggaaactaacatcacgtgaaaatttacttttaggcgtcgggcttgcgatggctacaaccctacagcttcctgaagatatagaacaaatggcgaacggaatagctctcggattgatggccctcaaactgatcacacaattcgaaacataccaactatggaccgcattaatttctctaacgtgttcaaacactatctttacgctaactgttgcatggagaaccgcaacacttattctcgctggagtctctttattaccagtttgccaatcatcgtctatgagaaaaagcgattggctcccgatgacagtagcggcaatgggtgttccgcctctgcccctgttcatcttttccctcaaagacacactgaagagaagatcatggcccctaaatgagggagttatggcagtaggcttagtaagtatcctggcgagcagtctactccgtaatgacgtgccaatggctggccctctcgtggctggcggattattgatagcatgttacgtcataactgggacaagtgcagatttaactgttgaaaaggcagccgatgtgacgtgggaagaagaggctgagcaaacaggagtaagccacaaccttatgataaccgttgatgacgacggtacgatgagaatcaaagatgatgaaacggaaaatatacttactgtactattaaagacagctttattaatagttagtggaattttcccatacagtatccctgcgacgctactcgtctggcatacctggcaaaaacaaactaggaggtccggcgtactatgggatgtcccttcgccacctgagacgcagaaagcagaactagaagaaggagtgtatagaatcaaacaacaggggatatttggtaaaacgcaagtaggtgtcggcgttcaaaaagaaggagtctttcatacaatgtggcacgtcacaaggggagctgtactcacatacaacgggaagagacttgagccaaactgggcgagtgttaagaaagatctgatctcttatggcggcggatggaggctaagcgcacagtggcaaaaaggggaagaagtacaagttatcgctgtcgaacccggcaagaatccgaagaatttccaaaccatgccagggacatttcaaactacaaccggagaaataggagcaatagcgttggattttaaaccaggtactagcggaagtccaataattaatcgcgagggaaaagtggtcggattatatggcaatggagtagtcacgaagaacggaggatatgtaagcggaattgcgcaaacgaatgcggagcccgacgggccgacgccagaactagaagaggaaatgtttaagaagcgtaatctcactattatggatctccatcccggatccggcaaaacccgaaaatatctaccagcaatagtgcgagaagccattaaacgcaggttaaggaccttaatattggcaccgactcgtgtagtagctgcagaaatggaagaagcactaaaaggactgcctattcgttaccaaacaaccgctacaaaaagtgaacacactggaagagaaattgttgatttaatgtgtcatgccacatttaccatgcgattactgtcacctgttagagtcccaaattacaacttaatcattatggacgaagcacattttacggacccagcatcgatagcagcaagaggatatatatcaacaagagttggaatgggagaagcagcggcaattttcatgacagctacaccacctggaacggcggacgcatttccgcaatcaaatgctccaatacaggacgaagagagggatatccccgaacgttcatggaatagtgggaatgaatggataactgactttgccggaaaaactgtatggttcgttccatccatcaaagcaggaaatgacatagctaattgtctaagaaagaacggtaagaaagtaattcagttgtcgagaaaaacatttgatactgaataccagaaaacgaaattaaatgactgggattttgtggtgacaactgacatttctgaaatgggtgcaaattttaaagcagatcgagtaatagacccacgaagatgtctaaaacccgtaattcttacagacggtcctgaaagagtaattctagcaggacccatgcccgtaacagcagcatctgctgctcagcgccgtggacgtgtgggtagaaaccctcaaaaagaaaatgatcaatacatatttactgggcaaccgctgaataatgatgaagatcacgcacattggacagaagcaaaaatgctacttgataatatcaacactccagaaggaataatacctgctttgttcgagccagaacgagagaaatcggcagcaatagacggcgagtacagacttaagggagagagtagaaaaacgtttgtagaactcatgaggagaggcgacttaccagtttggttggctcacaaggtggcctcggaggggatcaaatatacagaccgcaaatggtgttttgatgggcaaaggaataaccaaatcttggaggaaaatatggacgtcgaaatatggacgaaagaaggagagaagaagaaactaagacctaggtggctcgatgcgaggacatacagcgacccacttgcactaaaagagtttaaagattttgcagccgggcggaaatcaatagcattagacctggttacagaaataggacgggtgccctcccatctagcgcatcggacaagaaatgctctagacaatttagttatgttacatactagcgaacacggagggaaagcgtatagacacgcggtagaggaactcccagaaacgatggaaacgttattattgttagggttaatgatattacttacaggaggagcgatgctctttctcatcagtggaaaagggattggtaaaacatctataggtttgatatgtgtcatcgcctcttcgggaatgttatggatggcagaaatcccactacaatggatcgccagtgcaatagtcctcgagttctttatgatggtactcttaatccctgaacccgaaaaacagaggactcctcaagataatcaactagcatacgtcgtaatcggaattttaactctagctgcaatcatagcggcaaacgaaatgggcctcctagaaacaactaaacgcgaccttggaatgagtaaagaacctggtgtagtttcacccacgtcttatctggacgtagacttacacccagcatcagcgtggactttatacgcggtggccacaaccgtaataacgccaatgttaagacacacgatagaaaattcgacggcaaacgtttcattggctgcaatagcaaaccaggccgtcgtccttatgggcttagacaaagggtggcctattagcaagatggatcttggcgtgccactactagcattaggatgttacagtcaagttaatcccttaacactcactgcggccgtattattgctaatcacccactatgcaataataggccccggtttgcaggcgaaagcaacaagggaggctcaaaaacggacagcagctggaatcatgaaaaatccaacagtcgatggaatcatgacgatagatctggatcctgtcatttatgacagtaaatttgagaaacagttaggacaagtaatgttactggtactatgtgcagtacaattgttattgatgcggacaagttgggctttgtgtgaagccctaacactagcaactggacccataaccacgctatgggaaggatctcctggtaaattctggaacacaacgatagccgtttcaatggcaaatattttcagagggtcatacctagcgggtgcaggactagcattttcaataatgaaatcagtgggcactggcaagcgaggtacgggttctcagggagagactttgggagaaaaatggaagaagaaactaaatcagctgagtcgtaaagagtttgacctctataaaaagtctggaattactgaggtagacagaacagaagcaaaagagggtctaaagagaggcgagattacacatcacgcggtctcacggggctctgccaaactacaatggttcgtagaacggaatatggttattccggaggggagagtaatagatttagggtgtggaagaggtgggtggtcatactactgtgcgggacttaagaaagtaacagaagtacgaggatatactaaagggggaccagggcatgaagaaccagtgccaatgtcaacatatgggtggaatatagttaaattaatgagtggtaaggatgtcttctatttgcctcccgaaaaatgcgatactttattatgcgacataggagagtcaagtccgtccccgactgtagaagagtcgcgaactatacgcgtccttaaaatggttgagccatggcttaaaaataatcagttttgtataaaagtgttaaatccatatatgcctactgtaatagaacatttagagaggcttcagaggaaacatggtggtatgttggttagaaatcccctatcacgaaattccacacatgagatgtattggatctcaaatggaaccggaaacattgtcgcatcggttaacatggttagtaggctcttattgaatagattcacgatgacccatagaagacctacaattgaaaaagacgtcgatttaggggccggtacacgacatgtaaacgcagaaccggaaacaccaaacatggatgtaataggtgaacggattaaaagaataaaggaggagcataatagcacgtggcattacgatgatgagaacccatacaaaacgtgggcttatcacgggagttacgaagtaaaggccaccggctctgctagtagtatgatcaacggtgtagtcaaattactgacaaaaccttgggatgttgtacctatggttactcaaatggctatgacagacaccactcctttcgggcagcaacgagtattcaaagaaaaagtggacacccggacaccaaggagcatgccaggaactcgaagagtaatgggtatcacagcggaatggttatggcgaactctaggacgtaacaagaaacctagattgtgtacgagagaagaatttactaagaaagttaggacaaacgccgctatgggtgcagtattcacagaggaaaaccaatgggactctgccaaagcagccgtagaagacgaagacttttggaaattggtagaccgagaaagagaactacacaaattagggaagtgtgggagctgtgtatacaacatgatgggcaaacgtgagaagaaactaggtgaatttggtaaagctaaggggtcaagagccatttggtacatgtggttaggagcaagatatttagaatttgaagctctcggcttcttgaatgaggatcattggttcagtagagaaaactcttattctggcgttgaaggggaagggttacataagttaggatatatcttgagggacatcagcaaaatcccgggcggcgcgatgtatgcagatgacacagcaggatgggatacacgtataactgaagatgacctccataatgaagagaaaatcacacaccaaatggaccccgaacatagacaactagctaacgctatattcaaacttacatatcagaataaagtggttaaagtacaaagaccaactccaacggggactgtcatggatataatctccaggaaggaccaacggggaagtggccaagtaggaacatatgggttaaatacattcacgaatatggaagcacagctgataagacaaatggaaggagaaggcgtgttaagtaaagcagatttggaaaaccctcacctgagtgagaagaaaatcacacaatggttagaaaccaaaggtgtagagagactaaaacgaatggcaataagtggagacgactgtgtcgtaaaacctatagatgatagattcgccaatgcactactagcactaaatgatatgggcaaagtcaggaaggacataccccaatggcaaccttcaaaagggtggcatgactggcaacaggtccctttttgtagtcatcatttccatgaattgataatgaaagatggtcgtaagctagtagtgccgtgtaggccacaggacgagcttataggtagggcacgaattagccaaggcgcagggtggtcgttaagggagacagcatgcctagggaaggcttatgctcagatgtggagtcttatgtatttccatagacgtgatttgcgtttggcaagcaatgcaatatgttctgcggtccctgtacactgggtaccgacatctcgtactacctggtccatacacgctcaccatcaatggatgacgactgaagacatgctaactgtatggaatcgggtctggatagaggacaatccttggatggaggataagactcctgttacaacatgggagaacgtgccatacctaggtaaaagggaagatcaatggtgcgggtccctcattgggttgacttcaagggcaacgtgggcacaaaatatacccacagcaattcaacaggtcaggtcactgataggaaatgaggaatttttagactatatgccatctatgaaacggttcagaaaagaggaagagtcagaaggagctatttggtaa

SEQ ID NO: 23333 - RNA, 9873 nt, synthetic construct
  misc_feature 1..9873: note = derived and/or modified CDS sequence (opt6) from DENV-3__FJ024467__SS-prME
  source 1..9873: mol_type = other RNA
acgagcctttgtttgatgatggtgctacctgcagcactggcatttcatttgacatcaagagatggagaaccaagaatgatagtaggtaaaaacgaaagaggaaaatccttattattcaaaacagctagcggaattaacatgtgtacgttaattgcgatggacttaggtgaaatgtgtgatgatacagtgacttacaaatgcccacacataacggaagtcgaacctgaagatattgattgctggtgcaatctaacttcgacttgggttacatatggaacatgtaatcaagctggtgaacataggcgagataaaagatctgtagcactagcccctcacgttggtatggggctagatacaagaactcaaacgtggatgtcagctgaaggggcttggagacaagtagaaaaagtagaaacgtgggctctacggcatcctggatttacaatattagctttatttctggcacactatataggtacctcactaactcaaaaagttgtaatatttatactactaatgctagtaactccctcgatgaccatgcgctgcgtaggagtcggaaatcgagatttcgtcgaaggattgtcgggtgctacatgggtcgatgtagttctggaacatgggggatgcgttacaacgatggctaaaaacaaacctacattagatatagaacttcagaaaacagaagctactcaactagctacacttcgaaaactatgcatagaaggaaaaataactaatataacaactgatagtcgctgtccgactcaaggagaagccgtccttccagaggaacaagatcaaaattacgtgtgtaaacatacttacgttgatagaggttggggcaatggatgcgggttatttggaaaaggaagtttggtaacctgcgcaaaattccaatgtttggaaccaattgaaggtaaagtagtacaatacgaaaacttaaaatacacagtaataatcacagtccacaccggtgatcaacatcaagttggaaacgaaacccagggagttactgcggaaataacgccccaagcctcgacaacagaagcaattctgcctgagtacggcactctaggactagagtgctcaccacgtacagggctggattttaacgaaatgattctactcacaatgaaaaacaaagcgtggatggttcacagacaatggttctttgatctaccactcccatggacgtctggagctacaacggaaaccccgacttggaacagaaaagagcttctggtaacatttaaaaatgcgcatgcgaagaaacaggaagtagtagtcttaggatcacaagagggggcgatgcatacagcgttaacaggagcaacagagatacaaaacagtggagggacgagtatcttcgccgggcacctgaaatgtagactaaaaatggataaactagaacttaaaggcatgagttatgcaatgtgtactaacacatttgtactaaagaaagaggtcagtgagacgcaacatgggactatattaataaaggttgaatataaaggagaagatgccccttgtaaaatcccattcagcaccgaagatggacaaggcaaagcccacaatggacgactaataacagcaaaccctgtggtgacaaagaaggaagaaccggtaaacatcgaagcggaacccccgtttggagaatcaaatatagtaataggtattggagataatgctttgaaaataaattggtataagaaaggtagtagcataggaaaaatgttcgaggcaaccgcacgtggtgcacgtagaatggcaatactgggtgataccgcatgggattttggttcagtaggaggtgttctcaactcactaggaaagatggtacatcagatattcggaagcgcatacaccgcactgtttagcggcgtatcatgggtaatgaagataggaatcggagtactattaacatggataggtttaaatagcaaaaatacatcaatgtcattcagttgtatagcaataggtgtaatcaccttatacttgggtgcggttgtccaagccgatatgggctgtgttattaactggaaagggaaggaactaaaatgcgggagtggaatctttgtgactaacgaggtacacacatggacagaacaatataaatttcaagccgactctcctaaacgattggcgacagcaattgcgggagcgtgggaaaacggtgtctgtgggataagatcaacgacgagaatggaaaacctactatggaaacaaatcgcgaatgaactcaattacatattgtgggaaaataatataaaattaacagttgtcgtaggcgacatcataggagtacttgaacaaggaaaaagaacgttaacaccccaaccgatggaactaaaatattcctggaaaacatggggaaaagcaaaaattgtaacagctgaaacccaaaacagtagcttcattatagatggaccgaacactccggaatgtccaagcgcttcaagggcatggaacgtatgggaagtcgaagattatgggtttggagtttttacaacaaacatttggttgaaattaagagaagtctacacacagctatgtgaccatagattaatgagtgccgcagtgaaggatgaaagagcggtacatgctgacatggggtactggatcgaatcacaaaagaatgggagttggaaattagaaaaggcttcactgattgaagtgaagacatgtacttggcctaagagccatacgctgtggagtaacggtgttttagagagtgacatgataatcccaaaatcactagctggccctatttcacagcacaatcataggccgggatatcaaacacaaacagctggaccctggcatcttgggaaattagagttggattttaactactgcgaaggaacaacagtagttataactgaaaattgtgggacaagaggaccatccttaagaactactaccgtctcaggaaagttgattcacgaatggtgttgcagatcctgtacattaccaccactaaggtacatgggtgaagatggatgttggtacggcatggaaatcagaccgatcagcgaaaaagaggaaaatatggtgaaatcgctcgtatcggcaggatctggaaaagtcgataattttaccatgggagtcctttgcctagcaatactgtttgaagaaatgatgaggggaaaatttgggaaaaagcacatgatagccggtgtattctttactttcgtgctcctcctcagtggtcaaattacatggagagacatggctcacacattaattatgataggcagtaacgcaagcgatagaatgggtatgggagtaacatatctggcattaatagccgcgtttaaaatacaaccgtttttagcgttggggttctttttaagaaagttaaccagtagagaaaatctactcttaggagttgggttagcaatggcgaccacacttcaactccccgaagatatagaacagatggccaatgggattgcgttaggacttatggcattaaaattaattacacaattcgaaacatatcaactttggacagcacttataagcctaacatgctccaacactatgttcaccctaactgttgcttggcgtacagcaacgctaatattggccggagtttcattgctaccagtctgtcagagttcctccatgcgcaaaaccgactggttacccatggcagtagcagcaatgggtgtaccccctttaccattattcattttcagcttaaaagacactctcaaacgtcgatcatggccacttaatgaaggtgttatggcagtaggattagtatcaatattagcgtcgtcattgctgcgaaatgatgtgcctatggccggtccccttgtcgcaggaggactacttattgcatgctacgtaattactggtacatcagcagacttgacagtagaaaaagctgcggatataacatgggaggaagaagcagagcaaacaggggtaagccacaatttaatgataactgtcgatgatgatggcactatgcgcattaaagacgatgagacagagaacatattaacagttttgttaaaaactgcacttttaatcgttagcggggtcttcccttatagtatacctgctactctcttagtgtggcatacatggcagaaacaaacccaaagatcaggggtattatgggatgtcccatcaccgccagaaacacagaaggctgaactagaagaaggtgtgtaccgcattaagcaacagggaatattcgggaaaactcaggttggtgtcggagttcagaaagaaggagtattccatacaatgtggcatgtcacaagaggagcagttctaacatataatgggaaaagattagagccgaattgggcgagcgttaagaaagatctaatatcctatggtggcggttggagactttcggcacaatggcagaaaggggaagaagttcaagtaattgcagtagaaccgggcaaaaaccccaaaaattttcaaacgatgcccggaacatttcagacgaccactggagaaattggagcgatcgctctcgatttcaaacccggcacatctggatcacccatcataaatcgagaaggtaaagtcgtcggtctttatggaaatggggtggtcaccaaaaatgggggttatgtttcaggaatagcccagaccaatgcagaacctgatggaccaactcccgaactggaagaagaaatgtttaaaaagcgcaacttaacaatcatggacttgcatccaggtagcggaaagacacggaaatatctccccgcaattgtacgagaagcaataaaaagacgactaagaacattaatattagcgcctactagagtagttgcagcagaaatggaggaagcgctaaagggattacctattcgatatcagaccactgctacaaaaagtgagcatactggccgggaaattgtcgaccttatgtgtcatgcgacttttaccatgagattactatctccagtgagagtaccaaactataatttgattataatggacgaggcgcactttactgaccctgcgagcatagctgcacgtggatatatatcaactcgggttgggatgggtgaggctgcggcaatatttatgaccgctacgccaccaggcacagcagacgcatttccgcaatcaaatgctccgatacaggacgaagaaaaagatataccagagcgaagctggaactcagggaacgagtggataactgattttgcagggaaaactgtatggttcgtgccaagcataaaggcaggaaatgacatcgccaattgtctcaggaaaaacggcaagaaagttattcaactctcccgaaagacattcgatactgaataccagaaaaccaagctaaacgattgggatttcgttgtgacaacagatatcagcgaaatgggagctaattttaaagcagatcgagttatagacccgcggagatgtcttaaaccggtaattttgacggatggcccagaaagagtaatcttggccggaccaatgccagtcactgcagcgtcggctgcacaaaggcgaggacgagttggcagaaatcctcagaaagaaaatgatcagtatatttttacgggccaaccacttaataacgacgaagatcatgctcactggacggaagcaaaaatgttattagacaatataaacacaccagaaggaataattcctgctctttttgaaccagaaagagagaaaagcgcggcgatcgatggagaataccgtctaaaaggagagtctagaaagacgtttgtagaacttatgagacgaggagatctgccggtgtggcttgcgcataaggttgccagcgaaggtatcaaatacaccgacaggaaatggtgtttcgatggacaaagaaataatcaaatactagaagaaaatatggatgtggagatatggactaaggaaggagaaaagaaaaagttgcgaccccgatggctagatgccagaacatacagtgatcctttagcactcaaggagtttaaggactttgctgctggaagaaagagcatcgccctagaccttgttacagaaataggacgagtcccgtctcatctcgcccatagaacgagaaacgcattagataatctcgttatgttacacacaagcgaacatggcggacgagcatatagacatgccgtggaagaattacccgaaaccatggaaacgctactattattgggattgatgatcctacttaccggcggggccatgctctttttaataagcgggaaaggaattggaaaaacatccatcggtttaatttgtgttatagcatcaagcggaatgctatggatggcggaaattcctctgcaatggatagcatcagcaatagtattagaatttttcatgatggtgttattgataccggaaccagagaaacaacgtacaccccaagacaaccaattagcatacgtagtaattgggatcctcacactcgccgcaatcatagctgctaacgaaatgggactattagagaccacaaagcgagatctcggtatgagtaaagaacctggagtagtgtcccccacatcttatttggacgtagatttacaccctgctagtgcttggaccctatacgcagttgcaacaacagtgattacccccatgctacgccacactatagagaactctacagcaaacgtttcactagcagcaatcgcaaatcaagctgtagtactaatgggattggataaaggatggcctatatcgaaaatggacttaggggtacccctacttgcgcttggatgttatagccaagtaaatcctcttacgttgactgcagctgtattactgttaataacacattatgcgataatcggtcccgggctacaagcaaaagctactcgcgaagcccaaaaacgtactgctgcgggaatcatgaaaaatccaactgtagatggtataatgacaattgacttagatccagtaatatacgattcaaagtttgaaaaacagttaggacaagtcatgctcctagttttatgtgcagtgcaattattacttatgcgtacctcttgggctctatgtgaagctctaactctagctactgggcctataacaactctatgggaagggtctccaggaaaattttggaacactaccatagctgtttcgatggccaatatttttagggggtcttatttagcaggggcaggacttgcattcagtataatgaaaagcgtaggtacaggaaaacgaggcacaggtagccaaggggaaacgctcggcgaaaaatggaagaagaaattaaaccaactaagccggaaagagtttgacttatataagaaatctggtataaccgaagtagataggaccgaagctaaagaaggcctgaaacgcggagagaccactcaccacgcggtatcacgaggtacagccaaacttcaatggttcgtagagagaaacatggtaatccctgaagggagagtaatagacttaggatgtggaagaggagggtggagttattattgtgccggcctcaagaaagttacggaagtaagaggatacaccaaaggcggacccggacacgaggaacccgtaccaatgagtacttatggatggaacatcgtcaagctcatgtccggaaaagatgtattttatttgcctccagaaaagtgtgatactctactatgtgatattggagaaagctcacccagccccaccgtggaggaaagtcgcacaattcgagttttaaaaatggttgaaccttggttgaaaaacaatcagttttgtattaaagttttgaatccatatatgcccacagtaattgaacatctagaacgccttcaaaggaaacacggtggaatgcttgtacgcaatccattgagcaggaacagcactcacgagatgtactggatatctaacggtaccgggaatatagtggcctcagttaatatggtaagtcgactacttctaaacagatttacaatgactcatagacggccaacaatagaaaaagacgtcgatttgggcgcaggtacgagacatgtgaatgcggaaccggaaacacctaacatggatgtaatcggagagagaataaaacgaataaaagaagaacacaattccacatggcattacgatgatgaaaacccatacaaaacctgggcataccatggaagctacgaagtcaaagccacgggaagcgctagctcaatgatcaatggcgtagttaaacttctaaccaaaccttgggatgtagtaccaatggttactcaaatggcgatgactgacactactccctttggacagcaaagagtatttaaagaaaaggtagatactcggacgccacgcagtatgccaggaactcgaagggctatgggaatcactgcagaatggttgtggaggacactgggtcgaaacaagaaaccacggctgtgtacgagggaagagttcacaaagaaagtcagaacaaatgccgctatgggtgctgtatttactgaggagaatcaatgggacagtgctaaggccgcggtcgaagatgagaacttctggaaacttgtggacagggaaagagaactgcacaaacttggtaaatgtggatcatgcgtatataatatgatgggtaaaagggagaagaaattaggggaatttggaaaagccaaaggaagtagggcgatatggtatatgtggctaggtgcgcgatatttagaatttgaggcgctcggatttctaaacgaagaccattggttttcaagagagaactcttattcgggcgtagagggagagggtctacacaaactaggatacattcttcgagatatctccaagattccaggtggagccatgtacgccgacgatacggcaggttgggacacacgaatcactgaggacgatttacacaatgaagaaaagattactcaacaaatggatcccgaacacagacaattagcaaacgcaatttttaaactaacgtatcaaaataaagtagtcaaagttcaacgtcctactccgactggtactgttatggatatcataagtagaaaggatcaaagaggctcgggacaggtaggaacatatggtttaaacacttttaccaatatggaagctcaactaatacgccagatggaaggggagggggttctaagcaaagcagatttagaaaacccacacttaccagagaagaaaattacccaatggctagaaacaaaaggggtagaaaggctgcgaagaatggcaattagcggagacgattgcgtcgtaaaaccaatagacgataggttcgcgaatgcgcttttagctttaaatgatatggggaaagttcgtaaggatatcccccaatggcaaccaagtaaaggatggcatgactggcagcaagtacccttttgcagccatcatttccacgaattaataatgaaagacggaagaaagctagtagtcccttgccggcctcaggacgagctaataggtcgggcccggatctcacagggtgctgggtggagtctcagggaaacagcatgcttggggaaagcatatgcacagatgtggtcactaatgtatttccatagacgcgaccttcgattagccagcaacgcaatttgttctgcggttcccgttcactgggtaccgacatcaagaactacatggagcattcatgctcaccatcaatggatgacgaccgaagacatgttaacagtctggaatagagtatggatagaagataatccatggatggaggataagacccctgtcactacttgggaaaacgttccgtatctgggcaagagagaagatcaatggtgtggtagcttaatcggattgacgagtagagcaacgtgggctcaaaacattccaaccgcaattcaacaagtaagatcattgattggcaacgaggagttcctagattatatgccctcaatgaaacgttttagaaaagaagaagaatcggaaggagcaatctggtaa

SEQ ID NO: 23334 - RNA, 9873 nt, synthetic construct
  misc_feature 1..9873: note = derived and/or modified CDS sequence (opt6) from DENV-3__FJ024468__SS-prME
  source 1..9873: mol_type = other RNA
acttccctttgtttaatgatgatacttccggctgcattagctttccatttaacttcccgagatggagagccacgaatgattgttggcaaaaatgaaagagggaaatcattattatttaaaacggcttctgggatcaatatgtgcacgttaatagctatggatctcggagaaatgtgtgatgatacagtaacatataaatgtcctcatatcacagaggtagaacccgaagatattgactgttggtgcaatcttacaagtacttgggtaacctacggtacttgtaatcaagcgggagagcatcgcagagataaacgttcagttgcattagctcctcacgttggtatgggattagatacaagaacccaaacatggatgagtgcagagggagcatggagacaagtagaaaaagtagaaacgtgggcacttcgacacccaggattcacgatcttagctttatttctcgcacattatattggaacgtcattaacccaaaaagtagtcatcttcatcttattgatgcttgttacgccttcgatgacaatgagatgtgtcggtgtggggaatcgagattttgttgaaggattatctggtgcgacatgggtcgatgtagttctagaacatggaggatgtgttacaacgatggctaaaaataaacctacactagacatcgagcttcagaaaacagaggcaacgcaattagcaacccttcgaaaactttgtattgaagggaaaatcaccaacattactacagattcacgatgtcctacacaaggggaagccgtattacccgaagaacaagatcaaaattacgtatgcaaacatacttacgtggataggggatggggtaatggatgtgggctttttggtaaaggttcactcgttacatgtgccaaatttcaatgccttgagcctatagagggaaaagttgtacagtacgagaatctcaaatatacagtaataattactgtacataccggggatcagcatcaagtaggtaacgaaacacagggtgtgaccgcagagataactccccaggcatcaacgacagaagccatattgccagaatacggtacgttaggacttgaatgttcaccaagaacgggcctagacttcaatgaaatgatattactaacaatgaaaaataaagcatggatggttcatagacaatggttctttgacttacctttgccctggacttctggagcgacaacggagacccctacatggaacagaaaagaacttctagtaacatttaagaatgcacatgctaaaaagcaggaagttgtcgtattaggatctcaagaaggcgcaatgcatactgcattgacgggagctacagaaattcaaaacagcgggggtacgtccatatttgcaggccatttgaaatgtaggttaaaaatggataaattagaattaaagggtatgtcatacgctatgtgtacaaacacttttgttctaaagaaagaagtaagcgaaacccaacacgggacgatcctaataaaagtagaatataaaggagaagacgctccgtgtaaaatcccttttagtacggaagatggacaaggcaaagctcataatggcagactcataacggcgaacccagtagtgacgaagaaagaagaacctgtgaatattgaagcagaacccccattcggagaaagcaacatcgttataggaataggcgacaacgcgttaaaaataaactggtataagaaaggatcgagtataggaaaaatgtttgaagcgaccgctagaggagcacggcgcatggctattttaggagatactgcttgggattttggttctgtgggcggagtcttaaactcacttgggaaaatggttcatcagatctttggttccgcttatacagcattattctcgggtgtttcatgggttatgaaaatcggaataggagttctgttaacatggattggtcttaatagcaaaaatacaagtatgagcttctcatgtatagcaattggggtaataacattatacctaggcgccgtggttcaagccgatatgggctgcgttattaattggaaaggcaaagaacttaaatgtgggagtggtatattcgtaacaaatgaagttcacacctggactgaacaatacaaatttcaagcagacagtccaaagagattagcaactgcaatagccggtgcatgggaaaatggggtgtgtggaattagaagcacaacacgaatggaaaatttattatggaaacaaattgcaaatgaactaaattatatcctatgggaaaacaatatcaaactaaccgtagtagtaggagatataattggggtcttagaacagggtaaaagaaccctaacaccgcaacctatggagttgaaatattcttggaaaacttggggcaaagctaagattgtcactgcagaaacccaaaactcttcatttataatcgatggacccaatactccagaatgtccatctgcttccagggcgtggaatgtttgggaagttgaagactatgggttcggggtatttacaacaaacatatggcttaaattacgagaggtatacacacagttatgcgatcacaggctaatgtctgcagcagtcaaagacgaacgagctgtacatgcagacatgggatattggattgaaagtcagaaaaatggtagttggaaattagaaaaggcatccttaatagaagtgaaaacatgtacatggcctaaatctcatacactctggagcaatggtgttctagaatcagacatgattatcccaaagtcacttgccggaccaatatcccaacataattatcgaccaggctatcatacccagactgcgggcccgtggcacttgggcaaactcgaattggactttaattactgcgaaggtactacggtagtaattactgaaaattgtggaaccagaggtccgtcactacggaccacgacagtatctggaaaactaatacacgaatggtgctgtcgatcctgcactttgcctccgctcagatacatgggtgaagacggctgttggtatggcatggaaatcagacccatttcagagaaagaggagaatatggtaaaatccttggtaagcgcaggatcaggtaaagttgacaacttcaccatgggagttttatgtttagcaatattatttgaagaagtaatgagagggaaattcggaaagaaacacatgatagctggagtctttttcacatttgtcctattattgtcaggccaaatcacttggagggatatggcccacacattgattatgatcggttctaatgcaagtgacaaaatgggcatgggtgtgacttacttggccttaatagctacattcaaaatacaaccctttctagcgctaggattctttctcaggaaattaacaagtcgagaaaacctattgttaggagtaggactggctatggcaacaacattacagttacctgaggatatcgaacaaatggctaacgggattgcccttggcttaatggccttaaagttaataacacaattcgaaacttatcaactttggacagcccttatttcgcttacatgcagcaataccatgttcactcttactgtggcatggagaactgccacgctaatattagcaggagtaagtttattacctgtctgccaatcttctagtatgagaaaaacggattggttaccaatggcggtagcagcaatgggcgtaccaccattgccgctctttatttttagcctaaaagatactctcaaacgtaggtcatggccgttaaacgagggcgtaatggcagtaggcttagtgtccatattagcctccagcctattacgtaatgatgtaccgatggcgggtccccttgtagcaggaggtttgcttatagcgtgttatgtaataacaggtacgagtgctgatttgacagtagagaaagctgcggacattacgtgggaagaagaagcggaacagacgggggtatcacataacttaatgataaccgtggatgacgacggcacaatgcgaataaaagacgacgagacagaaaacatattaaccgtactattaaaaacggctctattgatagtgtcaggtgtgtttccgtattcaataccagcaacactattagtgtggcatacatggcaaaaacaaacccaacgaagcggagtattgtgggatgtgccatcgcctcccgaaacccaaaaagcagagttggaggagggcgtatatagaataaaacaacaagggatattcggtaaaactcaagtaggagtaggcgtgcaaaaagaaggtgtatttcatactatgtggcacgtgacacgaggagcagtacttacttataacggaaagcgtctagaaccgaattgggcttctgttaagaaagacctaatttcatatggtggtggttggcgtttatcagctcaatggcagaagggtgaagaagtacaagtcatagccgtcgagccagggaagaatcccaaaaatttccagacgatgccgggtacctttcaaacaaccacaggagaaattggtgctatcgcccttgactttaagccaggaacgagtggctcaccaataataaatcgagaaggaaaagtcgttggcctttatggcaacggcgttgtaactaaaaatggcggatatgtttccggcatcgcacaaacaaatgcagagcccgatgggcctacccccgaactcgaggaggaaatgttcaaaaagagaaacctaaccattatggatctccatccaggtagcggaaagacgcgaaaatatttgccggctatcgttagggaagcaattaaacgtagactgcgaacgctgattctggcgccgacaagagtcgttgcggcagaaatggaagaggcactgaagggattaccaattagatatcaaactactgcaacaaagtcagaacacacgggtcgagaaatagtagatttaatgtgtcacgccacatttacgatgagattattatctccagtaagggtgccaaattataatctcatcatcatggacgaagctcatttcacagatccggcctcaatcgcggcccggggatatatatccacaagagtcggtatgggcgaagccgcagcaatattcatgacagccaccccgcctgggacagcagatgcgtttccccaatctaatgctcccattcaagatgaagaaagagatatcccagagagaagttggaactcaggaaatgaatggataacggattttgctggtaaaacagtttggtttgttccgagtattaaagcaggcaatgatatcgcaaattgcctacgaaagaacggtaagaaagtaattcagttatcaaggaaaacattcgataccgaatatcagaaaacaaaacttaatgattgggactttgtagttacgacagatatatcggagatgggagcaaacttcaaagccgaccgagtaatcgatcctagacggtgcctaaaacccgtaatccttacggacggacccgaacgagtaatactggcaggaccaatgcccgtaacagctgcatctgcggcacaacgtcgcggacgagtcggtcgaaatccccagaaagaaaatgatcaatatatcttcactggtcaaccacttaataatgatgaagatcatgcacattggactgaagcaaaaatgttactagacaatataaacacccctgagggcataataccagcgctgtttgagccggagagggaaaagtcagctgcgattgatggagaatacaggctaaagggagagtcgcgaaaaaccttcgtagaattaatgaggagaggagatctacctgtatggttagcacataaagtcgctagcgagggaataaaatatacggataggaaatggtgttttgatggtcaaagaaacaatcagatattggaagaaaatatggacgtagaaatttggacgaaggaaggagagaaaaagaaactacgaccacgatggttagacgcgaggacatatagtgacccgttagcgttaaaagaatttaaagattttgcagcgggacgcaaatcaatagcgttagaccttgttacagagataggacgagtgccatcacacttagcacacaggacacgaaatgctcttgacaatcttgtaatgcttcacacgagtgagcacggaggacgtgcgtatcggcatgctgtagaagaactacctgaaacgatggagactttattacttttaggtctaatgatcctgctgacgggaggagcaatgctatttctaatatcggggaaaggaataggcaagacgagtattggcctaatatgtgttatcgcttcatcgggaatgttatggatggcagaaatacccttacaatggattgcatctgcaatagtcctcgagttctttatgatggttcttcttataccagaacccgaaaagcaaagaactccacaagataatcagttagcttatgttgtaatagggattctcacacttgccgccattattgcagcaaatgaaatgggactgctggaaactaccaaacgtgacttgggaatgtcgaaagaaccaggggtggtttcgccaacatcttatctagatgttgacttacatccagcaagtgcttggacgttatatgctgtcgcgactacagtaataacacctatgttaagacatacaatagagaactctacggcgaacgtttctctcgctgccattgcaaatcaagcggttgtactcatgggtttagacaagggatggcccatatcaaaaatggatctcggtgttccgttgcttgctctcggttgttattcgcaagtaaatcccttaactttaacagctgcagtcctattattgataacacactatgcaataatcggtccaggattacaagcaaaggcaacgagggaagcccaaaagaggaccgcggcaggtattatgaaaaacccaactgtcgatggtatcatgaccatagatttggatccagtaatatatgatagcaagtttgaaaaacagctaggccaggtaatgcttttggtcttgtgtgcggtacagctgctactcatgagaacctcatgggcactttgtgaagcgcttactcttgccacggggccaataaccacattatgggagggatcacccggaaaattttggaacacaaccattgcagtcagcatggcgaacattttcagaggaagttatctagcaggagcaggacttgccttctctatcatgaagtcagtggggacagggaaacgagggactggatcacagggcgaaacattgggagaaaaatggaagaaaaagttgaatcaattaagccgcaaagagtttgacttgtacaagaaaagcggaataacggaagttgatagaacagaagccaaagagggattaaaaagaggagaaacgacccatcatgcagttagtaggggaacagcaaagttacaatggtttgtagaaagaaatatggtcatacccgaaggaagagttatagatcttggctgtggacgcggaggttggagctattattgtgcgggccttaagaaagtaaccgaagtacgaggttatacgaagggtggaccaggccatgaagaacctgtacctatgtcgacgtacgggtggaatatagtaaaactaatgagtggaaaggacgtgttctatttaccgcccgagaaatgtgacacactactttgtgacattggtgaatctagtccatctcccactgttgaagaaagccgaaccattcgtgtgttgaaaatggtggaaccatggctgaagaataatcaattctgtatcaaagttttaaatccttatatgcccacagtgatagagcatttagaaagattacagagaaaacacggaggcatgctggtgagaaaccctctgtcaagaaactcgacacatgaaatgtattggatttcaaacggtacaggcaacattgttgcaagtgtgaacatggtgtcacgcctattgttaaacagatttacaatgacacaccgtaggcctacgattgaaaaggatgtagacttgggtgccggaaccaggcacgtaaatgctgaacccgaaacaccaaacatggatgtaataggggagaggatcaaacgcattaaagaagaacataattcaacgtggcattacgacgatgaaaatccttacaagacatgggcttatcatggatcttatgaagtaaaagctactggttcagctagctctatgataaacggggtagttaaactacttaccaaaccgtgggatgtcgtgccgatggtaacgcaaatggccatgactgatacaactccctttggtcagcaaagagtttttaaagaaaaagttgatacgaggaccccaaggtccatgcctggaacgaggagagtaatgggcattactgctgaatggctatggagaaccttaggtcgcaacaagaaacctcgactttgcacaagagaagaatttaccaagaaagttcgtactaatgccgctatgggcgcagtctttactgaagagaaccaatgggattctgctaaagcagccgtggaagatgaagatttctggaagttagtagatcgagaacgcgaacttcataagctaggaaagtgtggatcatgcgtatacaatatgatggggaaaagagaaaagaaattaggagaatttggcaaggctaaaggatccagggctatatggtacatgtggcttggagctcgatatctcgagtttgaggctttgggttttctgaacgaagatcattggtttagccgtgaaaattcttatagtggcgtagaaggtgaaggattgcataaactaggatacatactcagagatatcagtaaaataccaggtggagctatgtatgcagatgatacagcgggttgggataccagaataacggaggacgatcttcacaatgaggagaaaattactcagcaaatggatccagaacatagacagctggcgaacgctatatttaaacttacgtaccagaataaggtggtcaaagtacaacgcccgacgccaacaggaacagtaatggatataatatctaggaaggaccaacgcggatcaggccaggttggtacgtatggtctgaacactttcactaatatggaggctcaactaatacgtcagatggaaggcgagggtgtgctgtccaaagctgatctagaaaatccccacttgcctgagaagaaaatcactcagtggttagaaacgaaaggagtcgaaaggctacgcagaatggcaattagcggggacgattgtgtcgtgaaacctatcgacgaccggttcgctaacgcactattagctttaaatgatatgggcaaagtcaggaaagacataccacaatggcaaccgtctaaaggatggcacgattggcaacaagtgccgttctgttcccaccatttccacgaattgattatgaaagatgggcgtaagctagtagtaccgtgcaggccacaggacgagctgataggccgggcaagaataagtcaaggggcgggatggagtttacgagaaaccgcttgtttgggaaaagcgtatgcacaaatgtggagcctaatgtacttccacagaagagatcttcgattagcaagtaatgctatatgttccgcagtgccagtacattgggtaccaacgagcagaacaacctggtcaattcatgcacaccaccaatggatgacgacagaagacatgttaacggtatggaatagagtttggattgaagataacccatggatggaagacaaaacgcccgtgacgacttgggaaaacgtcccatatctagggaaacgtgaagatcagtggtgtggaagtttaataggattgactagccgcgctacatgggcacagaacattccaactgctattcaacaagtgaggtcgttaattggaaatgaggagttccttgactatatgccaagcatgaaaagatttcggaaagaagaagaatctgaaggcgccatatggtag

SEQ ID NO: 23335 - RNA, 9873 nt, synthetic construct
  misc_feature 1..9873: note = derived and/or modified CDS sequence (opt6) from DENV-3__FJ024470__SS-prME
  source 1..9873: mol_type = other RNA
acatctctatgcttgatgatgatattgccggcagcgttagcgttccaccttacttcaagagacggggaacctagaatgatagtcggcaaaaatgaacgcgggaaatcacttctttttaaaacggccagcgggataaatatgtgtactctaatagcaatggatctaggggaaatgtgcgatgatactgttacttacaaatgtcctcatataacagaagttgaacctgaagacatagactgttggtgtaatcttacgagtacctgggttacttatggtacgtgcaaccaagctggagaacaccgaagagacaaaagatccgtagccttagcgcctcatgtgggcatgggattagacacaagaacgcaaacttggatgtcggcagaaggggcatggcggcaagtcgaaaaagtagaaacctgggcactacgtcatccaggattcacaatcctagccctgtttctagcgcattatatagggacatcactaacacaaaaagtcgtcatattcattttactaatgttagtaactccaagtatgacaatgcgatgtgtgggtgtagggaacagggactttgtagaaggactatcgggagcaacttgggtggacgttgtactagaacatggtggctgtgttactaccatggctaaaaataaacccactctggatatagaattacaaaagacggaagccacacaattagcaacattacgaaaactatgtatagaaggcaaaataactaatattacaactgattcgagatgtccaacccaaggagaagcagcgctaccagaagaacaggatcaaaactacgtttgtaaacatacatacgtagacaggggatggggtaatggatgtgggctattcggtaaaggatctcttgtaacttgtgcaaaatttcagtgtctagaaccgattgagggtaaagttgtacaatatgaaaatctaaaatatactgtgataattacagtacacactggtgatcaacatcaagttggcaacgaaacgcaaggtgtgacagcagaaataacacctcaggcgtcaacaacagaggctatacttcctgaatacggaacactgggacttgaatgctcccccagaacaggacttgacttcaacgagatgatcttattaacaatgaaaaataaagcgtggatggttcataggcaatggttcttcgatctaccgttaccatggacctccggtgccacaacagaaactccgacatggaatcggaaagaactgttagtaacgttcaaaaatgcacatgccaagaaacaagaagttgtggttttaggctcacaggagggagcaatgcacacagccctaacaggagcaacagaaattcagaatagtggtggtacctcaatttttgctggccatttaaaatgccggcttaaaatggacaaactggaattaaaaggaatgtcatacgcaatgtgtacgaatacattcgtccttaaaaaggaggtatccgaaactcaacacgggaccatactaattaaggtagaatataaaggtgaggacgttccatgtaagatacctttttcaacggaagatggtcaaggtaaagctcacaacggcaggttaataacggcaaatccagtggtcacaaagaaagaggaacccgtaaatatagaagcagaacctccgtttggagagtcaaatatagtaatcggtataggggataacgcgttaaaaataaactggtacaagaaaggttcctcaataggtaagatgttcgaagcaacagccaggggagctaggcgaatggcgatcctaggtgacacagcttgggatttcggctcagtgggcggagttttaaattcgctaggcaaaatggtacaccaaatattcggaagcgcctacacggctctattctcgggcgtttcttgggtaatgaaaataggaattggagttttacttacttggatcggactaaacagtaaaaacacgagtatgagttttagctgcattgcgataggtataatcacactatatttaggcgctgtagtacaagctgatatgggttgcgttattaactggaagggcaaagaattaaaatgcggctccggtatatttgtaacaaatgaagtgcatacgtggacggagcaatacaagttccaggccgacagccctaagcgattggcaacagctatagcaggagcctgggaaaacggggtgtgtgggataagatcaacaacaagaatggaaaatctgctatggaaacaaatagctaatgaattaaattacatactatgggaaaacaatattaaattaacggtagttgttggtgatataataggggtacttgaacaaggaaaacgaacactaacaccacaacctatggagctaaaatacagttggaaaacctggggtaaggctaaaattgtaaccgcagaaactcagaacagttcatttatcatcgatggtccaaacactccagaatgcccttctgcaagtcgcgcgtggaatgtgtgggaagtcgaggactacgggtttggggtatttacgactaatatctggctgaagttacgtgaggtttacacgcaattatgcgatcacaggttgatgtcagcagccgtaaaggatgaacgggccgtccacgcagatatgggatattggattgaaagtcaaaagaacggttcatggaaattagaaaaagcatctcttattgaagtaaaaacttgtacatggcctaaatcgcacaccctgtggagcaatggtgtactagaatctgatatgatcataccaaagagtctagcaggaccaatcagtcaacataatcataggccaggatatcatacacaaacagctgggccatggcacttggggaaacttgaactggatttcaactactgtgagggaactaccgtagttataacagaaaattgcggtacacgtggtccgtcactaaggacgactacggttagtggaaagttgatacacgaatggtgctgtcgatcttgcacgcttccgccacttaggtacatgggggaagatggatgctggtacgggatggaaataagacccatcagtgaaaaagaagagaacatggttaagagtttagtttcagccggtagtgggaaagttgacaattttacaatgggtgttctatgtttagcaatcctatttgaagaagtgatgcgaggcaaatttggcaagaaacatatgatagccggtgttttctttacatttgtattattactctcaggtcagataacgtggagagacatggctcataccctaattatgattggcagcaatgctagcgatcgaatgggtatgggagtaacgtacctggcccttatagcaaccttcaaaatacaaccatttttagctctagggttctttctccgcaagttaacgtcccgagaaaatctacttttaggagtgggtcttgctatggcaactactttacaactaccggaagatatcgaacaaatggctaatggaattgcgttaggactaatggcactgaaactaataacccaatttgaaacatatcaactgtggactgctctgatcagtctcacatgctctaacaccatttttacgctaacagtagcgtggcgcaccgcaacattaatactagccggtgtcagcttactcccggtatgtcaatccagttctatgagaaaaacagattggttgccaatggcagtcgcagcgatgggagtaccaccgttaccgcttttcattttcagtctcaaggacacccttaagcgacgtagttggcctcttaacgaaggggttatggcggtcggcctcgtaagtatattagcttctagcttgctacgcaatgacgtacccatggcaggacctctagtagccggcgggctactgattgcctgctacgtgataacagggacttcagccgatctcactgttgaaaaagcagccgatataacgtgggaagaggaggcagaacagactggagtttctcacaacttgatgattaccgttgatgatgatggaacaatgaggattaaagatgatgaaaccgagaatatattaacagtacttctgaagacagcattattgattgtttcaggcatatttccatacagtatccctgcgacgctcctagtctggcatacttggcaaaaacaaacacaacgaagtggtgtcctttgggacgttccttctccacccgagacacaaaaagcagagcttgaagaaggcgtatatcgtattaaacaacaaggcatttttggtaaaactcaagtcggcgtaggagtacaaaaagaaggagtatttcatacaatgtggcacgtcacaaggggcgctgtactaacatataacggaaaacgattagaaccaaattgggcaagcgtgaagaaagatctaatatcatatggagggggatggagactgagcgcgcaatggcaaaaaggcgaggaggtacaagtaattgctgttgagcccggaaagaatcccaaaaactttcaaaccatgccaggaacattccaaacaacaacaggtgaaattggcgcaattgctttagactttaaacctggaactagcggtagccctattatcaatcgagaagggaaggtagttggattatatggtaacggcgtcgtgaccaaaaatggaggatatgtctccggcatagcacaaacaaacgctgagccagatggccctacacccgaactagaagaagaaatgtttaaaaagcgtaatctaactataatggatctccatccgggatcaggtaaaactaggaaatatctgcctgcaatagtacgtgaagctataaagagacgactccgaacactgatattagctcctactagagtagtagccgctgaaatggaagaagctcttaaaggcctcccaataagatatcaaactactgcgactaaatccgagcatactggaagagaaatagtggatctgatgtgtcatgccactttcacaatgaggctactaagcccagtacgtgtcccaaactataacctgattataatggacgaagcacactttacagatcccgcgtcgatagcagcgagaggatatatcagtacgcgagtaggaatgggtgaagcagctgcgatttttatgactgcaaccccgccgggaacagccgatgccttccctcaaagtaatgcacccattcaagatgaagagagggacattccggaacggtcatggaatagcgggaacgaatggataactgatttcgctggaaaaacggtatggtttgtcccatctataaaggcagggaacgatatagctaactgtcttaggaaaaatgggaagaaagttattcaactaagtcgaaaaacattcgatacagagtatcagaaaacaaaattgaatgattgggacttcgtagtaactaccgatatttcggaaatgggagcgaactttaaagccgatcgagtaatagacccacgtcgttgtctcaaacccgtaatattaactgatggacccgaacgggtgattctggctggaccaatgccggtaactgccgcaagcgcagcccaacgaagaggcagagtgggtcggaatccgcagaaagagaacgaccaatacatctttacgggacaaccattaaataacgacgaggatcacgcacactggactgaagcaaaaatgctgcttgataatataaataccccagagggaataataccggcattatttgaaccagagcgagaaaaatcagcagcaatagacggagaataccgcctaaagggagaaagcagaaagacttttgtagaattgatgcgccgcggtgacctgccagtctggttagcgcacaaagtagctagtgaaggaatcaagtatactgacaggaaatggtgcttcgacggacaacggaacaaccaaatattagaagaaaacatggacgttgaaatatggacaaaagaaggagagaagaagaaactgagaccacgatggttagacgcccgtacatatagtgatcctcttgcactaaaagaatttaaagactttgcagcggggaggaaatcaatagcgctagatcttgtaactgagataggcagagtcccatctcatctagctcataggacgagaaacgcgctagataatttggtcatgctacatacatcagagcatggagggagagcctatcgacatgcagtggaagaattaccagaaacaatggaaactctcttactacttggactcatgatattgctgacgggtggcgcaatgctttttctgatctccggcaaaggaatcggcaaaacctccatcggcctaatctgtgttatagcaagttcgggtatgctttggatggcagagataccgttacaatggatagcctcggcgatagtcctagagttcttcatgatggtattattaataccagaacccgagaaacagcgtacaccgcaagataatcaattagcttacgtggtgatcggtattttaaccttggcagcaattatagcagcaaacgaaatggggctgcttgaaaccacaaaaagggatttagggatgtcaaaagagcctggggttgtttcaccaacctcctacttagatgtcgacttacatcctgcgagtgcttggacactttatgccgtagctaccactgttataacaccaatgcttaggcatactattgaaaattctacggcaaatgtatctctcgcagctattgctaaccaggctgtagtgcttatgggattagataaaggatggccaataagtaaaatggatttaggcgtacctcttttagcattgggatgctacagtcaggtcaatcccttaactctaaccgctgcagttttattgctaataacacattacgcaataataggacctgggctacaggccaaagcgacgcgagaagctcagaaaagaaccgcagcgggcataatgaagaatccaaccgttgacggcattatgactatagatttggatccggttatctatgatagtaaatttgaaaaacaacttggacaagtaatgcttttagtcttatgtgcagtacaactacttttgatgcgcacgagttgggcattatgtgaagcattaactttagcaacaggccctattactacgttgtgggaaggaagtccagggaaattttggaacaccaccatagccgtctctatggctaatattttccgagggtcctatttagccggtgcaggtctagcattttctataatgaaaagcgtaggaacaggcaaacgtggtacgggctcgcagggggaaactctaggtgagaaatggaagaagaaattaaaccaactatcaaggaaagagttcgacttatataaaaagtcagggataaccgaagtagaccgtacggaagctaaggaaggtttaaaacgaggagaaataactcatcatgcagtcagccgcggctcagcaaagctgcagtggttcgtcgagagaaatatggtgataccagaagggagagtaatagacttaggatgtggtcgcggtggatggtcctattactgcgcggggctcaagaaagtaacggaggtaagaggctatacaaaaggaggacctggccatgaagaaccagttcctatgtcaacatacggctggaatatagttaaactcatgagcggtaaggacgtattctacttgcccccagaaaagtgtgataccctattgtgtgatataggtgaatcttcaccgtcgcctacagttgaggaatcacgcactatacgtgtactgaagatggtagaaccttggctcaaaaacaatcagttctgcatcaaagttttaaacccctacatgccgaccgtcatcgaacatcttgaaaggttgcaaagaaaacatggagggatgctggtaagaaatcccctttcaagaaacagcacacacgagatgtattggatcagtaacggtacaggtaatatagtagcctcagtaaacatggtatctaggctattactgaacaggtttacaatgacccatagaagacccacaatagaaaaagacgttgacttaggcgctggcacacgacatgtaaatgctgaacctgaaacaccaaatatggatgtaataggagaacgaataaagcggatcaaagaagaacacaatagtacttggcattatgacgatgaaaacccttataaaacttgggcttatcatggttcttacgaagtcaaagcaactggatcggcatcaagcatgatcaatggagtcgtaaaattgttaactaaaccatgggacgtagtacctatggtcactcagatggcaatgactgatacaaccccttttggacaacagagagtcttcaaggagaaagtagatacgagaactccgaggtcaatgccaggcacaagacgggtaatgggtataacggcagagtggttatggagaacgctaggaaggaacaaaaagcctaggctatgtacacgtgaagagtttaccaaaaaggtaagaacaaatgctgcaatgggtgctgtattcactgaagaaaatcagtgggacagtgcaaaagcagccgtagaggacgaagatttttggaagttagtagatcgcgaaagagaactacacaaattggggaaatgtggatcttgtgtatacaatatgatggggaaacgtgagaagaaacttggagaatttgggaaagctaaaggcagcagagcaatctggtacatgtggttgggtgcgcgatatttagagtttgaagcgttaggctttttaaatgaagaccactggttcagtcgtgaaaattcatacagcggagtcgaaggagagggcttgcataaattaggctatatcttacgtgatatatccaaaatcccaggtggagctatgtatgctgacgatacagctggctgggataccagaattacagaagacgatttgcataacgaagagaaaattacccaacaaatggacccagaacataggcaacttgcaaacgcaattttcaaacttacttatcaaaacaaggtagttaaagtacagagacctacaccgactggaacagtaatggatataatatcgcgaaaagatcaacgcgggtcaggccaagttggcacatatggcctaaatacttttactaatatggaagcccaattaatcaggcaaatggaaggggagggagttctaagtaaagccgatctagaaagccatcacctcccggagaagaaaataacacaatggttagaaacaaaaggagtagaacgtctaaagagaatggcaatatccggggacgattgtgtagtaaaaccgatcgatgacaggtttgcaaacgcattacttgcgcttaacgatatgggtaaggttagaaaagatataccgcaatggcaaccgtcaaaaggctggcatgattggcagcaagtccctttttgtagtcatcattttcatgagcttataatgaaagatggtagaaaattggttgtgccatgccggccccaagacgaattaataggtcgagcgagaatctcacaaggcgctggatggtcattgagagagacagcctgcctaggaaaagcatatgctcagatgtggtctcttatgtactttcatcggagagatttgagattagcttccaacgccatatgttctgcagtacctgttcattgggtacccacatcaagaactacttggtccattcacgcgcaccatcagtggatgacaactgaagatatgctgactgtatggaaccgagtctggatcgaggacaatccatggatggaggacaaaacacccgtaacgacttgggaaaacgtgccttacttaggaaaacgtgaagatcaatggtgcgggtccttgataggactgaccagtagagcaacatgggcacaaaatattccgactgcaatccaacaagtcagatcactaatcggaaatgaggagttcttagattatatgccatctatgaagagatttagaaaggaggaggaaagtgagggtgctatatggtaa

SEQ ID NO: 23336 - RNA, 9873 nt, synthetic construct
  misc_feature 1..9873: note = derived and/or modified CDS sequence (opt6) from DENV-3__FJ024471__SS-prME
  source 1..9873: mol_type = other RNA
acgtcattatgtctaatgatgattctacccgcggcactagcgtttcatttaacgtcaagggacggagaacctagaatgattgtcggcaaaaatgaacggggtaaatcactactctttaaaactgcttctggaattaacatgtgtacgcttatagctatggacttaggtgaaatgtgtgacgacacagttacctataaatgtccgcatattactgaagtagaacctgaagatattgattgttggtgtaatctaacatccacctgggtaacctatgggacgtgtaaccaagccggtgaacacagaagagacaaaaggtccgtagcattagctccacacgtcggtatgggattggatacaagaacccaaacctggatgagcgcggaaggtgcatggagacaagtcgaaaaagtggagacatgggcgttgagacacccaggatttaccatcctggcattatttctggcacattacataggtacctcactcacacaaaaagttgtgatatttattctacttatgttggtaacaccgtcaatgaccatgcggtgcgttggtgtggggaatcgggactttgttgaaggtttatccggagcaacatgggtagatgttgtcctggaacatggaggctgtgtgactacaatggctaaaaataaaccaaccctagacatagagctacagaaaactgaggcaacgcaactggcaacattgcggaaattgtgcatagagggaaaaatcacaaacataaccacagatagtcgatgtcctactcaaggtgaggcagcacttccagaagaacaagaccaaaattatgtatgtaaacacacatatgtagaccgaggttggggtaatggctgtggattatttggaaaagggagtttagtaacatgcgccaaatttcaatgcttagagccaatcgaaggaaaagtagtacaatacgaaaacttgaaatacaccgtaataattacggtacacacaggagatcaacatcaagttggaaatgaaacccaaggagttacggccgaaatcacaccccaggcttcaacaactgaggcgatattaccggagtatgggacactcggactcgaatgcagcccccggactgggttagactttaatgagatgattttattaaccatgaagaacaaagcctggatggtgcatcgacaatggttctttgatctacctttaccatggacatcgggagctactacagaaaccccaacttggaatcgaaaagagctcttggtcacattcaaaaacgctcatgcgaaaaagcaagaggtagtagtattgggttcccaagaaggagcgatgcacacagcattaacaggagctactgaaatacaaaatagcgggggaacatcgatatttgctggacatttgaaatgcagactcaaaatggataaacttgaattaaagggcatgagttatgcaatgtgtacaaacactttcgtacttaagaaagaagtaagtgaaactcaacacggtacaatacttatcaaagtagaatataagggcgaagacgtaccatgcaagataccattttcgacagaagatggacaaggaaaagctcataatggacgtttaataaccgctaatcccgttgtcacaaagaaagaagaaccggtaaacattgaggccgaaccaccatttggagaatccaacatcgtaataggaatcggtgataatgcacttaaaataaattggtacaagaaagggtcatcaataggaaaaatgttcgaggccacggctcgaggagctaggagaatggcgattctaggagatacagcatgggattttggatctgtaggaggcgtactaaattctctaggaaaaatggtgcaccaaatatttggatccgcatacactgcattattcagcggtgtatcctgggtcatgaaaatagggataggtgtgttgctaacctggataggattgaactcgaaaaatacaagcatgtctttctcatgtatcgctatagggatcataacgctatacttaggggcagtggtacaagccgacatgggctgtgtgatcaactggaaaggtaaagagttgaaatgcgggtctggtatattcgtaacaaacgaagtacatacctggactgagcaatacaaatttcaagcagattcaccaaaaagattggcaactgcaatagcaggcgcatgggaaaatggagtttgcgggataaggagcacaacaagaatggagaacttactttggaaacaaattgcaaatgaattaaactatattctatgggaaaacaacattaagttgaccgtagtagtcggtgatataattggagtactcgagcaaggaaaacggacgttaactccccaacccatggagttaaaatactcatggaaaacttggggaaaggcgaagatagttacagcggaaacacagaacagtagttttattatagatggaccaaatacaccggaatgcccatcagcttctagagcttggaatgtatgggaagtagaagattatggatttggagtcttcacaacaaacatatggttaaaattacgcgaggtctacactcaattatgcgatcacagactaatgtcagccgctgtaaaagacgaacgtgcagttcacgcagatatgggttactggatagaatcacagaaaaatggttcatggaaattagaaaaagctagtttgatcgaggtaaaaacttgtacatggcccaaatcacacaccctatggtcgaacggagtactagagtcagacatgataattcccaagtcattagctggtcctatatctcaacacaatcatcgacctgggtatcatacccagaccgcgggaccatggcacttaggaaaattggagttagactttaactattgtgaagggacaacggtggtgataacagaaaattgtggaactcgtggaccatctttacgaacaactacggtatcaggaaaattgatccatgaatggtgttgtaggtcttgtactctcccacctcttagatatatgggagaggatggatgctggtatggaatggaaataagaccaatcagcgagaaggaagaaaatatggtgaaatcattagtaagcgctggcagcggtaaagtagataatttcacaatgggcgttctctgcttggcaatcttattcgaagaagtgatgagaggcaaattcggcaagaaacatatgattgcaggagtattctttacctttgtgcttctccttagcgggcaaataacatggagagatatggcgcacacattaataatgattggctccaatgctagtgatcgcatgggaatgggggtgacttatctggcattaatcgctacattcaagattcaaccatttttggctctaggatttttcctaagaaagctaacaagtagagaaaatttactactaggtgttggtctagccatggcaacaactttacagcttcctgaagacatagaacagatggcaaatggaatcgcattgggtttaatggccttgaaactgataacacaatttgaaacgtaccaactatggaccgcattaatttctcttacgtgtagcaatacaatatttaccctcacggtggcatggagaactgccacacttatattagctggcgtttcactcctaccagtttgccaatccagtagcatgaggaaaactgactggttgcctatggctgttgcggcaatgggtgtacctccactaccgttgtttatattctcgctaaaagacactttaaagagaagaagttggccccttaacgaaggtgtaatggctgtcggtctagtaagtatacttgcttcttcactacttcgaaatgacgttccaatggctggtcctctagtagccggtggactccttatagcatgttacgtaattactggaacaagtgcggatttaacagtagaaaaagctgcagatataacatgggaggaagaagcagaacaaacgggggtatcacacaatttaatgattactgttgatgatgacggcactatgcgcatcaaagatgacgaaacagaaaatattttaacagtcttacttaaaacagcattattaatagttagcggaatatttccatatagcataccagctacgttactggtttggcacacatggcagaagcaaacgcaacgttctggcgttctgtgggatgtccctagcccacccgaaactcaaaaagccgaactagaagagggagtatatagaatcaaacaacaaggaatttttgggaaaacacaagtcggagttggcgtacaaaaggagggagtctttcatacaatgtggcatgtaacgagaggggcggttttgacttataatggcaaacgcctagaacctaactgggctagtgtcaagaaagacctaatctcttatggaggtggttggcggctatcagcacaatggcaaaaaggagaagaggtccaagttattgcagtagagcctgggaagaatcccaaaaactttcaaacaatgccaggaacctttcagactactactggggaaataggagcgatagccttagattttaaaccgggcacaagcggaagtcccataataaaccgagaaggtaaagtagttggactatatggtaatggggtggtaacgaaaaatggaggttatgtgtctgggatagctcaaactaatgcggaaccagatgggccgacccctgaattggaagaagaaatgtttaagaaaagaaacctaacaattatggatctccaccctggatcagggaaaacacggaagtaccttccagccatagtacgcgaagcgataaaaagacggctacgtacgttaatattagcccccactagagtggttgctgcggagatggaagaagccttgaagggattgccgatacggtaccaaacaacagcaaccaaaagtgaacacacaggccgtgagattgtagatttgatgtgtcatgcaactttcacaatgcgcttactaagtcccgtgcgagtacccaactataacttaatcataatggacgaggcacacttcaccgatcctgcaagtatagctgcaaggggttatataagtacacgtgtaggaatgggagaagcggcagctatctttatgaccgctactccaccgggaacagctgacgcatttccgcaaagtaatgcgcctatacaagacgaagaacgggacatcccagaaagaagctggaatagcggcaacgagtggataacagattttgcaggcaaaacagtctggtttgtcccgtcgatcaaggccggtaatgatatcgcaaactgcctaaggaaaaatggcaagaaggtcatccagctctctcggaaaacatttaatacagaataccagaaaactaaactaaatgattgggattttgtggtcacaacagatatcagcgaaatgggggcaaatttcaaagcagaccgagtcatagatccgcggaggtgtttaaaaccggtcattctcacagacgggccagaacgcgtgattctggctggaccgatgccggtgactgcagctagtgctgcgcaacggcgaggacgagtaggtagaaacccacaaaaagaaaatgaccaatacatttttaccggacaacccttaaataacgatgaggaccatgcacattggactgaagctaaaatgcttttagacaatattaacacaccagaagggataattccagctctcttcgaaccagagcgagaaaaatcagctgcaattgacggagagtatagacttaagggggaatcccggaaaacttttgtagaacttatgcgacgtggcgatttacccgtttggctagcccacaaagttgcaagcgagggtattaaatatacagacaggaaatggtgctttgacggacagagaaacaatcagatcttggaggaaaacatggacgtggaaatctggacaaaagagggggagaaaaagaaattacgtcctcgctggctagacgccagaacatattcagatcccttggcacttaaagaatttaaagacttcgccgcaggaaggaaaagtatagcactcgatttagtaacagaaataggtcgtgtcccctcgcacctagcgcacagaacgagaaacgcgttagacaatttggtaatgttacatacaagtgagcatggcggcagagcataccgtcatgcagtagaagaattaccagaaacgatggagactttactcttattaggtttaatgatactattaacaggtggagcgatgttgtttctgatttcggggaagggtataggtaaaacttccattggtctaatttgcgtgatagccagctccggaatgttatggatggctgaaataccattgcaatggatagcgagcgcaattgtacttgagtttttcatgatggtcttactcataccagagcctgaaaaacaaagaacccctcaagataatcagttagcttacgtcgttattggcattctgactttagcagctataattgcagcaaatgaaatgggattactagaaaccacgaaacgggacttaggaatgtctaaggaacctggggtagtcagtcctacaagttatcttgatgttgacctgcatccagcttcagcatggactctctacgcggtggcaacaaccgtgatcactccaatgcttcgacatacaatcgaaaattcaacggctaatgtatcccttgccgcaattgcgaaccaagcagtggtactgatgggtttggacaaggggtggccgatatcgaaaatggatttgggtgttcccttattggccttaggatgttattcccaagtcaatccactaactttgacagccgcagtacttttgttaataactcattacgcaataattggaccaggactacaagcaaaagcaacgcgcgaagcccaaaaacgaacggcggcaggaattatgaaaaatcctactgtggatggtataatgacaatagacttagacccagtcatatacgattcaaagtttgagaaacagcttggccaagttatgctattagtgttatgcgccgtacaattactattaatgaggacctcttgggcactatgtgaagcactaactctcgctaccggacctatcacgacactttgggaagggagccctggaaaattttggaacacaaccatagctgtgtctatggcaaacatttttagaggtagttacttagccggtgcaggtttggcattctcaataatgaaatcggtagggacgggtaaacgaggaacagggtcacagggtgagacattgggagaaaaatggaagaagaaattaaatcagctcagtagaaaagagttcgatttatataagaaatcgggaataactgaagtagatcgaactgaagccaaagagggtttgaagagaggagagataacccatcatgcagtttcacgtggtagcgcaaaactccagtggtttgtggaaagaaatatggtcataccagagggaagagtcatagatcttggttgcggtcgaggaggatggtcttactattgtgcgggactaaagaaagttaccgaagttcgcggatacacgaaaggaggtcccggtcacgaagaaccagttccaatgtccacttacgggtggaacatagtcaaactaatgagtggaaaagatgtattctatttgccaccagagaaatgcgacactctgctatgcgacataggagaatcctcaccctcccccacagtagaagaatctcgcactataagagttttgaagatggtagaaccctggctcaaaaataatcaattttgtattaaagtcttaaatccatacatgccaacagttatagagcatcttgaaagattgcagaggaaacacggtggaatgctcgtaagaaaccctctaagcagaaacagcacccacgaaatgtattggatcagtaatggaacaggaaacatcgttgccagtgtgaacatggtatcacgactcctactaaatcgatttacgatgacccaccggcgtcctacaatagaaaaagacgttgaccttggagcaggaactcgccatgtgaatgctgagcccgaaacgcccaacatggacgttataggtgaaagaattaaaagaattaaagaggagcacaacagcacctggcactatgacgacgagaatccatacaagacatgggcatatcatggatcgtatgaagtcaaggcaacaggctctgcttcttcaatgattaacggtgtagttaaattacttaccaaaccttgggacgtagtaccaatggtcacccaaatggctatgaccgatacgacaccctttggccaacaacgtgttttcaaggaaaaggtggatactcgtacccctcgctctatgcctggaacgcgccgagttatggggataacagctgaatggctatggaggacattaggacgcaataagaaaccaagattgtgtacacgtgaggaatttactaagaaagtcaggaccaatgctgcaatgggcgctgtattcaccgaagaaaatcaatgggatagcgccaaagcagccgtggaggatgaggatttctggaaactggtagacagggaacgtgaattacacaaattgggaaagtgcggaagctgtgtttataatatgatgggaaaaagagaaaagaaactaggagagttcggaaaagcgaaaggatctagagctatatggtacatgtggttgggtgcgcgatatctcgaatttgaggctttagggtttttaaatgaagatcattggtttagtagagaaaatagctactcaggagttgaaggagaaggactacacaagctagggtatatattaagagatattagtaagattcccggaggtgcaatgtatgcagatgacacagcgggatgggatacccgaattaccgaagacgacttacataatgaggagaaaataactcaacaaatggacccagaacaccgacagttagcgaacgcaatatttaaactaacctaccagaacaaagtcgtcaaggtgcaacgacccaccccaacgggaacggtaatggacattataagtcgcaaagatcaaagaggatcaggccaagtaggaacgtatggactaaatacattcacaaatatggaggcccaactgattaggcagatggagggagagggagtactcagtaaggcagacttagaaagtcaccatctgagcgaaaagaaaataactcagtggttagaaacaaagggcgtagaacgcttaaagagaatggctattagcggagatgattgtgtagtaaaaccaattgatgatagatttgcaaatgccctcttggcgttgaatgatatgggcaaggtccgaaaagacatacctcagtggcaaccgagcaaagggtggcacgattggcaacaggtaccattttgtagtcaccatttccatgaactaataatgaaggacggtcgaaagttggttgtaccatgccgaccacaagacgaactaataggcagagcaagaatttcacaaggcgccggctggagcctccgagaaactgcctgtctcggaaaagcgtatgctcaaatgtggtcactgatgtactttcataggagagatctaagattagcctcaaacgctatatgctccgcagtaccagtccattgggtccctacttctcgtacaacatggagtatacatgcgcatcatcaatggatgactactgaagacatgctaacggtttggaatcgagtgtggatagaagacaatccatggatggaagataaaacaccagttacaacatgggaaaatgtaccatacctgggcaaaagggaagaccaatggtgtggaagcctgattggtctgactagcagggcgacttgggcgcaaaatataccaaccgcaattcaacaagtacgaagccttattggcaacgaagagttcttggattatatgcccagcatgaaaagattccgcaaagaagaggaatctgaaggtgcaatatggtaa

SEQ ID NO: 23337 - RNA, 9873 nt, synthetic construct
  misc_feature 1..9873: note = derived and/or modified CDS sequence (opt6) from DENV-3__FJ182005__SS-prME
  source 1..9873: mol_type = other RNA
acgtctctatgtctgatgatgatcctaccagcagcgcttgcatttcacctcacttcgagagatggagaaccccgtatgatagttggcaaaaatgaaaggggaaaatccttactattcaaaacagcttcaggaatcaacatgtgcacattaatcgcaatggatttaggagaaatgtgtgatgacacagtgacatataaatgccctcatataactgaagtagaaccagaagacatagactgctggtgcaatcttacaagcacgtgggtcacatatggcacatgtaatcaagcaggggagcatagaagagataaacgatctgtcgcattggcgcctcacgtaggaatggggctagacacacgcactcaaacctggatgtcggctgaaggagcttggcgccaagtcgaaaaagtcgaaacttgggcattaaggcatccaggattcacaattctagcacttttccttgctcactatatcggaacaagtttaacgcaaaaagtggtcatttttattctgttaatgctggtaacaccatctatgactatgcgttgtgtgggagtgggaaaccgagatttcgtggaaggtctatcaggtgccacatgggtggatgtagttttagaacacggaggttgcgtcacgactatggccaaaaataaaccaacgctcgacatagaattgcagaaaacagaagcaacccaacttgctactcttaggaaattgtgtatcgagggtaaaattaccaatataacgaccgactcaaggtgtccaacgcaaggagaagcagtcttaccagaagaacaagatcaaaactatgtgtgtaaacatacctacgttgatcggggttggggtaacggatgcggactattcggaaaaggttcattagttacatgcgccaaattccaatgtttagaaccgatcgaaggtaaagttgtccaatatgaaaaccttaaatatactgtgattattacggtgcatacaggtgaccaacatcaagtaggtaatgaaacccaaggagtaactgcggaaataacaccacaggcttcaaccacagaggcaatcttacccgaatatggaacgcttggattggaatgttcgccaagaacaggattagactttaacgagatgattttactcacaatgaaaaataaagcgtggatggtgcacaggcagtggttctttgatctccctttaccgtggacaagcggcgctacaactgagacgccaacttggaaccgaaaagagctattggtaacatttaaaaacgcacatgccaagaaacaagaagtagtagtccttggttcccaagaaggagccatgcacaccgcgctgacaggcgcaactgaaatacaaaattcaggaggcacgtcaatttttgccgggcacttgaaatgtagactaaaaatggacaaactcgaattaaaaggtatgtcctatgcgatgtgtaccaataccttcgttttgaagaaagaagtctctgaaactcaacatggtacaattttaatcaaagtagagtacaaaggcgaggacgttccatgtaaagtcccgttctcgacagaagatggacaagggaaagcacattcaggcagactcataacagcgaatccagtagtgactaagaaagaagaaccagttaatattgaagcggagcctccctttggtgaatcgaacatagttataggaattggagataatgctttaaaaataaactggtacaagaaaggtagtagtatagggaaaatgtttgaggccacggcgaggggagcaaggagaatggcgatattaggagacacagcatgggatttcggctccgtaggcggagtattgaacagtctagggaaaatggtacaccaaattttcgggtccgcatacacagcattattctcaggcgtatcatgggttatgaaaataggcataggaatattattgacttggataggattaaacagcaaaaacacatcaatgagttttagttgtatcgtcattggtataataacactatacctgggagcggtcgtccaggcggatatgggatgcgtaataaattggaaaggcaaagaactgaaatgtggatccggtatttttgtgacaaacgaagtacatacttggaccgaacaatataaattccaagcagattctccaaaaagactagctaccgcaatcgcaggagcatgggaaaacggagtgtgtgggataagaagcactacaagaatggaaaatttactctggaaacaaatagctaatgagttgaactatattctatgggaaaataacattaaactcaccgtcgtagttggagatattatcggcgtattagaacaaggaaaaagaacactcactcctcaaccaatggaattaaaatacagttggaaagcatggggcaaagcaaaaatagtaacagcagagacccaaaacagtagcttcataatagatggacctaacacacccgagtgtccaagtgcctcaagagcatggaatgtatgggaggtagaagattatgggttcggggtatttaccaccaatatatggctcaaactcagagaagtctatacacaattgtgtgatcatcgcttaatgagtgcggcagttaaagacgagcgagcggtgcatgcagatatgggttactggatagaaagccagaaaaatggtagttggaaactcgagaaagcgtcactaatagaagtgaaaacttgtacatggccgaaaagccataccttatggtcaaacggtgtacttgaatctgatatgattattcctaaatcactagccggacccatctcgcaacataactaccggccggggtatcatacacaaactgcaggaccttggcatctgggaaaactcgaactagattttaattactgtgagggaactacagtagtaataactgaaaattgtgggacgcgaggacccagcttacgaacgacaacggttagcggtaaacttattcatgagtggtgctgtcgtagctgtacccttccaccattgaggtatatgggagaggatgggtgttggtatggaatggagatacgtcctatttctgaaaaagaagaaaatatggtcaaatcgttagtatcggccgggtcaggtaaagtcgacaatttcacaatgggtgttttatgcttagcaatactattcgaggaagtcatgcgggggaaattcggcaagaaacacatgatagcaggggttttctttacattcgtattgctattaagtggccaaataacatggcgagatatggctcatacattaatcatgataggttcaaatgcaagtgaccggatgggtatgggagttacatacttggcacttatagcaacgtttaagatacaacccttcttggcactaggatttttcttaagaaaattgacgtcaagggaaaatctcttgctaggtgtaggattagcaatggcaacaaccttacaattaccggaagacatagaacagatggcaaacggtatagccttgggattgatggctctaaaactaataacgcaatttgaaacgtatcaattgtggactgcgttaataagtcttacatgctctaacacaatctttacactaacagttgcctggagaacagccacgttaattcttgcaggggtgagcctcttaccagtatgccagtcgtccagcatgagaaaaactgattggctaccaatgaccgtggcagctatgggagttccacctcttcctctattcatatttagcttaaaagacaccctaaaacgaaggtcatggccactgaacgaaggcgtaatggcagtgggcttagtaagtatattagcgagtagtttgctaagaaacgacgtaccaatggcagggccattagtcgccggtggacttctaatagcatgctatgtcataactggtacctcagctgacttgacggtcgagaaagcggccgatgttacgtgggaagaggaagctgaacaaacaggagtaagccacaatttaatgattacggtagatgatgatggaaccatgaggataaaagatgacgaaactgaaaacatattaacagttctacttaagacggcactactaattgtatcgggcattttcccatactcaatacctgctacactccttgtatggcatacatggcaaaagcaaacacagcgatcaggagtgctgtgggatgtcccatcccctccggaaactcaaaaagctgagttagaagaaggcgtatataggatcaaacaacaggggatttttggaaaaacacaagtgggggtgggagtacagaaggaaggagtgttccatactatgtggcatgtcaccaggggagctgttttaacctataacggcaaacgactcgaaccaaattgggctagcgtgaagaaagacctaatatcatatggagggggatggcgcttgagcgctcaatggcaaaaaggagaagaagtccaagtgatagctgtggagcccggtaagaatcctaaaaattttcaaacaatgcccggaacatttcagacaacgacgggcgaaattggtgcaatagcgttagactttaaaccaggtacaagtggcagcccaattataaacagagaagggaaagtagtagggttatacgggaacggcgtagttaccaaaaatggaggatacgtttcaggcattgcccagacaaacgcggagccagatggtcctacaccagagctggaagaagaaatgttcaagaaaagaaatttaaccattatggacctccatcctgggagtggaaagaccagaaagtatttgcccgcaatagtgagggaagccattaaaagaagactacgaactctaattctcgcaccgacacgcgtagtggctgcagagatggaagaagccctaaaagggttgcccataagatatcagacaacggcaacgaaaagcgaacatacaggtcgagagatcgtcgacttaatgtgccatgcgacattcaccatgcgtttattatcccctgtgcgcgtacctaactataacttaataatcatggacgaagcgcactttacggatcctgcatcaattgccgctcgcggttacataagcacaagagtcggtatgggagaggcggctgctatctttatgactgcaacaccgccaggtacagcagatgctttccctcagtctaacgctcccatacaggacgaagagagggacattccagaacgatcatggaactcaggtaacgaatggatcactgactttgccgggaaaacagtgtggttcgtccctagcattaaagcaggcaatgacatagcaaattgcctaaggaaaaacggcaagaaagttattcagctatccagaaagacattcgataccgaatatcagaaaacgaaacttaatgattgggatttcgtagttactactgacatatccgaaatgggggcaaatttcaaagcagatagagtcattgatcccaggcgttgccttaagccggtgattttgacggacggaccagaaagagtaattcttgctgggccaatgccagtaacagctgcttccgctgcgcaaaggagaggaagggtagggcgaaacccacaaaaagaaaatgatcaatatatattcactggacaacctctaaataacgacgaagatcacgctcactggacagaagctaaaatgctccttgacaacattaatactccagaaggaataataccagctctttttgagcctgaaagagaaaaatcagccgccatagacggggaatacagacttaaaggtgaaagtagaaaaacatttgtggaactaatgagacgtggagatcttccagtatggctggctcataaagtcgcaagcgaaggaatcaaatacacggacagaaaatggtgctttgatggtcagcgcaataatcaaatattggaggaaaacatggatgtcgaaatctggacaaaagagggagagaagaagaaactacgcccaagatggctggacgcacgaacttatagcgatccactagcactaaaagaatttaaagactttgccgcaggcaggaaatccatagcactagatctagtaacagagatagggcgtgtaccctcacacttagctcacagaacaagaaatgctttggataacctagttatgttgcatacctctgaacatggtggacgggcatacaggcatgcagtagaagaactacctgaaactatggaaacactcttgctcttagggctaatgattttacttaccggtggcgctatgctatttctaatctctggaaaaggaattggaaaaacgtctattggtttaatatgtgtaattgcatcctccggtatgctatggatggcagaaattccacttcaatggatagcatcagcaatagtgctcgagttctttatgatggtacttttgattcctgaacccgagaaacaaaggacacctcaggataaccaactagcctatgtagtcataggcatactaacactagccgccatcattgctgcaaatgaaatggggttactcgaaactactaagcgagatttaggcatgtctaaagaaccaggagtagtatcacctacgagctatcttgatgtagacctacatccggcttcggcttggaccctatacgcggttgccaccacagtaataactccaatgctaagacatacgatagaaaactccacagccaatgtatcattagcggcaatagcaaatcaagctgttgtactaatgggattggacaaaggctggccgatatcaaagatggacctaggtgtaccattactagccttgggttgctactcacaagtcaatccattgacgttaacggcagctgttcttctgctcattacccattatgctataatcggacctggactgcaagcaaaggcaaccagagaagctcagaaaagaaccgcagcgggaattatgaaaaatcctacagttgatggtataatgacaatagacttagatccagttatatatgactcaaagttcgaaaaacagctaggacaagtaatgttgctcgttctgtgcgctgtccaactcttactaatgcggactagctgggcattatgtgaggcactgaccttggctacaggtccgataacaacgttatgggaaggatcaccgggaaaattctggaacacgactatagcagtcagcatggcaaatatatttcgaggctcgtacctcgctggcgccggacttgcattttcaattatgaaaagcgtaggcacaggaaagaggggcactggttcacagggcgaaacactgggagaaaaatggaagaagaaactaaatcaactaagccgaaaagagttcgacctatacaagaaatcaggcatcacagaagttgacaggacagaagctaaggagggacttaagagaggagagataacacatcatgcggttagtcgaggatctgctaaacttcaatggtttgtggagagaaatatggtaataccagagggtcgcgtaattgatttgggatgtgggcgaggaggatggtcatactattgcgccggattgaagaaagtgacagaagtgagaggatacacaaaaggtggacctggacatgaagaaccggtaccaatgagcacctatggatggaacattgtaaaattgatgtcaggaaaagatgtcttctatctacctccagaaaagtgcgacacattactctgcgacataggagagtcatcgcctagcccaaccgtagaagaatcaagaacaattagagtcttaaaaatggtagaaccctggttgaaaaataaccagttttgcatcaaagttttaaacccttatatgcctactgtaatcgagcatctagaacgcttacagagaaaacacggtggaatgttagttaggaacccattaagtagaaatagcactcacgaaatgtactggataagcaatggcacgggaaatatagtagcaagcgtgaatatggtctcaagattactgctgaacaggttcacaatgacacacaggcgaccaactatagagaaagatgttgatttaggcgccggaactcgacatgtgaacgccgaaccagaaactcctaatatggacgtaattggagagaggataaaacgaataaaagaagaacataattccacatggcattacgatgacgaaaatccttacaaaacatgggcatatcatggatcttacgaagtaaaggctacagggagcgcgagtagcatgataaatggtgttgtaaaattattaaccaaaccctgggacgttgtccccatggtcactcaaatggccatgacggatacaacaccgttcggacaacagcgggtattcaaagaaaaagtcgatactcgaacgccaaggagtatgcccgggacgcggagagttatgggtataaccgcagaatggctttggcgtaccttagggcggaataaaaagcccaggctctgtacacgtgaagagtttacaaagaaagtaagaaccaatgcagccatgggcgccgtttttaccgaagagaaccagtgggatagcgccaaagctgccgtcgaagacgaggatttttggatattagtagatagggagagagaattacacaagttaggtaaatgtgggagctgtgtatacaacatgatgggtaaacgagagaagaaacttggagaatttggaaaagcgaaaggatcaagagctatatggtatatgtggcttggagcacgatatctggaatttgaggctctgggctttcttaacgaggatcattggttctcacgagaaaactcctattctggagtagaaggtgagggtttacataaactgggatacatattacgagacataagcaagataccaggaggggcaatgtatgccgacgacactgcaggatgggacacaaggatcacagaagacgacttgcataatgaagaaaagatcactcaacaaatggaccccgaacatcgtcagctggctagtgcaatttttaaacttacatatcagaacaaagttgttaaagttcaaagaccgacgcctacagggactgtcatggacataatttcaagaaaggatcaaagaggatcaggtcaagttggaacttatggactaaatacgttcacaaacatggaggcgcaattaattaggcaaatggaaggcgagggagtattaagtaaagcggacttggaaaatccacatctgccagagaagaaaataacacagtggttagaaacaaaaggagttgagagactaaaacggatggctatcagtggagatgattgcgtagtaaaacctatagatgacaggtttgcgaatgctttattagcgctgaatgacatgggtaaagtacgcaaggacattccacagtggcaaccttcaaaaggatggcatgactggcaacaagtcccattttgtagtcatcattttcacgagttgatcatgaaagatggacgtaagctagttgtaccgtgtcgtccacaggacgagttaataggtcgggctaggattagtcagggcgccgggtggtctttaagggaaacggcgtgtctaggtaaagcgtatgcacagatgtggagtttaatgtatttccatcgccgtgacttgcgactagcttccaacgcaatatgtagcgctgtcccagtacattgggtcccaacgtctagaactacgtggagtatccatgcacaccaccaatggatgactactgaagacatgctgacagtatggaacagagtatggatagaagataatccctggatggaggacaagacgccagttacgacatgggaaaacgtaccttacttagggaaaagggaagatcagtggtgtggctctctaattggcctaacctcgcgcgcaacgtgggcacaaaatatacccactgctatacagcaggttcggtcgctcataggtaacgaggaatttctcgactatatgccgagtatgaaaagatttagaaaagaagaagaaagtgaaggagctatttggtaa

SEQ ID NO: 23338 - RNA, 9873 nt, synthetic construct
  misc_feature 1..9873: note = derived and/or modified CDS sequence (opt6) from DENV-3__FJ373302__SS-prME
  source 1..9873: mol_type = other RNA
acgtccttatgcttaatgatgatattgcctgctgcgctagcatttcacttaacttcccgagatggggaaccaagaatgatcgtaggcaaaaatgaaaggggaaaatcgctactatttaaaactgcatcaggaataaacatgtgcacacttattgcaatggacctaggagaaatgtgcgatgacactgtcacttataaatgccctcatatagcagaagtagaaccggaagacatagactgttggtgtaacttgacaagcacatgggttacgtatgggacttgcaatcaagctggtgaacatagaagagacaaacgtagcgtcgctttagctccacatgttgggatgggacttgatacaagaacgcaaacctggatgagcgccgaaggagcatggcgtcaggttgaaaaagtggagacctgggcattacgtcatcctggtttcactattctcgctctttttcttgcacattacatcggaacaagcctaacacaaaaagtcgtgatattcatattactaatgctagtaactcctagtatgacaatgagatgtgttggggtcggcaaccgagactttgtggagggactatcaggagcaacatgggtagacgttgtactagaacatggtggttgtgttaccacgatggccaaaaataaaccaacacttgatatagagcttcagaaaacagaagcgactcaactagctacactccgaaaactctgtatagaaggaaaaattactaacattaccacagatagccgctgcccaacccaaggcgaagcagtgttgcctgaagaacaagatcaaaattacgtttgcaaacacacatatgtagatcgcggctggggaaatggatgtggattatttggaaaaggtagtctcgtcacgtgcgcaaaattccaatgccttgagccgatagaaggaaaagtagtacaatacgaaaatttaaaatacactgtaataataacagtacacactggagatcaacatcaagttggcaacgaaacgcaaggtgtaactgcagaaatcacaccccaagcatcaacaacagaggcaatattacccgaatacggcacccttggcttggaatgtagtccaaggaccggattagatttcaacgaaatgatactactaaccatgaagaataaggcatggatggtacatcggcaatggttctttgatttaccattgccatggacatcaggcgcaacaactgaaaccccgacttggaatcgaaaagaactgctagttaccttcaaaaatgcacacgccaagaaacaggaagtagttgtactgggatcacaagaaggtgccatgcacactgcattaacaggagcaaccgagattcaaaattctgggggaacatcaatattcgcaggccacctcaagtgtcgtttaaaaatggacaaacttgagttaaaaggtatgtcatacgctatgtgcaccaacacttttgtattaaagaaagaagtgtctgaaacgcaacatggtacaatattaattaaagttgaatacaagggtgaagatgcgccttgtaaaatccctttcagtacagaagacggacaaggaaaagcacacaacggacgtttgatcacagccaaccccgtcgtcactaagaaagaggagccggtaaacattgaagcagagcctcctttcggcgaatcaaatattgtaatcggtataggcgataatgcattgaaaatcaactggtacaagaagggttctagcattggtaagatgtttgaagctacagcaaggggagcacgcagaatggctatactaggggatacggcctgggactttggaagtgtaggtggagtattaaactcccttggtaaaatggtacatcagatcttcggcagtgcatatactgccttattttcaggagtcagctgggtaatgaagataggcataggagtgctactcacttggatagggctgaatagtaaaaacacgtccatgagtttttcttgcattgctattggtataataacgttatacttaggagctgtcgttcaggcggacaccggatgtgtcataaactggaaaggcaaagagctaaaatgtggatccggaatattcgttacaaatgaagttcatacttggactgaacaatataagttccaagcggactcacctaaacgcctcgcaacagcgattgccggagcatgggaaaatggtgtatgtggtattaggtcaacgacacgaatggaaaacctgctatggaaacaaattgccaacgaattaaactacattctttgggagaacaatataaaattaaccgttgtggtgggtgatatcataggcgtactagaacaaggtaaaagaactttaaccccacagcctatggaacttaaatattcgtggaaaacatggggaaaagctaaaattgttacggcagaaactcagaacagctcatttatcatagatggacctaatactccagagtgtccgtcagcatcacgagcctggaacgtctgggaagttgaagattatggattcggcgtgtttaccactaatatctggttgaagctaagagaggcttacacgcagctttgtgaccacagattaatgtctgctgctgtgaaggacgaacgcgcagttcatgcggatatgggttactggattgaatcacagaagaaaggctcatggaaattagaaaaggctagcttaatcgaggtaaaaacgtgtacatggccgaaaagccacactttgtggtctaatggtgtacttgagtccgatatgattatacccaagagcttagccggccccatatcacagcataattatcgccccggatatcatacacaaactgctggtccttggcaccttggcaaattggaattagatttcaattattgtgaggggacaacagtagtgatcacagaaaactgcggaactcgtggacccagtctacggactacaacagtttctgggaaactaattcatgaatggtgctgtagatcatgtacattaccacctttacgatatatgggagaagatggctgctggtacggcatggaaatacgccctatctcagaaaaagaagagaacatggtaaagagcttggtgagtgcgggatccggtaaagtcgacaactttacaatgggtgtgctttgtctagcgattcttttcgaagaagtcatgagaggaaaatttggcaagaaacatatgatagcaggggtattctttacatttgtattattactaagtggacaaataacctggcgagacatggcacatacgttaattatgataggcagtaatgcatctgatcgtatgggtatgggcgttacgtacttggctttaatcgctacattcaaaattcaaccatttctcgcattaggcttctttctgcgaaaattgaccagcagagaaaaccttttattgggggtaggactagctatggccactacattacaacttccagaagacatagagcaaatggcgaatggtatagcattaggtctcatggccttaaagctaataacgcaattcgaaacatatcagttgtggactgcattaataagcctaacatgctcaaacactatatttactttaaccgtagcttggagaactgcgacacttattctagcgggagttagtctccttcctgtgtgtcagagttctagtatgaggaagtcggactggctacctatgactgttgccgccatgggcgttcctccattaccgttattcatattttcacttaaagatactttaaaaagacgaagttggccgctaaacgaaggagtcatggcagtaggattggtttccatattggcatcatcgttgctaagaaacgacgtaccgatggccggccctctggttgcaggaggcttattgatagcatgttatgtaattaccgggacttcagccgatcttacagttgaaaaagctgctgatgtaacgtgggaagaagaagccgaacaaacaggtgtaagccacaacctcatgataactgtagacgatgacggtaccatgcgcataaaagacgatgaaactgagaatatattaacagtgctattaaaaacagcacttctaattgtatcagggatttttccctattcaattcccgcaacgttactcgtatggcatacatggcaaaagcaaacacgtcgatcaggggtactatgggacgttccttcaccaccagagacccaaaaagcggaacttgaggagggagtgtatcgtataaaacaacaaggtatctttggaaaaacgcaagtaggggttggagtccaaaaagagggagttttccacacaatgtggcatgtcacaagaggagcagtcctaacatacaatggtaagagactagaaccaaactgggcaagtgtgaaaaaggacctgatatcatatggaggtggctggcgcctcagcgcgcaatggcaaaaaggagaagaagtacaagtaatagcagtagaaccaggtaaaaacccgaaaaattttcaaacaatgcctggaacgttccaaactacgacgggtgaaataggagccattgcgctagattttaaaccgggaacaagtggtagtccgattataaaccgagaaggaaaagtggtcggtctgtacggtaatggagttgtgactaaaaatggaggttacgtaagcggtatagcgcaaactaacgcggagccagatggtcctactccagaacttgaggaggaaatgtttaagaaaagaaatctaaccataatggatctgcacccaggatctgggaaaacccgaaagtacctaccggcaatagtaagagaagcaattaaacgtagactaaggacattaatacttgcaccaacaagagtagtggccgctgaaatggaggaagccctaaaggggttaccaatcagataccagactacggccacaaagtctgaacacacaggacgagaaattgtagatcttatgtgccatgcaacatttacaatgagactactctctcctgttagggtaccaaactataaccttattataatggacgaagcacattttaccgatccagcgtccatagcagcccgaggctatatcagcacaagagtaggtatgggagaagcggcagcgatattcatgactgctactccgccaggaacggcggatgcgttcccccaatcaaatgcaccaatccaggacgaagaacgggatattccagaacgatcatggaactcgggaaatgaatggatcacagacttcgcgggaaaaactgtatggtttgttccttctataaaagccggaaacgacatcgcaaattgtctaagaaagaatggtaaaaaggtgatacaacttagcagaaaaacttttgacactgaataccaaaagactaaattaaatgactgggattttgtcgtaactactgatatctccgaaatgggggccaatttcaaagctgaccgtgtaatagatccgaggagatgcctcaaacccgtaatcttgacagatggaccagaacgagtaatactagcgggacctatgccggtgacggctgcctcggcagctcaaaggcgaggacgagtaggccgtaacccccaaaaagaaaacgaccaatacatatttactggtcaaccgctcaacaatgatgaagaccacgcacattggaccgaagcgaaaatgttattggataatattaatacaccagaaggaataatccctgctctatttgaacctgagagagagaaaagcgctgccatagatggggaatatagactgaagggagaatctcgtaaaactttcgtagaattaatgagacggggagacttacccgtttggctcgcacataaagtcgcttcagaaggcataaaatatactgatagaaagtggtgttttgacggccaaagaaacaaccaaatattagaagaaaatatggatgttgaaatctggaccaaggagggagagaaaaagaaactcagaccaagatggcttgatgcccgaacttatagtgacccattagcactaaaagaatttaaagactttgctgccggacgaaaatcaatcgcacttgaccttgtaactgaaatcggcagagtaccatcacatctagcgcaccgcaccagaaatgcactcgataatctagttatgctacacacgtccgaacatggaggaaaagcatatcgtcatgccgttgaagaactaccagaaacgatggagacactcttactcttaggcctcatgatcttgcttacaggaggcgccatgttatttttaatatcaggcaaaggaataggaaaaacgagtattggtttaatctgtgtcatagcttcgtcgggcatgctatggatggccgagatcccactccaatggatcgcatcagccatagtattagagttctttatgatggtgctactaataccggaaccggaaaaacaacgtaccccgcaagataatcaactggcttatgttgttatcggcatcctcacgcttgctgcaataatcgctgcaaatgaaatgggactcctcgaaaccactaaaagagatttaggcatgtccaaagaaccaggggtcgtaagtcccacaagttacttagacgtagacctgcatccagcaagtgcttggactctgtatgcggtcgctacaacagtaataacaccaatgctaagacatacaatagaaaactcaactgcgaatgtaagcctagcggccatagctaaccaagccgtggttttaatgggtcttgataaaggatggccaataagtaaaatggatctgggcgttcctctgttagcccttggatgctacagtcaagttaaccccctcacactaactgctgcagtgctactcttgattacccattatgcaatcattggtccgggactccaagcaaaagctacaagagaagcacagaaaaggacagcagctgggataatgaaaaatcctacggtagatggaattatgaccatagatttagaccccgtaatatatgatagcaagtttgaaaaacaattaggacaggtcatgctattagttctttgtgctgtacaattacttttaatgagaacaagttgggctttgtgcgaagccttgactttagctacaggtcccatcacgacattatgggaaggaagtccaggaaaattctggaatacaacaatcgccgtgtccatggctaatatatttaggggatcctatttggctggcgccggtttagcatttagtatcatgaagagtgtagggacaggaaagaggggcaccggttctaaaggggagacactaggtgaaaagtggaaaaagaaattaaatcaattgtcgaggaaagaatttgatctttacaagaaatcaggaattacagaagtagatagaacagaagccaaagaaggactaaaaagaggtgaaataacgcaccacgccgtaagtagaggctcagcgaaacttcaatggtttgttgaaagaaacatggttataccggaagggcgtgtgatcgatctaggctgtggtcgtgggggatggtcctactactgcgcggggctcaagaaagtgactgaagtacgaggatatacaaaaggaggcccgggacacgaagaaccagtcccaatgtctacctacggttggaatatcgtgaagttaatgtcaggaaaagatgtcttctatttgccccctgaaaagtgcgatacattactatgtgacatcggtgaaagttcacctagccctacagtagaagagtctcgaaccatacgagttttaaaaatggtcgaaccttggctgaaaaataaccaattttgtattaaagtactaaatccctacatgccaacggttatagaacatttagagcgtcttcaacgtaaacatggagggatgttagttagaaacccgttgtctagaaattcgacccatgagatgtattggatttctaatggcaccgggaacatagtagcttctgtaaatatggtgtcaagattgttacttaataggttcacaatgacccatagacgaccaactattgaaaaagatgtcgacttaggagccggaacacgacatgtcaatgcagagcccgaaacacctaacatggatgttataggcgagcgcatcaaacgtataaaagaagaacataattctacctggcactatgacgatgaaaatccttataaaacatgggcatatcacggcagctatgaggtgaaggctacaggtagcgctagtagtatgatcaatggcgtagtaaaattactaacaaagccatgggatgttgtgccgatggtgactcaaatggcaatgacagatacaactcccttcggccaacagcgcgtattcaaagaaaaagtagacacacgaactcctcgctcaatgccaggtacccgccgagtcatgggaatcacagcggaatggctatggcggactttgggaaggaataagaaaccgagattatgtacaagagaagagtttactaagaaagtgagaactaatgctgcaatgggagctgtatttacagaagaaaaccaatgggatagcgcaaaggctgccgtagaagatgaagacttttggaaattggttgatagggaacgtgaattacataagttaggtaaatgtggaagctgtgtttataacatgatgggaaaaagagagaagaaattgggagaatttggaaaagcgaaaggcagtagagcaatctggtatatgtggttaggagctaggtatctagaatttgaagcattaggcttccttaatgaggatcattggttctcacgagaaaattcatacagcggggtagaaggtgagggtttacacaaacttggatatattctaagggacataagcaaaattccagggggagcaatgtacgcagatgacacagcagggtgggatacgcggataacggaagacgatttacacaatgaggagaaaattacacaacagatggatcccgaacaccgccaattagctaatgccatctttaaattgacctaccaaaacaaggtcgtgaaagtccaacggccgacacctacagggaccgtcatggacataatttcgcgaaaggatcagagaggaagtgggcaagtcggcacatatggattaaatacctttacaaatatggaagcacaattaattcgtcaaatggaaggagaaggagtactgtctaaagcagatctggaaaatccccatctatctgagaagaaaatcacgcaatggttagaaaccaaaggagtagagcgcctcaaacgaatggcgatatcgggggatgactgtgtggttaaaccaatagatgatagatttgcaaatgcacttctagcattgaacgatatggggaaagtacgtaaagatataccccagtggcaaccttcaaaagggtggcacgactggcagcaagtaccgttctgcagccatcacttccatgaactcattatgaaagacgggaggaaattagtggttccgtgcagacctcaggatgaacttataggtagagctcggatatctcaaggagccggatggtcgttaagagagactgcctgtttaggaaaagcgtatgcccaaatgtggtcactaatgtacttccatagacgggacctcaggttggcaagtaatgctatttgtagcgccgtaccagtacattgggtaccaacttcccgaacaacttggtctatacatgcgcatcatcaatggatgaccaccgaagatatgttaacggtttggaaccgggtgtggatagaagacaacccttggatggaggacaaaaccccagtaacaacctgggaaaatgtgccctacctgggaaaacgagaggatcaatggtgtggtagcctcattgggttaacatccagagccacatgggcccaaaatatcccaaccgccatacaacaagtccgttcattgatcgggaacgaagaatttttggactatatgcctagcatgaaaagattcagaaaagaagaggagagtgaaggcgctatatggtaa

SEQ ID NO: 23339 - RNA, 9873 nt, synthetic construct
  misc_feature 1..9873: note = derived and/or modified CDS sequence (opt6) from DENV-3__FJ182007__SS-prME
  source 1..9873: mol_type = other RNA
acgagtttgtgcctaatgatgatcttaccagcagctttggccttccatctaacttcaagagatggggaacccagaatgatagttggcaaaaacgaacgaggtaaaagcctactctttaaaactgcctctggtattaatatgtgcacactaatcgctatggatctaggagaaatgtgtgatgataccgtaacttacaaatgcccacatattgcggaagtagaacccgaagatatagattgctggtgtaatttgacaagtacctgggtgacatatggaacgtgtaatcaagctggagaacaccgacgagacaaaagatctgtagccctagcgccacatgtaggaatggggctggacactagaacccaaacctggatgagcgctgaaggtgcatggaggcaagttgaaaaagtcgaaacttgggctttgcgtcatccagggttcacaatacttgctttatttttagcacattacatagggacaagtttaacacaaaaagtcgtaatttttatattgttaatgttagtcacaccatcaatgacgatgcgctgcgtgggtgtcggcaacagggattttgtagaaggtctgtctggagcaacttgggtagatgttgtactcgaacacgggggttgcgtaacaacaatggccaaaaacaaaccgacattagatatagaattacagaaaaccgaagcaacacaattagccacactaagaaaactatgtattgaaggtaaaattacaaatataacaacagacagtcgatgcccaacacagggcgaagctgtattaccagaagaacaagatcaaaactacgtttgcaaacatacatatgtagatagaggttggggcaatggatgtggtttgtttggcaaaggaagcctagtcacctgtgccaaatttcaatgcctagaacctatagagggtaaagtagtccaatacgagaatttaaaatacacagtgattattacagttcatacaggggaccaacatcaagtgggaaacgagactcaaggcgtgaccgcagaaataacgccacaggcttcaacgacggaagcgattctaccagaatacggaaccctgggactggaatgttcccccaggactgggttagacttcaatgaaatgatcctattaacaatgaaaaataaagcatggatggttcatcgacaatggttctttgatttaccacttccctggacttctggggctacaactgagacccctacatggaatcgaaaagaattattagtgacgttcaaaaatgcccacgctaagaaacaagaagttgttgtcctaggaagtcaagaaggtgctatgcatactgctctaacaggtgcgacggaaatacaaaattctggcggtacatccatttttgccgggcacctaaaatgcaggttaaaaatggataaattagaactcaaaggaatgtcttacgctatgtgtacaaacacctttgtgctaaagaaagaagtctcagaaactcagcatggtactatcttgatcaaagtggaatacaaaggtgaagatgctccatgcaaaatacctttcagtactgaagatgggcaaggaaaggcccataacggacgcttgataactgccaatccagtagtcacaaagaaagaagaaccagtgaacattgaagccgagcctcctttcggcgaatctaacatagtaataggaacgggtgataatgcactaaaaattaattggtataagaaagggtcgagcatcggtaaaatgttcgaagcaaccgcccgaggggccagaagaatggccatactcggtgataccgcgtgggacttcggcagtgtaggcggtgtattaaactcattgggaaaaatggtacaccagatattcggtagcgcttacactgcgttattcagtggcgtgagttgggtaatgaagattgggattggagtactattaacttggattggtctgaactccaaaaacacctcaatgagcttctcatgcatcgcaattgggattatcactctctaccttggcgccgtggtacaagccgatactggatgtgtaataaactggaaagggaaagaactcaaatgcggatccggcattttcgtcacgaacgaagttcatacttggactgagcaatataagtttcaagcagattcaccgaagcggctagccaccgccatagcgggagcgtgggagaacggtgtatgtggtatacgtagcacgaccagaatggagaacttgttgtggaaacaaatagcaaatgaacttaattacatcctctgggagaacaatataaagctaacagttgtagtaggggacataataggcgttttagaacaaggaaaaaggacacttacccctcagccaatggaacttaaatatagctggaaaacatgggggaaagcgaaaatcgttacggccgaaacgcaaaacagttcgttcataattgacgggcctaatacacctgaatgtccctcagcatcgagagcatggaacgtgtgggaggtagaagattacggatttggcgtgttcacaacaaatatttggctaaaattacgtgaagtatatacacaattgtgtgatcatcgattgatgtcagctgcagtcaaagatgaacgagcagttcatgcagatatgggatattggatcgaatcgcagaaaaacggatcatggaaactagaaaaggcttcgttgatagaagtaaagacttgtacgtggccgaaatcgcacacattgtggtcaaacggcgtacttgaatcagatatgatcataccaaaatcattggcaggaccgattagtcagcataattacagacccggctatcacactcagaccgcaggaccgtggcacttgggcaagttagaattagactttaactattgcgaaggtacaacagtcgtgatcacggaagattgcggaacaagaggtccttctctgagaacaactactgtatcaggaaaacttattcacgagtggtgctgtcgatcctgcacattaccccctctgagatatatgggagaggacggttgctggtatggaatggagatacgacccataagtgagaaggaagaaaacatggtcaaatcactggtaagtgctggatctggaaaggtagataacttcaccatgggagtcctatgcctcgctatactatttgaagaggttatgcgaggaaaatttggcaagaaacatatgattgcaggcgtattctttacctttgtacttctattgagtggacaaatcacgtggagggatatggcgcatacgcttataatgatagggagcaatgctagcgacagaatgggaatgggagtgacttatttagcattaattgctacctttaaaattcaaccgtttctggctttggggtttttcctcagaaagttaacatcacgcgaaaatttactcctcggagtcggactagccatggcgactaccttacagttaccagaagatatagaacaaatggctaacggcattgcacttggattgatggctttaaagttgatcacccaattcgaaacttatcagttatggaccgccttgataagtctaacatgttcaaacacaatttttacgctcacggtagcttggagaacagccacattgatattagccggtgtaagccttctacctgtgtgtcaaagtagttcaatgcgtaagtctgattggcttcccatgaccgtagcagcaatgggtgtcccgcccctccctctatttatctttagtctcaaagacactctaaagcggaggtcgtggcctttgaatgaaggagtaatggcagttggactcgtatcaatcctcgcaagtagcctcctaaggaacgatgttccaatggcaggaccgcttgtagcaggaggtctcttaattgcatgctacgtaatcacaggaaccagcgcagatctcacagtagagaaagcagcagatgtcacttgggaagaagaagctgaacaaaccggtgtctctcataatttgatgatcactgtcgacgacgatggtaccatgaggatcaaagacgatgaaacagaaaatatccttacagttctgctcaaaacagcgttactgatagtaagtggtatattcccctacagtattccagcaacattattggtgtggcatacatggcaaaagcagacgcgcaggtccggagtattatgggatgtccctagcccgcccgagacacagaaagcggaattggaggagggcgtgtataggatcaaacaacaaggtatcttcggcaaaacccaggttggagttggggtacaaaaggaaggagtttttcatacgatgtggcatgtaacacgaggtgccgttttaacatacaatggaaagcgattagagccaaactgggcatcggtcaagaaagatttgatatcttatggagggggatggaggctatcagcacagtggcagaaaggagaagaagtacaagtgattgcggtagaaccagggaaaaatcctaaaaatttccaaactatgccagggacctttcaaacaacaacgggagagataggggcaattgcactggattttaaaccgggaacatcaggctcaccaataattaatagagagggcaaggttgtgggactctatggaaacggtgttgtaaccaaaaatggcgggtacgtatcaggtatagctcagaccaatgcagagccagatggtcctaccccggaactagaagaagaaatgttcaagaaacgtaatttaaccataatggatttacatcccgggagtggtaaaactcgtaaatacctacctgcaatagtaagagaagctatcaaaagaagattacgaacgctcattttggcacccacaagggttgtggcagcagaaatggaagaggctttaaagggattaccaatcagatatcagacaaccgctacaaaatctgaacatacgggcagagagatcgtagatttaatgtgccatgccacgtttactatgcgtttactttcaccagtacgcgtgcccaattacaacctgattattatggatgaagcgcactttactgatccagcttcgatagcagcacgaggttatataagtactagggtcggtatgggggaagctgcagcgatttttatgacagcaacacccccaggtacagccgacgcatttcctcaatccaacgcaccgatacaggatgaagaacgtgatataccagaaagatcttggaatagtggaaatgaatggataaccgattttgcaggtaaaactgtatggttcgttccatctattaaagccggaaatgatatagcaaattgcttgagaaagaacggaaagaaggtaattcagctgagccgaaaaacttttgacacggaataccagaaaactaaactaaatgactgggacttcgtggtcacaacggacatttcagaaatgggtgcaaactttaaggccgacagagtaatagacccacgaaggtgtttaaaacccgtcattctaactgacgggccagaaagagtaatactagctggacccatgccagtgacagcagcctcggctgcacagaggagagggagagtaggaagaaacccacagaaagaaaatgaccaatacatatttactggacaacctctaaataatgatgaagatcacgcccattggacggaagcaaaaatgctattggacaacataaatacaccagaaggcattatacctgcactattcgagcccgaaagagaaaaatcagcggcaatagatggagaatatcggctcaaaggcgagtcccgtaaaacatttgttgaactaatgaggcgaggagatttgccagtatggttagcccacaaagttgccagcgaaggcataaaatataccgatcgcaaatggtgttttgacggccaacggaataaccaaatacttgaggagaatatggatgttgaaatctggactaaagaaggtgagaagaagaaactacgaccaaggtggctagacgcacggacttattcagatcctttagccttgaaagaatttaaagatttcgctgctggcagaaaatccatagcgctagatctggtcacggaaatcggaagggtaccaagccacttggcacatcgtacaaggaacgccttggataatttagtgatgttacatacaagtgaacatggtggaaaggcctatcgacacgccgttgaagaactacctgaaacaatggaaacgcttttgctccttggtttaatgatacttctaacaggaggcgcaatgttatttctaattagtggcaaagggatagggaaaacatcaataggtctaatatgcgttattgcatcatcgggcatgttgtggatagcagagataccacttcaatggatagcaagtgcaatcgttctagagttctttatgatggtacttctaatcccggagccggaaaaacaacgtacgccccaagataatcaattagcctatgtggtaatcggtatattaacattagctgctatcatagcggctaatgagatgggactactggaaactacaaagagagatttaggtatgtcgaaagaaccaggtgtcgtttcgcctacatcgtatctagatgttgatcttcatccggccagcgcatggactttgtatgcagtagcaaccacagtgataactccaatgcttagacacacgatcgaaaattcaacagcgaatgtcagtttagctgcgattgctaatcaagctgtcgtcctcatgggtttagataaaggatggcctataagcaagatggatttaggagtgccactactagccttgggatgctatagtcaagtcaatcccttaacactaaccgccgccgtgctgctattgataacacattatgcaataattggtccaggactacaagctaaagctacgagagaagcccagaaacggacagctgctggcattatgaaaaatccaacagtagatggaattatgaccattgatctggatccagttatatatgattcgaagtttgagaaacaacttggacaggtgatgttacttgtcctttgtgcggttcagctattgctcatgaggaccagctgggcgctctgcgaagcgttaactttggcgacaggaccaataacaacactatgggaaggaagtccgggtaaattttggaatactacaattgctgtcagtatggcgaatatatttcgtggtagttatcttgccggagctggtcttgcattcagtataatgaaaagcgttggtacaggaaaaagaggaactggatctcagggtgaaactttaggcgagaaatggaagcgtaaactcaatcaattgagcagaaaagaatttgacctatacaaaaagagcggcatcactgaagtagatcgtaccgaagcgaaagaaggtctcaaacgaggggagattacacatcatgcagtgtcccgagggtcagcaaagctgcaatggttcgttgaaagaaacatggtgatacctgagggtcgagtcatcgacttaggctgcggaagaggagggtggagctactattgcgcgggtctaaagaaggtaaccgaggtaagaggttacacgaaaggaggaccgggccacgaggaaccagtgcctatgagcacatatggatggaatattgtaaaactaatgtccgggaaagacgttttctaccttccgcctgaaaaatgcgatacactattgtgtgacattggtgagtctagcccaagccctacagtagaagaaagtagaacaataagggtattaaagatggtagaaccttggcttaaaaataaccaattttgtattaaagtactaaacccatatatgccaacagttattgaacatctagaacgactccaaagaaaacatggtgggatgttagtccgtaatcccctgtcacgcaactcaacacatgaaatgtattggatttcgaatggaactggaaacatagttgcttcagttaatatggtgtcaagattactactcaaccgttttaccatgacccatcgtagaccaacaatcgaaaaagatgtcgatctgggcgcaggaacgcgacacgttaacgccgaaccggagacaccaaacatggacgtaattggagagaggataaaacgtataaaagaagaacacaattctacgtggcattatgatgatgagaacccatataaaacttgggcttatcatggctcatatgaagtcaaggcaaccggctctgcgtcatccatgattaatggagtggtaaaattattaacaaaaccgtgggacgttgttcctatggtaactcaaatggccatgaccgataccacgccgtttggacagcagcgcgtatttaaagagaaggttgacacgagaactcctagatctatgcccggcactagaagagtaatgggaattacagcggaatggttgtggcgaactctaggcagaaataagaaaccgcgattatgcacaagagaggagtttaccaaaaaggttcgtacaaatgcggcgatgggggcagtgttcactgaagaaaaccaatgggattccgcaaaggctgcagttgaagatgaggatttttggaagttggtagatagagaaagagaactccacaaattgggcaagtgtggttcgtgtgtttataacatgatgggaaaaagagagaagaaacttggtgagtttggtaaagcaaaaggatcaagagctatatggtacatgtggctgggggcaagatatctagaatttgaagcattgggattcctaaatgaagatcactggttttcgagagaaaatagttattctggagtggaaggagaaggtttacataaacttggatatatcttgcgagacatatccaaaattcctggaggggcaatgtatgcagatgacactgcaggatgggatactcgaattacggaagacgatcttcataatgaagagaaaataactcaacaaatggatccagaacacagacaactagccaatgcgatcttcaaactgacataccaaaataaggttgtaaaagttcaaagacctacaccaacaggcacagttatggatataatcagcaggaaagatcaacgcggttcagggcaagtgggaacttatggactaaatacttttacaaatatggaagcacagttgattagacagatggaaggggaaggcgttctctcaaaagccgatctagaaaatcctcatctttccgagaagaaaataactcaatggctcgaaactaagggggttgaaagacttaaaagaatggctatttctggcgatgattgtgtagtcaagccaatcgacgatagatttgctaatgcattgttagctcttaacgacatgggcaaagtaagaaaggatataccgcaatggcaaccaagtaaagggtggcacgattggcaacaagttcctttttgttcccaccattttcacgaattaattatgaaagacggacggaaacttgtcgtcccatgtaggccacaagacgagctcataggtcgcgcccgaatatcacaaggagctgggtggtcgttgcgggaaaccgcatgtctcggaaaagcctatgcgcaaatgtggagtttaatgtatttccataggcgagatctaaggctcgcatcaaatgccatttgctcggctgtccccgtccactgggtaccgacaagtcgcactacatggtctatccatgcgcatcatcaatggatgacaactgaagacatgctgacagtttggaaccgagtatggatagaagacaatccatggatggaggacaaaacgcctgttacaacatgggaaaatgtaccctacttaggaaaaagagaagaccagtggtgtggatcacttataggactaacctcgagagctacttgggcgcaaaacattccaacggccattcagcaagtacgttcgctgataggtaatgaagaatttttagactatatgccgtctatgaaacgttttagaaaagaagaagaaagtgaaggtgctatatggtag

SEQ ID NO: 23340 - RNA, 9873 nt, synthetic construct
  misc_feature 1..9873: note = derived and/or modified CDS sequence (opt6) from DENV-3__FJ182008__SS-prME
  source 1..9873: mol_type = other RNA
acatccttatgcataatgatgatcctacctgctgctctcgcattccatctaacgtcaagagacggagaacctaggatgatcgttggcaaaaatgaaagaggtaaaagcctccttttcaaaacagcatcagggatcaacatgtgtacactcatagcaatggatctaggtgaaatgtgtgatgatactgtaacatataaatgcccacacataacagaagttgaaccggaagacatcgactgttggtgcaatttaacaagtacttgggtgacatatggcacatgtaatcaggctggtgaacatcggcgagataaaagaagtgtggcccttgcaccgcatgttgggatgggtttagacacccggactcaaacatggatgagcgcggaaggagcgtggagacaagttgaaaaagtagaaacatgggccctaagacacccggggtttacaatactggcactgtttctagcacattatataggaacctcattaacacagaaagttgtcatttttatccttctgatgctcgtaactccatccatgacgatgcgatgcgtgggggtcggaaacagagatttcgtcgaaggactgagtggagcaacttgggtagatgttgtcttggaacatgggggttgtgttacaacaatggccaaaaacaaaccaactttagacatagaacttcagaaaacggaagctacacaacttgcaacattacgtaaactctgcatcgaaggtaaaataactaatataaccacggactctcgatgtccgactcaaggagaagctgttctaccagaagaacaagatcaaaattacgtttgcaaacacacatacgtagataggggatggggtaatggttgtggtttgtttggtaaaggtagcttagtgacatgtgcaaaattccaatgcctcgaaccaatagaaggaaaagtagttcagtatgaaaatttaaaatatactgtgataataaccgtacacacaggggatcaacatcaagtcggcaacgaaacacaaggcgtgactgcagaaataacaccacaagcctctacaaccgaagcaattttacccgaatacggcactcttggattagaatgcagtccaagaaccggattagatttcaacgaaatgatattactaaccatgaaaaataaagcatggatggtacatagacagtggttcttcgacctacctctcccatggacaagcggggctactacggaaactcccacttggaatagaaaagaattattagtaacttttaaaaatgcacatgcaaagaaacaagaagtagtagtactcgggtcacaggaaggagctatgcacacggcactgacgggagctacagaaattcaaaatagtggtggtacttctatattcgctggacacttgaaatgtagattaaaaatggacaaattagaattgaaaggcatgtcatatgcgatgtgcactaacacttttgttctaaagaaagaagtatcagaaacgcaacacggaacaatacttataaaagttgaatacaaaggagaagatgcgccatgcaaaataccattcagcacggaagatggacagggaaaagctcataatggcagactcataacagcaaacccagtcgttacgaagaaagaggaacccgtaaatatagaagccgaacctccattcggagagtctaacatcgtaattggtataggagacaacgcattgaaaattaattggtataagaaaggctcatcaattggcaaaatgtttgaggcaacagcccgaggagctcgtagaatggcaattctaggcgatacagcttgggatttcggttccgtaggaggggtactaaactcattgggcaaaatggtacatcaaattttcggttcggcatacactgcactcttttcaggtgtctcgtgggtaatgaaaataggaattggagtgctcttgacatggatagggctcaattccaaaaatacatcaatgtcctttagttgtattgctataggggtgataacactgtatcttggcgcggttgtacaagccgacatgggttgtgtaataaattggaaaggtaaagagctgaaatgcggtagtggtatcttcgtcacgaatgaagtgcacacgtggactgaacaatataaatttcaagcagattctccaaaacgactcgccactgcaatagctggtgcctgggaaaacggagtttgtggtatccgatcaacaacacgtatggaaaatctgctttggaaacaaatagcaaacgagctaaactatatactctgggaaaacaatatcaaattgaccgtggtagtcggggatatcattggcgttctagaacaaggaaaacgcacgttaactcctcaaccgatggaactcaaatattcttggaaaacttggggcaaagctaaaatagtaacagctgaaacacaaaatagctctttcataattgatggtcccaatacaccggaatgcccatcggcttcaagagcatggaacgtatgggaagtagaagactatggcttcggtgtgttcacaacaaacatttggttaaaactcagggaagtgtatacacaattgtgcgaccaccgacttatgagtgcagctgtaaaagacgaaagagcggtacatgctgatatgggctactggatagaatcacagaaaaacgggtcatggaaacttgagaaggcctccctaatagaagtaaaaacatgtacatggccgaaatcgcatacattgtggagcaatggggtcttagaaagcgatatgatcatacctaaaagtctagcgggacctataagccaacataattacagacctggttaccatactcaaaccgctgggccatggcatttaggcaaattagaactggattttaactattgtgaaggcactacagttgtaattacggaaaattgcggaactagaggcccctcattaagaacaacaaccgtgtcgggaaaacttatacacgaatggtgctgccgttcatgcactctacctccactaagatacatgggcgaagacggctgttggtacgggatggaaatacgccctatatccgaaaaggaagaaaatatggtaaaatccctagtatccgcaggcagtgggaaggttgacaatttcacaatgggagtgctatgtttagcgattttgtttgaagaagtaatgagaggaaaatttggtaagaaacacatgattgcgggagtattcttcactttcgtcctccttcttagtggccaaatcacatggagagacatggctcatacactgataatgatcggaagtaatgcttctgacaaaatgggaatgggcgttacatatctagcgttaattgcaacattcaaaatacaaccatttctagctttaggtttctttcttagaaaactcacgagtagagaaaacctattattaggggtgggactagcaatggccactacactacagttgcccgaagacatagagcaaatggcgaatgggatagcattaggactcatggctttgaagttgataacccagttcgaaacatatcaattatggactgctttaatatctctaacatgtagtaacaccatgtttacgctaacggttgcgtggagaactgcaacgctgatattagccggagtatccttactgccagtttgtcaatcttcatcaatgcgaaaaactgattggctaccgatggcagtagctgcaatgggggttcccccgttaccactttttatcttttcgctgaaagacacacttaaaagaagaagttggcccctcaatgagggcgtaatggctgtcgggcttgtttctatactcgctagctctcttctccggaatgatgtacccatggccggcccattagtggccggtggtctattgatagcgtgttatgttataacaggaacaagtgctgatttgacagttgagaaggcagcagatattacttgggaagaggaggctgagcaaaccggtgtatctcataatttgatgataactgtggatgatgacggtacaatgaggataaaagatgacgaaaccgaaaatatactcacagtattactaaaaaccgcgctgttaattatatctggagttttcccatactcaatccctgctacattattagtttggcatacctggcaaaaacaaacacagagatctggagtattgtgggatgtgccatcacctcccgaaacacaaaaagcagaattagaagaaggggtatatcgaattaaacagcaaggaatattcggaaaaacacaagttggagtcggagtccaaaaagaaggggtgtttcacaccatgtggcatgtaacaaggggagcagtactaacatataacgggaaacgattagaacctaattgggcctccgttaagaaagatcttataagttacggcgggggctggagacttagcgcccaatggcagaaaggggaagaagtacaagttatagcggtcgaaccaggcaaaaatcctaagaactttcaaacgatgccggggacatttcaaactaccactggggagattggtgcaattgctttagatttcaagccaggaacatccggatcaccgatcataaatcgcgaggggaaagttgtcggactatatggaaatggcgtagtaactaagaatggagggtacgtaagcggaatagcccaaacgaacgcagaacctgatggcccgacgccagaactagaagaagaaatgtttaagaagcgaaacttgaccataatggatttacacccaggtagcggcaaaacgcgaaaatatctccctgctatcgtacgagaagcaatcaagcgtagattaagaaccctaattttagcccctactcgcgttgttgcagctgaaatggaagaagcattaaaaggccttccaataagataccaaacaactgccacaaagtctgaacacactggacgtgaaatagtcgacctcatgtgccatgcgacatttactatgcgactgctgtcacctgtaagagttccgaattataatttgataataatggatgaagcccattttactgaccccgcgagcattgctgcgcgaggatatatatcaacccgtgtagggatgggcgaagctgcagctatattcatgactgctacaccccctggaactgccgatgcctttcctcaatctaacgctcctatacaagatgaagaaagagacatacccgagagaagttggaactctggtaacgaatggattactgattttgcaggaaaaactgtctggtttgtacccagcatcaaggccgggaatgacatcgccaattgcctacgtaaaaatgggaagaaagtaatacaactatcacgaaaaacctttgatactgagtatcagaaaacaaaactaaatgattgggactttgttgtgacaactgacatttcagaaatgggtgcaaacttcaaggccgatagagtaatagacccaaggagatgtcttaaaccagttattctgactgacgggcccgaaagggtaatactagcggggcctatgcctgttaccgcagcatctgctgcacaacggcgcggaagagtcggaagaaatccccaaaaggagaatgaccagtatatatttacaggacaaccactaaacaacgacgaagaccatgctcactggacagaagcgaaaatgttactagacaacattaatactcctgaaggaattattcccgcactttttgagcctgagcgagagaaaagtgctgcgatcgacggtgaatatcgtttaaaaggagaaagtagaaaaacttttgtagaactcatgagaagaggggatctccctgtttggcttgcgcataaagtggcctctgagggaattaaatatactgatcgaaaatggtgttttgatgggcaacgtaataatcagatattagaagaaaatatggatgtcgaaatatggacaaaagaaggcgagaagaagaaactgagaccccggtggttagatgcgcgtacgtattcagatccgttagcactaaaagaatttaaagattttgcggctggaagaaaatcaatcgccttggacttagtgaccgagataggacgagtaccaagtcacctggcacatcggacaaggaatgctctagataatttagtaatgttgcatacaagcgagcatggcggccgagcctaccgtcatgcagtagaagaactacctgaaacaatggaaacattattactactaggtctcatgattcttttaactggaggtgcgatgttattcttgatttccggcaaaggcataggaaaaacgtctattggcttaatatgcgtcatagccagttctggaatgttgtggatggcagaaattccactacaatggatagcaagtgccatagttttagagttctttatgatggtacttctaatacctgaacctgagaaacaaaggaccccacaagacaatcaattggcgtatgtagtgatcggaattttaacattagcagctataatagccgctaacgagatggggttactagagacaactaaacgtgacttaggtatgtcaaaggaaccaggagtagtatcaccgaccagctacctagacgtcgatttacacccggcatcggcttggaccttgtacgcagtggcgacgactgtaataaccccaatgctgcgccacacaatagaaaactccacagccaacgtctcgttagcggcaatagcaaatcaagcggttgtcctgatgggattagacaaaggttggccgatctcaaaaatggatctaggcgtcccactacttgccttaggatgctacagccaggtaaatccgttaacactgacagcagcagttttactactgatcacacattacgcgattatagggcctggcctccaagctaaggctacaagggaagcacaaaagcgcaccgctgccggaataatgaaaaatcctacagttgacgggatcatgactatagacttagatcccgtcatttatgactctaaatttgaaaaacaattgggacaagtgatgctcttagtgttatgtgctgtacaactgctacttatgcggacaagctgggcattgtgtgaggccttaaccctagcaacagggccaattaccacactatgggaaggtagtcccggtaaattctggaatactactattgctgtgagcatggcaaatatattcagaggtagctatttagctggcgcgggccttgcatttagtataatgaaaagtgtaggtaccggtaaaagaggtacgggatcccaaggggaaacattaggagaaaagtggaagaagaaattaaatcaattaagccggaaagaatttgacctttataaaaagtcggggataacggaagtcgatagaaccgaagcaaaagaaggtctcaaacgaggtgaaacaacacatcatgccgtttccagaggaactgctaaactccaatggtttgtagaaagaaacatggtaattccagaaggacgggtaattgatctggggtgtggtcgaggtggatggagttattactgcgccggacttaagaaagtgacggaagtaagaggctacactaagggcggaccaggccacgaagaaccagtaccgatgagcacatacgggtggaatatagttaaactgatgtccggaaaggacgtattctacttacctccagaaaaatgcgataccttactctgtgatatcggagaatcatcaccttcacccacagttgaagagtctagaacgataagagtgctgaaaatggtcgaaccttggttaaagaataaccaattttgtataaaagtactaaatccctacatgcctactgttatagagcaccttgaacgtctccagagaaaacatggaggtatgcttgtacgaaacccactctcacgaaatagcacacatgagatgtattggataagtaatggaacgggaaatatagtcgcaagcgtcaatatggtgagccgcctattgttaaacagattcacgatgactcatcgccgtccaaccatagagaaggacgtggaccttggtgcaggaactagacatgtaaatgccgagccagaaacaccgaacatggatgtaataggagaaagaatcaaaaggatcaaagaagaacataactctacctggcactacgacgacgaaaatccctataaaacttgggcttatcatggatcatacgaggttaaagccacaggtagcgcaagttcgatgataaacggagtggtcaaactattgacaaagccatgggacgtggttcctatggttacacagatggccatgacagacacaaccccgttcggccagcaaagagtctttaaagagaaagtcgacactagaacgccaagatctatgccaggaacaagaagagttatggggataacagcggaatggttatggagaactctaggacgaaataagaaacccaggctttgtacacgagaggagttcactaagaaagttcgaacaaatgcggctatgggtgctgtatttacagaagaaaatcaatgggactcggctaaagcagccgtagaagatgaagacttttggaagctagtggacagggagcgagaacttcacaaattgggcaagtgtggatcatgtgtgtataacatgatgggtaaaagggagaagaaactaggtgaatttgggaaggcaaaagggtcaagagccatttggtacatgtggcttggagcccgatatctagagtttgaggccctaggatttcttaacgaagatcactggtttagtagagaaaactcatattcaggcgtagaaggcgaaggtttgcacaaattggggtatatcttaagagacataagcaaaataccaggtggagcgatgtacgcagatgatacagcagggtgggatacaaggatcactgaagacgatcttcataatgaggagaaaattacacaacaaatggaccctgagcacagacaattagcaaatgcaatctttaaactgacgtatcagaataaagtagtcaaagtccaacgacctacaccaactggtaccgttatggatataatctccaggaaagatcaaaggggaagcgggcaagttggtacatacggcttaaacacattcacaaacatggaagctcaattaatacggcagatggaaggagaaggagttcttagtaaagcagacctagaaaacccacacttgccagagaagaaaattactcaatggcttgagacaaaaggagtagaacgactcagacgaatggctatcagtggggatgattgcgtagttaaacctatagacgatagattcgctaatgccctgttagcactcaatgacatggggaaagtacgtaaagatataccacaatggcagccgagtaagggatggcacgattggcaacaagtcccattttgtagccatcacttccatgagttgataatgaaggatggtagaaaactcgtagtcccttgcagaccacaagatgaactcatagggagggcacgaataagtcaaggggcagggtggtccttaagagaaacggcgtgcttaggcaaagcctacgcgcaaatgtggtcgttaatgtattttcacagaagagatctgagacttgctagcaatgctatctgttcagccgttcccgttcactgggtaccgacatcccgaacaacctggtcgatacacgctcaccaccaatggatgaccacagaggatatgttaacagtatggaatagagtatggattgaagataacccatggatggaagataaaactcctgttacaacatgggaaaatgtaccatatctaggtaagagggaggaccaatggtgcggatccttgattggactaacttccagagcaacttgggcgcagaacataccaactgcaatacaacaggttagatcactaatagggaatgaagagttccttgattacatgccatctatgaaacgctttcgcaaagaagaagaatcagaaggtgcgatttggtag

SEQ ID NO: 23341 - RNA, 9873 nt, synthetic construct
  misc_feature 1..9873: note = derived and/or modified CDS sequence (opt6) from DENV-3__FJ182010__SS-prME
  source 1..9873: mol_type = other RNA
actagcttatgcctgatgatgatacttccagcggcattagcctttcatttgacatctcgcgatggggaaccaagaatgatcgttggcaaaaacgaaagaggaaaatcattattattcaaaacggcttccgggatcaatatgtgtacactcatcgctatggatctcggggaaatgtgtgatgatactgtgacatataaatgcccacatatagcagaagtggaaccggaagatattgattgctggtgcaatttaacaagcacgtgggtgacatatggtacatgtaaccaagcaggggaacatagaagagataaaagaagcgtagcgttagcaccacacgtaggtatgggcttagacacgagaacccaaacttggatgtcggcagaaggtgcatggcgacaagtagaaaaagtggaaacatgggcattacggcatcctggcttcacgatattggctttgtttcttgcgcattacataggaacaagcctaactcaaaaagtagtgatctttgttctgctgatgctcgtaactccgagtatgactatgcgatgtgtcggagtaggcaatagagattttgttgaaggtctttccggcgcaacctgggtcgacgttgttcttgaacacggaggttgcgttacgactatggccaaaaacaaaccgactctagacatcgagctccagaaaactgaagctacacaactagcgactcttagaaaattatgtatcgaagggaaaattactaatataaccacggattcaagatgtccgacccaaggtgaggcagtgctgccagaagaacaagatcaaaattatgtttgtaaacatacgtacgtagacagaggctggggcaatggttgcggtctttttggcaaaggaagcctagtaacatgtgcaaaattccagtgccttgaaccaatagaaggaaaagtagtacaatatgagaacctaaaatacacagttatcattacagtacatacgggggatcagcatcaagtaggaaatgaaactcaaggggtaacggcagaaataacgccacaagcctcaacgacggaggccatcttaccagagtatggtactttaggtttggagtgtagtccaagaacgggcttggactttaatgaaatgatacttttgacaatgaaaaacaaggcttggatggtacatagacaatggttctttgatttgcctctaccgtggacctccggtgccacaacggaaacgccgacgtggaaccgaaaagaattattggtaacatttaaaaatgcacacgctaagaaacaagaagtcgtagtactaggaagccaggaaggtgctatgcacacagcacttactggggcaactgaaatacaaaacagtgggggaaccagcattttcgctggtcaccttaaatgtagattaaaaatggacaaactagaactcaaaggaatgagttatgcaatgtgtactaatacatttgtactaaagaaagaggttagtgaaactcaacatggaaccatactaataaaagtcgaatataaaggtgaagacgcaccatgtaaaattccatttagtactgaagatggacaaggcaaagcacacaacggtcgtctaattacggcaaatcccgtagtgacgaagaaagaagaacctgttaacatagaagcagagcctccctttggagaatcaaacatcgtcatagggataggggacaatgcactaaaaattaactggtataagaaagggagttccattggaaaaatgttcgaagcgacagcacgtggagctcgacgcatggccatcttgggagatacagcatgggatttcggatccgtcggaggagttttgaatagtctaggtaaaatggtgcaccagatatttggatccgcatatacagcgctattttcaggagttagttgggtcatgaaaatcggcataggggtgctactaacatggataggtctaaatagcaaaaatacaagtatgtcattttcatgcatcgctataggcatcataacactatacctcggagctgtagtacaagctgatactggctgtgtaattaattggaaaggaaaagaacttaaatgtgggagtggtatattcgtcacaaatgaagtgcacacctggacagaacaatacaaattccaagcagacagcccaaaaaggctagcaacagctattgctggtgcttgggaaaacggcgtttgtggcataagatcaacaacgagaatggagaacttattatggaaacaggtcgcaaacgaactgaattatatattatgggaaaacaatattaaactaacggttgtagtaggtgacattattggggtattagagcaaggcaaacggacactgacaccacaacctatggagttgaaatattcatggaaaacctgggggaaagcgaaaatagttacggcagaaacacagaatagcagctttataattgatggcccgaatacaccggagtgccctagtgcgtcgagggcttggaatgtatgggaagtagaagattatgggtttggagttttcactaccaacatatggctgaaactgagagaggtctatacacaactatgcgatcatagacttatgagcgcagcagtaaaagatgagagggccgttcatgcagatatgggctattggatagaatcccagaaaaacggatcatggaaacttgaaaaggcttcgttgatagaagtaaaaacttgcacctggccaaaaagtcatacactgtggtcaaatggtgtcttggaaagcgacatgattatcccaaaatccctagcgggaccaatatcacaacataattacagaccaggatatcacactcaaacagcgggcccatggcacttaggtaaacttgagctcgattttaattattgtgaagggacgactgtagtaatcactgaaaattgcggcacacgcggcccaagtcttaggacgacaaccgtctctgggaaacttatacatgagtggtgctgtagaagctgtactttaccaccacttagatatatgggcgaagatggctgctggtacggaatggagattagacctatttcagagaaagaagaaaacatggtcaaatctcttgttagtgcagggtcgggcaaagtcgataacttcactatgggtgtattatgtttagctatattatttgaagaggtcatgcgaggaaaatttggtaagaaacacatgattgcgggcgtctttttcacctttgtcttactattgagcgggcagataacatggagagacatggcccacacgttgattatgataggaagcaatgcatcagatcggatgggcatgggtgtaacgtaccttgccttgattgctacattcaaaatacagccatttcttgcactcggatttttccttcgtaaacttacaagtagggagaatttactactcggagtaggactagctatggcaacaacactacaattgcctgaggacatagaacagatggcgaacggtattgcactaggcctaatggccctaaaacttatcactcaatttgaaacttaccaactgtggacggcactgatcagcctgacttgtagcaacacgatttttacactgacagttgcatggagaacagcaaccctcatcttagctggagtgtcgctattgcccgtatgccagtccagttcaatgcgaaaatcagactggctacctatgactgtcgcagcaatgggcgtacccccgctaccattgttcatattctctttaaaagatacactaaaacgtagaagttggcctctcaatgagggagtaatggcagtaggcttagtatcaattctagcatcttcactattacgaaatgatgtgccaatggcaggaccacttgtagccgggggattactaatagcgtgttacgtcattaccggtacgtcagcagacctaaccgtagagaaagcggccgacgtaacttgggaagaagaggctgaacaaaccggagtttcacataacttaatgataaccgtagatgatgacggtactatgaggataaaagacgacgagaccgaaaatatactaacagttttattgaaaaccgcactgctgatagttagcggcatatttccttattcgatacctgctacgctcctcgtatggcatacgtggcagaaacaaacacggcgctctggagtattgtgggatgtaccatcaccaccagaaactcaaaaagcagaactagaagaaggcgtttatcgtatcaaacagcaaggaatatttggtaaaactcaggtaggtgtaggggtgcaaaaagaaggcgtctttcatactatgtggcatgtcacacgcggagcagttctaacctacaatggaaaaagattagagcctaattgggcttctgtcaagaaagacttaatttcatatgggggcggctggcgtttaagcgcccaatggcaaaagggggaggaagtgcaagtgattgccgttgagcctgggaaaaatcccaaaaatttccaaaccatgcccggtacctttcagacaacgacaggcgagattggtgcaatcgcattagattttaaacctgggactagcggtagtccaataattaatagagaaggcaaagtagtgggactatacggaaatggggtggtgaccaaaaatggtggctacgtaagcggtattgcacagacaaatgccgaacccgatggaccaacaccagagctagaagaggaaatgtttaagaaacgcaatctcacaatcatggatcttcatccggggtcgggtaaaacaagaaaatatctccccgccatcgtccgtgaggccataaaacgaagacttcgaacactcattttagctcccactagagtcgtagcggcagagatggaagaagcacttaaaggtctcccaatcagataccaaacaacagcgacaaagtcagagcacacagggagagaaatagtggacttaatgtgccatgcaacctttacgatgagactactgagcccggtacgagtcccaaactacaacttgataattatggacgaagctcattttacggaccccgcttcaatagctgcccggggatacatttcaacaagagtcggtatgggagaagctgccgcaatttttatgacagcaacacctccaggcaccgcggatgcattcccacagagtaacgcaccaatacaggacgaagaacgagacataccggaaagaagttggaacagtggtaatgagtggataaccgactttgcagggaaaacggtctggttcgtcccaagtataaaagctggaaatgatatagcaaactgtctgaggaaaaacggcaagaaagtcattcaattaagtcgtaaaacgtttgatacggaatatcagaaaacgaaactaaatgattgggacttcgtcgtcactacggatataagtgagatgggagcgaactttaaagctgatcgagtcatcgatccgagaagatgcctaaagcctgtgattctcaccgatgggccagaaagagtcatactggctggtccgatgccagttaccgccgcatctgctgcacaaaggcgaggccgggtagggcgcaatccacagaaagaaaacgaccaatacatatttactggacaacccctaaataatgatgaagatcatgctcactggactgaagccaaaatgctactcgacaacataaatactcccgagggaataataccggcactcttcgagcctgaacgcgagaagagtgcagccatagatggtgaataccgacttaagggagagtcacgtaaaacatttgtggaactaatgaggagaggggatctaccagtttggttggcgcataaggtagcaagcgaaggtattaaatacacagaccgaaaatggtgttttgacggacaacgtaacaatcaaatacttgaagagaatatggacgtagaaatatggacgaaggaaggtgagaagaagaaattaagaccgagatggcttgacgccagaacatacagtgacccgcttgcgttaaaagaatttaaggattttgcagcaggcagaaaatcaattgcacttgatttagtgacagaaatagggcgagtgccgagccacctagcgcaccgaaccagaaacgccctagacaatttggtaatgctgcacacatccgaacacggtggaaaagcctatcgacacgctgttgaagaattaccagagacaatggagacattactacttttaggtcttatgatacttttgactggaggggcaatgctatttttgataagtggtaagggcatcggaaaaacatcgatagggctaatatgtgtaatcgcaagctcaggtatgctctggatggccgaaatacctttacaatggattgcatctgcaatagtccttgagttctttatgatggttttactgatacccgaacccgaaaaacaaaggacaccccaagataatcagctagcttacgttgtcattggaattttaactctcgcagctatcatcgcagcaaacgaaatgggacttttagaaactaccaaacgggatctgggcatgagcaaagaacccggggtagtatcaccaaccagttatctcgatgttgacttacatccagcaagtgcatggactctatacgccgttgctacaacagtaatcacgccaatgctcagacatactattgaaaactcaacggctaacgtaagtctggcagcgatagcgaaccaggcagtagtattgatgggtctggataaaggatggccaatcagtaaaatggatctgggagtacctctgctagcattgggttgctactcacaagttaatccgttaaccttaacagcggctgtacttcttcttatcacacattacgctataataggcccaggcctacaagcaaaagctaccagagaagcccagaagcgtaccgcggcaggaattatgaaaaatccgactgttgatggaataatgaccattgacttagatccagtaatttatgattccaaattcgagaaacaacttggacaagttatgttgctcgtactttgtgctgtccagcttttgttaatgagaacgtcttgggcactatgtgaagcgctcacgctagcaacaggacccataacgaccctctgggaaggctcaccaggcaagttttggaacacaactattgcggtaagcatggcaaatatattccgagggtcatacctggccggtgctggactagccttttctattatgaaatcagttggaactgggaaaagaggtacaggaagccaaggagagacattaggagaaaaatggaagaagaaattaaaccaattgtctcggaaagagttcgatttatataagaaatctgggataacggaggtagaccgtacagaagctaaagagggattaaaaagaggtgaaataactcatcacgctgtgtccagaggcagtgccaagctgcaatggtttgttgaacgcaatatggtaatccccgaaggccgagtaatagaccttggatgcggcagaggaggatggagctactattgcgcaggattaaagaaagttactgaagtaagaggctacacaaaaggaggaccaggacacgaagaaccagtacccatgtctacctatgggtggaatatcgtaaaattgatgagcggtaaggacgtgttttatctgccaccagaaaaatgcgacacattgttatgtgatatcggcgaatcaagtcctagccccactgtagaagaaagtagaacaatccgtgtcctaaaaatggtagaaccttggctgaaaaataaccaattctgcattaaagttttgaatccgtatatgcccactgtaatcgaacacttagaaagactccaacgaaaacacggagggatgttagttagaaatccactttccagaaattccacacatgaaatgtactggataagcaacggcactggaaatattgtagcatccgtaaacatggtttcccgcctcctattaaatagattcactatgactcacaggcggcccacaattgaaaaagatgtggatttaggagctggcacccgtcacgttaacgccgaaccagagacacctaacatggacgttataggagagcgaataaaacgaattaaagaagaacataattctacgtggcattatgacgatgagaacccctataaaacttgggcttatcatggcagctatgaggtcaaagcaaccggaagtgctagttcgatgattaacggagtcgtcaaactactcacaaagccatgggatgtggtacctatggtaacacaaatggctatgacagatacaacaccatttggccaacagcgtgtttttaaagagaaagttgatacaaggactccaagatcaatgccgggtacccgcagagtcatgggaataacagcggaatggctttggagaaccctaggtcgaaataagaaaccaagattatgtacaagagaagaatttacaaagaaagtacgtaccaacgcagcgatgggagctgtatttacggaagaaaatcaatgggactcggcaaaagcggcagttgaagacgaagatttctggaagttagtagatagagaaagagagttgcataaattaggtaaatgtggatcgtgtgtatataatatgatgggcaaacgagaaaagaaactgggtgaatttgggaaggcaaaaggtagccgggcgatttggtatatgtggttgggcgctcgatatcttgaatttgaggcactaggatttttaaatgaagaccactggttctcacgagaaaattcatattctggtgtcgaaggtgaaggcttacataagctgggatatatactgagagacataagcaaaatcccgggaggagcaatgtacgcggatgataccgctgggtgggacaccagaatcacagaggatgacctgcacaatgaagagaaaattacacaacagatggatccggaacaccgacaactagctgatgctatatttaaactcacgtaccaaaacaaggtagtaaaagtgcaacgacccacaccgacgggtacagtaatggacataatctcccgcaaggatcagcgcgggagtgggcaagtcggaacatatggattaaatacttttactaacatggaagcacaactaataagacagatggagggggaaggtgtacttaccaaagcagatctcgagaatccacacctctccgagaagaaaataactcaatggctcgagacaaaaggggtagaaagattaaaaaggatggctatctcgggagacgactgtgtcgtcaagcccatagacgaccgatttgctaatgcgctcttagctttaaatgacatgggaaaagtaagaaaagatataccacaatggcagcctagcaagggctggcatgactggcaacaagttcctttttgcagtcatcactttcacgaacttattatgaaagacggaaggaaacttgttgttccatgtagaccacaagacgagcttattggccgcgctagaataagtcaaggcgcgggttggagcttaagagaaaccgcctgtttaggtaaggcatatgcccaaatgtggtctctcatgtactttcacagaagagatcttaggctagcctcaaatgcaatatgcagcgccgttccagtccattgggtcccgacctcgcgtacgacatggagtatacacgcccaccatcaatggatgacaacggaagatatgttaacagtatggaatcgagtatggatagaagataacccatggatggaagataaaacaccagtgaccacttgggagaatgtaccttatttgggaaaaagagaggatcaatggtgtggatctctaataggactaacgagcagagccacatgggcacaaaatattcctacagccatacaacaagttagaagcctcataggaaacgaggagttcttagactacatgccaagtatgaaaagatttcgtaaggaagaagaatctgaaggcgctatatggtaa

SEQ ID NO: 23342 - RNA, 9873 nt, synthetic construct
  misc_feature 1..9873: note = derived and/or modified CDS sequence (opt6) from DENV-3__FJ182011__SS-prME
  source 1..9873: mol_type = other RNA
actagcttatgtttaatgatgatcttaccggctgctcttgcatttcatctgacctcacgggatggagaaccccgaatgatagtgggtaaaaatgaacgcggtaaatctttattatttaaaactgcttcaggtataaatatgtgcacattaattgctatggacctgggtgaaatgtgcgacgacacagtgacttacaaatgcccccacattgcggaagtagaacctgaggacatagattgctggtgcaacttaacatcaacatgggtcacgtatggcacgtgtaatcaagcgggagagcatcgtcgcgacaaaagaagtgtggcgcttgccccacatgtagggatgggacttgacactcgtacacagacttggatgagtgcagaaggagcctggagacaagttgagaaagtagaaacgtgggcgctaagacatccaggattcaccatcttagcgttattcttagcccattatataggaacctcgttgacgcaaaaagtagtcattttcatactacttatgttagtaacaccatctatgaccatgagatgcgttggagtaggaaacagagacttcgtcgagggtttatcaggggcgacctgggtggatgtagtactggaacacggagggtgcgtaactacaatggctaaaaataaacccacactagacatagagctacagaaaactgaagcaactcaactagctacattaaggaaattatgtattgagggaaaaataaccaacatcaccaccgattcgcgatgccctacccaaggagaagctgtattgccagaagaacaagaccaaaattatgtatgcaaacatacctatgtggataggggctgggggaacggttgcggcttattcggaaaaggcagtctggttacctgtgcaaaatttcaatgtcttgaaccaattgaaggcaaagtcgtccaatatgaaaacctcaaatatacggtcataataactgtccatacgggggaccaacatcaagttggcaatgaaacccaaggtgtaacagccgagataacaccacaagcatctacaacggaagccatattacctgagtatggaaccctcggtctagaatgcagcccccgtacaggacttgatttcaacgaaatgatactattgactatgaaaaacaaagcatggatggtacaccgtcagtggttctttgatctaccgcttccatggacaagtggcgcgaccacggaaacacccacatggaataggaaagaactattagtgacatttaaaaatgctcacgccaagaaacaggaggtggtagtgttgggatcgcaagaaggggccatgcatacagcattaacaggcgccactgaaattcaaaactcgggcggcacgagcatatttgcaggtcatctgaaatgcagactaaaaatggataaattagaacttaaaggcatgtcctatgccatgtgcactaatactttcgttttgaagaaagaagtcagcgagacccagcatggtacgatactaataaaagttgaatataaaggagaagatgccccttgtaaaatcccgttttccacagaggatgggcaggggaaagctcataacggaagacttatcacagcaaatcccgttgttacgaaaaaggaggaacctgttaatatcgaagctgaaccgccatttggcgagtctaatattgtcataggtataggggataacgctttaaaaattaactggtataagaaagggtcgagcatcggaaaaatgtttgaggcgacagctcggggagcccgtaggatggccatattgggtgataccgcctgggactttgggagcgtaggcggtgtattaaattcacttggaaaaatggtacatcagattttcgggtcagcatatacagcgctattttcgggcgtcagctgggtcatgaaaattggtattggtgttctactaacctggattggactaaattctaaaaataccagtatgagtttttcatgtatcgccataggtattattactctttacctgggagcggtcgttcaagctgacactggatgtgtgataaattggaaaggcaaagaattaaaatgtggatctggtatctttgtgacaaacgaagtacatacgtggacagaacagtataaatttcaagcggattctcccaaacgattggcaacagcaatagctggagcctgggagaacggtgtatgcggaatccgaagtacaactagaatggaaaatctattgtggaaacaaatcgccaacgagttaaattatatattatgggaaaataacataaaacttactgtggttgtcggagacataattggggtactagaacaaggaaaacgaactctaacgccacaaccaatggaactaaaatattcatggaaaacatggggaaaagcgaaaatagtcacagcagagacccagaactccagtttcattattgacggcccaaacacccctgaatgcccttcggcttcacgtgcatggaacgtctgggaggtagaagattacgggttcggagtatttactaccaatatatggctcaaacttcgcgaagtatatacacagctatgcgaccataggcttatgagtgcggcagtaaaagacgaacgagcagtgcatgccgacatgggatattggattgaatcacagaaaaatggatcatggaaactcgaaaaagcaagtttaattgaagttaagacatgtacatggcctaaatcacatactttatggtcaaacggagttctagaatcagatatgattattcctaagtctcttgcaggtcctatatcgcaacataactatcgacctggatatcacacacaaacagctggtccgtggcacttaggaaagttagaactagattttaattactgtgagggaacgacagttgtaataacagacaattgcggaacccgaggaccatcacttcgtactactacggtaagtggtaaactaatacatgaatggtgttgtaggagctgtacgttgccacctcttcgatatatgggggaagatggctgttggtacgggatggaaattaggcctatttcagagaaagaggagaacatggtcaagagtcttgtaagcgcaggaagtgggaaggtagacaattttacaatgggcgttctatgcttagcaattctatttgaagaagtgatgcgtggcaaattcggcaagaaacacatgatagctggcgtattctttacctttgttcttctattgagcggtcaaataacttggagagacatggcgcatactttgataatgataggttcgaatgcctcagaccgaatgggtatgggagtgacttatctagctttaattgctacatttaaaatacagccttttctagctttagggttctttctcagaaaattaacttcaagggaaaatctcctattaggcgtagggctagcaatggcaacaactctacaattaccagaagatattgaacaaatggcaaatgggatagctctaggtttaatggctttaaaactcataacacaatttgagacatatcagctgtggacagcgctaatatccttaacgtgttccaatactatttttacgctcacagtagcatggaggacagcgacattgatcttagcaggagtaagccttctgccagtatgccaatcttcatcaatgcgtaaatcagattggctaccaatgactgtagctgcaatgggagtccctccattaccactgttcatattctccttaaaagataccctaaagaggagatcatggccactaaacgagggtgtcatggccgttggactcgtttcaattttggcctcttccctgctaaggaacgatgtaccaatggcggggcctctagtagctggaggtttattgatcgcatgttacgtcataacaggaacaagtgcagatctaactgtagagaaagcggcagacgtaacatgggaagaagaagctgaacagactggagtaagccacaatctaatgataacagtggatgacgatggaactatgaggataaaagacgatgaaacagagaacatcctgacggtcttactgaaaactgcgctactgatcgtctcgggaatctttccatacagcattcctgcgactctcttggtatggcacacatggcaaaaacaaactcgccgcagcggagttctatgggatgttccatccccacccgaaacccagaaggctgaactagaagaaggagtttatcgaattaaacaacaaggaatcttcggaaagacccaggtaggagtaggggtacaaaaagaaggagttttccacactatgtggcacgtcactagaggagcggtactaacctacaatggaaagagactggaaccaaattgggctagcgtaaagaaagacctcattagctatggcgggggctggcgactcagtgcccagtggcaaaaaggcgaagaagttcaggtaatagcagtggaacctgggaagaaccctaagaattttcaaacaatgcctggaacattccagacgaccactggtgaaattggagcaatagcattagattttaaacctggcacttcaggcagcccaatcataaacagagaagggaaagtagtcggtctctacggtaacggggtagtaactaaaaatgggggttacgtttctggcattgcgcaaacaaatgcagaacctgatggtccgacaccagaattagaggaagagatgtttaaaaagcgtaatttaaccataatggacttacatcctggctccggtaagacaagaaaatatcttcctgctattgtccgagaagctattaaaagacgccttagaaccttaatacttgcaccaacacgagtagttgcagccgaaatggaagaagcactaaaaggactacctattagatatcaaactacagcaactaaaagcgaacatactggacgagaaatcgtagacctaatgtgccatgctactttcaccatgcggctgctaagcccagttcgtgtgcccaattacaacctaataataatggacgaagcacatttcacagaccctgcatcgattgcggcccggggttacattagcacacgcgtagggatgggcgaagcagcagcgattttcatgaccgcaacaccaccaggtaccgccgatgcattcccgcaatcgaacgcacctattcaagatgaagaacgcgatatacccgaacgatcttggaactccggaaatgaatggatcacagatttcgcaggaaaaactgtctggttcgttccaagtataaaagcagggaacgacattgcaaattgcttacgtaagaacggtaagaaagttatacaactttcgaggaagacttttgacacagagtaccaaaagacaaaactaaatgattgggacttcgtagtgacaacagacatatcagaaatgggagcgaactttaaagcagaccgggtaattgaccctcgtaggtgcctgaagccagtaatactcacagatgggccagaaagggtgatcttggccggaccaatgccagttacggcagcaagtgcagcccaaagaagagggcgggtaggtaggaacccgcaaaaagagaacgatcagtatattttcacgggtcaaccactgaacaatgacgaagatcacgcccactggacagaagctaaaatgctacttgacaatattaacacacccgaaggcatcattccagcactttttgagccagagagggagaagtctgcagccatagatggcgagtaccgacttaagggtgaaagtcgaaaaacatttgtcgaactcatgagaagaggggacctaccagtatggttagctcataaagtggcgagtgagggaataaaatatacagaccgaaagtggtgcttcgatggacaacgcaataaccagatactcgaagaaaatatggatgtagaaatatggacaaaggaaggagaaaagaagaaacttcgcccgcggtggttagacgccagaacgtactctgatcctttagccctaaaagagttcaaagacttcgcagctggtagaaaaagtatagctttagatctggtaacggaaattggaagagtaccttcacaccttgcccacagaacgagaaatgcgttggataacctagtaatgcttcatactagcgagcatggagggaaagcctatagacacgcagtggaagaattaccagagacaatggagacgcttctattacttgggttaatgatactcctaacaggtggagcaatgctatttctcatttctggaaaaggaatagggaaaacttcaataggtctaatttgtgtcatagcctcaagtggcatgttgtggatggcggagatcccattgcagtggattgcgtctgcaatcgtactagagttcttcatgatggtgttactaatcccagagcctgagaaacaaagaacaccacaagataatcagttagcttacgttgtgatcggaatcctaacattagctgcgataattgctgcaaatgaaatggggttacttgaaaccacaaaaagagacttaggaatgagcaaagaacctggcgtagtctcgccaacgtcatatctagatgtcgatttacatcccgcctcggcatggacattatacgccgtggctacaaccgtaataacgcctatgttaagacatacaatagaaaattcaacagctaatgtctcattagcagctattgcaaaccaagcggtagtactaatgggacttgataaagggtggccaatttctaaaatggaccttggtgtcccactacttgcattagggtgttactcccaggtgaatcctctaacactgacagctgctgtcctattactcataacacactatgcaataataggtcctggactgcaagcaaaggctacgagagaagctcaaaaacgtactgctgcaggaataatgaaaaacccaacagtcgacggtataatgacaattgatctcgatccagtgatatatgatagcaaattcgaaaaacagcttggtcaagtaatgttactggtgctgtgcgccgttcagctgttactaatgcgcacaagttgggcattatgtgaagctctaacattggctacgggtcctataacaacgctgtgggaggggagccctggaaaattttggaatactacaatagctgtgagcatggccaatatttttagaggttcatatcttgcaggagctggtttagcattcagcataatgaaaagcgttggtactggaaaaagaggaacagggtcccaaggagaaaccctaggggaaaaatggaagaagaaattaaatcagctttctagaaaagagttcgatttatacaagaaaagtggaattacagaagtcgataggacggaagcaaaagaagggctgaaaagaggcgaaatcacacaccatgcagtaagccgtggatccgcaaaattacaatggtttgtagaacggaatatggtaattccagaaggaagagtaattgatttaggatgcggtaggggaggatggagttattattgcgcggggctaaagaaagttacagaagttagaggatatactaagggcggcccaggccatgaagaaccagttccaatgtcaacatacggatggaatatagttaagctaatgtccggaaaggacgtattttacctacccccggaaaaatgtgatacgttattgtgtgatatcggtgaaagtagcccatcccctactgtagaagaatcccggacaatcagagttttaaagatggttgaaccttggctgaaaaacaatcagttctgtataaaagtacttaacccatatatgccgacagtaatcgagcatttagaaagactccaacgtaaacatggcggcatgttggttagaaacccactcagcaggaactcaacccatgaaatgtactggattagtaacgggaccggaaatatagtagcatccgtaaatatggttagtaggctcttactgaacagatttacgatgacacatagacgccctacaatagagaaagatgtagacctaggcgcaggtactcggcacgttaacgccgagcccgaaacgccgaatatggacgtaataggggaaaggataaaaagaattaaagaagaacataactcgacatggcattatgatgatgaaaacccttataaaacgtgggcataccatgggtcatatgaagtcaaagcaacaggaagcgcctcaagtatgataaatggggttgtcaaattactaacgaaaccctgggacgtagtaccaatggtaacacagatggctatgacggataccactccctttggtcaacagcgtgtgtttaaagaaaaagtggacacacggactcctcgttcgatgccaggaactcggcgagtgatggggataactgcagaatggttatggcgtacgttagggagaaataagaagccaagactttgcacgagggaagaatttactaagaaagtaaggacgaatgcagctatgggtgcggtatttacagaagaaaatcagtgggatagtgccaaagcggcagtagaggatgaagacttttggaagttagtagaccgtgagagggaattgcataagttaggaaagtgtggtagctgcgtttataacatgatgggaaaaagagagaagaaactaggagagttcggtaaagcaaaaggatccagagcaatttggtatatgtggctcggagcacgatacttagaatttgaagctctgggattcttaaatgaagatcactggttttctagagaaaactcctacagcggcgtagaaggggaaggcctacacaaattagggtatatactgagagacataagtaaaatacccggaggagcaatgtacgctgacgatactgctggatgggatacaagaataaccgaggacgatctacacaatgaggagaaaattactcaccaaatggatcctgaacatagacaattggctaacgcaatctttaaactaacttaccagaataaggtcgtgaaggttcaaaggccaacaccaactggtactgtaatggatataatttcaagaaaagatcaacgaggttcggggcaggtaggaacgtatggtttgaatacattcacgaatatggaagcgcaactgataagacaaatggaaggagaaggcgttctatccaaggccgatttagaaaacccacatctatcagaaaagaaaataacacaatggctagagaccaaaggtgttgaaagacttaaacgcatggcgatttctggggatgattgtgtcgtcaaacctatcgatgatcgatttgcaaacgctttgttagcactgaatgatatgggaaaggtccgcaaggatataccacagtggcagccgtcgaaaggatggcacgattggcaacaagtaccattttgttcacatcattttcatgaactaattatgaaagatggacgaaagttagtcgtaccatgtagacctcaggatgagcttatagggcgtgcacgtatcagccaaggggcaggttggtcactcagggagacagcgtgtcttggaaaagcatatgcacaaatgtggagtctgatgtatttccatcgtcgggatttaagattagcttccaatgctatatgcagcgcggtacctgtacattgggttccaacctcccgcacaacgtggagcatacacgctcatcaccaatggatgaccactgaggatatgctaacagtatggaacagagtctggattgaggataatccgtggatggaagacaaaacaccagtaacaacatgggaaaatgtcccatacctcggaaagagagaagatcagtggtgcggaagtttaataggtttgacctcccgagcgacgtgggcacaaaatatacctactgcaattcagcaggttagatcattaataggcaatgaagagttcttagattatatgccaagcatgaagaggtttcgcaaagaagaagagtcagaaggggcgatctggtag

SEQ ID NO: 23343 - RNA, 9873 nt, synthetic construct
  misc_feature 1..9873: note = derived and/or modified CDS sequence (opt6) from DENV-3__FJ182038__SS-prME
  source 1..9873: mol_type = other RNA
acctctctttgcttaatgatgattttaccggcagccttagcatttcatttaacctctagggatggtgaaccccgaatgattgttggcaaaaacgaacgtggaaaatcactactatttaaaaccgccagcgggattaacatgtgcacgctaatcgccatggatctaggagaaatgtgtgacgacaccgtaacgtacaaatgtccgcacataacagaagtagaaccggaagacatagattgttggtgtaatctaacttcaacatgggttacttacggaacttgcaatcaagccggtgaacatcgccgtgataaacggagtgtcgctttagctcctcatgttggtatgggtctggatactcgaacgcaaacatggatgagtgctgaaggagcgtggagacaagtcgaaaaagttgagacctgggcgttacgtcatcctggcttcacgatacttgccttgtttttggcacactatattggaacttcattaacacaaaaagtagttatatttattttactcatgctggtaactccatctatgacgatgcgctgtgttggtgtgggaaaccgagacttcgtagaaggtctgtctggcgccacatgggtggacgtggttctagaacacggaggatgcgtaaccactatggcgaaaaataaacctacattagatatagaacttcagaaaacagaagcaactcaactagccacgctacgcaaattatgtatcgaaggaaaaattacaaacataacaaccgatagtagatgtccaacacaaggagaagcagttctaccggaagaacaagatcaaaattatgtgtgcaaacatacatacgttgatcgcggatggggtaatggttgtgggttattcggaaaagggagcttagtgacgtgtgcaaaattccagtgtctcgagccaatagaaggtaaagtagttcaatacgaaaacctaaaatataccgtaataataactgttcatacaggggaccaacaccaagtcggcaatgaaacacaaggggtaactgcagaaatcacaccacaagcatccactacagaagcgattctcccggaatacggcacgctaggcttggaatgttcgcctagaacaggtctcgatttcaatgagatgattctattaaccatgaaaaacaaagcatggatggtacatagacaatggtttttcgatttaccattaccatggacttccggagcgacgacagagacacctacttggaatagaaaagagcttcttgtaactttcaaaaatgcgcacgcgaagaaacaggaagtcgttgttcttggtagccaggaaggagcaatgcacacggctctaacgggagcgacagaaatccaaaacagcggcggaacttccattttcgctggccatttaaaatgtaggctaaaaatggacaaattagaattgaaaggtatgagctacgctatgtgcacaaatacttttgtacttaagaaagaagtaagtgaaacacagcatggaacaattctaataaaagtcgaatataaaggagaagacgccccttgtaaaattcccttctcaactgaagacggtcaaggaaaagcccacaacggaagattaatcacggcaaaccctgtagtcacgaagaaagaagaacccgtaaacattgaagctgaaccaccttttggagagtcaaatatagtcatcgggattggagataatgctttaaaaataaattggtataagaaaggatcctcgattggaaaaatgtttgaagcaacggctcgaggtgcaagacgaatggcaatattgggagatacggcatgggattttggaagcgtagggggagttctaaacagccttggaaaaatggttcatcaaattttcggcagcgcctatacgacattattctcgggggtatcgtgggtgatgaaaataggaataggcgttttgctaacatggattggactaaacagtaaaaacacaagcatgagcttttcctgtatcgcgataggcgtaataaccctgtaccttggcgcagtcgtacaagcagacatgggatgtgtcataaattggaaaggtaaagagctaaaatgtgggtctggcatatttgtcacaaatgaagtgcacacatggacagaacaatacaaatttcaagcagattcaccaaaaagactcgcaaccgcgatagctggtgcatgggagaacggtgtatgcggaataagaagtactacaagaatggagaacttgctatggaaacaaatagcaaatgaattaaactacatactatgggaaaataacattaaacttacggttgtcgtaggtgatattataggggtactcgaacagggcaaaagaacattaaccccgcaacctatggaactaaaatattcatggaagacctggggtaaagcaaaaatagtaactgcggagacccaaaattcttcatttataattgatgggccaaacacaccggaatgtccgtcggcttcccgggcttggaatgtttgggaagttgaagactacgggttcggtgtttttacgacaaacatttggttaaaattaagagaagtatacactcaactctgcgaccaccggttgatgagtgctgccgtaaaggacgaaagagccgttcatgcagatatggggtactggattgaaagtcagaaaaacgggtcttggaaattagaaaaggcttcgttaattgaagtaaaaacttgtacatggccaaaatctcacaccctatggtcgaatggagtattggagtcagatatgataattccaaaatcacttgcgggaccgatatctcaacacaactacaggccgggttatcatacacaaacagccgggccatggcacctaggaaagttagagctagattttaattattgcgaaggaacaactgtcgtaattaccgaaaactgtggaacacggggcccgtccctccggacaaccacagtcagcgggaagctgatacacgaatggtgttgtagatcctgtacgcttccacccttaaggtacatgggggaggatggatgctggtacgggatggaaataagacctatttccgagaaggaagaaaatatggtaaaatctctagtcagcgccggctcaggcaaagtcgataattttaccatgggagttctttgtctagccattctgtttgaagaagtaatgcgagggaaatttggtaagaaacatatgattgctggtgtgttctttacgtttgtactcttattatcggggcaaatcacttggagggatatggcgcacacactaataatgataggatcaaacgcaagcgacaagatgggcatgggtgttacgtacctcgcactaatagcaacatttaaaatccaaccatttttagcattaggattcttcttaagaaaattaacaagcagagaaaatttattactgggtgtaggtctagccatggccacaactttacaattgccagaagacattgaacaaatggctaatggtattgcgctggggttgatggcacttaagttaataactcaatttgaaacatatcaactatggacagctttaatcagcttaacttgtagtaacaccatgtttaccttaacagttgcatggcgtacagctacgctaatattagcaggcgtgagcctcttaccagtctgtcagagttcttcaatgaggaaaacagattggttaccaatggctgtagctgcgatgggcgtacctccgttgccgctgtttatattctcattgaaagacacacttaaaagaagaagttggcctctaaacgaaggtgttatggcggtaggcttagtaagtatactggctagttccctcctgcggaacgatgtgccaatggcgggccccttagtagcaggcggtttgcttattgcctgttatgtaattaccggcacaagtgcggatttaacagtggaaaaggcggcagacataacttgggaggaagaagcagaacagactggagtttcacataatctgatgatcacagtagatgatgatgggacgatgagaattaaagatgacgagacagaaaatatattgactgtgcttcttaagacagcactcttgatagtgagtggcgtctttccctattcgataccggcgactttgctagtctggcacacatggcagaaacagacacaaaggagtggtgtactatgggatgtgcccagtcctccggaaacacaaaaagcggaactagaagaaggagtttatagaataaaacaacagggcatttttggtaaaacgcaagttggagtcggagtgcaaaaagaaggtgtcttccatacgatgtggcacgtgacccgaggagctgtcttaacctacaatggtaaaagattagaacctaactgggcctcagtcaagaaagatttgataagttacggtggaggatggcgattatcggcccaatggcaaaaaggagaagaagtacaagttattgctgtagaacccggaaagaatcctaagaattttcagaccatgccgggaacttttcaaaccacaacaggagaaatcggagcaatagcattagactttaagcccgggacatcagggtcacctataattaaccgcgagggaaaagttgtcggtctatatggtaacggtgtagtaaccaaaaatggtggatacgtctctggaatagcgcaaaccaatgcagaaccagatggaccgacgcctgaactggaagaagaaatgttcaagaaacgaaatctcacaataatggacctacaccctggtagtggcaaaacaaggaaatatctgccagcgatagtacgtgaagcgataaaacgtagattgagaacacttatactagcacccacacgagttgttgcagctgaaatggaggaagcattaaaagggttaccgattagatatcagacgacggctaccaagtccgaacataccggacgggaaatagttgacttaatgtgtcacgccacatttacgatgagattgctctcgccagtaagagtcccgaactataacctcataataatggatgaagcacatttcactgacccagctagtatcgccgcaagaggttacataagcactagagtaggaatgggagaggctgcagctatattcatgacagctacgcctccgggcacagcagacgccttccctcagagtaatgcaccaatccaagatgaagaacgtgacatacctgaaagatcctggaatagtggtaatgagtggattacagacttcgcaggaaaaacagtatggttcgtccccagtattaaagcaggtaatgatatcgcgaactgcctacgcaagaatggaaagaaagtcatacagctctctagaaagaccttcgatacagaataccagaaaacaaaacttaatgactgggacttcgtggtaactacagacatatccgaaatgggtgcaaacttcaaagccgaccgggtaatagatccgaggagatgcctaaaaccagtgatactgaccgatggacctgaaagggtaatcctagcggggccaatgcctgtaacagccgccagcgctgcacagagaagagggagggtaggacgaaacccacagaaagagaatgatcagtatatatttatgggacaaccccttaataatgacgaagaccatgcccattggacagaagcgaagatgttattagacaatataaatactccagaagggatcatacctgcgctctttgagccagaaagagagaaatcggcagctatagatggagagtatcgattaaaaggtgaaagccgaaagacatttgtagaactgatgcgtcgaggcgatcttcccgtatggctcgcacataaagtggcgagcgagggtatcaagtatacggaccgtaaatggtgctttgatggtcaaagaaacaatcagatattagaagaaaatatggatgtagaaatatggaccaaggaaggtgagaagaagaaacttagaccgcgctggctggacgctagaacttatagtgatccactagcgttaaaagagtttaaagatttcgccgcaggtcgaaaatccattgcattagatctcgtcaccgagataggaagggtaccatcacatctagcacacagaacaagaaacgctcttgacaatttagttatgttacatacaagtgaacacggtggacgagcatacagacatgctgtagaagaacttcccgagactatggaaacactccttttactcggtctaatgatcctcttaacgggaggcgctatgctattcttaataagcggaaaaggaatagggaagacaagtataggactgatatgtgtgattgctagtagtggtatgttatggatggcagaaatacctctacagtggatagcaagcgcaatcgtattggagttcttcatgatggtgttactaattcctgaacccgaaaaacaacggacaccacaagacaatcaactcgcctacgtcgttattggaatattgacacttgcagccacaatcgcagccaatgagatgggcttattagaaacaacaaagagagacttaggaatgtcaaaagaaccaggggtagtcagccctacatcctatctagacgtggatttacatccagcatcagcatggacattatatgccgtcgctacaacagtaataacgccaatgctgcggcatacgatagaaaattctacggcaaatgtatcattggctgcgattgctaaccaagcagtagtactaatgggattggataagggctggcctatatctaaaatggacctaggtgttcccctattagcattaggatgctacagccaggttaatcccttgactttaacagcggcggtactactcctaattacacattatgcaataatcggacccggcctgcaagctaaagccacacgtgaggcgcagaaacgaacagctgcaggaataatgaaaaatccaactgtagatggaataatgacaattgacttagatccagttatctatgattctaaattcgaaaaacaattaggtcaagttatgttacttgttttatgtgctgtacaactattacttatgagaacatcttgggctctttgtgaagcactaacacttgctacgggcccaataacgacattatgggaagggagtccaggaaagttctggaacacaacaatcgcagtatctatggcaaacatcttccgaggatcgtacctcgccggagcaggactagctttttcaataatgaaaagcgtaggtactggtaaacgaggcacaggtagccagggtgaaacattaggagagaaatggaagaagaagctcaatcaactttcaagaaaggagtttgatttatacaaaaagagcggtataacggaggtagatcgcaccgaagccaaggaaggtcttaaaaggggagagacaacacatcatgcagttagcagaggtacagcaaagttacaatggtttgtagaaaggaacatggtcataccggaaggtagagtgatagacctaggatgtgggcgaggcggttggtcttattactgtgcgggacttaagaaagtaaccgaagtgcgtggctatacaaaaggtggacctgggcatgaagaaccagtgcctatgtccacatatggatggaatatagtaaagttgatgtccggaaaagacgtattttatttaccccctgaaaaatgtgacacactactctgtgatataggggaaagttctccgagtccgacagtggaagaaagtcgtacaattagggttttgaaaatggttgaaccgtggctgaaaaataaccaattctgtattaaagtactaaacccttatatgcctaccgtcatagaacatctcgagaggttacaaaggaaacatggaggaatgctagtacgaaaccctttgtctcgaaattcaacacatgaaatgtactggataagcaacggcacgggaaacatagttgccagtgttaacatggtctcgcgactattactaaatcgtttcacgatgacccatagaagacccacaatagaaaaagacgttgatctaggtgcaggtacacgtcacgttaatgctgagcctgagactccaaacatggatgtcatcggagaacgaataaaacgaattaaagaagaacataattccacatggcattatgatgatgaaaatccatataaaacgtgggcgtatcacgggtcttacgaagtaaaggctacgggaagtgcaagcagtatgataaacggtgtggttaaattactgaccaaaccatgggacgtagtaccaatggtaacacaaatggcgatgacagataccacacctttcggccaacaaagagtctttaaagaaaaagttgacactagaactccacgttctatgccagggacacgacgagtaatgggtatcactgcagagtggctctggcgcaccttaggaagaaataagaaaccaagattatgtacacgagaagagttcactaagaaagtacgaacaaacgctgccatgggcgccgttttcacggaagaaaatcaatgggattccgcaaaggctgccgtagaagatgaagatttctggaaacttgttgacagagaacgagaactacataaattaggtaagtgcggtagctgcgtgtataacatgatgggaaaaagagagaagaaattaggtgaatttggaaaggcaaaaggcagtagagcaatctggtatatgtggctaggtgcacggtatcttgagtttgaggcattaggttttctgaatgaagatcactggttctccagggaaaattcttacagcggggtggaaggagaaggtttacacaaattgggttatatattacgagatatcagcaaaataccaggaggagccatgtacgcagacgacactgctggttgggatacaagaatcacggaagatgatttacacaacgaagagaaaataacacagcaaatggatccagagcataggcaattagctaacgcaattttcaagttgacctaccaaaataaagttgtaaaagtacaaagaccaacacctactgggactgttatggatatcatttcaagaaaagaccagaggggaagcggtcaagtgggtacttacgggttaaacacattcacgaacatggaagcgcaactaattcgtcagatggagggcgaaggagtattatccaaagcggatcttgaaaatccacatcttcccgaaaagaaaataactcaatggctggagacaaagggggttgaacggttgagacgaatggcgatttctggtgacgattgcgtggttaaaccaatagatgaccgtttcgccaacgccctactagcccttaatgacatgggaaaggttcgtaaagacataccacaatggcaacctagtaaaggatggcatgactggcaacaggtacctttctgctcacatcattttcacgaactcatcatgaaagatgggcgaaagctagtcgtaccttgtcgtccccaagatgaacttattggcagagcgaggatatcacagggcgccggctggtctttgcgagagactgcttgcctgggtaaggcttatgcccaaatgtggtcattgatgtactttcacagaagagatttacgactcgcatcaaacgctatatgttctgcggtaccagtccattgggttccaacctctcgtacaacctggagcatacatgcccatcaccagtggatgacaacagaagatatgttaactgtttggaatcgagtatggattgaggataacccttggatggaggataagacccctgttactacttgggagaacgtaccatacctaggaaaaagagaagatcagtggtgtggatctcttataggtttaacgtcaagagctacatgggcacagaacatacccacagcgatccaacaagtgcgttctttgattggaaacgaagagtttctagactacatgccgtcgatgaagagattcagaaaggaggaggaatcggaaggagcaatttggtga

SEQ ID NO: 23344 - RNA, 9873 nt, synthetic construct
  misc_feature 1..9873: note = derived and/or modified CDS sequence (opt6) from DENV-3__FJ182041__SS-prME
  source 1..9873: mol_type = other RNA
acttcactttgtttaatgatgattctacccgctgcacttgcgtttcacttaaccagccgagatggagagcctcgaatgatagtgggtaaaaacgaacgtggaaaatctttactctttaaaactgcatcgggaatcaatatgtgcacgctaatagcaatggatctaggtgaaatgtgtgatgatactgtaacatacaaatgtcctcacattgcagaagttgaacctgaagacattgactgttggtgtaatttaacctcaacatgggttacttacggaacctgcaatcaggcaggcgaacatagacgcgataaaagatctgttgcactagcaccgcatgtaggaatggggttagatacgcgaacccaaacttggatgtctgcagaaggagcatggagacaagtagaaaaagtagaaacttgggcactgagacatccaggatttacgattctagctctctttctggcacactatatcggaacgtcgctaacccagaaagtagttatatttattttactaatgctagtaactccatcaatgaccatgagatgcgttggtgtaggaaatcgagatttcgtggaaggcctaagtggagcaacctgggtagatgtagtcctggaacacggaggttgcgtaacaactatggctaaaaacaaaccaactctggatatagaattacagaaaacggaagcgacgcagctagctactctcagaaaattatgtatagaaggtaaaataacgaatattaccactgattctcgctgtccaactcaaggtgaagccgtcttacccgaagaacaagaccagaattatgtctgcaaacacacatatgtcgataggggatggggaaacggatgtggtttatttggaaaaggtagtttggtgacatgtgcaaaatttcaatgcctagaaccaatcgaaggaaaagtagtacaatatgaaaacctcaaatatacagtaattataacagtacacacaggagatcaacatcaagttggaaatgagacacaaggtgtaactgctgaaataacaccacaagcaagcacaacagaagcgatacttcccgagtacggaacactaggattagaatgttcacctcgaacaggtttagattttaacgaaatgatcctactaactatgaaaaataaagcgtggatggtacacagacaatggttctttgatctacccctaccctggacatcaggagccacaactgaaactccgacgtggaaccgtaaagagttgcttgtaacattcaaaaacgctcatgccaagaaacaagaagttgttgtactagggagccaggaaggggcgatgcataccgccctaacaggtgcaacagagatacaaaattccggagggacgagcatatttgcaggccacttaaaatgtcgtctgaaaatggacaaacttgagttaaaaggaatgtcctacgctatgtgcaccaacacttttgtactaaagaaagaggtgagtgaaacccagcatggaacaatccttattaaagtagagtataaaggggaagacgttccttgcaaaataccattttccacagaggatggtcaaggtaaggctcataatggacgcctgatcacggcaaaccccgtggttactaaaaaggaagaaccagtaaatattgaagcagaaccaccatttggggagtcgaatatagttataggtattggcgataatgcgttaaaaattaattggtacaagaaaggtagctcaatcggaaaaatgtttgaagcaacagctagaggggctaggcgtatggccatattaggtgataccgcctgggattttggaagtgtaggaggagtcttaaatagcctcggaaaaatggtacatcaaatcttcggtagcgcctatacagcgttgtttagcggagtaagttgggttatgaaaataggtataggtgtgttactaacttggataggtttaaactccaagaatactagcatgagtttttcatgtatcgctatcgggatcatcactttgtatttaggggcggtagtacaagcagacacaggctgcgtaattaattggaaggggaaggaactaaaatgtggctcagggatattcgtaaccaacgaagtgcatacgtggacagaacagtataaatttcaagctgattcacccaaaagattggcaacagcaatcgcgggggcatgggaaaatggtgtgtgcggaatacgttcaactacacggatggaaaatctcctttggaaacaaatagcaaacgaactaaactatatactatgggagaataacatcaaattaacggtcgttgtaggagatattataggagtcttagagcagggtaaaagaaccctcacaccgcaaccaatggagctcaagtactcgtggaaaacgtggggtaaagctaaaatagtgacagcggaaacacaaaacagtagttttatcatcgacggccctaacacacctgaatgtccatcagcttctcgtgcatggaacgtctgggaagttgaggattatggtttcggagtgtttacaactaatatttggttaaaactccgagaggtgtatacacaattgtgcgatcaccgtttaatgtcagcagctgtcaaagatgaaagagcggtacatgctgacatgggatattggatcgaatcccaaaagaatggtagttggaaacttgaaaaagccagcttgattgaggtaaagacatgcacctggccaaaatcacatacactctggtcaaacggagttctagagtctgacatgataattccgaaaagcctagccgggcccataagccagcataattatagaccgggatatcacacacaaacggcaggtccctggcacctaggaaaattagaattagattttaattactgtgaagggacaacagtagttataacagaaaactgtggaacaaggggcccttcactaagaacaacaacagttagcggaaagttgatacatgaatggtgttgcagaagttgtacccttccaccgctgcgatacatgggagaagatggttgttggtacggaatggaaataagaccgatcagcgaaaaagaggagaatatggtgaaaagcctcgtttctgctggatctggtaaagttgataattttactatgggggtcttatgcttggctatcttatttgaagaagtgatgaggggaaaatttggtaagaaacacatgatagcgggagtgttctttacctttgtattactactctccgggcagattacctggcgcgatatggcacacacattgattatgatagggagcaatgcaagtgatcgtatgggcatgggggtgacatatctcgcgttaattgcaacattcaagatacaaccatttctagctttaggattcttcctacgaaaactaacctccagagaaaatttattattaggtgtgggactcgctatggctacgactctacaactacccgaagatatagagcaaatggctaatggaatagctttaggcctaatggcactgaagttaattactcaatttgaaacataccaactgtggacagctttaatcagtctaacatgcagtaatacaattttcacactaacagtagcatggcgtactgctacgctgatattagcaggggtgtcgctactgcccgtctgccagtcttcctctatgcggaagtcagactggcttcctatgaccgtggcggctatgggagtacctcctttaccgttattcattttctctctaaaggatacattaaaacgaagatcttggcctctaaatgaaggagtaatggccgtcggactcgtatccattcttgcgagctcattgttgagaaacgatgtccccatggccggaccattggttgctggtggtttgctgatagcgtgctacgtcatcacagggacaagtgcagatttaacggtcgagaaagcagcagacgtcacgtgggaggaagaagcagaacaaacgggtgtatcacataacctgatgattacagttgatgatgatggaactatgcgaataaaagacgacgaaacggaaaatatcctgacagttcttctaaaaactgcattattaatcgtctccgggatatttccttacagtattcctgcaacactactggtatggcacacttggcaaaagcagacacaacggtcaggagttttgtgggatgttccatccccacctgagactcaaaaagccgagctcgaggaaggtgtctacaggattaaacaacaaggaatatttgggaaaacgcaagttggtgtcggagtgcaaaaagaaggtgttttccacactatgtggcacgtaactcgtggagcggtgctcacctacaatggcaagcgattagaacctaattgggcttctgttaagaaagacttaatatcttatggaggagggtggcgcttgtctgctcaatggcaaaaaggagaggaagtacaagtgatcgccgtagaaccgggcaaaaacccaaagaattttcaaacaatgcccggtacatttcagactacaacaggagaaataggcgctatagctctggactttaaaccgggcacctctggaagtcccataatcaacagagagggcaaggtcgttggattatatggcaacggcgtagtaactaaaaatggcggttatgtctcaggaatagcacaaacaaatgcagaaccagatggcccaactccagagctcgaagaagaaatgttcaaaaagagaaatctaacaatcatggatttacacccaggtagcggcaagacaagaaaatatctaccggcgattgttagggaagcaataaaacgaagactacgtaccttgatcttagcaccaactcgagtggtagcagccgaaatggaagaggcattgaaaggacttcccatacgttaccagactacagccactaaaagtgagcatactgggcgggaaatagtcgacctcatgtgtcatgccacctttacaatgcgccttctctctcctgtccgcgtaccaaattataacctaataatcatggacgaagcacacttcacggacccagcaagtattgctgcacgggggtacattagtacaagagttgggatgggcgaagctgcagccatctttatgaccgcgactcctccagggacggctgacgcgttccctcagagtaatgcgccgatacaagatgaagaaagagatatacctgagagatcttggaatagcggtaacgaatggataaccgacttcgctggaaaaactgtatggtttgtgccaagtattaaagcaggtaacgatattgcaaactgtctacgtaaaaatgggaagaaagtcatacaactatcaagaaagactttcgacacagagtatcagaagacaaaattaaacgattgggacttcgtagtaaccactgatattagtgagatgggtgctaattttaaggcagatagggtaatagacccaagacgatgtttaaaaccagttatattaactgatggacccgaaagagtaatattagctggaccaatgccagtaaccgccgcaagtgcggctcaacgcagaggaagagtaggtcgaaatccacaaaaggagaacgatcaatacatatttacgggccaaccgttaaacaacgatgaggatcatgcacactggacggaagctaaaatgctgttagataacataaatacgccagaaggcatcatacctgccttgtttgagccagaacgcgagaaatcagccgctattgacggggaatatagactcaaaggagaatcccgtaagacatttgtcgaactcatgcgcagaggagatttaccggtatggttagcccataaagttgcgagtgaaggtataaaatacacagatagaaaatggtgctttgatggacaaagaaacaaccaaattttggaggaaaacatggatgtggaaatatggacgaaagaaggagagaaaaagaaactgcgaccacgatggctcgacgcaaggacgtattcggatccactcgcgttaaaagaatttaaagatttcgccgccggtcgcaaaagtatcgcccttgatctagtgactgagattggtcgagtaccaagtcacttagcccataggacacggaacgcactcgacaatctcgtaatgttacataccagcgaacatggcggaaaggcttaccgtcacgctgtagaagaattacctgagacaatggaaacgttactattactaggtttaatgatattgttaacaggcggggcgatgctatttcttatttccgggaaaggcataggaaaaacatcgatcggtttaatttgcgtcattgcttcatctggcatgctatggatggcagaaattccactacaatggattgcatcagccatagtgttggagttctttatgatggtcctactcatccctgaaccagaaaaacaacgaactcctcaagataatcaattagcctatgttgttatcggtattctcactctagcagcaatcatagctgcgaacgaaatgggattacttgaaactacaaaacgagatttaggaatgtcaaaagaaccaggagtcgtatcccctacttcatatttagatgtggatcttcatcccgcatcggcctggacgctatacgcagtggctacgacagtcatcacgccaatgttgcgtcataccattgaaaattcaacggcaaatgtgtccctagctgccatcgcgaatcaagcagtggtattaatgggactcgataagggttggccgatctcaaaaatggacttgggggttccactactagctctcggttgttattcgcaagtaaaccctttgacattgacggctgccgttttgctgctcataactcactacgcaataattgggcccggcttacaagctaaagcaacaagagaagcacagaaacgaaccgcagctggtattatgaaaaacccaaccgttgatggtatcatgacaattgacctggatccagtcatatatgattctaagttcgaaaagcaactaggacaggtgatgctacttgtactgtgtgcagtacaattattactcatgcgaactagctgggcgctatgcgaagcattaacgctagcaaccggtccaattactacgctttgggaaggctctccgggaaaattctggaatacaacgatcgcagtcagtatggcgaacatctttcgtggttcgtatttggcaggggcaggactagcttttagcataatgaaaagtgttggaactggtaaaaggggcacaggcacacaaggagaaacattaggcgaaaaatggaagaagaaactgaatcaactctcaaggaaagagtttgacttatataagaaaagcggcataacagaggttgatcggactgaggcaaaagaaggactaaagagaggggaaataacccaccatgccgtctcgaggggctctgccaaattacaatggtttgtagaaagaaacatggtgattccggaaggtagggtcatcgatctcgggtgtggcagaggaggttggagttactattgtgccggattaaagaaagttactgaggtacgtggttacactaaaggaggacctggacatgaggaaccagtacccatgagtacatacggatggaatatagtgaagttgatgagcggtaaggatgtattttacttacctccagaaaaatgtgacacactcctatgtgatatcggtgaatcctcaccatctccaactgtggaagagagtcgtaccatacgagttcttaaaatggtagaaccgtggctgaaaaacaaccaattttgcataaaagtgttgaatccttatatgccaactgtaattgagcatttagaaagactgcaaaggaagcatggaggaatgttagtgcgaaatcccctgtcgcgaaattccacacatgaaatgtactggatcagcaatggtactggtaacatagtcgctagtgtaaacatggtttccagattattgttaaacagatttacaatgacacacagaaggccaaccatagaaaaagatgttgacttaggtgcgggaacaagacatgtaaatgccgaaccggaaacacctaacatggacgttataggtgaacgcattaaacgaataaaggaagaacataatagcacttggcattatgatgacgaaaatccctacaaaacatgggcatatcatggttcttacgaagtaaaagccacggggagcgcgagctcaatgataaatggagttgtaaagttgctaacgaaaccttgggacgtagtacctatggtcacacaaatggcaatgacggatacaacaccatttggacagcagagagtctttaaagagaaggtcgacacgaggacacctagatctatgcccggtacgcgacgagtaatgggcatcacagcggaatggttatggaggactttaggtcgcaataagaaaccacgtctatgtactcgcgaggaatttacgaagaaagtcagaaccaatgcagcaatgggagccgtatttacggaagaaaaccaatgggattcagcgaaggccgctgttgaagatgaagatttctggaagttagtcgacagagaacgagaactgcacaaacttggcaaatgtggatcctgtgtgtataatatgatgggtaaacgcgaaaagaagctgggtgaatttggaaaagccaaaggatcaagggctatatggtacatgtggttaggcgcacgatatctagaatttgaagcgttgggatttcttaatgaagaccactggtttagcagggaaaactcttattctggggtcgaaggagagggtttacataaacttggatacatacttcgagatatatcaaaaatcccaggtggagccatgtacgcagatgatactgcagggtgggatacaagaataactgaagacgatctacacaatgaagagaagataacccaacaaatggacccggagcataggcagctagcaaacgcgatttttaaattgacatatcaaaataaggtagtcaaggttcaaaggcccactcccaccggcacagttatggatattatttcacgaaaagatcaacgcggaagtggacaagtgggtacatatggactaaacacttttacaaatatggaagcacaactaatacgacaaatggaaggtgaaggagtgctctcaaaggcggacttagagaatccacatttaagcgagaagaaaataactcaatggctcgaaaccaaaggtgttgaaaggctgaaaagaatggctataagtggcgatgactgtgttgtaaaaccaatagacgatcgatttgcgaatgcacttctggctttaaatgatatgggcaaagtaaggaaagatataccccagtggcaaccaagtaagggatggcatgactggcaacaggtgcccttctgctctcaccattttcacgagcttattatgaaagacggaagaaagctagtcgtaccttgtagaccacaagacgaactgataggacgagctcgaattagccaaggagcggggtggagtttaagagagacagcatgtttgggcaaagcgtatgcccagatgtggtcgctaatgtatttccaccgaagagacttacgtctagcttcaaatgcaatatgttccgcagtcccagttcattgggtgcccacatctcgcacgacttggtctatacatgcacatcaccaatggatgacaaccgaagacatgcttacagtatggaatcgagtatggatagaagataatccttggatggaggataaaactcctgtcacaacttgggagaatgtaccttacttggggaaaagagaagatcaatggtgtggcagcctcattggactaacatcccgtgccacgtgggcacaaaatattccaacagccatccaacaggtgcggagtcttataggaaacgaagagtttcttgattacatgcctagcatgaaaagatttcgtaaggaagaagaatcggaaggagcaatttggtaa

SEQ ID NO: 23345 - RNA, 9873 nt, synthetic construct
  misc_feature 1..9873: note = derived and/or modified CDS sequence (opt6) from DENV-3__FJ390371__SS-prME
  source 1..9873: mol_type = other RNA
acgtccttgtgcttaatgatgatactaccagctgcattagcattccatttaacatcacgcgatggagaacccagaatgatcgtgggcaaaaatgaaagagggaaatcattattatttaaaacggcttcaggtattaatatgtgtactttaatagcgatggatctgggtgaaatgtgtgatgatacagttacatataaatgcccccatatagcagaagttgaaccagaagatatagattgctggtgcaacctaacatctacatgggtcacgtatgggacgtgtaatcaggctggagaacaccggagagataaaaggagtgtagctctagctccacatgtgggtatgggactggatacacgaacacaaacatggatgtcggccgaaggagcgtggaggcaagttgaaaaagtagaaacgtgggcattgagacaccctggatttacaattttagcactatttttggcacactacatagggacatccctgacacagaaagtcgtcatattcatacttttaatgctagtaacacctagtatgacaatgagatgtgtaggtgtcggaaatagagattttgtagaagggctttcaggtgcaacttgggtagacgtggtcctcgaacacgggggatgtgtaaccaccatggccaaaaataaacccacgctagatattgaactacagaaaaccgaagcgacccagttagccactttgcgaaaactttgtatcgaaggcaaaataacaaatataaccacagattcgcgatgtccgacacaaggagaagcagtattgcctgaagaacaagatcagaattacgtttgtaaacacacatatgtagaccgaggatggggaaacggctgtggcttatttggaaaaggtagtcttgtcacatgtgccaaattccagtgtttagaaccaatcgaaggtaaagtagtacaatacgaaaacttgaaatatacagtaattattacagtccatacaggagaccaacaccaagtaggtaatgagactcaaggtgtcacggcagaaataacaccccaagcatctaccacagaggccatcctcccggagtacggaacgcttgggttagagtgctccccaagaactggtttagacttcaacgagatgatattattaacaatgaaaaacaaagcatggatggttcatagacaatggttcttcgacttacctctcccttggacttctggtgcaactacagaaacgccgacttggaatcgtaaagaactcttagttacattcaaaaacgcacatgccaagaaacaagaagtagtagtgttgggcagtcaggaaggcgcaatgcacacagctttaactggagcgactgaaattcaaaattctggaggcacatcaatcttcgcaggtcacctcaaatgtcgactcaaaatggacaaactagaattgaaaggaatgtcttatgcaatgtgcactaacacattcgttcttaagaaagaagtttcagaaactcagcacggaacgatattgatcaaagttgagtacaaaggagaagatgctccctgcaaaatcccttttagcacagaagacgggcagggaaaagctcataatggtcgattgattacggcaaatcccgtcgttactaagaaagaagaaccagttaatatagaggcagagccacccttcggagaatcaaatatcgtaataggtattggagataatgcgcttaaaataaactggtacaagaaaggctcaagtataggaaaaatgttcgaagcaactgcaagaggcgcacgacgaatggcaatactcggagatacagcctgggattttggctctgttggtggagtactcaattcattagggaaaatggttcaccagatatttgggagtgcatacactgccttattctcaggagttagctgggttatgaaaatcggaattggtgtgctcctaacatggattggattaaacagcaaaaatacgagtatgtcattctcatgtatagccattggcataataaccttatatttaggggctgtagtccaagcagacaccgggtgcgtaataaattggaaaggaaaagagctaaaatgtggttcagggatattcgtaacaaatgaagtacacacatggacagaacaatacaaatttcaagctgatagtcctaaacggctggcgacagcaatcgcaggcgcatgggaaaatggcgtatgcggcatacggtctaccacaagaatggaaaatctgctttggaaacaaatagcaaatgagcttaactatatactttgggaaaacaatataaaactcactgtagtcgtgggagatattatcggagtgctagaacaaggaaaacgaacattaacaccacaaccaatggagctgaagtatagctggaaaacctggggcaaagctaaaatcgtaactgcagaaacccaaaatagtagttttataattgatgggccaaatacacctgaatgtccctcagcctctcgcgcgtggaatgtatgggaagtggaagactatgggttcggtgtatttactacaaacatatggctaaagttacgagaagtctatacccagctatgtgatcatagactaatgagcgccgctgtgaaagatgaaagagcggtacatgccgacatgggatattggattgagagtcagaaaaatggtagttggaaattagagaaggcatcccttatagaggttaaaacatgtacttggccaaagtcacatacactctggagcaacggtgtattggagtcagacatgatcatacccaaatcattggctggacctatctcacagcacaattatagacccgggtatcatacgcaaactgcagggccctggcaccttggaaaacttgagctggatttcaattattgtgaagggacaacagttgtgattacagagaattgtggtactcgaggaccatctctcaggacaacaactgtgagtggcaagctaatacatgaatggtgctgccgaagttgcactctaccgccacttcgatacatgggagaagacggttgttggtacggtatggaaataaggccaattagcgaaaaagaagaaaacatggttaaatcgttagtgtctgcgggatccggaaaggttgataattttactatgggagtattatgtctagccatactgttcgaggaagtaatgaggggtaaatttgggaagaaacacatgatagctggagtcttctttactttcgttctgcttctatcgggtcagatcacctggcgggacatggctcacacccttataatgataggaagcaatgcaagtgacagaatgggtatgggggtcacttatctagcattaattgctacatttaaaatacagcccttccttgccctagggttcttcctaagaaaattaacctcccgtgagaatctattattaggcgttgggttagccatggccactactttgcaactacctgaagatattgaacagatggcaaacggtattgcacttggtttaatggctctaaaattaattactcaatttgaaacataccaactatggacagccctgattagtttgacatgtagcaatacaatatttactcttaccgtcgcatggagaaccgcaacgttgatactcgctggcgtcagtctgctgcctgtctgtcagtcatccagtatgagaaaatccgactggttacctatgaccgtagccgcaatgggagtacccccactcccattatttattttctcactaaaagatacgctaaagagaaggagttggccgttaaatgaaggagtaatggcagttggacttgtaagtattctcgcatcatcactcctaagaaacgatgtacctatggcaggacccctagtagcagggggtctccttattgcatgttatgtaataacgggtacctctgctgacctaacagttgagaaagctgctgatgtgacatgggaagaggaagcagagcaaacaggagtatcacataacttaatgataacagttgatgacgacggcactatgaggatcaaggacgatgagacagagaacattcttacagttctattaaaaacagcattattaatcgtaagtggcatatttccatattcaatacccgcaaccctattagtatggcatacttggcaaaaacagactagaagaagtggagtattatgggatgtaccctcccctcccgagacgcaaaaggccgagctagaagaaggcgtatataggataaaacagcaaggcatctttggaaaaacacaagtaggagtaggggtacaaaaagagggcgtattccatacgatgtggcatgtgactagaggagccgttctgacatataacggaaaacggttagaaccaaattgggctagtgtcaagaaagacttgataagttatggtggagggtggagactatctgcgcagtggcaaaaaggcgaagaagtacaagtaatagctgtagagccaggcaaaaatcccaaaaatttccaaaccatgcctgggacttttcaaacaacaaccggcgagattggagctatagcgttagatttcaaaccaggcacctcggggtcgcctatcatcaacagagagggtaaagttgtaggcttatacggaaatggggtagtaacaaagaacggtggttatgtatccggtattgctcaaactaacgcagaacctgatggtccaacacccgaattagaagaagagatgtttaaaaagcgcaatttaacaataatggacttgcatccgggctccggaaaaacacgtaaatacttgccagctattgtacgagaagccataaagcgaagattaagaaccctaatcttggcacccacaagggtggtagcagctgagatggaagaagctcttaaaggcctaccgataagataccaaacaacagcaacaaaaagtgaacatacgggcagagaaattgtagatcttatgtgccacgctacatttacaatgagactactctcaccggtacgtgttcctaattacaatctcatcatcatggacgaggcccattttactgacccagcatctatagctgcgagaggttatataagtacaagagtaggaatgggggaagccgctgcgattttcatgacagctactcctcctggtacggctgacgctttcccacagagtaatgcgcccatacaagacgaagagagagacatacctgaaagatcgtggaacagtggaaatgaatggattacagattttgcaggaaaaactgtctggttcgtaccaagtattaaggcgggtaatgatattgcaaactgcttgcgaaagaatggaaagaaagtcatacaattaagcaggaagacgtttgatacagaataccaaaagacgaaactaaatgattgggactttgtggtaactactgacatttcggaaatgggagcaaactttaaagctgatagagtcatagaccctagacgatgtctaaaacccgttatcttaactgatggtcctgagcgcgtaatattggcaggacctatgccagttacagcagcgtccgcagcccaaaggagaggtcgggtcggcaggaatccacagaaagaaaatgaccaatatatatttacagggcaaccgctgaacaacgatgaggatcatgcccactggactgaagcaaaaatgttactagataacataaacacacctgaaggtataataccagcgctatttgaacctgagcgtgagaagtctgcggcaatagacggagagtataggctgaagggagaatctcgcaaaactttcgtagagctgatgaggcgaggcgacttaccagtgtggttagcacataaagtagcaagtgagggcataaaatatactgacagaaaatggtgtttcgatggacaaaggaataaccaaattctcgaagagaatatggatgtagaaatatggaccaaagagggggaaaagaagaaattgaggcccaggtggttagatgcaagaacatacagcgatccattagcattaaaggagttcaaagacttcgccgcaggaaggaaatctatcgctttagatctagtaacagaaatcggtcgcgttccttcacatttagcacatcgaacccgtaatgctttggacaatctggtaatgctacacacctccgaacatggaggtaaagcataccgtcatgcggtggaagaactgccagaaacgatggaaacactcttacttctgggcctaatgattttactaaccggaggtgctatgttattcctaatcagcggtaaaggaataggaaagacctcaattggattaatatgcgtcattgctagttcaggcatgctatggatggcagaaatcccccttcaatggatcgcaagtgcaatcgttttggaatttttcatgatggtgctattaatacctgagccagagaaacagcgaacgccccaagacaatcaattagcttacgttgtaataggaatcctcaccctagctgcgatcatagcagcgaatgaaatgggacttttagaaaccaccaaaagggacttaggtatgagtaaagagccaggagttgtaagcccaactagctatttggacgttgacctacacccagcaagcgcctggacattatacgccgtagcaaccacggtaattactcccatgcttcgacatacaatcgaaaatagtacagcgaacgtctcgttggcagctattgcgaatcaggcagttgtcctaatgggattagacaaggggtggcctatctctaagatggacctaggcgttccattattagctctaggatgttactctcaagtcaacccattaactttaacagccgctgttcttctattgatcactcattatgcgataattgggccaggattacaagcaaaggcaaccagggaagctcagaaacgaactgcggcgggcatcatgaaaaaccccacagtagatggaataatgaccatagatcttgatccagtgatatatgattctaaatttgaaaaacagctcggtcaggttatgttgctagtcctatgcgccgttcaactattattaatgagaacatcatgggccttatgtgaagcattgaccctagcaaccggaccgataactaccttatgggaaggttctccgggaaagttttggaacacaacaatcgctgtatcaatggcaaacatttttagaggttcgtacttggcgggtgccgggcttgcatttagtatcatgaaatcagttgggaccggaaaacgcggtaccggaagccagggtgagacccttggggaaaaatggaaaaagaaattgaatcaactgtctcgtaaagagttcgacttatataaaaagtcagggataacagaagtagatcgaacagaggcaaaggaaggtctaaaacgaggcgaaataacccatcacgcagtgtcccgaggatctgcgaaattgcaatggttcgtagagcgaaatatggtcatccccgagggcagagttatagatcttggttgcggacgaggtggatggtcttattattgcgcgggactaaagaaagtgacagaagtgcgagggtacaccaagggaggcccaggtcatgaagaaccggtacccatgtctacctatggttggaatattgtaaaattaatgtcgggcaaagacgtattttacctgccgcctgaaaaatgcgatactttattatgtgacataggagaaagcagtccaagtcctacagtagaagaaagtcgtactatacgagtattaaaaatggtagaaccatggctcaaaaataatcagttttgtataaaagtcctaaacccgtatatgccgacagtaattgaacacctggagcgtttacaacgaaaacacggcggtatgttagtgcgcaatccattatcccgaaattctacacatgaaatgtattggatttccaacggtacaggtaatatagtagctagcgtcaatatggtcagcagactactacttaaccgatttaccatgacccatagacgacctacaattgagaaagatgtggatctcggagctggcactcgccacgtcaatgcagaacccgagacacccaatatggacgtaatcggagaacgcataaagaggataaaagaagaacataactcgacttggcattatgatgacgaaaatccttataaaacatgggcctaccatggatcatacgaagtgaaagctaccggaagtgctagctctatgataaacggggtagttaaactattaacgaagccatgggatgtggtcccaatggtaacccaaatggctatgacagatacaacaccgttcggacaacaacgagtatttaaagaaaaagttgatacccgaaccccaagatccatgccagggacacgacgagtcatgggtataacggcagaatggctctggagaactttaggcagaaacaagaaacctagactttgcactcgagaagagtttacgaagaaagtacggacaaacgccgcgatgggagctgttttcacagaggaaaatcaatgggattccgcaaaagctgccgtggaagacgaggatttctggaaattagttgatcgtgagagagaattacacaaattggggaagtgcgggtcatgtgtttataacatgatgggaaaaagggagaagaaactaggagagttcggtaaagcaaaaggctcaagagctatatggtatatgtggttaggggcacgatacctagagttcgaagctcttggatttttaaacgaggaccattggttcagccgagaaaattcatacagcggagtagaaggggagggattacacaaactggggtatatactaagagacataagtaagatacctggaggcgccatgtacgcggatgatacagccgggtgggatacacgtattacagaagacgatcttcacaacgaagagaaaatcactcaacaaatggacccagagcatcggcaactggctaacgctatctttaagttgacatatcagaacaaggtcgttaaagttcaaagacccacgccaacaggaacagttatggatattataagccgtaaagaccaaagaggatcgggacaagtgggcacgtacggcttaaacacttttactaacatggaagcccaattaataaggcaaatggaaggagagggagtactaacaaaggcagatctagaaaatcctcatttgtctgagaagaaaattactcagtggcttgaaactaagggagtagaaagattaaaaagaatggcgatatccggtgatgattgtgttgtaaaaccaatagacgaccgatttgcaaatgcattattagcgttgaatgacatgggcaaagtcaggaaagatattccacaatggcaaccaagcaaagggtggcatgactggcaacaagtaccattctgctctcatcactttcatgagttaatcatgaaggacgggaggaaattggttgtaccatgtcggccacaagatgaattaatcggcagggctagaatatcccaaggtgcaggctggtctcttcgtgaaacagcatgtcttggaaaagcatacgcgcaaatgtggagtctaatgtattttcatagacgtgatttgcgattagcatcgaacgccatctgttccgccgttcctgtgcattgggtccctacaagtcgcacaacatggtccatacatgctcaccaccaatggatgacgacagaagacatgttaacagtctggaatcgtgtatggattgaggacaatccttggatggaagataaaactcctgttaccacttgggaaaacgttccgtacttgggaaaacgggaggatcagtggtgcggtagcttgatagggctgacctcaagggccacatgggcacaaaatatacccactgctatacaacaagtcaggagcctcataggcaacgaagagtttttagattacatgccgtcaatgaagaggtttcgcaaagaagaggagtcagagggggcaatttggtag

SEQ ID NO: 23346 - RNA, 9873 nt, synthetic construct
  misc_feature 1..9873: note = derived and/or modified CDS sequence (opt6) from DENV-3__FJ390372__SS-prME
  source 1..9873: mol_type = other RNA
actagcttatgcttaatgatggttctacctgcagcattagcctttcacctgacctcccgtgacggagaacctaggatgattgtgggtaaaaacgaaagggggaaaagtctgctattcaaaacagcatccggtataaatatgtgtaccttaattgctatggaccttggtgaaatgtgcgatgatactgttacctataaatgccctcacattactgaagtggaacctgaagacatagactgttggtgcaacttgacctcaacatgggtaacatacgggacatgcaaccaagccggtgagcacagaagggataaaagatcggttgccctagctcctcacgtaggaatggggcttgacacaagaacacaaacctggatgagcgctgaaggagcttggaggcaggttgagaaagtggaaacatgggctctgagacatccaggctttactatactagccctatttctagcacattatatcggcacaagtttaacacaaaaagtagttatttttatattattaatgttagttacaccatcaatgaccatgagatgtgtaggcgtcggaaacagagactttgtcgaggggctatcaggcgctacatgggtagatgtagtattagaacacggcggatgtgtcaccactatggccaaaaacaaacctaccttggacatagaacttcagaaaacagaagccactcaactagccacactaagaaaactatgtattgaaggtaaaataaccaatataactacagactcccggtgccccacgcaaggggaggcggtgttaccagaagaacaagatcaaaattatgtgtgtaaacacacatacgttgatcggggctggggaaacggatgtggcttatttggcaaaggctcgctagtaacatgtgcaaaatttcagtgtttagagccgatcgaagggaaagttgttcaatacgaaaatctaaaatacacagtaataataacagtacacacgggtgatcaacatcaggtaggaaatgaaactcaaggagtgacagcagaaataacaccacaagctagcacaacagaagccatactacctgaatacgggaccctaggtctcgaatgcagccctcgtaccggacttgactttaatgagatgatacttcttacaatgaaaaataaagcatggatggtacatagacagtggttcttcgacttaccactcccatggactagcggcgcaactacggaaacgccaacatggaatcgcaaagagcttctagtcactttcaaaaacgcgcacgccaagaaacaagaagttgtagtattaggctcacaagaaggtgctatgcacacagctcttacgggcgccactgagatacaaaatagtggaggaacgagcatcttcgcgggtcatttaaaatgtaggcttaaaatggataaattagaactcaaaggcatgtcgtatgccatgtgtacaaatactttcgtcctcaagaaagaagtctcagaaactcaacacggaaccatcctgataaaagtagagtataaaggtgaagatgcaccatgcaaaataccgtttagtacggaagatggacaaggaaaagcacacaatggcagattaataacggctaaccctgtagtcactaagaaagaagaaccagtaaatatagaagctgaaccaccgttcggcgagtctaatatagtaattggtattggcgacaatgcattaaaaattaactggtataagaaaggtagtagcataggaaaaatgttcgaggcgacagcacgaggagccaggcgtatggcaatattaggggacacggcttgggattttggtagtgtaggcggtgttctcaatagcctaggcaaaatggttcaccaaatctttgggtcagcctacaccgcgttatttagtggtgtcagctgggtcatgaaaatagggataggagttctactcacctggataggattaaatagtaaaaacacgtcaatgtcattcagttgtatcgctattggggtaataacattatatttaggagcagtagtccaggccgacatgggatgcgtaatcaactggaaaggaaaagaattaaaatgtggctcaggaattttcgtgaccaatgaagtccatacgtggactgaacaatacaaattccaggccgatagtcctaaaaggctagccaccgcaatagcaggagcatgggaaaacggtgtatgtggtataagatctacgaccagaatggagaatctactatggaaacaaatagcaaacgaactaaattatatattgtgggaaaacaatataaaattaactgtagtagtaggggatataattggagtccttgaacaaggcaaaaggaccctaacaccacagccaatggagctgaaatactcgtggaaaacttggggtaaagcgaaaatcgtaactgcagaaacacaaaattctagttttataatagatggacctaacactccagaatgccccagcgcgagcagagcatggaacgtctgggaagtagaagattatggatttggtgtatttacaactaatatttggttaaagctgcgggaagtttacacccaattatgcgaccataggctaatgtcggctgcagtaaaggatgaacgagcggtccacgccgacatgggttactggatcgaaagccagaagaatggtagttggaaattagaaaaagcatcgctcatagaagtaaaaacatgtacgtggcccaaatcacatactttgtggtcgaacggtgtgctagagtctgatatgattatacccaaaagcctagcgggacccattagtcaacataaccacagacctgggtatcatactcaaacagcaggaccatggcacctgggtaaactagagctagactttaactactgcgaaggtacaacggtagttattacagaaaattgtgggacacgaggaccgtccttaagaacgaccacagtgagcggtaagttaatacacgagtggtgctgtagatcttgcacgttaccgccattaagatatatgggggaagatggctgctggtacgggatggaaataagaccgatttccgaaaaagaggaaaatatggttaaaagtcttgtgtcggcgggttcaggaaaggtagacaactttaccatgggagtactatgccttgccattttattcgaggaggtgatgcgcggtaaatttggcaagaaacacatgatagccggcgtattctttacatttgtgttattgttaagtggacagattacctggagagatatggcccacacgttgattatgataggttcaaatgcaagtgataggatgggtatgggagtgacctatttagctctaattgctacatttaaaatccaaccatttttagcattgggtttcttcttaagaaagctgacatcaagagagaatctattgttaggtgtaggattagctatggccactacattacaattacctgaagatatagaacagatggctaacggaatagcattgggcctaatggccctaaagctaataacacaatttgagacatatcaactctggacagcattaatcagtctgacttgtagcaatacaatgtttacactaactgtagcatggcgtactgcgacgttgatattagccggagtaagtcttctcccagtatgccagagcagcagtatgagaaaaacggattggctacccatggcagtggccgcaatgggagtgccgccactacctttgtttatattttcactaaaagataccctaaaaagaagatcgtggcccttaaacgaaggcgtaatggcggtgggccttgtctctatcctcgcgagtagtctcctacgaaatgatgttccaatggccggaccccttgttgcaggcgggctattaatagcatgttatgttatcacgggtacaagtgccgaccttacggtggaaaaagcagcggatattacttgggaagaagaagcagagcaaactggtgtatcacacaacctaatgattaccgtagacgacgatgggacaatgcgaataaaagacgatgagacagagaacatactaacagtactactgaaaactgcattgctgatcgtaagtggggtcttcccatattcaataccagctactctgttggtctggcacacttggcagaaacagacccagcgttccggcgtactatgggatgtaccctcacccccagaaactcaaaaggcagaattagaggaaggagtgtacaggataaaacagcaagggattttcggaaagactcaagtaggagtaggggtgcaaaaagaaggggtgttccatactatgtggcatgtcactaggggcgctgtcctaacgtacaatggaaagaggctagaacccaattgggcttccgtcaaaaaggatttaattagctatggaggaggatggagattaagcgcacaatggcaaaaaggcgaagaagtgcaagtgattgcggttgaaccgggcaaaaaccccaaaaactttcaaacaatgcctggtacattccaaacaacaaccggtgaaatcggagctatagctcttgatttcaaaccaggaacgagcggatcgcccatcataaaccgggaaggaaaagttgttggcctctacgggaatggcgtggttacaaagaacggaggatacgttagcggaatagcacagaccaatgcagaacctgatgggccaacacctgagcttgaggaggaaatgtttaagaaaagaaatttaacaatcatggatttgcatccgggatccggaaaaacgagaaagtatctccctgcaatagtcagagaagcaataaagcgacgacttcggacacttatattagcgcctactagagtagtggcagcggagatggaagaagccttaaaaggtttacctattcggtatcagactacggcaaccaagtccgaacatacgggaagagagattgtagatctcatgtgtcacgctacctttactatgcgtctcctttcaccggttcgagtaccaaactataacctgataatcatggatgaagcacattttacagatccagcatctattgctgcaagagggtacatatcaacaagagtcggaatgggagaggctgcagcaatttttatgacagccacaccacctggaacagcagatgcgtttccacaatcaaatgcaccaattcaagatgaggagaaagacatacctgaacgaagttggaatagtggaaatgaatggatcacagattttgctggtaaaactgtgtggttcgtaccttctattaaagccggaaatgatatagctaattgtcttagaaagaatgggaagaaggtaatacagttgtctcgcaagacattcgataccgaatatcagaaaacaaaattaaacgactgggattttgttgtaacaacagacatatccgaaatgggagcgaattttaaggcagacagagtaatcgacccaagaagatgtctcaaaccagtaatacttacggatggacccgagagagtgatattagcagggcccatgccggtcacagcagcatcggccgcacaaagacgaggacgcgttgggagaaatccacaaaaggaaaacgatcaatatatcttcactggtcagccactaaataacgacgaagatcatgctcattggactgaggccaaaatgttattggataacataaatactccagaaggcataatcccggcattatttgaaccggaaagagagaaaagtgcggctatagacggggagtacagactgaaaggagaatcccgaaagacatttgtagaactaatgcgaaggggagatctaccagtatggctagctcataaggtagcttcagaaggaataaagtacacagatagaaagtggtgttttgatggtcagagaaataatcaaatactggaggaaaacatggatgtcgaaatatggacaaaagaaggcgagaagaagaaattacgaccacgatggcttgatgctcggacatattccgaccccctagcattaaaagagtttaaagactttgcagctggaagaaaaagcatagcattagatctagtaacagaaatcgggagagtaccgagtcacctcgcccatcgcacaagaaacgcactcgacaatttagtcatgctacatacgtccgagcacggaggacgggcttaccgacacgctgtagaggaattgccagagactatggaaactttgttactcctgggactcatgattctcttaacgggtggagcaatgctctttttgataagcggaaagggcataggtaaaacatcgattggattgatatgtgttattgcatcaagtggaatgctgtggatggcagaaatccccctacaatggatcgcatctgccatagtattggagtttttcatgatggtattgttaatacccgaaccagaaaaacaacgaacaccccaagataatcagctggcgtacgtggttatagggattctgacgttagctgcaatcattgcagcaaacgaaatgggactgctggaaactacaaaacgagatttaggtatgagcaaagagccaggtgtcgtaagtccaacgtcatatttagatgtcgatctacatcctgcaagcgcttggactttgtacgcagtggctacaacagtcataaccccaatgcttagacacacaatagaaaattcaacagctaacgtttcgctagcagcaattgctaatcaggccgtagtattaatgggtctcgacaaaggctggccaataagtaaaatggatttaggagtacccttgctagctttaggttgttacagccaagtgaaccctctaacgttaacggctgcagtcctattactaataacgcattacgcaattataggaccgggattgcaagcgaaggcgacccgagaggctcagaaacgaactgcagctggaattatgaaaaacccaaccgtcgatgggattatgacaatcgatctagacccagtgatttatgattcaaaatttgagaagcaattgggacaggtaatgctcctagtcttgtgtgccgtacagctattactaatgagaacatcatgggcactttgcgaggcgttgacattagccacaggaccaataacaaccctgtgggaagggtcgccgggtaaattttggaacacgacaatagcagtaagtatggcaaatattttcagaggatcatacttagcaggggcaggtttagcattttctattatgaaatctgtagggaccggcaagagaggaacaggcagccaaggggaaacactcggggaaaagtggaagaagaaattgaatcagttatcacgaaaagaatttgacctatacaagaaatctggcattactgaggttgacagaacagaagcaaaggaaggattgaagcgtggtgagactactcaccacgctgtatcacgcggcaccgcaaaacttcaatggtttgttgagaggaatatggtaatccctgaaggcagggttattgacctagggtgcggaagaggagggtggagttactattgcgcaggcctcaagaaagtaacagaggtgcgagggtacacgaaaggcggtccaggacatgaagaaccagttcctatgagcacatatgggtggaacatcgttaagctgatgtctggtaaagatgtattctatttaccaccagaaaaatgtgacactcttctctgtgacataggcgaaagctcaccatcacccactgtcgaagaaagcaggacgattcgagtgcttaaaatggtagaaccgtggcttaaaaataatcaattctgtataaaagttcttaacccatatatgccaacagtaattgaacatttagagcgactacagagaaaacatggaggtatgttggtgcgtaatcctctgtctagaaactcaactcacgaaatgtattggattagtaacggaactggaaacatagtagcttcagttaacatggtttccagactattgcttaatagattcaccatgacacacaggagacctacaatagaaaaagacgtggatctgggggcaggaacaagacacgtaaacgctgaaccagaaaccccgaatatggatgtaataggcgaacgcataaaaagaataaaggaagaacacaattctacttggcattacgacgatgaaaacccctacaaaacttgggcctatcatggatcttatgaagtcaaagctacgggcagtgcctcttccatgataaatggcgtagtaaaattattaactaaaccatgggacgtagtaccaatggtaacacagatggcaatgaccgatacgacaccgtttggtcaccaaagagtatttaaggagaaagtagatactagaacgccacggtctatgcccggtccgaggagagcgatgggaataacagctgaatggctatggagaacccttggaagaaacaagaaacccaggttatgcacacgtgaagagtttactaagaaaggacgtactaacgcagcgatgggtgccgtttttacggaagaaaaccaatgggattcggcaaaggcggctgtagaagatgaagacttttggaaattggtcgatagagaacgtgaactccataaacttggaaagtgcgggtcttgtgtttacaatatgatggggaagagagagaagaaactaggtgagtttggaaaggccaaaggttctcgagcaatctggtacatgtggttaggagcacgctatctggaatttgaagcgctaggattccttaatgaagaccattggttttcaagagaaaatagctactcaggggtagaaggcgagggtttacataaactcggctatatactgagagacatcagcaaaatccccggtggagcaatgtacgccgacgccactgcaggttgggatacccgcattacagaagatgaccttcacaatgaagagaaaatcactcaacaaatggatccagatcatagacaactagcgaccgccatttttaaactcacttatcaaaataaagtcgtcaaagtccagagaccgacaccaacaggaaccgttatggatataatttccagaaaagaccagcgaggctccggacaggtgggtacctatggtctaaacacattcacaaatatggaagcacaactaattcgacagatggaaggagagggagtgttaagcaaggctgaccttgagaatcctcacttacccgaaaagaagattacacaatggttagaaacaaagggggtggaaaggcttaggcgcatggcaatttcgggcgatgattgcgttgtaaaaccaatagatgatagattcgcaaatgcccttctagcacttaatgatatggggaaagtcagaaaagacatcccacaatggcaaccttcaaagggatggcacgactggcaacaagtccccttctgttcgcatcattttcatgaactaataatgaaagacggaagaaagctagtcgtaccgtgtagacctcaagatgaattaattgggagggcaaggatttcgcaaggtgcaggctggagtttaagggaaactgcctgtttaggcaaggcctatgcgcaaatgtggagtttaatgtactttcatcgccgggatctaagactcgcaagcaatgctatctgctcagctgtaccagtacactgggtccccacctcacggacaacgtggagcatacatgcacaccaccagtggatgacaacagaagatatgcttaccgtttggaaccgcgtatggatagaagataacccttggatggaagataaaactcctgtaacaacttgggaaaatgtaccatacctaggaaaaagggaagaccaatggtgtggttcgctaataggtttaacatcacgtgctacatgggcccaaaacattccaacagcaatacaacaagttagatctttaatagggaatgaagaatttttggactacatgcccagcatgaaacgattcagaaaagaagaagaaagcgaaggtgcgatatggtaa

SEQ ID NO: 23347 - RNA, 9873 nt, synthetic construct
  misc_feature 1..9873: note = derived and/or modified CDS sequence (opt6) from DENV-3__FJ205870__SS-prME
  source 1..9873: mol_type = other RNA
acttcgttatgcttaatgatgattctgcctgcagcgctagcatttcatttaacgtcaagagatggagaaccgaggatgatagttggcaaaaatgaacgcggaaaatcactactatttaaaaccgcatcgggaataaatatgtgtactttaattgcaatggatctaggagagatgtgtgacgacacagtaacctacaaatgccctcacattgcagaagttgaaccagaagacatcgattgctggtgtaacctaactagcacctgggttacatatggaacctgcaatcaagcaggagaacacaggcgggataaacgatctgttgcgctcgctcctcatgtgggaatgggattagatacacgaactcaaacgtggatgtcagcagagggagcgtggagacaagttgaaaaagtagaaacctgggctttacgtcaccccggatttactatccttgcactattcctagcacattatattggaactagcttaactcagaaagttgttatatttatccttttaatgttagtgacgccctccatgacaatgagatgcgtcggagtagggaatcgagattttgtagagggactatcaggagcgacctgggtagacgtagttcttgaacacggtgggtgtgtcactacgatggccaaaaacaaacccaccctggatatagaacttcagaaaacagaagcaacccaactggcaacgttacgaaaattatgtatagagggtaaaataacgaatattaccacagattccagatgcccaacacaaggggaggctgtgttacctgaggaacaggatcaaaattatgtatgcaaacacacttatgtcgacaggggatggggaaacggatgcggtttgtttgggaaaggtagcctagtgacatgtgctaaatttcaatgtcttgaacctatcgaaggtaaagtagtacagtatgagaacctaaaatatacggtaataattacagttcatacaggcgatcagcaccaagtaggtaatgaaacacaaggagtcacagcagagattacacctcaggctagtacaactgaagccatattaccagaatatggcacactagggctagagtgtagcccccgcacaggactagactttaatgaaatgatccttcttacaatgaaaaataaagcatggatggtacatcggcaatggttctttgacttacctcttccttggacgtcaggtgctactacagaaaccccgacatggaataggaaagaactattggttacatttaaaaatgcgcatgcgaagaaacaggaagtagtagtactaggatctcaagaaggtgcaatgcacacagcactgaccggtgcaactgaaattcaaaattccgggggcacctccatatttgcaggtcacttaaaatgccgacttaaaatggataaacttgaactaaaaggcatgtcttacgcaatgtgcacaaacacattcgtcttgaagaaagaggtgagtgaaacgcaacacggaacaatattgataaaagtagagtataaaggtgaagatgttccgtgtaaaatacccttctctacagaagatggtcaaggaaaagcacacaacggtaggcttataacagcaaatcccgttgtaacgaagaaagaagaaccggtaaacatcgaagctgaaccaccatttggagaatctaacattgtaatagggattggggataacgccctcaaaattaattggtataagaaagggagttcaataggcaaaatgtttgaggctacagcgcgaggggctagaaggatggctatcctaggcgacacagcttgggacttcggaagcgttggaggtgttctaaattctcttggaaaaatggtgcatcaaatcttcggttccgcctataccgctttgtttagtggagtatcttgggttatgaaaataggaattggtgtacttttgacgtggataggtctaaacagtaaaaatacatcaatgtcatttagctgtatagccattggaatcataacactctacctaggggctgtagtacaagcggacaccggttgcgtgataaattggaaaggtaaagaattaaaatgtggatctggtatatttgtcacgaacgaagtgcacacctggacagaacagtataaatttcaggcggattctccgaaacgtttagcaaccgccatcgccggtgcatgggaaaatggtgtttgtgggattcgttcaacaacgcgcatggagaacttactctggaaacaaatcgcaaacgagcttaattatatattatgggaaaataacattaaattaaccgttgtagttggggatatcataggcattttagaacaaggcaaaagaactctcacaccccaaccaatggagcttaaatactcgtggaaaacttgggggaaagcaaaaattgttacagccgagacacaaaacagctcttttataatagacggcccaaatactccggaatgcccatccgcatccagagcctggaacgtatgggaagtggaggattacggatttggtgtctttactacaaacatttggctgaaactccgagaagtatatacccagttgtgtgaccatagacttatgtcagctgccgtcaaagatgagcgagcagtacacgcagatatgggttattggatagaatcccagaaaaatggttcctggaaactggagaaagcatcactaattgaagtcaaaacttgtacatggccaaaatcgcatactctatggagtaacggagtattagaatccgacatgatcataccgaaatcattggcaggtcctatttcgcaacataattatagacctggatatcacacccaaacagcaggcccatggcatcttggaaaactggaactcgattttaattattgtgagggtacaacagtagtgataaccgaaaattgcggcacccgcggtccgtcacttcggacaacaacagttagtggtaaattgatacatgaatggtgttgccgcagttgtacgcttccacctcttcgttacatgggagaagacggttgttggtacggcatggaaataaggccaattagtgaaaaagaagaaaatatggtgaaaagccttgtgtcagcaggctctggcaaagtagataatttcacaatgggtgtattatgcttagcaatactatttgaagaagtaatgcgaggaaaattcggtaagaaacatatgatcgcgggagtattctttacatttgtactgttgctgagtggacaaattacctggagagacatggctcacacattgataatgataggcagtaacgcgtccgaccgaatgggaatgggagtgacttatctagcgttaatcgcaacgtttaaaattcaaccattcttggctctgggcttctttcttcggaaattaacctctagagaaaatctactactgggggtaggcttagctatggcaacaaccttacaattaccagaggacatcgaacaaatggcaaacggaatcgccctaggtttaatggcgttgaaattaataacacagttcgagacgtatcaactgtggacagcattaatttccttgacctgctcaaacacgatttttacattaacagttgcctggagaaccgcaacgttaattcttgctggagtatctatattaccagtctgtcaatccagtagcatgcgaaaaagtgattggctaccaatgactgtagcagctatgggagtaccacccttacccttatttattttctctcttaaagacactctcaagagaaggagctggccgcttaatgagggcgtaatggcagttggacttgtaagcatcttagcaagcagcctactacggaatgatgtacctatggctggtccattagtagcagggggtttactcatcgcgtgttatgtaataaccggaacctcagcagatcttacggtagagaaggcagcagacgtaacttgggaagaagaagcagaacaaactggggtttctcataatctaatgattacagttgatgacgacggcaccatgagaataaaagatgatgaaacggaaaatatactaacggtcctcctgaaaactgctctcttaatagttagcggaatatttccttactctatcccggcaacacttttagtctggcatacttggcagaaacagacgaggcgttcaggagtattgtgggacgttccttccccgccggaaactcagaaagcagagctcgaagagggcgtatatcggattaaacaacaggggatattcggaaaaacccaggttggcgtgggcgtccaaaaagagggggtatttcataccatgtggcatgtaacgaggggtgcagtgcttacatacaacggtaagagattggaacccaattgggctagtgtcaaaaaggaccttatttcatatggtggaggttggcgactatcagcacagtggcagaaaggagaagaagttcaagttatcgctgtggaacccgggaaaaatcccaaaaactttcaaacaatgcccggaacctttcagactacaacaggggagattggggcgattgcattagatttcaaaccagggacaagtgggagccctataataaatcgtgaaggaaaagtagtaggtctgtacggaaatggtgtagttactaaaaacggaggatacgtatcaggtatagcacaaacgaacgccgagccggatggtccaacgccggaattagaagaggagatgtttaagaaaagaaacctgacgattatggaccttcacccgggaagtggaaaaacgagaaaatatctgcctgccatagtgagagaggctattaagaggcgattgcggacacttattttagctcccactcgtgttgtcgctgcggagatggaagaagccttgaagggcttaccgattagataccaaaccacagccacgaaatcagaacatacaggaagggaaattgttgatttaatgtgtcacgctacattcacaatgcgcttattgtcccctgtaagggtacctaactacaatttaatcataatggatgaagcacattttacggatcccgcatcgatagcagcgaggggttatatatcaacaagggtaggaatgggcgaggccgcggccatatttatgaccgcaacaccgcctggaacggctgacgcctttcctcaaagcaatgcaccaatacaggatgaagaacgggatattccagaaaggagttggaactctggtaatgaatggatcactgattttgcaggaaaaaccgtttggtttgtaccttcaattaaggcaggcaatgatatagctaactgtcttcgcaaaaacggcaagaaagtaatacaattaagtcgaaaaacatttgacacagaatatcagaagactaaattgaacgactgggattttgttgttaccacggacataagtgaaatgggggctaactttaaagctgatcgcgtcatcgacccaagacgctgcttaaagccagtaatattaacagatggccctgaaagggtcatattagccgggccaatgcctgttactgctgcatccgctgcacaacgacggggcagagtaggacgaaatcctcaaaaagagaacgatcaatacatatttactgggcaaccattgaataatgacgaagatcacgcacactggacagaagcaaaaatgcttcttgacaacataaataccccggagggcataataccagccctatttgagccagaacgtgaaaagagcgcagccatcgacggcgagtacagactaaaaggagaatctagaaagacgttcgtagaactaatgcgcagaggagacctaccggtctggttagcgcataaggtagcatcagagggcataaaatataccgatagaaaatggtgcttcgacggtcaaaggaacaatcaaatacttgaagagaatatggatgtcgaaatttggactaaagaaggagagaagaagaaattgcggccaaggtggttagatgcaaggacatatagcgatccacttgctctgaaagaatttaaagacttcgcagccgggagaaagtcaatcgccttggatctcgttactgaaataggtagagtaccctcacatctggcccatagaactagaaacgcgctagataatttagtgatgttacacacaagcgaacatgggggcaaagcctataggcacgccgtagaagagttgccagagactatggaaacattgctattgcttggcctcatgattttgctaacgggtggcgctatgctctttttaatatcgggaaaaggaataggaaaaacttccataggcctaatatgtgtcattgcttcctctgggatgttatggatggctgaaattcctttacaatggattgcgtcagcaatagtattagaatttttcatgatggtgctcttgatccctgaaccggagaagcaaagaacaccgcaagataaccagttagcatatgtagtgataggcattctcacattagcagcaataatagccgcaaatgaaatgggtctcttagagacaacaaaaagggaccttggcatgtctaaagaaccaggggtagtaagtccaacttcctatttggatgtagatctgcatccagcatcagcatggacattgtatgccgtcgctacaacagtcataacgccgatgttacgtcatacaatagaaaatagtacagcgaacgtcagcctcgccgctattgccaatcaggcagtcgtgttaatgggcttggataaaggatggccaatatcgaagatggacttaggggtacccttgttagcattaggatgttatagtcaggtgaatccgcttacgttaacggcagcagtactcttgctaataacacattatgcaataataggtccgggattacaagctaaggcgactagggaagcacaaaaacgtactgcagcaggaataatgaaaaatccaacggtagatggcataatgacgattgacctggatccggtaatttatgattcgaaatttgaaaagcagctgggtcaagtaatgctacttgtgctttgcgcagtacaacttctactaatgagaacaagttgggctctttgtgaagcacttacactagcgactggcccaatcacaacattatgggaaggcagcccaggtaaattctggaatactaccatagctgtatccatggccaacatctttcgaggtagttatctagccggtgcaggacttgctttttctattatgaaaagcgtagggacagggaaaagaggcacaggatcccaaggagagacactcggagagaaatggaagaagaagttaaatcaactttctcgaaaggaatttgacttgtataagaaatcaggaatcacggaggtagatcggacggaagccaaggaaggtctaaaacgaggagagataacgcatcatgcagtctcacgaggtagtgccaaacttcagtggttcgtggaacggaacatggtaattccagaaggcagagttattgacttagggtgtgggcgcggagggtggtcttattattgtgctggtttaaagaaggtgaccgaggtaagaggatacacaaaagggggtccaggacatgaagaaccagtgccaatgagtacatacggttggaacatcgttaaacttatgagcgggaaagatgtattttacttaccacccgaaaaatgtgacacccttctttgcgatataggcgagagtagtccatctccaactgttgaagaaagtcggacaattagagttttaaaaatggtcgaaccttggctcaaaaataatcaattctgtataaaagtcttaaatccatatatgccaactgtaatagagcatttagaaagacttcaacgaaaacacggcggtatgttagtgaggaaccctctttctcggaatagtactcacgaaatgtactggatatctaatggaacagggaatatcgttgctagcgtaaacatggtatcgcgtcttctacttaaccgatttacaatgacacataggcgccctacaatagagaaagacgttgacctgggagcaggaacccgccatgtcaacgcggagcctgagactccaaatatggatgttataggagaacgcatcaagagaataaaagaggaacataattcaacgtggcattacgatgatgaaaatccttataaaacttgggcttatcatggtagttatgaagtaaaggcaactggaagcgcatccagcatgattaacggagtcgtaaagttattgactaagccttgggacgtagtgccaatggtaacacaaatggcaatgaccgataccaccccatttgggcaacaacgtgtgtttaaagaaaaggtagacacacgaacaccacgaagcatgcctggaacaagacgagtaatgggcataactgctgaatggctatggagaacgcttgggagaaacaagaagccaagactgtgcacgagggaagaatttacgaagaaagttagaaccaatgcggctatgggcgctgtttttactgaagaaaaccaatgggactcagcgaaagccgcggtggaagatgaagatttttggaagttggttgacagagagagagaactacacaaactagggaaatgcgggtcctgtgtctataacatgatgggcaaacgagagaagaaacttggcgagtttggaaaagcgaagggctcgcgggcgatatggtatatgtggcttggcgcgaggtatctggaatttgaagcgttaggctttttaaatgaggaccattggttcagcagagaaaactcttattctggtgtcgaaggagaaggattacctaaacttggttacattctgagagacatatcaaaaattccaggtggtgcaatgtatgcagatgatactgcaggatgggacacccgtatcactgaagatgacctccataacgaggagaaaattacacaacaaatggatccagaacatagacaactagccaatgctatcttcaaattgacttaccaaaacaaagtagtaaaagtccagagacctacacccaccggcactgtaatggacataattagtaggaaagatcagagaggatcaggacaagttggtacttatggacttaatacattcacaaacatggaagcacaactcatcaggcagatggaaggggaaggagtactaagtaaggcagatttagaaaatccacacctctctgagaagaaaataacacaatggttagagacaaagggagtggaaaggctaaagcgcatggctatcagtggtgacgattgtgtagtaaaaccaatagatgatagatttgctaacgcattattagctctaaatgacatgggcaaagtgcggaaagatatcccgcaatggcaacccagtaaaggctggcatgactggcaacaagtacccttttgctcccatcatttccatgaattaataatgaaggatgggagaaagctagtcgtcccttgcagacctcaagacgaattgattggcagagcaagaatttcacaaggagcgggttggtcactacgcgagactgcatgccttggcaaggcttatgcccaaatgtggtctttaatgtattttcacaggcgggatttaagattagcatcaaatgcaatatgttctgcagtcccagtccactgggtaccaacaagtcgaactacatggtcgatacatgcgcatcaccaatggatgacaacggaagacatgttaacagtctggaatagagtatggatcgaagacaatccatggatggaggataaaactccggtcaccacctgggaaaatgtcccatatttgggaaaacgagaagaccaatggtgtggctcactaattggactaacctccagagctacttgggcgcaaaacataccaaccgctatacagcaagtgagatcattaattggtaacgaagaatttctcgattacatgccatccatgaaacgttttagaaaagaagaagagagtgaaggtgcaatatggtaa

SEQ ID NO: 23348 - RNA, 9873 nt, synthetic construct
  misc_feature 1..9873: note = derived and/or modified CDS sequence (opt6) from DENV-3__FJ390373__SS-prME
  source 1..9873: mol_type = other RNA
acatctctttgccttatgatgatactaccagccgctttagcattccatttaacctcacgggatggggaacctcgtatgatcgtaggaaaaaatgagaggggaaaaagccttttgtttaagacagcatctggtattaatatgtgcaccctaatagcaatggatctaggagaaatgtgcgatgacactgtaacatataagtgtcctcatataacagaggttgagcctgaagatatagattgttggtgcaatttaacatctacatgggttacatacggaacgtgtaatcaagccggagaacaccggagagataaaagatccgtagctttggcaccacatgtaggcatgggattagacacccgcacacagacttggatgtctgccgaaggagcctggagacaagtggaaaaagtcgagacttgggcattaaggcaccctggatttacaatcctagccctttttctagctcactatatcggaaccagtttgactcaaaaggtagtgattttcatcttattgatgttagtgacaccatcaatgacaatgaggtgcgtgggggtgggtaatagagatttcgttgaaggattgtcaggagcaacatgggtagacgtcgtactagaacatggcgggtgtgtgacaacaatggccaaaaacaaacccacgctcgacatcgaattgcaaaaaactgaagctacacaactggctacattgagaaagctatgtattgaaggtaaaataactaatatcacaacagactcgaggtgtcctacccaaggcgaagcagtattaccagaggagcaggaccaaaactacgtatgcaaacacacgtatgtagaccgaggttggggaaacggctgcggattatttggtaaaggatcgctagtaacgtgtgcgaaattccagtgtttagaacctattgaaggaaaagttgttcagtacgaaaaccttaagtacactgtaattattaccgtccatacgggtgatcaacatcaagttggaaacgaaacacagggtgtgactgcagaaataaccccacaagcttctaccactgaagcaatattaccggaatatggtacgttaggactcgaatgttcacccagaactgggttagactttaatgaaatgattctgctaacaatgaagaataaagcatggatggtacatagacagtggttcttcgaccttccattaccatggacaagtggtgccacaacggaaaccccaacttggaatagaaaagaattattagttacttttaaaaatgcgcatgcaaaaaagcaagaagtagtcgtactagggtcgcaagaaggcgccatgcataccgctttaacaggcgcgaccgagattcaaaattctggtggtacaagtatatttgcgggtcacctaaaatgccgactgaaaatggacaagcttgagttaaaaggtatgagctatgcaatgtgcacaaacacctttgttcttaagaaagaagtctcagagacccagcatggaacaattctaattaaagtcgaatacaagggcgaagacgtcccatgtaaaataccattttctaccgaagacggacgcggaaaggctcacaacggaaggctcatcacagcaaatccagtagtcaccaaaaaagaggaacctgtaaatatagaagcggagccccctttcggagaaagcaatatagtgattggtataggtgataatgcgttaaagataaattggtataagaaaggttcgtcaataggaaaaatgtttgaagctacagcacgcggcgctagacgtatggcgatattgggagatacagcatgggactttggctccgttgggggcgtcttgaattcactaggaaaaatggtgcatcaaattttcggaagcgcgtatacagccctatttagtggtgtcagttgggtgatgaaaataggtataggtgtactacttacttggataggacttaattcaaaaaacacatccatgtcattttcttgtatcgctataggaattatcacactttatcttggagcagtcgttcaagcggatatgggatgtgtaataaattggaaaggaaaagaattaaaatgtgggagcggaatatttgtgacaaatgaagtgcatacttggacggagcagtataaattccaggcagatagccctaaaagattggcaacggcaatagctggcgcatgggagaatggtgtatgcggaataagatcgaccacaagaatggaaaacctactatggaagcagattgcgaacgaacttaattatatattatgggaaaacaacatcaaactaactgttgtggtgggtgataccattggtgtactagaacaaggtaaacgtactttaacgccccaaccaatggaattgaaatattcgtggaaaacttggggaaaagcaaagatagtgacagctgaaacacaaaatagttcctttataattgacggcccaaacactccagaatgcccgtccgcaagtcgagcgtggaacgtttgggaggttgaagattatggattcggagtatttacaaccaacatttggctgaagttgagggaagtctatactcaactctgtgaccatcgactaatgagtgcagcagtaaaagatgaacgtgcagtccatgcagatatgggttactggatcgagtctcagaaaaatggaagctggaaactcgagaaagcctcacttatagaggttaaaacatgtacatggcccaagtctcatacgttgtggtcaaatggagtattagagagtgatatgataatccctaaatctcttgcaggaccaattagtcaacataactatcggccaggctaccatactcagacagcaggaccctggcatctaggcaaattagaattagactttaactactgcgaagggaccactgtagttataaccgaaaactgtgggacacgaggaccaagcctacgcacgacgacggtaagtgggaagcttatacatgagtggtgctgtagaagttgtaccttaccccctttaaggtatatgggtgaagatggctgttggtatggtatggaaataaggcctatatcggaaaaagaagaaaacatggttaagagtttagtatctgcaggatcaggtaaggtagataatttcaccatgggagtattatgtcttgccatactttttgaggaagttatgaggggcaaattcgggaaaaaacacatgatagcgggagtattctttacctttgtactacttctttctggacaaattacatggcgagatatggcacacactttaataatgataggatcaaatgcctcagatcgtatgggtatgggtgttacatacctagcattgattgcaacttttaaaatacagccattcttagctttgggtttctttctacgtaaattaacgtcacgtgaaaacttactattgggggtaggattagcgatggcaactacacttcagcttccagaagatattgaacagatggccaacggaattgcactaggtctaatggctctcaagctcactactcaattcgaaacttaccaattatggacagcgttaatatccctaacttgttcaaacaccatattcacattaacagtggcgtggagaaccgcaacgttgatactagcaggggtatcgctattgccggtgtgtcagtctagttctatgcgaaaaacagattggttaccgatgacggtggctgcaatgggcgtaccgccattgcctcttttcattttctcacttaaagacacacttaaacgtaggagctggccattaaatgagggagtaatggcagtaggacttgttagcatactggctagttctctattacgaaatgatgtgcctatggcgggaccgttagtagcaggaggtttgttgattgcatgctatgtgataactgggacatcagcggatcttactgttgagaaagccgcagacgtcacatgggaggaagaggcagaacagactggagtgtcccataatcttatgataacagtagatgatgatggaactatgcgcataaaagacgatgaaacagaaaacatcctgactgtgctattaaagacagctttattgattgtgagtggcatatttccttattcgataccagcaacactcctcgtatggcatacttggcaaaaacagacccaaagatcaggagtactatgggacgtgcctagccctcctgagactcaaaaagcagaattagaagaaggtgtctatcgtataaagcagcaggggatattcggaaaaacacaggtaggagtcggagtacaaaaagagggagtattccacaccatgtggcacgtaacaaggggtgccgtcttgacatataatgggaaaagactagaacccaattgggcctcggtcaagaaagacttaattagttacggaggaggatggcgattatcagcgcaatggcaaaaaggagaagaggtccaggtgatcgcagtggagcccggaaaaaatccaaaaaatttccagacaatgccaggaaccttccaaactactactggagaaataggtgcgatagcattagactttaaacccgggacaagcggcagtcctataattaatagagaaggtaaagtagtaggtctatacggaaacggggtagtaactaaaaatggcggttatgtttcaggtatagcacaaacgaatgcagagccagacggacctacaccagagttagaagaagaaatgtttaaaaaacggaatctaacaattatggacttacacccaggcagcggaaaaacgagaaaatatctacccgctattgttagagaagctataaaacggcgattacgaacccttatcctcgcgccaacccgtgtagttgctgcggagatggaggaagctttaaaaggtctaccgattagataccaaactacagcaacgaagtccgaacatacaggaagagaaatagtagatttaatgtgtcacgccacgttcacgatgcggctactaagcccagtacgagtcccgaattacaatttaattataatggatgaagcccattttacagatcctgcttcaatcgccgcgaggggatatatttcgacaagggtgggaatgggtgaagccgcagctatctttatgaccgcaacaccccccggaacggcggacgctttcccgcaatcgaatgctccgatccaggatgaggaacgagatatccctgagagatcgtggaacagtggaaacgaatggataactgactttgcaggaaaaaccgtgtggttcgtcccaagtataaaagcaggaaacgacatcgcaaattgtctacgaaaaaatggaaaaaaagttatacaattatcacgaaagaccttcgatacagagtatcaaaaaaccaaactaaatgattgggacttcgttgtgacaacagatatatcggaaatgggagccaattttaaggccgatcgtgtgatagacccgcgcagatgcttaaagcccgtgatattgactgatggcccagaaagagtcatattggcaggaccaatgcctgtaaccgccgctagcgccgcgcagcgaaggggaagagttggaaggaacccacaaaaagaaaatgatcaatatattttcactggacaacctcttaataatgacgaagatcacgcgcattggacagaagcaaaaatgttattagataatatcaataccccggaagggattatacctgctttattcgaaccagaaagggaaaaatcagcagctatagatggtgagtacagactaaaaggtgaatcgagaaaaacatttgtcgaacttatgagaaggggcgcattaccggtttggctagcccataaggttgctagtgaagggatcaaatatacagataggaagtggtgctttgatggacagaggaataatcaaattttagaagaaaatatggatgtcgagatatggacaaaagaaggagaaaaaaaaaagctgagaccacggtggttggacgctcgcacatattccgaccccttggcacttaaagaattcaaggacttcgctgcagggcgtaaatcaattgcactcgatctagtgacagaaataggccgtgttccgtctcacttagcacaccgaacaagaaacgcattggataacctggtaatgttgcacaccagcgaacatggagggaaggcgtatcgtcacgcagtagaagaactccctgaaacaatggaaacacttttattgttaggtttaatgatcctattaaccggtggagccatgctttttctaatttcaggaaaagggataggcaagacatccattggcctaatatgtgttattgcgtcctcaggtatgctgtggatggctgaaatcccacttcaatggatagcaagcgcaattgtcctggaattctttatgatggtcctattgatcccggagcctgaaaaacaacgaacgcctcaagataaccagcttgcctatgttgttataggcatactaacgctagctgcaattattgcagctaacgaaatggggctactggaaacaacaaagagagacttgggtatgtcgaaagaacctggagtggtttccccaacaagctatctcgacgtggaccttcacccagccagtgcttggacgctatatgcggttgctactactgtaatcacccctatgttaaggcacactattgaaaattcaaccgccaacgtgtcattagcggctatagccaaccaggctgttgtgctaatgggtttggacaaggggtggccaataagtaaaatggatttaggtgtaccactactggcgctaggttgttacagccaagtgaaccccctcactcttacagcagcagtgctactacttattacacattatgccatcattggtccaggattacaagcaaaagctacacgagaagcccagaaaagaacagctgcgggaataatgaagaatcctacagtagatggcataatgacaattgatttagatccagtaatatacgatagtaagttcgaaaaacaattgggacaagtgatgttattagttctatgtgcggtacaactattgctcatgcgtaccagttgggcgttatgcgaagcgctaactcttgcaacgggcccaataacaacattatgggaagggtctcccggaaaattctggaataccacgatagccgtcagcatggcgaatatattcagaggaagctatctggccggagcaggtttagctttcagtattatgaagtcagtaggtacaggtaaaagaggaacaggatcgcaaggggaaacattgggtgaaaaatggaaaaaaaaactgaaccaactttccagaaaagaatttgatctatataagaaatcaggtattacagaagttgatcgtacggaggctaaagaaggactcaaaagaggcgaaataacgcatcacgctgtatcaaggggcagtgcaaagctccagtggtttgtcgaaagaaatatggtgataccagaaggacgtgtcatcgatttaggctgcggaaggggaggttggtcgtattattgcgcagggctaaaaaaagttacagaggttcgaggatacactaaagggggtccaggtcacgaagaaccagtaccaatgtctacatatggctggaacattgtgaagctaatgtctggtaaagatgttttttatctgcccccagaaaaatgtgacactctactttgtgacatcggcgaatctagcccatcaccgacggttgaggaatcgcgcactatccgtgtattgaaaatggttgaaccatggttgaagaataatcagttctgcataaaagtactcaatccctatatgccaaccgtaatagaacatttagaacgattacaacgtaaacatgggggtatgctcgtgagaaatccgttaagcagaaatagtactcacgagatgtactggatatcgaacggaactggtaatattgtagcatcggttaatatggtatctagattactgttaaacaggtttacgatgacgcacagaagaccaacaattgagaaagatgtagacttaggcgccggtacacggcacgtgaatgctgaacctgaaaccccaaatatggatgtgataggagagcgaataaaacggataaaagaagaacataactcaacatggcattatgatgacgaaaacccttataagacctgggcgtaccacggctcgtacgaagttaaagcaacaggatctgcaagtagtatgataaacggagtagttaaactattaacaaaaccatgggacgtagtaccgatggtaactcagatggcaatgactgatacaacaccctttggacaacaacgagtatttaaagagaaggtagacacccgaaccccaagatctatgcctgggactagacgtgtcatgggaataaccgcagaatggctatggagaacattaggaaggaacaagaaaccaagactctgtacacgtgaagaatttacgaaaaaggttagaacaaatgcggccatgggcgcagtattcacagaggaaaatcaatgggattcagcaaaagccgccgtagaggacgaggatttttggaagctggtagatcgagagcgtgaattacacaaacttggtaaatgtggaagttgtgtatataacatgatggggaaaagagaaaaaaaacttggtgagtttggaaaagcaaagggatcgcgcgcgatatggtatatgtggttaggagccagatatctggaatttgaagcgttgggtttcctaaatgaagatcattggttctccagggaaaattcatattcaggagttgaaggcgaaggattacataaattaggttatatccttagggatatatcgaaaattcctggaggagcgatgtacgccgatgatactgctggttgggatacacgcattacggaggatgatctgcataacgaagaaaagattactcaacagatggatcctgagcataggcaactagcaaacgcgatattcaaactgacttaccaaaataaagtagtaaaggtccaaagaccgacaccaactggtacggttatggacattatcagtagaaaagaccaaagaggtagtggccaggtaggtacatacggattaaatacatttactaatatggaggcacagttaataaggcagatggaaggagaaggcgttttatcgaaagccgatttagagaatccacacctgccagagaaaaaaataactcagtggcttgaaacaaaaggggtagaaagactaaagcgaatggctatatcaggtgatgactgcgtagttaaacctatagatgacagatttgcaaacgcactactagcattaaacgacatgggtaaagtccgaaaagatatcccgcagtggcaaccttccaaaggatggcacgactggcaacaggtaccattttgcagtcatcactttcatgagttaatcatgaaggacggcaggaaattggtagtaccatgtcgcccacaagatgagttaatcggtcgagctaggattagtcaaggtgcaggatggagcttacgagaaacggcttgcttagggaaggcatatgcacagatgtggagtcttatgtacttccaccgacgagatttaagactcgcttcaaatgcgatatgttcagccgttcctgtccactgggtccccacttctagaacaacttggtcgatccacgcacatcatcaatggatgaccaccgaagatatgttgacagtttggaacagagtctggatcgaagacaacccatggatggaggataaaacgcctgtaacgacatgggaaaacgtcccgtacctaggtaaaagagaagatcagtggtgtggatccctaataggactaacatcccgtgcgacttgggctcagaatatacctacggctatacaacaggtacgatcgttgattggaaatgaggaattcctcgattatatgccgagcatgaaacgcttcagaaaagaagaggagtcagaaggcgcaatatggtaa

SEQ ID NO: 23349 - RNA, 9873 nt, synthetic construct
  misc_feature 1..9873: note = derived and/or modified CDS sequence (opt6) from DENV-3__FJ205871__SS-prME
  source 1..9873: mol_type = other RNA
acttctttgtgcttaatgatgattttaccagcagcacttgcttttcacctaacttcgagagacggggaacctagaatgatcgttgggaaaaatgaaagaggaaaaagcctactttttaaaacagcgtcaggaattaatatgtgtactctaatagctatggaccttggagaaatgtgtgacgacaccgtaacttataaatgtccacatattacagaagtagaaccagaagatatcgattgttggtgcaatctaacctctacatgggtaacctacgggacatgcaatcaagcgggtgaacaccgaagagataaacggagcgttgctctggcaccccacgtgggaatgggactagacacgagaacccaaacctggatgagtgctgaaggagcatggcgccaagtcgaaaaagtggaaacatgggccttacgtcatccaggctttaccatcctagcgctatttctagcgcattacatcggaactagcctcacacaaaaagttgtaatctttatattgttgatgttagtaactccctcaatgaccatgaggtgcgtgggagtcggtaatagggattttgttgaaggtctgtcaggggctacgtgggtagacgtggtccttgaacatggaggatgcgttacaactatggctaaaaataaaccaacattagatattgagttacagaaaacggaggcaacacaactagcaacgctgaggaaattatgtattgaaggaaaaataaccaatattacgaccgattcgagatgcccgacacaaggcgaagcggtacttcccgaggaacaagatcaaaactatgtttgcaaacacacatatgttgacagaggatggggaaatggatgcggattgttcggcaaaggttcattagtaacatgcgcaaaatttcaatgccttgagccaatagaaggtaaagtcgtacaatacgaaaacctcaaatacacagtaataataactgtccatacgggagatcagcatcaagtcgggaacgaaactcaaggtgtaactgcagaaattacgcctcaagcaagtacaacggaagccattctgccagaatatggaacactcgggctagaatgcagtcctaggacgggtcttgacttcaacgagatgatcctactgaccatgaaaaacaaagcgtggatggtacatcgtcaatggttctttgatttgccattaccttggaccagcggtgccactacagagacacctacttggaatagaaaagagctattagttacttttaaaaacgctcatgccaagaaacaagaggtagtggtattaggtagtcaagaaggtgctatgcataccgcattaacaggcgcgaccgaaattcaaaattctggtgggacaagtatatttgccggtcatttaaaatgtagattaaaaatggacaaactcgaactaaagggaatgtcatatgctatgtgtacgaatactttcgtgctcaagaaagaagttagcgaaacgcaacacgggacgatattgatcaaggtagaatacaaaggagaagatgtgccttgtaaaataccattctccacagaagatggacaaggaaaagcccataacggaagacttatcactgccaatcctgtagttaccaagaaagaggagcctgtaaatatcgaagcagaacctccatttggggaatctaatatcgtaataggaataggggacaatgctcttaaaataaactggtataagaaaggtagtagtattggcaaaatgttcgaggccacagcccgaggcgctcgaaggatggctatactaggtgataccgcctgggattttgggtcggtaggtggtgttttaaatagcttaggcaagatggttcatcaaatttttggatcggcctatacagcattattctcaggagtctcatgggtaatgaaaatcgggattggagtactacttacatggattggactaaactctaagaacacttctatgtctttttcatgtattgcaattggaataataacattatacttaggagcagtagtacaagcagatatggggtgtgtgattaactggaaaggcaaagagctaaaatgtgggtctggtatttttgtaacgaacgaagttcatacttggaccgaacaatataaattccaggcggactcaccgaaacgcttagcaaccgctatcgccggagcttgggagaacggtgtttgcggaatcagatccacaacaagaatggagaacttattatggaaacagattgctaatgagctcaactatatcctatgggagaataatatcaaattaacagtagtagtgggcgataccattggagtgcttgaacaaggcaaaagaacattaacgccacagcctatggaattgaaatactcctggaaaacttgggggaaagcgaaaatagtaaccgcagaaactcaaaatagtagttttattatagacggacccaacacacccgagtgtccgtccgctagccgggcatggaatgtatgggaagttgaagactacggctttggtgtgtttaccaccaatatatggctaaaactcagagaggcttatacgcaactttgtgatcatcgattgatgtctgcggccgtgaaagatgaaagagccgtccatgcagacatgggctattggattgaaagccaaaagaacggtagttggaaactagagaaagccagcttaatagaggtaaaaacatgtacctggccaaaatcacacactttgtggtcaaatggcgtgcttgaatcagacatgataatacccaaatcactcgctggtccgatatcacaacacaactacagaccaggataccatactcaaacagcggggccatggcacttaggtaaattagaattagatttcaactattgtgaaggcactacagtggtcataaccgaaaattgtggaacaagagggccctcactgcgaactacgacagtaagtggaaagttaatacatgaatggtgctgcaggtcctgcactttacctccactaagatatatgggagaagatggctgctggtacggtatggaaatacgacccatcagtgaaaaagaagagaatatggtgaaaagtctagtttcagcgggatccggtaaggttgataattttactatgggagttctgtgtttggcaatactattcgaagaagtaatgcgaggaaagttcggaaagaaacatatgatagccggtgtgtttttcacttttgtgctgttgctttcagggcaaatcacgtggcgagatatggcccacaccttaataatgataggtagcaacgctagcgaccgaatgggcatgggagtgacctatttagcactaatagcaacttttaaaattcagccatttttagctctcggatttttcttaagaaaactaacatctcgcgaaaacttactattaggtgtaggattagcaatggctactacattgcagttgcctgaagacattgagcaaatggcaaacggaatagcgttaggacttatggcactaaagctaacaacacagtttgaaacttaccaactatggactgccttaatatcactaacctgctcaaataccatcttcacactcacggttgcatggagaacagccactttaatattagctggagttagtttgttgccagtgtgccagagttcgagtatgcgtaaaacagactggctacctatgacagttgctgcaatgggtgtacctcctttacctctcttcatattttcactaaaggatacacttaaacggagatcttggccactcaacgagggagtcatggcggtgggattagtatcgattctagcctctagtctattacgtaacgacgtacctatggccggcccactcgtcgcgggtggtctcctaattgcatgctacgtcattaccggaacaagcgcagacctaactgttgaaaaagcggcggatgtgacttgggaagaggaagcagaacaaacaggagtgtcccataatctcatgataaccgttgacgatgacggtacgatgaggattaaagacgatgaaaccgaaaacatacttaccgtattacttaaaactgctttattaatagtctcgggaatctttccttatagtatacctgcgacgctattagtatggcatacctggcaaaagcaaactcaaagatcgggagtactgtgggatgtaccatcaccacccgaaacacaaaaagcagaactagaagaaggcgtctatcgaatcaaacaacaaggtatatttgggaaaacacaagttggagtaggagtccaaaaagaaggtgtcttccacaccatgtggcacgtaacaagaggtgctgttctcacctataacggtaaaagattagaacccaattgggcaagtgtcaagaaagatctcatttcatatggaggagggtggaggctttcagctcaatggcaaaaaggcgaagaagtgcaggtcattgcagtggagccaggaaagaatccaaagaatttccaaacaatgcctgggacatttcaaactacaacaggtgaaattggagctatagctttagatttcaaaccaggaacatcaggatccccgattattaatagagaagggaaggttgttggtctatacgggaatggggtggttactaaaaatggaggatacgttagtggtatagctcagacgaatgcggaacctgacggtccaacacccgaactggaggaggagatgttcaagaaacgaaaccttaccattatggatttacatccgggaagtggcaaaacacgcaagtacctcccggctatagttcgggaagcaatcaaaaggcgattgcgaacattaatacttgctccaacaagggtagtagcagcggaaatggaagaagctctaaaaggtttaccaatcaggtatcaaacaacggcgactaaatcagaacatacgggtcgcgaaatcgtagatctaatgtgtcatgccaccttcacaatgagattactgagccccgtacgcgttccgaattacaacttaatcattatggacgaagcacattttaccgatccagcaagcatagcagcaaggggttatataagtacaagagtagggatgggtgaagctgcagctatatttatgacagcaacaccacccgggacagcggatgctttccctcaaagcaatgcaccgattcaagacgaagagagagatatacccgaaagatcttggaactctgggaatgaatggatcaccgactttgcagggaaaacagtatggtttgtaccgagtataaaggcaggcaatgatatagccaattgtttacggaaaaatggcaaaaaggtgattcagctgtcacgcaaaacatttgatacagaataccaaaagacaaagttaaatgattgggattttgtggtaacaacagatatatcagaaatgggagctaattttaaagctgaccgagtaatagaccctcgaagatgtctaaaaccagttatactaacagacggtcctgagcgggttattctagctggaccaatgcctgtaacggctgcatcagctgcacaacgacgcggtagggttggacgaaatccccaaaaggaaaacgatcaatacatattcaccggacaacctttaaacaatgacgaagaccatgcacattggactgaagccaaaatgttgttagataacattaatactccagagggaataatacctgctctgttcgagcccgagcgcgaaaagagcgccgctattgacggtgagtacagacttaagggagaatcacgaaaaaccttcgtcgaattaatgagaagaggcgatttaccggtttggttggcccataaagtagcaagtgaagggataaaatatactgatagaaagtggtgctttgacggtcagagaaacaaccagatcctggaggaaaatatggacgttgaaatatggacaaaagagggggaaaagaagaaacttagaccacggtggctagatgcaaggacatattccgatcctcttgccctcaaagagtttaaagactttgctgccggccgaaaaagtatagctttggatctggtcactgaaatagggagagtaccatcccacttagcccacaggacaagaaacgctttagacaacttagtaatgttgcacacatcagaacatggtgggaaggcctataggcatgcagtagaagaactacccgaaaccatggagaccctcctcctcctaggattaatgattctgctaacgggaggagcgatgttatttttaatcagtggaaagggtattggaaaaacaagtatcgggttaatctgcgtcatcgcaagcagcggcatgttatggatggccgaaataccattacagtggatcgccagtgccatagttctggagttctttatgatggtattattaataccagagccagagaaacagcgtactccacaagataatcagcttgcatatgtggtaataggaatactaacattagctgctatcatagcggctaacgaaatggggttattagaaacaacaaagagggatctaggaatgagtaaagaacctggtgtagtaagccctacatcgtatctcgatgtagatttacatcccgcatccgcatggacgttatatgctgtagcaacaacagtaatcacgccaatgctgagacacacaatagaaaatagtactgccaacgtttcgttggcagcaatcgccaatcaagcagtggtactcatgggactagacaaagggtggccaatatccaagatggatttaggagttcctttacttgcactcggctgttatagccaggttaatccgttaacgctcacagcggctgtgttactattaataacacattacgcaataattggacctggcctacaagcaaaagcaacgagagaggcccagaaaaggaccgcagctggaatcatgaaaaacccaaccgtcgatggtattatgactatagatcttgatccggttatttatgatagcaagttcgagaaacaacttggtcaagtaatgttactggttctctgtgcggtacaattactactaatgcgaaccagttgggctctatgcgaagccttaactctcgctaccggccccatcacgaccttatgggaaggtagcccaggtaagttttggaatacaacgatcgctgtcagcatggcaaatatatttcgcgggagttatttggctggagcgggccttgcattcagtataatgaagtctgtaggaaccggaaaaagaggtacgggatcgcaaggagaaaccttgggcgaaaaatggaaaaagaaattaaatcaattgtcacgtaaggagttcgatctgtacaagaaaagtggtattacggaagtcgatcgaaccgaagcaaaggaaggcttaaaaagaggagagatcactcatcacgctgttagtagaggttcggccaaactacaatggtttgtggaaagaaatatggtaatccctgaagggagagtcattgacttaggatgcggaaggggcggatggagttactattgcgcaggacttaagaaggtaacagaagtaaggggctatacaaaaggcggacccgggcatgaagaacccgtaccaatgtctacgtacggctggaacatagtcaagttaatgagtggaaaagacgtattttacttacctcccgaaaaatgtgacaccttgctttgtgacataggcgagtcatctcccagccctacagtggaggaaagcaggacaataagggttctaaaaatggtagaaccatggttaaagaataaccaattctgtattaaagttttaaatccgtatatgcccacagtgatagaacaccttgaaagactgcaaagaaaacacggtggaatgttggtgcgtaatccccttagtagaaattcaacacatgagatgtactggattagcaacgggactggtaatattgtggctagtgtaaatatggtgtcccggctgctgttgaataggtttacaatgacacatagaaggccaacaatagaaaaagatgttgatttgggagcgggaaccaggcacgtaaatgcagaacccgaaaccccaaacatggacgttataggtgaacgaatcaaaagaattaaagaggaacacaatagtacatggcactacgacgacgaaaacccatataaaacgtgggcctaccatggatcatatgaagttaaagcgacgggttcagcctcatccatgataaacggggttgtaaagctactgactaaaccatgggacgttgtacctatggtgacacagatggcgatgaccgacacgactccgtttgggcaacaaagagtatttaaggaaaaggtcgatacaagaactcccaggagcatgccaggcacaagaagagtaatgggtataacagcagaatggctatggagaacgttaggtaggaacaaaaagcctagactctgcacacgcgaggaatttaccaagaaagtccgaacaaatgccgcgatgggtgctgtcttcacggaagaaaatcaatgggattcagccaaagctgcagtagaggacgaagatttctggaagctagtagatagagaacgggaactgcataagctaggaaaatgcggatcttgcgtatataatatgatgggaaaaagggagaagaaactaggagagttcggaaaagcaaaagggtcacgagcaatatggtatatgtggctaggggcaagatatctcgagttcgaagcgctagggtttttaaacgaggatcattggttctcccgggaaaatagctattccggcgtcgagggagagggactccataaactaggttatatattgcgagatatttcaaaaatacctggtggtgctatgtacgcagatgatacagcaggatgggacacacgcataaccgaagatgatttgcataatgaagagaaaattactcaacaaatggatcccgaacataggcagctagctaatgcgatctttaaattaacctaccaaaacaaagttgtaaaggttcaaagacctactccgacaggtacggtaatggacatcatatcacgtaaggatcagagaggaagtggtcaggtaggcacttatggcctcaatacgttcacaaatatggaagctcagcttatcaggcagatggaaggagagggagtattgagcaaagcagacttagaaaatccccatttaccagagaaaaagattacacagtggctagaaaccaagggggtggaacgcctgaaacggatggcaatatcaggtgatgattgtgtggtgaaaccaatagatgatcgtttcgcaaacgcgcttttggccctgaatgatatgggtaaagtcagaaaagatatacctcaatggcaaccatcgaagggttggcacgactggcaacaggtaccattttgttctcaccattttcacgaattgataatgaaagatgggagaaaactggtggtaccttgcagaccacaagacgaactcataggtcgagctaggattagtcagggtgctgggtggtcgttaagagagactgcatgtttgggaaaagcatatgcgcaaatgtggtctctaatgtattttcatcggcgagacttaaggttggcgagcaacgctatatgctcggcagtaccagttcactgggtaccaacctcacggactacatggagcatacatgcacaccatcagtggatgacgacagaagatatgctgactgtttggaatcgagtgtggatcgaagacaacccttggatggaagacaaaacacctgtcacgacttgggaaaacgttccctacttagggaaacgcgaagatcaatggtgtggttccttaataggattgacatcacgcgcaacttgggcccaaaacatacccactgccatacagcaagttcgctcacttatcggaaacgaggaatttttggactacatgccatctatgaaaagatttcgtaaagaagaggaaagcgaaggagctatttggtga

SEQ ID NO: 23350 - RNA, 9873 nt, synthetic construct
  misc_feature 1..9873: note = derived and/or modified CDS sequence (opt6) from DENV-3__FJ390375__SS-prME
  source 1..9873: mol_type = other RNA
acttcattgtgccttatgatgattctaccagcagcactagcattccatcttacaagtagagacggtgaaccacgcatgatcgtaggtaaaaacgaaagaggaaaaagtctattattcaaaacagcatctgggataaacatgtgcactttaatcgccatggatcttggtgaaatgtgcgatgataccgtaacatacaaatgtcctcatatcacagaagtggaaccagaagatattgattgctggtgcaacctcacatccacttgggttacatatggaacctgcaatcaagctggtgaacatcgcagagacaaaaggtctgttgcgttagcacctcatgtaggtatgggtttagacacacggacgcaaacttggatgagtgcggaaggcgcttggcggcaagttgaaaaagttgaaacctgggcactaagacatccaggttttacgattctcgctttatttctggcacactacatcggcacttcactgacccaaaaagttgtgatatttattctgcttatgttggtaacaccatctatgactatgcgttgtgttggagtcggtaaccgagatttcgttgaagggctttcaggtgctacgtgggtagatgttgtattagaacacggtggttgcgtaaccacaatggccaaaaataaacccacgttagatattgaactacagaaaacagaagctacacaattggcaacattacgtaaactttgcattgaaggtaaaataacaaacatcacgacggatagtagatgtccaacacagggtgaagcagtactccccgaagaacaagatcaaaattatgtctgcaaacatacgtatgtagatagaggttgggggaacggctgcgggctttttggcaaaggttctttagtcacgtgcgctaaattccagtgtttagaaccgatagaaggaaaagtggtccagtatgaaaacttgaaatatactgtcattataacagttcacactggagaccaacaccaagttggaaatgagacacaaggtgtcacagcagagataacaccacaagcctcaactacagaagcaatactacctgaatacggaactcttggtctagaatgctcgcccaggactggtttggactttaacgaaatgatattactaacgatgaaaaacaaagcgtggatggttcatagacagtggtttttcgacctccccttaccttggacgagtggtgctacaactgagacaccaacttggaatagaaaagaacttcttgttacctttaaaaatgctcacgccaagaaacaggaagtcgtggtactaggaagtcaagagggtgcaatgcacacagctttaactggggcaactgaaatacaaaatagtggaggaacatctatttttgcgggccacctcaaatgtcgactaaaaatggataaactagaattaaaaggcatgagttatgcaatgtgcacaaatacttttgtactgaagaaagaagtaagcgaaacgcaacatggaacaattctaataaaagttgagtataaaggtgaagatgtaccttgtaaaataccattttcgaccgaagacggacaagggaaagctcacaacggtagattaataaccgctaacccagttgttactaagaaagaagaacccgtaaatattgaagcagaaccgccttttggcgaatcaaatatagttatcgggataggtgataacgccctaaaaataaattggtacaagaaaggctcaagcatcggcaaaatgtttgaggctacagcaagaggcgcaaggagaatggccatattgggagacactgcatgggatttcggatcggttggaggcgtattaaatagtctagggaaaatggtccaccaaatctttggttcagcttatacagcactattttcaggtgtcagttgggtaatgaaaataggaattggtgttctactaacttggattgggctgaatagtaagaacacatcaatgtctttttcatgtatagctataggaataattacgttataccttggcgccgttgtgcaagcagatatgggctgtgtcataaattggaaaggtaaagaactaaaatgtggatccggaatattcgttactaacgaagtacacacatggacagaacaatacaagttccaagcggactcaccgaaacgtttagcaacagcaatagcaggagcatgggaaaacggagtatgcggaatacgtagcacaactagaatggaaaatctattatggaaacaaatcgcgaatgaactaaattacatactgtgggaaaacaacatcaagctaacggtcgttgtaggggacaccataggggtgcttgaacagggaaaacgcacacttactccgcagcccatggaactgaaatattcatggaaaacttggggtaaagctaaaatagtaacggcagaaactcagaactcgtcgttcattatagacggtccaaataccccagagtgtcccagtgcatcaagagcgtggaatgtgtgggaggtagaggactatggttttggagttttcacgaccaacatttggttaaaactccgggaggtgtacacgcaattatgcgaccatcggctaatgagtgctgcggtcaaagatgagcgagcggtgcatgcggatatgggttattggatagagtcccagaaaaatgggtcatggaaattggaaaaggcttccttgatagaagttaaaacatgtacatggccaaaatctcatacactttggtcaaatggtgtacttgaatcagatatgataatacctaagtctttggccggtccaatatcgcaacataattacaggcctgggtaccatacgcaaaccgcggggccgtggcatcttggtaaactcgaattagattttaactattgcgaaggcacaaccgtagttataaccgaaaactgtggaacaagaggaccaagtttgcgtacaacgacagtttccggtaaacttatacacgaatggtgctgccgctcttgcacgttacctcccttacggtacatgggagaagatggatgttggtacggcatggaaataagacccatatcagaaaaagaagaaaatatggtcaaatcattagtctcagcagggtcaggaaaagtggataatttcacgatgggtgtattatgcctcgcaatcctgttcgaagaagttatgagaggcaaattcggaaagaagcatatgattgcaggagtattcttcactttcgtattactcctaagtggacagataacctggagggacatggctcatacattaataatgatcgggagtaatgcaagtgacagaatgggaatgggcgtgacatatttagcactaatcgctacattcaaaatccaaccctttctagcattaggattctttcttagaaaactaacatccagggaaaatctcttactaggtgtaggtttagcaatggccactacgttgcaattaccagaagacatcgagcaaatggcaaacggcatagcactaggtctaatggcccttaaattaacaactcaattcgaaacttatcaactttggacggcattgatttccctaacatgcagcaacacaatattcaccctgacagtagcatggcgaaccgcgacactaatattggccggtgtatctttattaccagtatgccaatcttcttctatgcgaaaaactgattggctgccgatgacagtagcagcaatgggggtaccacctcttccgttattcatcttctccctcaaagacacactgaaacgtagatcttggcccctaaatgaaggcgttatggccgtgggattagtcagcattttagcaagttcattgcttagaaacgacgtacctatggcagggcccctagtagccggtggtttgctaatagcatgttatgtaataactggaactagcgctgatcttactgtagaaaaggcagcggatgtgacatgggaagaagaagcagagcaaactggggtctctcacaatttaatgattacggtcgatgatgatggtacaatgcgaattaaagacgacgaaacggaaaatatccttacggtcttgttaaaaacggccttactcattgtctcgggtatatttccatattccataccagcaacgttacttgtttggcatacttggcagaaacaaactcaaagaagcggggttttatgggatgtcccaagcccgccagaaactcaaaaagcagaattagaagaaggtgtttatcgaataaaacagcaaggcatatttgggaaaacacaagtaggagtgggggtacaaaaagaaggtgtgttccatacaatgtggcacgtcacaagaggggctgtattgacatataatggtaagaggctagaacctaattgggcgtcagtcaagaaggacttaatatcctacggcggaggttggaggttaagtgcacaatggcaaaaaggtgaagaggtccaagtaatagcagttgagccaggcaaaaatccaaagaactttcaaactatgcccggcacctttcaaacaaccacgggggaaataggagcaatagcattagatttcaaacctggcacgagcggaagtcctataataaatagagagggcaaggtagttggattatacgggaacggagtggtaactaagaacggtggatatgtcagcggcatagcacaaacaaatgccgaaccggacggcccaacgccagagctcgaagaagaaatgttcaagaaacgaaatttaacaatcatggaccttcatccaggtagcgggaaaaccagaaaatatctcccagcgatcgtaagagaggcaattaaacgacgattgcgcacacttattctagctcctacgcgcgtagttgcagcagagatggaggaagcactaaaaggcttaccaatacgctatcagactaccgcaacaaaaagtgaacatacaggcagggaaatagttgatctcatgtgtcatgcaactttcactatgagactactaagccctgtacgagttccaaactacaatttaattatcatggacgaagcccactttacggatccagcatcaatagcggccaggggctacatatctacccgtgtcggcatgggggaagccgcagccatctttatgacagcaacacctccgggcacagcggatgcattcccgcaaagcaatgctccgatacaagatgaggaaagagatatcccagaaagatcatggaatagtggaaacgaatggataacagattttgctggtaaaactgtctggttcgtaccgtccataaaagcaggaaacgacatcgccaattgtctgcgtaaaaatggtaagaaagtgattcaactatccagaaaaacattcgacaccgaatatcagaaaaccaaactgaacgattgggacttcgtcgtaaccaccgatattagcgagatgggggcaaacttcaaagcagatcgagttattgaccctcgacgatgtttaaagccggtgatactaacagatggacctgaacgcgtcattctagctggtccaatgccagtgaccgcggcaagcgcagctcaacgacgaggaagagtaggaaggaatcctcagaaagaaaacgatcaatatatattcacgggtcagcctttaaacaatgacgaagatcacgcccactggacagaagccaagatgctgctcgacaacataaacaccccggaaggaataataccggcgctattcgaacccgaaagagaaaaatccgctgccatagatggtgaatatagattaaagggtgaatctagaaaaacgtttgtagaactaatgcgtagaggagaccttccggtttggctagctcacaaagttgccagtgaaggaataaaatatacagatcgaaaatggtgttttgatggccagcggaataatcagatattagaagaaaatatggatgttgaaatttggactaaagagggagagaagaagaaactaagaccaagatggctcgatgctcgtacgtacagtgatccactggcattgaaagaatttaaagatttcgctgcaggaagaaaatctatagcactggatctcgtcacagaaattggaagagtaccatcgcatttagcacatagaacacggaacgcattggacaatctcgtaatgcttcacacctcagaacacggtgggaaagcatacagacacgcagtcgaggaattacctgaaacaatggaaacactactcctcctaggattaatgatcctgctaactggcggcgcaatgctattcttaatctctggcaagggcatagggaagacatcaataggactaatatgcgtaatagcctcgtctggaatgttatggatggctgaaatacctctacagtggatagcaagcgcaatagttctcgagttctttatgatggttctgttgatacctgaaccagaaaagcaaaggaccccacaagataaccaacttgcctatgttgtgataggcatactgactcttgcagcaataatagctgccaacgaaatgggtcttttagaaacaacaaaacgtgatttaggtatgtcaaaggaacctggtgtagtgtcaccaacctcttatttagatgtcgatctacacccagcatcagcatggacactttatgcagtagcaactacagtaataacacccatgttacgtcatactatagaaaactcgaccgcgaatgtttcattggctgcaatagccaatcaggcggtagttctcatgggcttagataaaggctggccaataagcaaaatggaccttggtgtaccactcttggcactgggctgttactctcaagttaatccactaaccctaacggccgcagtcttgctgcttataacacactatgcaatcataggtcccggtctacaagcgaaagccacgagggaagcgcagaaacgtactgcagcaggaataatgaaaaatccaacagtggacggcataatgacaattgatctagatcccgtgatttacgattcaaaatttgagaagcagttaggtcaagttatgctcctggttctctgcgcagttcaacttctgcttatgcgaacatcatgggcattgtgcgaggccttaacgcttgcgactggacctatcactactctatgggaaggatcgcctggcaagttctggaatactacaatcgcggtgagtatggcgaatatattcagaggaagctacttggctggagcgggacttgcctttagtattatgaagtcagtcggtacaggaaaaagaggaacaggaagccagggggagacactaggcgagaaatggaaaaagaaactaaatcaactgagtagaaaagagttcgacctatacaagaaaagtggtatcacagaagtagaccgcaccgaggcaaaagaaggcttgaaaaggggtgagataacgcatcacgcggttagtcgtgggtcagctaaacttcaatggtttgttgagagaaatatggtaataccagaaggtagggtgattgatctagggtgtggtagaggaggatggtcatattattgtgccggactaaagaaagtaacggaggtacgaggctacactaaagggggtcccggtcatgaagaaccagtaccgatgtccacctacggatggaatattgtcaaactaatgtcaggcaaagatgtattctatttacctccagaaaagtgcgatactcttctttgcgacataggtgaaagttctccatcaccaacagtggaagaatcgcgaacaataagagtgctgaaaatggtagaaccgtggctaaagaacaaccaattttgtataaaagtcctcaatccctatatgccaactgtaatcgaacatcttgaaagactccaacgtaagcatggagggatgctagtacgcaatcctctttcaaggaacagcacacatgaaatgtactggattagcaacggtacaggaaatattgtcgccagtgtaaatatggtcagccggctactcctgaatcgttttacgatgacacatcgaagaccaaccattgagaaggacgtagacttaggggcaggcactagacatgttaacgcagaacccgaaacacccaacatggacgtgattggtgaaaggatcaaaagaattaaagaagaacataatagtacatggcattatgatgatgagaatccctataagacttgggcataccacggatcttatgaagtaaaagccacaggctctgcttcctccatgataaacggagtcgtcaagttactaacaaagccatgggatgtcgtccctatggtaacccaaatggccatgacagacacaacaccttttgggcaacaacgggtgtttaaagaaaaagtcgatactcgaacccccaggtcgatgcctggtacacgaagggttatgggtatcactgcagaatggttatggagaacactaggtcgaaacaagaaaccaaggctttgtactagggaagagttcactaagaaagtgcgaacaaatgccgcaatgggagcggtctttacggaagagaaccaatgggattcggcaaaagctgcagtagaagacgaagatttttggaagctagttgatagagaaagagaactacacaaactaggaaaatgtggctcatgtgtctataatatgatgggtaagagagaaaagaaattaggagagttcggtaaagctaagggtagcagggccatatggtacatgtggctcggagctaggtatctcgaatttgaggctttaggctttttaaatgaagatcattggttctcccgggaaaattcttactccggagttgaaggcgaaggtttacataaactgggttacatcctaagagacatcagcaagattcctggtggcgctatgtatgcagatgataccgcaggatgggatacaagaataacagaagacgacctccacaatgaagagaaaattactcaacaaatggatccagaacatagacaactagcgaatgctatattcaagctaacatatcaaaataaagtcgtgaaagtacagcggcccactcccactggtactgttatggacataatttcacgcaaggaccaaagaggttctggccaagtaggcacttatggattaaatacatttaccaatatggaagcacaacttataagacaaatggaaggcgaaggagttctcagtaaagccgatttagaaaatccgcatctacctgagaagaaaataacacaatggttggaaacaaagggtgtggaacgcctaaaaagaatggcaatatccggagatgactgtgtcgtaaaaccgattgacgatagattcgcaaacgcattattagcgctcaatgatatgggcaaagtccgtaaagatattcctcagtggcaacccagtaaaggttggcacgattggcaacaagtaccgttttgtagccaccactttcacgaattgataatgaaggatggacgaaaacttgtggtcccatgtcgaccacaagacgagctcataggacgagccagaatatctcaaggcgcgggttggtcactaagggaaacagcatgtctaggaaaggcttatgcgcaaatgtggtccctcatgtatttccacagaagagatttgagactcgcatcaaatgccatttgtagcgcggtaccagtccactgggtacctactagccgaacgacttggagcatacacgcgcaccatcaatggatgaccaccgaagacatgttaaccgtatggaatcgcgtttggatcgaggataatccttggatggaagacaaaactccagttacaacttgggagaatgtaccatatctaggtaagagagaagatcagtggtgcggttcccttataggacttacaagcagagcaacttgggctcaaaacattccaacagcaattcaacaggttcgtagtctcatcggcaatgaggagtttttagactatatgccatcgatgaagaggttccgaaaggaggaagaaagtgaaggagctatatggtaa

SEQ ID NO: 23351 - RNA, 9873 nt, synthetic construct
  misc_feature 1..9873: note = derived and/or modified CDS sequence (opt6) from DENV-3__FJ390376__SS-prME
  source 1..9873: mol_type = other RNA
acgtccttatgtctgatgatgattttaccggcggcactagcattccatcttacatcccgtgatggagaaccacggatgatagtaggtaaaaatgaacgaggaaaatcattattattcaaaactgctagcggaattaacatgtgcactcttatagctatggacctaggagaaatgtgtgatgacactgtaacttataaatgcccacacattacggaagtagaaccagaagatattgactgttggtgcaatcttacttccacttgggtaacatatggtacatgtaaccaagcaggagaacaccgtcgtgacaaaagatcagtagccctagctccacatgtaggaatgggactagacacacgaacacaaacctggatgtccgccgaaggagcatggcgacaagtagaaaaagttgaaacttgggcacttagacatccgggctttactatactggcactatttttggcgcactacattggaacaagcctaactcaaaaagtcgtaatctttacgttgttgatgttagtaactcctagtatgactatgcgatgcgtaggagtagggaatagagattttgttgaaggactgagtggagccacatgggttgacgtggttttagaacatggaggatgcgtaaccacaatggccaaaaacaaaccaaccttggacatcgaattacagaaaacagaagcaacacaactcgcaacactgcgtaaattatgcatagaaggcaaaattacaaatataactactgattcgagatgcccaacacaaggggaagcagtcttaccagaagaacaggatcaaaactacgtttgtaaacatacatatgtggatcgaggatggggaaatggatgtgggttatttgggaaaggatcgcttgttacatgtgcaaaatttcaatgtttagaaccgatagaggggaaagtagtgcaatatgagaacctaaaatatacagttataattacggtccatactggagatcagcatcaggtaggtaacgaaacccaaggggtgacagcagagataactccacaagcaagtacaaccgaagcaattctacccgaatatggcacacttggactagagtgtagtccgaggaccggacttgattttaacgaaatgatattactgactatgaaaaacaaagcatggatggtacaccggcagtggttctttgacctacccttaccttggacaagcggagcaaccacggaaacacccacatggaatagaaaagaattactcgtaaccttcaaaaatgcacacgctaagaaacaagaagttgtcgtcttaggatctcaagagggcgctatgcatacggcgttaactggagcgacggaaatccagaatagcggaggtacgtcgatcttcgcaggacacttaaaatgccgactaaaaatggataaattagaattgaaaggaatgtcatatgcgatgtgtacaaacacttttgtactaaagaaagaggtgtcggagactcaacatgggacgatattaataaaggtagaatacaaaggtgaggatgtaccatgtaaaattcccttctctaccgaagatggccaaggaaaggcacataatggccgcttaattacagcaaatcctgtagtaacgaagaaagaagaacccgttaatattgaagctgaacccccattcggcgaatctaatattgttattggcataggagataatgctttaaaaataaattggtacaagaaaggttcaagtatagggaaaatgtttgaagccacggcaagaggggcaaggcgtatggcaatattaggcgacaccgcttgggattttggaagtgtcggcggcgtactaaacagcctaggtaagatggttcatcaaatctttggaagcgcgtataccgctttgttttcaggagtttcatgggtaatgaaaataggtataggggtactactgacctggataggcctaaattctaagaatacctccatgtcctttagttgcatcgctatcggaataataacactttatctgggtgcagtagtacaagccgacatgggttgtgtaataaactggaaaggaaaagaactgaaatgtggaagtggaatctttgtaaccaatgaggtccacacatggaccgaacaatataaatttcaagcagattcccccaaacgactggcaacagcaattgctggtgcttgggagaacggggtatgtggaataaggagcacaactaggatggaaaacttgctgtggaaacaaatcgcgaatgagctaaactatatactctgggagaataacataaagttaacagtcgtggtcggggacatcataggggttttagaacaaggtaaaaggacactaacaccacaacccatggagttaaagtacagctggaaaacttggggaaaggcaaaaatagtaaccgcagaaacacagaacagttcttttataattgacggtccgaataccccagaatgtccgagtgcgtctagggcatggaacgtctgggaagtagaagattacggattcggagtatttacgacaaacatctggttgaaattgcgagaggtgtacactcaattatgcgatcaccgcttaatgtcggctgctgtaaaagatgaacgagctgttcatgctgacatgggatactggatcgaaagtcagaaaaatggatcatggaagttagaaaaagcgtctcttatcgaagtaaaaacttgcacatggcctaaatctcacacattatggtccaacggcgtattagaatccgacatgataatccctaaatcgctcgccggacctatatctcaacacaactatagacctggatatcatacacagacagctgggccatggcatctcggaaaattagagctagattttaactattgcgaaggaactacagtcgttatcaccgaaaattgtggaacgagaggaccttctctaagaactacaactgtttctggtaaactaatacacgaatggtgttgccgtagttgtactttaccgcctttacggtatatgggtgaagatggttgctggtacggaatggaaattaggcccatctcagaacgggaagaaaacatggtcaagtctttagtgagcgctggttcgggtaaagtagacaactttactatgggcgtgctctgtctggcaattctcttcgaagaagttatgagaggtaaatttggcaagaaacatatgatagcgggggtgtttttcacattcgtacttcttttgtcaggacaaataatttggcgggacatggctcatacattaattatgattggtagtaacgcttcggatcgcatgggtatgggtgttacatacttagcactcatagcgacatttaaaatacaaccgttcctcgcactaggattcttcctgcgcaaactgacctcccgagaaaacttactactaggagttggcttagcgatggcaacgacactgcaacttcctgaagacatagagcagatggctaacggtattgcgcttggactaatggcgctaaaattaatcacacaattcgaaacttatcaactatggactgcattgatctcactaacttgcagcaatactattttcactctgacggtggcttggagaacggcaactctaatattagcgggggtgtcacttctccctgtatgccaaagttcctcaatgagaaaaaccgattggttaccgatgaccgtagcagcaatgggggtcccaccactacctctatttatattttccctaaaagataccttaaagagacgatcatggccgctaaacgaaggcgtaatggcagtaggattagttagcattctcgcctcctcgttgttaagaaatgatgtaccgatggcggggcccctagtagcaggaggacttctaattgcatgctacgttatcactggtacgagcgctgatttgacagtagaaaaggccgcagatgtcacatgggaagaagaggcagaacagacaggggtatcacataatttaatgataacagttgatgatgatggtacaatgagaataaaagacgacgagacagaaaatatcttgacagttcttttaaagacagccttattaatagtatctggaatcttcccatattctattccagctacgttactggtttggcatacatggcaaaaacaaactcagaggtctggtgttctgtgggacgttcctagccctccagaaacacaaaaagctgaattggaagagggggtatatagaattaaacagcaaggtatctttggaaaaacacaagtaggtgtaggggtacaaaaggaaggggtattccacacaatgtggcatgtaaccagaggagcggtgctcacatataacggaaaacgtctagaacctaactgggcctctgtcaagaaagacttaatatcctatggtggaggatggagactatcagcacagtggcagaaaggggaagaggttcaagtcatagcagttgaacccggaaagaaccccaaaaactttcaaaccatgccaggtactttccaaactacgacaggagagataggagcaattgcattagacttcaaaccaggtacaagcggaagtcctattatcaacagagaaggtaaagtcgttggtctgtatggtaatggcgttgtaacgaaaaacggcggatacgtaagcggaatagctcagactaacgccgagccagatggaccaacaccagaactggaagaagaaatgttcaagaaacgtaaccttacgataatggatttgcatccaggatcaggaaaaacaagaaagtatttaccagctattgtaagagaagctataaaaagacgattacgcactttaatattagcacccacaagagtagtagctgctgagatggaagaggcattaaaaggactgccaattcggtatcaaactacagccacgaaatccgaacacacaggtagggaaattgtcgatcttatgtgccatgcgacctttaccatgagactactaagccccgtgagagtcccaaactataatctaataataatggacgaagctcattttactgatcccgcaagcatagcagcacgtggttatataagcacgagagtcggaatgggagaggcagctgctatattcatgacggcgacgcctcccggcactgcagatgccttcccccagagtaatgctccgatacaggatgaagagagagatatcccagagaggtcgtggaatagcggtaatgaatggataacggattttgccggtaaaaccgtgtggtttgtcccatcgataaaggcaggaaacgatatagccaactgtttaaggaaaaatgggaagaaagtcattcagctttcgaggaagactttcgacacagaatatcagaaaacgaaactcaacgattgggattttgttgtaactaccgacatttctgagatgggagcaaatttcaaagcagaccgtgtcatcgatccaagaaggtgcctaaaaccggtaattctgacagacggcccagaaagagttatattagcagggcccatgccagtgaccgcagcatccgcggctcagcgaagaggaagagtaggtcggaatccccaaaaagaaaatgatcagtatatcttcacgggtcagcctttaaataacgacgaagatcacgcacactggacagaggccaagatgttacttgacaatataaacacacccgaaggcatcataccagctttatttgagcctgaaagagagaaaagtgcggctattgacggggaataccgtctcaaaggagaatcgcgtaaaacgttcgtagaattaatgaggagaggcgatttaccagtgtggctagcgcataaggtagcaagtgaaggtataaaatacactgatagaaaatggtgtttcgatggtcagagaaataaccaaattctagaggaaaatatggatgtagaaatttggacaaaggaaggagaaaagaagaaacttcgaccaaggtggcttgatgctagaacttattcagatccacttgcgctaaaggaatttaaagattttgcagcaggtagaaaatctatcgctctggatcttgtcacagaaataggaagagtcccctcacacctagcccataggacaagaaatgcgctggataatctggtgatgctacatacatccgaacacgggggtaaagcgtaccgacatgccgtagaagaattacccgagacaatggaaacacttcttttattagggttaatgattctactgactggaggagcaatgttattcctgataagtggaaaaggaattggtaaaacatccatcggattgatttgtgtcatagcatcatctggtatgctctggatggccgaaattccgttacagtggatagctagcgccatagtgctagagttctttatgatggtgctactaattcccgaaccagaaaaacagcgaactccacaggacaatcagctagcctatgtagttatcgggatcttaacgctggccgctattattgcggcgaatgagatgggtttattagaaacgaccaagagggatcttggtatgagtaaagagcccggagtagtaagtccaacaagctatctagacgtagatcttcatcctgcatcagcatggactttatacgcggtggcgactaccgttataactcccatgctccgacatacgattgagaactccaccgcaaatgtcagtctagcagcaattgctaaccaagctgtagtactaatgggattagacaaaggttggcccattagcaaaatggatctaggggtgcctctattagccttaggttgctacagccaagtaaacccattgacattgactgcagcagtattactcctgatcactcattacgcgataatagggcctggcttacaagcaaaggcgacaagagaggcacagaaacgaacagcagctggtataatgaagaatccaactgtagatggaattatgaccatagatttggacccggtgatctatgactctaagttcgaaaaacagctgggtcaggttatgctattagtactttgtgctgtacaactattactcatgcgcaccagctgggctctatgcgaagcacttacattagcgacgggacctatcactaccctctgggagggatctcctggaaaattttggaatactacgatagcggtgtcgatggcaaacattttcagaggctcctatctggcaggagccggtttagcttttagtattatgaaatcagttggtactggcaaaagaggaacaggctctcaaggtgaaaccttaggtgagaagtggaaaaagaagttaaaccaattgtcgcggaaagaatttgatctgtacaagaagtctggcataacggaggtagatcgaacagaggcgaaagaaggtctgaaacgaggtgaaatcacccaccatgcggtctcccgaggtagtgctaagttgcaatggtttgtcgaaagaaatatggtaataccagaaggcagagtaattgatctaggatgcgggagagggggatggtcttattactgtgcaggcctcaagaaagttactgaagttcgaggctatactaaaggaggtccagggcacgaagaacctgttccaatgtcaacgtatggctggaatatcgttaagttaatgtccgggaaggatgtgttctaccttccacctgagaagtgtgacacgctattatgtgatattggagaaagttcaccgagcccaactgttgaagaaagtcggacaattagagtcttaaaaatggttgaaccatggctgaaaaataatcaattctgtataaaagtactaaacccctatatgcctactgttattgaacatttggaaagattgcaaagaaaacatggtgggatgctcgtaaggaatcccttatctcgtaattctacccatgaaatgtactggattagtaacggtaccggcaacatagtggcttcagtcaatatggtatcccgcttactcttaaacaggttcaccatgactcatagacgcccaacgatagaaaaggatgtcgatttaggagcaggaacacggcatgtgaacgcagaacccgagacgccaaatatggacgttataggggaaagaattaaaagaatcaaagaagaacataatagcacttggcactacgatgacgaaaatccatacaaaacgtgggcttatcatggtagttatgaagtcaaagcgaccggaagcgcttcaagtatgataaacggagtagtaaaattacttacaaaaccatgggatgttgtaccaatggttacgcaaatggcaatgacagatacaacgccttttggtcagcaaagggtttttaaagaaaaagtagatactaggaccccaaggtcgatgcctggtactagacgggttatgggaataactgccgaatggttgtggagaacactgggacgtaacaagaaacccagattgtgtacaagagaagagttcaccaagaaagtaagaaccaatgccgcgatgggagctgttttcacggaagaaaatcaatgggacagtgccaaagctgctgtagaagacgaagatttctggaagttagtagatagagaaagagagctccataaattagggaaatgtggatcgtgtgtctacaacatgatggggaagcgggaaaagaaacttggagagttcggaaaagccaaaggaagcagagcgatttggtatatgtggttgggtgcaaggtacctagagttcgaggctctaggattcttgaatgaagatcattggttttctcgggaaaacagctatagtggtgtagaaggagagggattacacaaattaggttacattttaagagatatctcaaaaataccagggggcgcaatgtacgctgatgatactgcaggatgggatacaaggatcactgaagatgatctacataacgaggagaaaataacacagcagatggacccagaacatcgacaacttgcaaacgccatctttaaattgacataccaaaataaagtggtaaaagtacaacgcccaacgccaactgggaccgtcatggatataataagccggaaagatcagcgtggaagcggtcaagtgggaacttatggattgaacacatttaccaatatggaagcacagctcatacgtcaaatggaaggagagggagtattaagcaaagcagatttagaaaaccctcaccttccagagaagaaaataacacagtggctagaaacgaaaggcgtagaaagacttaaaagaatggcgattagcggtgatgactgcgtggtcaaacctattgatgaccgattcgcaaacgccctattagcattgaatgacatgggtaaagttcgaaaagatatcccgcagtggcagccaagtaaaggttggcacgattggcagcaagtaccgttttgctcacaccattttcatgaactcattatgaaagatggcagaaaattggtggtaccatgtagacctcaagatgaattaatcggtcgggcgcgcatatcgcaaggagccggatggagcctaagagaaaccgcttgtttagggaaagcctatgcacaaatgtggtctttgatgtattttcacagacgagatttaagacttgctagcaacgctatctgttcggcagtgccggtgcattgggtgcccacatcaaggaccacatggtctattcacgcacaccaccaatggatgacaaccgaagacatgctaacagtctggaatagagtatggattgaggataacccttggatggaggataaaaccccagtaactacgtgggaaaatgttccatatcttggcaagcgagaggaccaatggtgcggatccttaatagggcttacatcgagagccacatgggctcaaaatatccctacagcgatacagcaagttaggtccttgatagggaacgaggagttcctagactacatgcccagcatgaaaagattcagaaaagaagaagaatcagaaggcgccatctggtaa

SEQ ID NO: 23352 - RNA, 9873 nt, synthetic construct
  misc_feature 1..9873: note = derived and/or modified CDS sequence (opt6) from DENV-3__FJ390377__SS-prME
  source 1..9873: mol_type = other RNA
acttcactatgtctaatgatgatacttcctgcagccttagcattccatctaacatcaagagacggggaacccagaatgatagtaggcaaaaatgaacgaggaaaatctttattattcaaaacagcatcaggaatcaatatgtgtaccctaatagcaatggatctaggtgaaatgtgcgatgatacggttacatacaaatgcccccatataactgaagtggaacccgaagacatagactgctggtgtaatcttactagcacgtgggttacatacggtacgtgtaaccaagctggagaacatcggcgggacaaacgcagcgtggcattagcaccacacgttggaatgggtttagatacacgcacacaaacgtggatgtcagctgaaggagcgtggcgccaagtagagaaagtggagacttgggcattacgccaccccggtttcaccatactagcattattcctagcacattatattggaacgagcctaactcaaaaagttgttatctttacattgttaatgttagttacgccgagtatgacaatgagatgcgtaggagtaggcaatagagatttcgtggaagggttatctggagcaacatgggtggacgtggtactagaacacggtggctgcgtgactacaatggccaaaaataaacccacccttgatatagaactacagaaaacagaagcgacgcaattggctacattacggaaactatgcattgaagggaaaattaccaatataacgaccgattccagatgcccaacacaaggcgaagcggtattacctgaagaacaagaccaaaactatgtatgtaaacatacatatgtagatagagggtgggggaatggatgtggcttatttggaaaaggctcattggtaacatgcgccaagtttcaatgcctggagcctattgagggaaaagttgtccaatacgagaatttaaaatacaccgtcataatcaccgtgcatactggggatcaacatcaagtaggaaatgagactcaaggcgtaactgcagagataacccctcaggcaagcacaacagaagctattttgccagaatacggtaccttaggtttagaatgttcgccaagaactggtttggattttaatgaaatgatccttttaacaatgaaaaacaaggcatggatggttcaccgacagtggttctttgacctcccgctcccctggacatcaggagcaacgactgaaacccccacgtggaatagaaaagaattgctagttacgtttaaaaatgcccacgccaagaaacaggaggtggtagtgctgggctcacaagaaggagcaatgcacacggcattaaccggcgcaacggaaatacaaaactccggtggaacaagtatatttgctgggcacttaaagtgtagacttaaaatggataaactagaattgaagggaatgtcgtacgctatgtgtactaatacatttgtactcaagaaagaagtttcagaaacgcaacatggcaccatattaataaaagtcgaatataaaggagaagacgtcccatgtaagataccgttttctaccgaagacggtcaagggaaggctcataatggtcgactaataactgctaacccagtcgtaactaagaaagaagaaccagtgaacattgaagccgagccgccctttggggaaagtaacatcgtaataggaatcggcgataacgcattaaaaataaactggtataagaaaggtagttccatcggaaaaatgttcgaagcaacagccagaggagctcgaagaatggccattttaggagatactgcttgggactttgggtcagtcggtggagtgcttaacagcctaggaaaaatggtgcaccaaatatttggatcagcatatacggcactattttcaggagtgagttgggtaatgaaaataggtattggagtcttgttaacctggatcggactaaacagcaaaaatactagcatgtcattttcatgtatagccattggaatcataacactatatttaggagcagtggtacaagctgacatgggatgtgtgataaattggaaagggaaggaactaaaatgtggatccggaatttttgtaacaaacgaggttcatacctggacagaacaatataaatttcaagccgattcaccaaaaagactagccacagcaatagcgggcgcgtgggaaaacggtgtttgcggtatcaggtcaacaacaagaatggagaatctgctttggaaacagatagcgaacgaactcaactatatcctatgggagaacaatattaagttaactgtagtagtaggtgatataataggagtattggaacagggtaaaaggactcttactccacagccaatggaattaaaatactcgtggaaaacctggggaaaggccaaaatcgttactgcggaaacacaaaattcatcatttataatagatgggccgaacacaccagaatgtccaagtgcgtctagagcatggaatgtgtgggaagtagaagactatggttttggcgtatttaccaccaacatatggcttaaattaagggaagtttacactcaactctgcgatcacagactaatgtccgctgccgtaaaagatgaaagagcagttcacgccgatatgggttactggattgagtctcagaaaaatggaagctggaaactcgaaaaggctagtttgatcgaagtcaaaacttgtacttggcccaaatctcatacactttggagtaatggggtattagaatcagatatgatcattcctaagagcctagccggaccaatatcacaacataattaccgtcctggctatcatacgcaaacagccggaccgtggcatctagggaaactagaattggatttcaattattgtgaagggacaactgtcgttataactgagaactgcggaacacgaggccctagtttacgcaccacgactgtttctggtaaactaattcatgagtggtgttgccgttcctgcacacttccacccttgagatacatgggagaagacggatgttggtatggcatggaaataaggcccatctccgagaaggaagaaaatatggttaagtccctagtaagtgcaggttcgggaaaggtagataacttcacgatgggggtgttgtgtctagctatcctcttcgaggaagttatgaggggtaaattcggcaagaagcatatgatagcgggagtattctttacatttgtcctactactatcgggccagataacatggagagacatggcgcacactttaattatgattggaagcaatgcaagtgaccgaatgggtatgggagttacatatttagcattaatagctactttcaaaattcagccgtttctcgctctcggatttttcttaagaaaacttacctcacgtgaaaatttactactaggagttggtctcgcgatggcaacaaccttgcaacttccagaagatatagagcaaatggctaacggaattgccttgggactaatggcactaaaactaattacgcaattcgaaacttatcagctttggacagcattaatttcactcacatgttctaatacgatatttacgctaaccgtagcctggcgtacagcaactttaatattagcaggagtaagtttgcttccagtatgtcaatcttccagtatgaggaagacggactggcttccgatgacagtagctgctatgggtgtacctccactcccgttatttatctttagtttaaaagacacgctaaaaaggcgcagctggcccttgaatgaaggggtaatggcagtcgggttggtatccatattagcgagttccctattaagaaacgatgtaccaatggctggacctctggtagcgggtggtttattaatagcatgttatgttataaccggaacaagcgccgatttgactgtcgaaaaagctgctgatgtaacctgggaagaggaagcggaacagactggggtaagtcacaatctcatgataactgtagatgacgatggaacaatgagaatcaaagatgacgaaacggagaatatactgactgtcttattgaaaaccgcattgttgatagtaagtggaatttttccttatagcattccagcgacacttttagtttggcatacctggcaaaaacaaacccaacgatcgggagtattatgggatgtaccatcaccgccagagactcaaaaagctgaacttgaagaaggcgtctatcgaattaagcagcaaggcatcttcggcaaaacacaagtcggagtaggagtacagaaagagggagtgtttcatacaatgtggcacgtaacgagaggagcagtactcacatacaacgggaaaagattagaaccaaactgggcaagtgtcaagaaagatctaataagctatggtggtggctggcgattaagtgctcagtggcaaaaaggagaggaggttcaggtgatagcagtcgaaccagggaaaaaccccaaaaattttcaaactatgcctggtacttttcaaacaacaacaggagaaataggagctatagccctagacttcaaacctggcacatcgggctcacctataataaaccgcgagggaaaggtggtaggattatatggcaatggtgtagtaaccaaaaatggaggttatgtctcaggaattgcacaaacaaacgcagagcctgatggcccaacacctgagttggaggaagagatgttcaagaaaagaaatttaactattatggatctacatcccgggtcaggtaaaactcgcaaatatttgcctgccatagttcgagaagccatcaagcgaagattacgaaccctaatcttagctcctacaagagttgtagctgctgaaatggaggaggcgttaaagggactacctatacgatatcagaccactgcgacgaaatctgaacatactggaagggaaattgttgatcttatgtgtcatgcgacgtttactatgaggttgctatcgcctgttagagtgccaaactacaatttaattataatggatgaagctcactttacggaccccgcatcaattgccgccaggggatatatttccactagagtcggaatgggagaggcagcagctatcttcatgacagctacacctccaggaacagctgatgccttccctcaatcgaatgccccaatacaagacgaagaaagagacatacccgagagaagttggaactcagggaacgaatggattactgattttgcagggaaaaccgtttggtttgtaccatccatcaaggctggaaatgacattgcgaattgtctcagaaagaatggtaagaaagttatacaacttagtcggaaaactttcgacaccgaatatcagaaaacaaaactgaatgactgggacttcgtcgtaacgaccgatatatctgaaatgggcgcaaattttaaagcagatagagtaattgacccacgcagatgtttaaaaccagtgatattgacagacggtccagaacgtgtgattctagcaggtccaatgccagttacagcagcaagcgctgcacagcgccgtggacgtgtcggaagaaacccccaaaaagaaaacgatcagtacatatttacaggccagccgcttaataacgatgaagatcatgcccattggacagaggccaaaatgctattagataatattaacacaccagagggaatcatacctgctctgttcgaacctgaacgggaaaaatctgccgcgatcgatggtgaatatagattgaaaggtgaatcaaggaaaacattcgtcgaattgatgaggcgcggagacctaccagtctggctagcacacaaagttgcaagcgagggtataaaatatacagaccggaagtggtgctttgacggtcagagaaataatcaaatattagaagaaaacatggatgttgaaatttggacaaaagaaggagagaaaaagaaattaaggccacggtggttagacgcacgtacttatagtgatccgttagcattaaaagaatttaaggattttgcggcaggacgtaaaagcatagcgcttgacttggtaacagagattgggcgcgtcccatctcatctagcacatagaactagaaatgcattagacaacttagtaatgctgcatacaagcgagcatggtggaaaagcatatcgacacgcagttgaagaattacctgaaactatggaaaccctgttattacttgggttgatgattctgctgacaggtggagcaatgttatttttaatttccggtaaaggcatagggaaaaccagtattggtctaatatgtgttatagcctcatctggtatgttatggatggcagagatacccctacaatggattgcttctgcgatcgtgttagagttctttatgatggtgttattaatacccgagcccgaaaaacaaaggacaccacaggataaccaattggcgtacgtggtgatcggtatcttaacgcttgcagcgataatagccgctaatgagatgggattactcgagacaacaaaaagggatctaggtatgagtaaagagcctggagtggtaagcccaacctcatatttagatgtagatctacacccggcatctgcttggacactatatgctgtagccacaacagtaattactccaatgcttcgccataccatagagaatagtacagcaaacgtctccttggcagcaattgcgaatcaagcagtggtgcttatgggactggataaaggatggcccatatcgaaaatggatcttggtgtaccactgttggcactcggatgctattcacaagttaatcccttaacattgacagcagcggtattattacttataacccattatgcgataatagggccgggattacaagcaaaagcgacacgagaagcacagaaaagaactgctgcaggcatcatgaagaatccaactgtagatgggataatgacaatcgacctagatcccgtaatttacgacagtaagttcgaaaaacaacttggacaagttatgctcttagtattatgcgcagttcagctactacttatgcgcacgtcatgggcactatgcgaagccctcactttagcgaccggaccgataacaactctctgggaagggtcaccaggcaagttctggaataccacaatagctgtttctatggccaatatattccgagggtcatatctagcaggggccggtttagccttctctataatgaaaagtgtggggaccggaaagcgtggtactggatcccaaggtgaaaccttgggggaaaagtggaagaagaaactcaatcaactaagcagaaaagaatttgacctttataagaaatccggaatcactgaagtagacagaaccgaagcaaaggaagggctcaagaggggtgaaatcacgcatcatgctgtgagcagggggtctgctaagctccaatggttcgtcgagcgtaacatggtaattccagagggaagagtgatagaccttggttgcgggagaggagggtggagttactactgcgcaggactaaagaaagtaactgaggtaagggggtataccaaaggagggccgggccacgaagaacccgtaccaatgagtacatatgggtggaatatagtaaaattgatgtccggcaaagacgtattctatctacctcctgaaaaatgcgatacgctcctttgtgacattggagagtcaagtccatcgcctacggtagaagaatctcgaacgatcagagtacttaaaatggttgaaccatggctaaagaataatcaattttgtattaaagtattaaatccgtatatgccgactgtcatagaacatttggagagactacaacgaaaacatggaggcatgttagttcgaaaccccttaagtagaaattccacacatgaaatgtattggatctcaaacggcacaggcaatattgtagcatcagtaaatatggtatcaagactattattaaatcgctttactatgacacatagacgccccactattgaaaaagatgtggatctgggcgcaggaactaggcatgtcaacgcggaacctgaaactccgaacatggacgtaattggtgaaagaataaaacgtatcaaagaggaacataactctacttggcactatgacgatgaaaatccctacaaaacgtgggcatatcatgggtcttacgaagtaaaagctacagggagtgcttcctcaatgatcaacggggtggttaaacttttaactaagccgtgggatgtggtaccaatggtcacacagatggctatgacagacacgacgccatttggtcagcagagagtatttaaggagaaagttgacacaaggacccctcgatccatgcctggaactagacgggttatggggattacagctgaatggttatggcggactttagggcgaaataagaaaccgcgtttgtgcactagggaagaatttaccaagaaagtaagaacaaatgcggcaatgggggcagtattcacggaagaaaatcaatgggacagtgcaaaagcggctgtagaagacgaagatttctggaaattagtagatagagaacgagagctacataaactaggcaaatgcggcagttgtgtatacaatatgatgggcaaaagggagaagaaattgggggagtttggaaaagcgaaaggttctcgagctatatggtatatgtggctaggagctcgatatctagagttcgaagcacttggtttcctaaatgaggaccactggttctcaagagaaaatagttacagtggagtagagggtgagggtcttcataaacttggatacatattacgcgacatcagcaaaataccgggaggcgccatgtatgcagatgatacggctggctgggatacgagaattacggaagacgatctacacaatgaagagaaaataacacaacaaatggatccggagcatagacaactggcaaacgctatcttcaaattaacataccagaataaggttgtcaaagtccaacgcccaactccgactggtacggtaatggatatcatatcaagaaaagaccaacgtggctcaggacaagtaggaacttacggattaaatacatttacaaatatggaggcgcaattaatccgccagatggagggggaaggagtgttaagtaaagctgacttagaaaatccacatcttccagaaaagaaaattacacagtggttggaaacgaaaggtgtcgaacgtttaaaacgtatggcaataagtggtgatgactgtgttgtaaagcccattgatgatagatttgctaacgcgctactagcattgaacgatatgggaaaagttcgaaaggatatcccacaatggcaaccaagtaagggctggcatgattggcaacaagtcccgttttgttcacatcactttcacgaattaatcatgaaagacggtcgcaaactggttgtaccatgtaggccccaagacgaactaattggccgtgcaaggatttcccagggggcaggctggagcttaagggaaaccgcatgtctaggaaaggcttacgcacaaatgtggtcgttaatgtacttccatagaagagatctgcgtctagcctcaaacgctatatgttcggctgtaccagtacattgggttcctacctctcgaactacttggagtatacatgcacaccatcaatggatgacaacagaggatatgctaacagtatggaatagagtttggatagaagacaatccatggatggaggataaaacccccgtcactacatgggagaacgtcccatacctcggcaaacgggaggatcagtggtgtgggtcgttgattggacttacaagccgtgcgacctgggcccaaaatatcccgacggcgatacagcaagtaagaagtctaattggaaatgaggagttcctagactacatgccaagtatgaaacgatttagaaaagaagaagagtcagagggagcgatatggtaa

SEQ ID NO: 23353 - RNA, 9873 nt, synthetic construct
  misc_feature 1..9873: note = derived and/or modified CDS sequence (opt6) from DENV-3__FJ547069__SS-prME
  source 1..9873: mol_type = other RNA
acgtcattgtgtttaatgatgatattacctgcagcacttgcatttcaccttacttctagagacggggaaccgcgaatgatagtgggtaaaaatgaacggggaaaatctcttctatttaaaacggcatcaggaatcaatatgtgtactttaatagctatggacttaggggaaatgtgcgacgatacagtgacctataaatgtccgcacatcaccgaagtagaaccagaagacatagattgctggtgtaacttaacaagtacgtgggtcacctatggtacctgtaatcaagctggtgaacaccgcagggacaaacgaagtgtggcactcgctccacacgtaggaatgggtctagatacacgaacccaaacatggatgtcagctgaaggggcatggcgccaagtagaaaaagtggaaacgtgggcacttcgacatcccggattcaccatattagccctgttcctagcacattatataggtacgtcactaacccaaaaagttgtaatatttatattattaatgttagtcactccatctatgactatgcgttgtgtaggggttggtaatagagattttgtagaagggttaagtggagcaacttgggttgacgtagttctggaacatggaggatgtgttacaacgatggcgaagaataagccaacattagatatagaattacagaaaacagaggcaacacaactcgctactctaaggaaattatgtatcgagggcaaaattacaaacataacaacagatagtcgatgtcctacacaaggtgaagccgtactaccagaggaacaagatcaaaattacgtatgtaagcatacatatgttgaccgcggatggggtaatgggtgcggtttatttggtaaaggatctttagtaacatgtgctaaatttcaatgtctggaacctattgagggcaaagttgtacaatacgaaaacctaaagtatacagtcataataactgtgcatactggagaccaacaccaagtgggtaacgaaactcaaggtgtaactgccgaaataacaccacaagcatctacaacagaagcaatactgccagaatatgggactctaggtctcgagtgttcacctaggacgggtctcgattttaacgaaatgatacttttaacaatgaaaaacaaagcatggatggttcaccggcagtggttcttcgacttgcctttaccctggacatcaggagcaactacggaaacaccgacttggaacagaaaagaactacttgttaccttcaaaaatgcacatgctaagaaacaagaagtcgttgtacttggaagccaagaaggagccatgcacacagcactaactggagcaactgagatacaaaatcttggtggtacaagtatattcgcaggccatctaaaatgcaggctgaaaatggataaacttgagctaaaaggaatgtcatacgcaatgtgtactaatactttcgtgctcaagaaagaagtatccgagacacagcatggtaccatactaattaaggtagaatataaaggggaagatgtaccttgtaaaataccattcagcacagaagatggacagggaaaagcacacaatggacgcctcatcacagccaacccagtggttaccaagaaagaagaacctgtaaatattgaagcagaacccccgtttggtgaatctaatatagtaatcggtatcggagataacgccttaaaaatcaattggtacaagaaaggaagctcaataggaaaaatgtttgaggccacagctcgtggggccagacgcatggcaatattaggagatacggcgtgggatttcggttcagtaggcggagttttaaacagtttggggaagatggtacatcagatatttggctcagcgtatacagcactattttcaggagtaagctgggtaatgaaaattggtataggagtcttattaacatggattgggttgaatagtaaaaatacctcgatgtcattttcatgtatcgcgatcggtattataactctctatctcggagcagtagtgcaggcagatatgggttgtgtaatcaattggaaaggtaaagagcttaaatgcggatcgggaatatttgtcacgaatgaagtgcacacctggactgaacaatataagtttcaagctgattctcccaaaagactcgcaacagctatagcgggggcatgggaaaatggtgtatgtggtattcgcagtacaacaagaatggagaatctattatggaaacaaatcgccaacgaattgaactacatattatgggaaaacaatataaaactaacagtcgttgtaggtgatatcataggtgttctggagcaaggaaaacgtaccctcacacctcaaccaatggagctaaaatattcatggaaaacctgggggaaagccaaaatagtcactgctgaaacccaaaattcatctttcataatagatggcccgaatacacctgaatgtccatccgcatctcgcgcctggaatgtatgggaggtagaagattacggcttcggggtattcacaacgaatatctggcttaaacttagagaagtctatacacaattgtgcgatcaccgactaatgagtgcagcagttaaggacgaaagagccgttcatgccgatatggggtactggattgagtctcagaaaaatggaagttggaagctggagaaggctagtttgatagaagtaaaaacatgcacatggccgaaatcgcatactttgtggtctaacggagtgctagaatcggatatgataataccaaagagcttagcaggcccgatatctcaacataattacagaccgggatatcatacgcagacggcaggcccgtggcacttgggcaaacttgaattagactttaattattgtgagggaactacagtagttattactgaaaattgcggtacacgaggaccgtcactacgaacaacaactgtctcaggaaaacttatccacgaatggtgttgcagatcctgcaccttaccgcccttgaggtacatgggagaagacggatgttggtacggaatggagataagaccgatatcagaaaaagaagaaaacatggtaaaatctttggtgtcagcggggagtggcaaggttgataactttacgatgggagtattatgcctcgctattcttttcgaagaagtcatgcgaggcaaatttgggaaaaagcatatgatcgccggtgtattctttactttcgtccttcttttaagcggccaaataacttggcgagatatggctcacacacttatcatgataggtagcaacgcatccgacagaatggggatgggtgtaacatatttggcgctaatagcgacttttaagatacagccttttctagcgttaggctttttcttaagaaaacttaccagccgagaaaatttactgctaggtgtaggtttagcaatggcgactaccctacaactccctgaagatatagaacagatggcgaacgggatagctcttgggctcatggcattaaaattaattacgcagttcgaaacatatcaattatggacagcattgatttcattaacctgttcaaacaccatctttaccttaacagtagcatggcgtacagcgacattaatactagccggtgtatcactactacccgtatgccaatcttcaagcatgcgaaaaacagactggcttcccatgacagtagccgcaatgggagtgccacctttacctctttttatattctctctgaaagacactctaaaacgaagaagctggcctctaaatgaaggggtaatggcagtcggacttgtatcaattttagcctccagtctgctacgaaacgacgtaccaatggccggacccctggtagcaggaggactattaatagcttgttatgtcataacagggacctctgcagacctaactgtagaaaaagctgcggatgtaacctgggaagaggaagccgagcaaactggagttagccacaacttgatgataacagttgacgatgacggtactatgagaatcaaagacgacgagacagagaatatccttaccgttttgttaaagacagcattattaatcgtatcaggaattttcccttatagtatccccgcgacgctactggtttggcatacatggcaaaaacaaactcagaggagtggggtattatgggacgtgccatctcctccagaaactcagaaagctgagttggaagaaggagtatacagaataaaacaacaaggcatattcgggaaaacccaagtcggagttggggtgcagaaagaaggggtattccacactatgtggcatgtaacacgcggagccgttctcacctataatggcaagcgtttagaaccaaattgggccagcgtgaagaaagatcttattagctatggaggaggatggcgactatccgcacagtggcagaagggtgaagaggttcaagttatagctgtggaaccaggtaaaaatcccaaaaattttcaaaccatgcctggaacattccagactacaacaggagagatcggtgctatagcattagactttaagcccggaacaagcgggagtccaataatcaacagagaaggaaaagtcgtaggcttgtatggaaacggagtagtgactaaaaatggtggctacgtcagcggcatagcccaaacaaatgccgaaccggacgggccaacaccagaattagaagaagaaatgtttaaaaagaggaacttaactattatggatttacatccagggtctggaaagactcggaaatatttaccagcaattgtgagagaggccataaaaaggcggctaaggacacttatcttagcgcccaccagagtagtagcggcagaaatggaagaagcacttaagggacttcctataagatatcagactacagcaacaaaaagcgagcacacgggaagggagatagttgatttaatgtgtcatgcaacatttacaatgcgattattatcacctgtaagggtgcctaactataacctaataataatggatgaagcacacttcacggatccagcgtccattgcggctcgaggttacatttcaacacgtgtcgggatgggagaggctgctgccatattcatgacagcaacgccaccgggtacagctgatgcatttccccaatcaaatgcgccaatccaggacgaagaaagagatatacctgagcggtcgtggaactcaggaaacgaatggataactgattttgcagggaaaacagtgtggtttgtccctagcataaaagcaggcaacgatatcgcaaactgtttgaggaaaaatggcaagaaagtcatacaattatcacgtaagacattcgatacagaataccagaaaaccaagttgaatgattgggactttgttgtaacaactgacatatctgaaatgggtgcaaattttaaagcagaccgagtcatcgacccgaggagatgcttaaagcctgtaatcttaacggatggacctgaacgggtaattcttgctgggccgatgccagttacagcggcctcggcagcccaacgacgtggaagggtaggtagaaacccacagaaggagaacgatcaatatatatttaccggacaacctttgaataatgatgaagaccatgctcactggacggaagccaagatgttacttgataatataaacacgcccgaaggcattataccagctttattcgaaccagaaagagaaaaatcagccgccattgatggagaatacaggttaaaaggagaaagtagaaaaacttttgtggaactcatgcgacgaggggatctaccagtttggttagctcataaagtagcatctgaggggatcaaatacacggaccgcaaatggtgctttgatggacaacgaaataaccaaattcttgaagagaacatggatgtagaaatatggacgaaggaaggagaaaagaagaaactcagacctcggtggctcgatgctaggacatatagtgacccattagccctaaaagagttcaaagatttcgcagcaggccgaaaaagtatagccttagatttggtaacagaaattggaagagtaccatcgcatctggcacatcgtacgcgaaacgcattggacaacctagttatgttacatacatccgaacacggaggaaaagcgtatcgacacgcggtagaagaattgccggagacaatggaaaccctattactattaggtttaatgatcttattgacaggaggggccatgctgtttctcattagcggcaaaggcataggcaagacatcaattggcttaatatgcgtaattgcttcctctggtatgctttggatggcggaaatcccattgcaatggatagcttctgcaattgtacttgaatttttcatgatggtgcttctaatacctgaacctgaaaaacaacgaacgccccaggacaatcaattagcttacgtagtaataggaatcctcaccctcgcggccatcatagcagcaaatgaaatgggtctactcgaaactactaaacgggatctggggatgagtaaagaacctggagttgtgtcacctacatcatacctagatgtagatcttcatcctgcttctgcttggacactgtatgccgtggcaacgacagtcataacaccaatgttacgacatactattgaaaatagtaccgcaaacgtctcacttgcggcaatagcaaaccaagcagtagttctaatgggacttgataaaggttggccgataagcaaaatggatttaggcgtcccactactagccctggggtgctattcccaggtcaatccactaaccctaaccgctgctgtattattactaataacgcattatgctataattggcccaggattacaagcaaaagcgacaagagaggctcagaaaagaacggctgctggaattatgaaaaatccaaccgtggacggaataatgactattgacttagacccggtaatctacgactccaaatttgaaaaacaattagggcaagtcatgttacttgttctatgtgcggtccaactattattaatgcgcacttcttgggcactttgcgaggctctaacgttggcaaccggtccaattacgactctgtgggagggaagcccgggaaagttttggaacaccactatagctgtatctatggcaaatatattcaggggctcatatctagctggagcgggattagcctttagcataatgaagagtgtaggtaccggaaagagaggaacgggatcccaaggcgagactctcggagaaaaatggaagaagaagttaaaccaattatcccgaaaggagttcgatttatataagaaaagcggtataacagaagtagacaggacagaggcaaaggaaggtttaaagcgtggcgaaataacccaccacgcagtatcacgaggttcagcgaagttacaatggttcgtagaaagaaatatggtcataccagaaggacgagtcatcgacctcggttgtggaagaggcggatggtcctactactgcgctggcctgaagaaagtaactgaagtgaggggatataccaaaggaggaccaggacatgaagaaccggtgccgatgtcaacgtatggatggaatatcgtgaagctcatgtcaggaaaagatgtcttttatttgccacctgaaaaatgcgatacactcctctgcgatattggcgaatccagccctagtcctaccgtcgaagaatcacggactattcgtgttttaaaaatggtagaaccatggctaaagaacaatcaattctgcatcaaagtgttaaacccttatatgccaacagtcatcgagcacctagaaagactgcagaggaagcacggaggcatgttagtaagaaacccactgtcgagaaactcaacccacgagatgtactggatatcaaacggtacgggcaatatagtagcgtcagtaaatatggtctcaagactcctgctaaatcgttttactatgacccatagaagacccacaattgaaaaagacgtggacttaggggctggaacccgtcatgttaatgctgaacctgaaaccccaaatatggacgttataggtgaaagaatcaaacgcatcaaggaagaacacaattcaacgtggcactacgatgatgaaaacccttacaaaacctgggcatatcacggatcttacgaagttaaagctacaggaagcgcaagctccatgattaatggcgtagttaagttactaactaaaccatgggatgtagtacctatggttacacaaatggcgatgacagatacaactccttttggccaacaacgagtttttaaagaaaaagtagatacaagaactccaagatcaatgccaggaactagaagagtcatgggcataaccgcagaatggttgtggcggacactaggaagaaacaagaaaccgaggctgtgcacacgcgaggagttcacgaagaaagtcagaacaaatgctgcaatgggcgcggtctttacagaagaaaaccaatgggacagtgccaaagcagcagtagaggatgaagacttttggaaactcgttgatcgagagagggagttacacaaactaggtaaatgtggctcatgtgtatacaacatgatgggtaaaagagagaagaaattaggcgagttcgggaaagctaagggtagtagagcaatatggtacatgtggcttggagccagatatttagagttcgaagcactggggtttctgaatgaggaccattggtttagcagagaaaattcttattctggagtcgaaggagaaggtctccataaattagggtatattttgagggacattagtaaaatcccaggcggtgcaatgtacgctgatgatacagctgggtgggacactcgcataacggaagatgacctccataacgaagagaaaataacacaacaaatggatccggaacatcgacaattggccaatgcaatatttaaactgacatatcaaaacaaagtagtaaaggtccaacggccaacgcccacaggaacagtgatggatataatatcacgaaaagaccaaagaggctccggccaggttggtacgtatggactgaatactttcacgaacatggaggctcagctaattagacaaatggaaggtgaaggcgttttatcgaaggccgacctagaaaacccacacttacctgagaagaaaataacccagtggttagaaaccaaaggtgttgaaagactcaaaagaatggcaatttcgggtgatgattgtgttgtaaaacctattgatgataggtttgcgaatgcactcttagctctaaacgatatgggtaaggtgagaaaagatatcccacagtggcaaccaagtaaagggtggcacgattggcaacaggtacctttctgctcacatcattttcatgaactcatcatgaaagatggaagaaaactcgtagtaccatgtagaccccaagacgaacttatcggtcgagctagaatatcacaaggagctggctggagtcttagagagacagcctgtctcggtaaggcttacgctcaaatgtggtctttaatgtattttcacagaagagacttacgacttgccagcaatgctatttgcagcgcagtaccggtacactgggtccctacttctcgaacaacatggtctattcatgcgcatcatcaatggatgacgaccgaagatatgctaaccgtctggaaccgagtctggatagaggataacccgtggatggaagataaaacacctgtcaccacgtgggagaatgtaccatatttaggaaaacgtgaagaccaatggtgtggaagtctaatcggactgaccagtagagctacctgggcacagaatattcctactgctatccaacaagtgagatcactgattggcaatgaagaatttctagattatatgccaagtatgaagcggtttcgcaaggaagaagaatcagagggcgccatttggtaa

SEQ ID NO: 23354 - RNA, 9873 nt, synthetic construct
  misc_feature 1..9873: note = derived and/or modified CDS sequence (opt6) from DENV-3__FJ562107__SS-prME
  source 1..9873: mol_type = other RNA
acgtcattgtgcttaatgatgattttaccagcggcattagctttccacctgacctcgcgagacggagaacctagaatgatagtaggcaaaaacgaacgcggtaaatctttactatttaaaactgcatcgggcatcaatatgtgtacactgatcgcaatggatttaggagaaatgtgcgatgacacagtaacatataaatgcccccacattacagaggttgaacccgaagacattgattgctggtgtaatctcacaagcacgtgggtcacgtacggaacctgcaaccaagccggggaacatcgtagagataaacgctcagtcgcattggccccacacgtgggaatggggttagacacaagaactcaaacatggatgtctgcagaaggggcatggcgacaagtagaaaaagtagaaacttgggccctcaggcatcccggtttcacaatattagcacttttcctggcacactatattggaacatcattgactcagaaagtagttatctttatattgctcatgctagtaactccatcgatgactatgagatgtgtaggggtagggaatcgtgacttcgtcgaaggtttatccggagcaacctgggttgacgtagtactagaacacggtggttgtgtgacaacaatggccaaaaataaaccaacgttagatattgaacttcagaaaaccgaagcaacgcagctcgctacgctaagaaaactatgcatagaaggcaaaattaccaatataaccactgatagcagatgtccgactcaaggagaggcagtacttcctgaagaacaagatcaaaattatgtatgtaaacatacctacgtcgaccgcggatgggggaatggctgcggactcttcggcaaagggagcttagtaacctgcgcaaaattccaatgtttggagcccatagaggggaaagtagttcagtacgaaaatttaaaatatacagtaatcatcacagtgcacactggagaccaacaccaagtaggaaacgagacccaaggagtgacagcagaaataaccccgcaagcaagcacaaccgaagctatccttcccgagtatggtactctaggattggaatgcagtcccagaacaggtcttgattttaacgaaatgatcctacttacgatgaaaaataaggcttggatggtacatcgtcagtggttctttgatttacccttaccatggacgtcaggagcaactacagaaacgccgacttggaatcgaaaagaactactggtgacatttaaaaatgcccatgctaagaaacaagaggtcgttgttttgggatctcaggagggagccatgcatacagcattgacaggcgccacagagatacaaaatagtggtggaacatcgatctttgctggccacctcaaatgtaggttgaaaatggataaacttgaattgaaaggaatgtcttacgcaatgtgtaccaacacatttgtgttgaagaaagaagtttcggagactcaacacgggactattttaataaaagtggagtacaaaggtgaagacgtgccctgtaaaattccatttagtacggaagatggccaaggaaaagctcataatggcaggttaataacagctaatcctgttgtcactaagaaagaagaaccagtcaacatcgaagcggaaccaccatttggtgaaagtaatatagtgataggaattggcgacaacgctttaaaaataaactggtataagaaagggtcgagcataggcaaaatgtttgaagctaccgcaagaggggccagaagaatggcgatattaggcgatacagcatgggattttgggagcgtcggaggggtcctaaatagtctaggaaaaatggtgcatcagatctttggaagtgcatatacagcactgttctcaggtgtgtcatgggttatgaaaataggtataggagtgttgcttacttggattggtcttaactcaaagaacacatcaatgtctttcagctgcattgtcattggtatcatcacattatatctaggtgctgtcgtacaagcagatatgggctgtgttattaactggaaaggcaaagaattgaaatgtggtagtggaattttcgtaactaacgaagttcatacatggaccgagcaatataaatttcaagccgattcgcctaaaagactggcgaccgcaatagccggtgcatgggaaaatggcgtatgtggaattagatcaacaacgagaatggaaaatctattatggaaacagattgcaaacgagctgaattatatattatgggaaaacaatataaaattaaccgtcgtggtaggtgacattataggagtgttagaacaaggcaaaagaacgttaacgccacaaccaatggaattaaaatactcttggaaaacatggggaaaagcgaagatagtaacggctgagactcaaaactcatcttttataatagacggacctaacacaccagaatgtccctcggcaagtagagcttggaacgtctgggaagttgaagactatggtttcggagtgtttacaacaaatatttggctcaaactaagagaagtttacacgcagctatgcgatcaccgcttaatgtcggctgcagtaaaagatgaaagagctgtacatgcggatatggggtattggattgagtcgcaaaagaatggaagttggaagttggaaaaggcatctcttatcgaggttaaaacgtgtacgtggccgaaatcgcacacactgtggagtaatggtgtattagagtcagacatgataataccaaaatcccttgcaggaccaatttcgcaacacaattatagaccgggctaccacactcaaactgccgggccgtggcacttaggaaaactagagctagacttcaactactgtgaaggaacaaccgtagtcataactgaaaactgcggaactagagggccgtcgttacggacaaccacggtgtcgggtaagttaatccacgaatggtgttgtaggtcatgtaccttaccacctctaagatacatgggagaggacggatgctggtacggtatggagatcagaccgatttcggaaaaagaagaaaatatggtaaagtcgttggtaagcgcagggagcgggaaagttgataactttacaatgggggtactatgtcttgctattctttttgaggaagtcatgcgaggcaaatttggtaaaaagcatatgatagcgggagtattctttactttcgtattactattatcagggcaaattacgtggcgagatatggcacatacattgatcatgataggatcaaatgcttcagacaggatgggtatgggcgtaacatatcttgcactcattgcaacattcaaaattcaaccatttttggcactaggattctttttgagaaaactaacgtcaagagaaaacttgctattaggagttggcttagcaatggcgacaacactacaacttccggaagatatcgaacaaatggctaatggcatagccttaggattaatggctttaaaactgatcacacaatttgaaacgtatcaactatggacggccttgatttctttaacatgcagtaatacaatttttacccttaccgttgcatggcgtacagccacattgatcctggcaggcgtaagtctactacctgtgtgccagagtagcagtatgaggaagaccgattggttaccgatgacagttgctgcaatgggagtacctccattacccctattcatattttctttaaaagatactttaaagcgaagatcctggcctttaaacgaaggagtaatggccgttggcttagtttctatattagcttcatctttattacgcaatgacgtaccaatggcaggccccttggtagctggaggtttattaatcgcgtgttacgtgattacaggtacaagtgcggacttaaccgtagagaaagcagcagacgtaacttgggaagaagaagcggagcaaacaggtgtaagtcataatttaatgataaccgtagacgacgatggaaccatgagaattaaagatgatgaaaccgaaaatatcttaactgtgttgttaaagactgcattacttatagtgtcaggtatctttccctatagtatcccagcaacgctccttgtctggcatacatggcaaaagcaaacccaaaggtccggggttttgtgggatgttccatctcctccagaaacacagaaggctgagctagaagaaggcgtctatagaattaaacaacagggaatttttgggaaaacgcaagtgggagttggagtacaaaaagaaggcgtattccataccatgtggcatgtcactagaggagccgtactaacatataacggaaaaaggttagagccaaattgggctagcgtaaagaaagaccttatctcctacggaggcggatggaggttatcggcacaatggcaaaagggcgaagaagtgcaggttattgctgttgagccggggaaaaatcctaaaaatttccaaaccatgccaggtactttccaaacaaccacaggagaaataggggcgatagcactcgacttcaaacccggcacctcaggatcacctataataaacagggaaggaaaggtggttggactatatggaaacggagtggtgacgaaaaacgggggatacgtcagtggaatcgcccaaactaatgctgaaccggacggacctacgccagagctagaggaagaaatgtttaagaaaaggaatctcacgattatggaccttcatccaggctcaggcaaaactaggaaatatcttccggctatagtaagagaagcaataaaaaggcgcttgcgtacgttaattttagccccaactcgcgtagttgctgcggagatggaagaggcattaaagggcctgccaatacgctatcaaaccacagccacaaaatcagaacacacaggaagagaaattgtggacttaatgtgccacgcaacctttacaatgcgactattgagccctgttagggtcccaaactacaatctcattatcatggacgaagcacactttacagatcccgcatctatagctgcaagaggttacatttctacacgtgtcggcatgggtgaagcggcagctatttttatgacagccacgcctccaggcacggcagatgcatttcctcaaagcaacgcccccatacaggatgaagaacgagatataccagaaagaagctggaatagtgggaacgaatggataacagacttcgcagggaagactgtctggtttgttccgtcaataaaagctggaaatgatatcgctaattgtttaaggaagaacggtaagaaagtaattcaattgagtaggaagacatttgacacggagtaccagaaaacaaaattaaatgactgggatttcgtagttacaacagatatatctgaaatgggagcgaattttaaagcggatagggtaatagatcctcgaaggtgccttaaacctgtgatattgacggacggccctgagcgtgttatactggctggtccaatgccagtaaccgctgcatctgcagcccaaaggaggggcagagttggaaggaatccccaaaaagaaaatgatcagtatatattcacaggacaaccattaaataatgatgaagatcatgcgcactggactgaagccaagatgctattggacaatattaatacacctgaaggaatcatacctgcactatttgagcccgagcgagagaaaagtgccgccattgacggcgaatatagactcaaaggcgaaagcagaaagaccttcgtagaactaatgagacgcggagacttaccagtttggctagcatataaagtggcaagtgaaggaataaagtatacggaccgcaaatggtgcttcgatggacaaagaaataaccaaatattggaagaaaatatggacgtagaaatctggaccaaagaaggagagaagaagaaactacgaccaagatggctagatgccagaacttactccgatccattagctcttaaagagtttaaagattttgccgctggtcgaaaatctattgcccttgacctggtaacagaaataggaagggtaccaagccatttagcccaccgcacaagaaacgcgcttgataatctagtaatgcttcatacttcagagcatggcggcaaggcttatagacacgcagtagaagaactaccggaaactatggagacattattattattaggattaatgatcctactaacaggtggtgcaatgctatttttgataagtggtaaagggattggaaaaacatcaataggcttaatttgcgttattgcatcatcagggatgctttggatggcggagatcccattacaatggatcgctagtgcaatagtattagagttctttatgatggtgttattaatacctgaacctgaaaagcaaaggacaccgcaagataaccaactagcatacgttgttatcggtattttaacccttgccgctataatagcggctaacgaaatgggactactggaaaccacaaagagagatctcggcatgtcaaaagaacctggagtagtttcgcctacttcatacctggacgtagacttgcatccagcaagcgcttggacactatatgccgtcgcaacaactgtaataaccccgatgctcaggcacacgatcgaaaacagtaccgcaaatgtaagtttagcagcgatagcaaatcaggccgttgtactgatgggattagataaaggatggcccatttcgaaaatggatttaggagtgccgcttctggcattaggatgttattctcaggtgaacccacttacacttactgctgcagtactccttctcataacgcattatgcaataataggtcccggcttacaagccaaagcaacacgagaggcccaaaagcgtacagctgcgggtattatgaagaaccccacagtagacggtattatgacaatagatctggaccctgttatatacgatagtaagttcgaaaagcagctgggacaagtcatgctattagtattatgcgccgtacaattactcctcatgagaacatcgtgggctctctgtgaagcactgaccttagcaacgggaccaataacaactctttgggaaggctctcctggtaagttttggaatacaactatagcggtatcaatggcgaatatattccgaggctcatatctggctggtgctggattggcatttagcataatgaaatcagtcggcacgggtaagagaggcactggatcacaaggagaaacattaggcgagaagtggaagaagaaattgaaccaactgagtcgaaaggaatttgatctgtataagaaaagtggaattacagaggtagataggacggaggctaaagaaggattaaagagaggggaaataacacatcatgcggtaagccgagggtctgcaaaattacaatggtttgtcgaacgtaacatggtcatccctgaaggaagagtaatcgatctgggatgcggacggggaggatggtcatattattgcgcaggtctaaagaaagtcaccgaggtaagaggatatacaaagggaggtcccggacatgaggaaccagtgccaatgagtacatatgggtggaacatagtcaagttgatgagtggcaaagacgtattctatttacctccggaaaaatgcgatacattactgtgcgatattggtgaaagtagcccaagccctacagtcgaggaatcccgaactatcagagttctaaaaatggtagaaccatggctgaaaaataatcaattttgcattaaggtactcaatccatatatgcctactgtaatagaacatctcgaaagattgcaaaggaaacatggagggatgcttgtcagaaatccccttagtagaaatagtacgcatgaaatgtactggatctctaatggtacaggaaacatcgttgcatcggtaaatatggtttcacgattactcctcaacagatttactatgactcatagaagaccaacaatcgaaaaagatgtagatctaggtgcgggaactcgtcatgtaaacgccgaacctgagacacccaatatggatgtgataggtgaacgaatcaagcgaattaaagaagaacataatagtacatggcattatgacgatgaaaacccctacaaaacttgggcataccatggaagttacgaagttaaagccaccgggtcagcaagtagtatgataaatggcgttgtaaagttattaaccaagccctgggatgttgtcccaatggtaacacaaatggcgatgaccgatactactccgtttggtcaacagcgggttttcaaagaaaaagtagatacgaggacccctcgctcaatgccagggaccagacgtgtcatgggaatcacggctgaatggttatggcgtaccttaggacgaaacaagaaaccacgactatgcacgagagaggaatttacaaagaaagttcgaactaacgcagcaatgggcgccgtgtttactgaggaaaaccagtgggactcagctaaagcagccgtggaagatgaggatttttggatactcgtagacagggaacgggaactccacaaacttggaaaatgtggatcatgtgtatataatatgatgggaaaaagagagaagaaattaggagagtttggcaaagctaaaggatccagagcaatttggtatatgtggttaggggctcgatatttagaatttgaagcgctagggttcttaaacgaagatcattggttctcacgagaaaactcatacagcggcgtagaaggtgaaggcctacataaattaggttacattctacgtgatatatctaagataccgggtggagcgatgtatgcagacgacacagctgggtgggacactcgaataaccgaagatgacttacacaacgaagagaaaatcacacagcaaatggatcccgaacaccgacaacttgcaaatgcaatatttaaactaacttaccaaaataaagtagttaaggtgcagaggccgacgcccactggtacagtgatggatataataagcaggaaagatcaacgaggctcgggccaagttggaacgtacggtcttaatacgtttacaaacatggaagcgcaactaatacgacaaatggaaggagaaggagtattgagtaaggcagaccttgaaaacccgcatctgcctgagaagaagataacacaatggttggaaacaaaaggagttgaaagattaaaaagaatggctatatcaggtgacgactgtgtagtgaaaccaatagatgatcggtttgctaacgcgctattagcattaaatgacatgggcaaggttaggaaggacataccgcaatggcaacctagtaaggggtggcacgactggcaacaagttccattctgcagccaccatttccatgaacttataatgaaagatggtcgaaaactcgtggtaccatgcaggccacaagacgagctaataggaagggcccgcatttcacaaggcgccggttggtctttgagagaaacagcatgtttagggaaagcatacgctcaaatgtggagcctcatgtactttcatcgacgagatttacgactagcctcaaatgctatatgtagcgccgttcctgtgcattgggttccgacttctagaactacctggtcaattcacgcacatcaccaatggatgactaccgaggacatgctaacagtatggaacagagtatggatcgaggataatccctggatggaagacaaaacacctgttacaacgtgggaaaacgttccatatttaggcaaaagagaggatcaatggtgtggatcattaattggcctcacctctagggctacatgggcacagaatatacccacagcaatacaacaagtccgcagcttaatcggtaacgaagagttcttggactatatgcctagtatgaagcgatttagaaaagaagaggagtcagaaggtgcaatatggtaa

SEQ ID NO: 23355 - RNA, 9873 nt, synthetic construct
  misc_feature 1..9873: note = derived and/or modified CDS sequence (opt6) from DENV-3__FJ547071__SS-prME
  source 1..9873: mol_type = other RNA
acgagcttatgtttaatgatgatcctacctgctgcactagctttccatttaactagcagagacggagaaccaagaatgatagtaggcaaaaatgaaagaggtaaatcactgctctttaaaactgcttcaggaataaacatgtgcactctgattgctatggatcttggagaaatgtgcgatgatacagttacttacaaatgtccacacataactgaagtcgaaccagaagacattgactgttggtgcaatttaacatctacatgggttacttatggaacttgcaaccaagctggagaacacagaagagataaaaggtcagtagcgttagctccgcacgtggggatgggcctagatacaagaacccaaacctggatgtctgctgaaggagcatggagacaagtggaaaaagttgaaacatgggcgctacgacaccccggattcacaatattagctctatttctagctcactacataggcacttcccttacacaaaaagtagtaatttttatattacttatgttagtcacaccatccatgacaatgcgctgtgtaggagtgggaaatagagattttgtagaaggattaagcggagccacatgggtcgacgtagtacttgagcatggtggttgtgtgaccacaatggccaaaaacaaaccaacattagacatcgagttgcagaaaacagaagccacacaacttgcgacgctaagaaaactgtgcattgaaggtaaaataactaatattactacggattcgcgatgtcccactcaaggagaggcagtacttcctgaggaacaagatcaaaattatgtatgcaaacacacgtatgtagacagaggttggggtaacggatgtgggctattcggaaaagggtcacttgtaacatgtgctaaatttcaatgtctcgaacctattgaaggcaaagtagtgcaatatgaaaacctaaaatatacagtaattataacagtacacacgggggaccaacatcaagttgggaacgaaacccaaggcgtaacggccgaaataacaccccaagcatcaacaacagaagccatactaccagaatacggtacactaggactcgaatgttccccaaggacaggattggattttaatgaaatgatactgcttacaatgaaaaacaaagcatggatggttcatagacaatggttcttcgatcttcctctaccatggacaagtggagcgacaaccgagacaccaacatggaataggaaagagctattagtgacattcaaaaatgcccatgccaagaaacaagaagtagttgttttaggttctcaagagggcgcaatgcacactgcactgaccggagcgacagaaattcaaaactcaggtggtacaagtatctttgccggacacctcaaatgccgcctaaaaatggataaattagaactaaaaggcatgagctatgctatgtgtacgaatacattcgtcctaaagaaagaggttagtgaaacccaacatggcactatattaataaaagttgaatataaaggtgaagacgttccttgtaaaatccccttcagtacagaggatggacagggaaaagcacataatggaagacttataaccgccaatcccgtagtaacaaagaaggaggaaccagttaatatcgaggctgagccaccgtttggcgaaagtaatattgtaataggaatcggggataatgctttaaagataaactggtacaaaaagggatctagcataggtaagatgtttgaggcaacagctcgaggggccagaagaatggcaatacttggagacacggcctgggatttcggttcggtagggggtgtacttaattccctagggaaaatggttcatcagatatttggaagcgcttatacagctctattctcaggagtaagctgggtaatgaaaataggaattggggtcctgttgacatggatcgggctaaattctaaaaacacctcaatgtccttctcttgtattgcaataggaataataactctatacctcggcgccgtagttcaagcagatatgggatgcgtgataaactggaaaggaaaagaactaaagtgtggcagcgggatttttgtaacgaacgaagttcacacttggacagaacaatacaagtttcaagcagattcacccaagcgcttagccacagccatcgctggagcctgggaaaacggtgtatgtggaatacgatcaacgacacgaatggaaaatttattatggaagcaaatagcaaacgaactgaactatattctttgggaaaataatatcaaacttaccgtcgttgtcggagatattattggagttttagaacagggtaagcgaactttaacgcctcaaccaatggagttaaaatactcctggaaaacatggggaaaagcaaaaatagtcactgcagaaacccaaaatagttcattcattatcgatggcccaaatacaccagaatgcccgtctgcatcccgagcgtggaatgtatgggaagtcgaagactatggtttcggtgtttttactactaatatatggttaaaactccgagaagtttacactcaactctgtgaccaccggctgatgagtgctgcagtaaaagacgaacgcgccgtgcacgcagatatgggttactggattgaatcccagaaaaacggatcgtggaagctcgaaaaagcatcgttgattgaggtaaaaacatgtacctggcccaagtcccatactctgtggagcaatggtgtgttagaatctgatatgattatcccaaaaagtcttgccggtccgatttcacagcataattaccgccctggatatcacacacaaacggccggcccttggcatctcggaaaacttgaactcgactttaattactgtgaaggtacaaccgttgtaattaccgagaactgcggcacgaggggtccctccctaagaacaacaacagtgtcggggaaactgattcatgaatggtgttgccgatcgtgcacactacctcctctaagatacatgggagaagatggttgttggtacggcatggaaatcagaccaatatcagaaaaagaggaaaatatggtaaaaagtctggtatcggctggctcgggcaaagtggataacttcactatgggtgttctttgtttagctatactatttgaagaagtcatgaggggaaagttcggcaagaaacacatgatagcaggcgtattctttacttttgtcttgttgttatcgggtcagataacttggcgggatatggcacatacacttattatgattggttcaaatgcatctgatcgtatgggcatgggtgtgacatatctcgcactcatagcaacatttaagatacaaccgttcctagcattaggattctttctgagaaaactaacatcgcgcgaaaatcttttgttgggagtcgggttggcgatggccacaactttacagttgcctgaagacattgaacagatggctaatgggatagcgttagggctaatggcattaaagttaattacacaatttgaaacgtatcaactatggactgctttaatcagcttaacgtgtagtaataccatattcacgctaactgttgcctggcgcacagctaccttaatactagcaggagtgagtttgctacccgtctgtcaaagttcctccatgaggaaaactgattggttaccaatgactgtagcagctatgggggttcctcccttaccattatttattttctcattaaaagacaccttaaaacgtagatcctggccattaaacgaaggagtaatggcagtcggattggtgagtatcttggcatcatctctgttaagaaatgatgttccaatggcaggtcccttagttgctggtggattactcatagcttgttacgttatcacaggtacatctgctgacctcacagtggagaaaactgccgacgtcacatgggaagaagaagctgaacaaaccggcgttagtcacaacctaatgattaccgttgatgacgatggtactatgaggataaaagatgacgagactgaaaacatcctaacagtactgttaaaaacagcgcttctgatagtaagtggtatctttccctatagtataccagcaacattgttggtgtggcatacatggcagaaacaaacccaaagatccggagtcctttgggatgttccatcacccccagaaacccagaaggccgaactagaagagggcgtatacagaataaaacaacaaggtatatttgggaaaacacaagtcggcgtaggtgtgcaaaaagaaggcgtattccatacgatgtggcatgtcacaagaggcgctgtcttaacttacaatggaaaaaggttagaacccaactgggctagtgttaagaaagacttaatctcttatggcggcgggtggagattaagtgcacaatggcagaaaggagaagaggtacaagtaatagcagtagaacctggcaaaaaccccaaaaatttccaaacaatgccaggaacatttcaaaccaccaccggagaaataggtgcaatagctttagacttcaaacccggcacatccggtagtccgattatcaatcgtgaagggaaagtagtcggactatacggaaatggagtagtcacaaagaatggaggttacgtttcgggtattgctcaaaccaatgcagaacctgatggtccaacacctgagttagaggaggagatgtttaaaaagaggaatctgaccatcatggacctacatccgggctcaggaaaaacaagaaagtatctacctgcgatagtaagagaagcaataaaaagacgattgcgcacacttatactagcaccaacacgagtagtagcggctgaaatggaagaagccttaaaaggtttgccaattagatatcagacaactgcaacaaaatctgagcatactggtcgtgaaattgtagatttgatgtgtcacgcgacatttacaatgagattgctcagtccagtaagggtacccaactataatttaataattatggatgaggcccattttacggatccagcctcaatagcagcacggggctatataagtactagggttggtatgggagaagcagccgccatatttatgactgctactccgccaggtacggcagacgccttcccacaatcaaatgctccaattcaagatgaggaacgtgatataccggaacgtagttggaactctggcaacgaatggattacggattttgccgggaaaacagtttggtttgttccttccattaaagccggtaacgacatagcaaactgtctacgtaaaaacggcaagaaagtaattcaactttcacgtaaaacatttgacacagaataccaaaagacaaaattaaatgactgggactttgtagtcacaacggacatctccgaaatgggtgcaaactttaaagcggatagagtgatagacccccgtcgatgtctgaaaccagtcatacttactgacggccctgagagagtgattcttgctggccctatgccagtaacagcggcctcagcagcccaacgtcgtgggcgtgtaggccgtaatccgcaaaaagaaaatgaccaatatatctttactggtcaacctcttaataatgacgaagatcacgcacattggacagaggcaaaaatgctactagacaacataaacacacccgagggaattatacccgcactgtttgagcccgaaagagaaaagagtgcagcaattgatggggaataccgtttgaagggagagtcacgaaaaacattcgtggaattaatgagaagaggagacctaccagtttggttggcacataaagtagccagtgaaggtataaaatacaccgacagaaaatggtgcttcgatgggcaaagaaataaccaaatcttagaggaaaatatggatgtagagatatggaccaaagagggtgaaaagaaaaagttacggcccaggtggttggatgcccgtacatactcagatcccctggcgctaaaagaatttaaggattttgcagcaggtaggaagtcaatagctctagacttagtcacggaaattggacgtgtgcctagtcacttggctcaccgaacacgcaatgcactcgataatctggttatgctacacaccagcgagcatggaggaaaggcttatagacacgcagtcgaggagcttccagagacaatggagactttattattgttagggttaatgatactgttgactggaggggcaatgctatttctaataagtggtaaaggaataggaaaaacaagcataggattaatatgtgtgatcgctagttcgggaatgctctggatggcggaaataccattacagtggatagcatcagctatagtattagagttctttatgatggtactgttaattcccgaacctgaaaaacaacgtacaccccaagataatcagctcgcctacgtagtgatagggattttgacgctggcagcaatcatagcagctaatgaaatgggattattagaaactacaaaaagggacttaggaatgagcaaggaacccggcgtagtatcaccaacaagttatttagacgtggatttacacccagcatctgcgtggacattatacgcagtagctacgacagttattactccaatgctaaggcatacgatagagaacagtactgcaaatgtaagtctagccgcaatcgcaaatcaagctgttgtattaatgggcttagataaaggctggccaatttccaaaatggatcttggggttcctctcttagctttgggttgctattcccaagttaatccattaacactaactgctgccgtattgttgttaatcactcattacgcaatcataggaccaggattacaagctaaagccactcgtgaagcccagaaacggacagctgcggggatcatgaaaaacccaaccgtagacgggataatgacaatagacctagaccccgttatctatgacagcaaatttgaaaaacaattaggtcaagtaatgttgttaatattatgcgcagtacagctcttgttaatgcgaacaagttgggcattatgtgaagcattaacgctcgccacgggacccattacgacactttgggaaggatccccagggaaattttggaatactacaatagcagtgagcatggctaacatatttagaggtagttacctagctggagcgggtttggcattcagcataatgaagtcagtcgggacaggaaaacgaggaacgggctctcaaggcgaaaccttaggagagaaatggaagaagaaattgaatcaattaagccgaaaagagtttgatctgtacaagaaatcaggcataacagaggttgacaggactgaagcaaaagagggattaaagagaggggagataacacatcatgcagtaagcagaggcagtgcaaaattacaatggtttgttgaaagaaatatggtcatacccgaaggaagagttatagacttaggatgcgggagaggaggctggtcctattattgtgcaggcctgaagaaggttaccgaagtgcgaggatacacaaaaggaggacccgggcacgaagaacccgtgcctatgtctacctacggctggaatattgtcaaactaatgagtggcaaagacgtattctacctaccgccagaaaagtgcgacactttactatgtgatataggagaatcctctccgagtcctacagtggaagaaagtcgtaccatcagagtacttaagatggtcgagccctggttaaagaataatcaattttgcataaaagtactaaatccatacatgccaactgttatcgaacatctagaaagattacaacgcaaacatggaggcatgctagtaaggaatccgctatcaagaaattcaacccacgagatgtactggatatcaaatggcacagggaacatcgtagcaagcgtaaacatggtaagccggcttcttttaaacagatttacaatgactcatagaagaccgactatagagaaagatgtcgacctcggagcaggtactcgccatgtcaatgccgagcctgaaaccccaaatatggacgtgataggagagcggatcaagcgaattaaagaggaacacaacagtacgtggcattatgacgatgaaaacccgtataagacctgggcctatcatggttcatatgaagtaaaagcgacaggatcggctagttcgatgataaacggtgtggtcaaactattaacaaaaccttgggacgtcgtacctatggtaacccagatggcaatgacggatactacaccgttcggacagcaaagagtttttaaggagaaagtcgacacaaggacgcccagatcgatgccaggcactcgaagggtaatgggaatcacagcggagtggttatggcgaacactaggaaggaataagaaaccccggctatgcacaagagaggagttcactaagaaagtccgtaccaatgcagcaatgggagcagtttttaccgaagagaatcagtgggattcagctaaggcagcagtagaagacgaagacttctggaaattagtagacagagagcgagaattacacaaactaggaaaatgcggaagctgtgtttataatatgatgggaaagcgggagaagaaacttggagagttcggtaaagcgaaaggaagtcgtgctatttggtatatgtggttaggtgcaagatatttagagttcgaagcgttaggatttctcaacgaagaccattggttctcacgagaaaactcgtatagtggcgtggaaggcgaggggttacataaactcgggtatatattaagagatatctcgaaaatacctggaggagctatgtatgcagatgatacagcgggatgggacacccgcattactgaggacgacctgcacaatgaggagaaaataacgcaacaaatggacccagaacatagacagctggcgaacgccatatttaaattaacttaccagaacaaggtagtaaaagtacaaagacctacgcccacgggcacggtaatggatataatttcgcggaaggatcagcggggtagtgggcaagtagggacctatggtttaaacaccttcacaaatatggaagcccaattaataaggcaaatggaaggtgaaggggtactaagtaaagctgatctagaaaacccccaccttcctgagaagaaaataactcagtggttggaaacaaaaggcgtagaacgattaaaacgaatggctataagtggggatgattgcgtagtaaaacccattgatgatcgatttgcaaacgccttattggcattaaatgacatgggaaaagtgcgcaaagacatacctcaatggcaaccgtccaaaggttggcacgactggcaacaagtacctttttgctcacaccactttcatgaactcataatgaaagacggccgcaaactcgtggtcccatgtagaccccaagatgagctaatagggagagccagaatttcacaaggtgcaggctggagcctacgtgaaacagcctgtctgggaaaggcatacgcccagatgtggagtctaatgtactttcatagacgagatttgcgcttagcaagcaacgccatatgttcggctgtaccagtacactgggtaccaacgtcgcgcacgacctggtcaatacatgcacatcaccaatggatgacaacagaagacatgctaacagtgtggaatagagtatggatagaagacaatccatggatggaggacaaaactcccgttaccacgtgggaaaatgttccctatctaggcaagcgggaagatcagtggtgtggaagcctgataggtctaacaagccgggcaacatgggctcaaaacatacctacagcgattcaacaagttagaagtttaatagggaatgaagaatttcttgattacatgcctagtatgaaaagattccggaaggaagaagaaagtgaaggtgcaatctggtag

SEQ ID NO: 23356 - RNA, 9873 nt, synthetic construct
  misc_feature 1..9873: note = derived and/or modified CDS sequence (opt6) from DENV-3__FJ410176__SS-prME
  source 1..9873: mol_type = other RNA
acttcgttatgcctaatgatgatactacctgcagcacttgcatttcaccttacttcgcgcgacggggaaccccgcatgattgtcggcaaaaatgaaagaggaaaatctttactattcaaaacagcttcaggtataaacatgtgtacattaattgcaatggacctaggagaaatgtgtgatgatactgtgacgtataaatgtccacatataacagaggttgagcctgaagacatagactgctggtgcaatttaacatccacgtgggtaacatacggtacatgcaatcaagcgggagagcacaggcgggataaaagatcggttgcattggcgccgcatgttggaatgggactggatacaaggacgcaaacttggatgtccgctgagggagcttggagacaagtagaaaaagtagaaacttgggcccttcgccacccgggattcacaatcctagcactatttttggcacactacataggtacatcgctaactcaaaaagtcgtcatatttattctactcatgttagtcaccccaagcatgactatgaggtgcgtaggagtaggaaacagagacttcgtcgagggtctatcaggtgccacgtgggttgacgtagttttagaacatgggggttgtgtcaccacgatggccaaaaacaagcccacactagacatcgaattacagaaaactgaagcaacgcaacttgcgacattaaggaaattatgcatcgaaggaaaaataacaaatattacaactgacagtcggtgtcctacgcaaggggaagctgtattgccagaagaacaagatcagaattacgtatgtaaacacacatatgtcgatcggggttggggaaatggatgtggtttattcggaaaaggtagtcttgtcacgtgtgccaaatttcaatgtttggaaccaatagagggaaaggtagtccaatatgaaaatttaaaatatacggttatcattaccgtacataccggggatcaacatcaagttggtaacgaaacacagggagtgaccgcagaaattacaccacaggcttccacgaccgaagcgatattaccagaatacggaactttaggattagagtgttcacctcgtacaggtctagacttcaacgaaatgatactgttgaccatgaaaaataaagcctggatggtacaccgacaatggttctttgatcttcccctgccatggacaagtggagcgactaccgagacccccacgtggaaccgcaaagagctcctagtgacttttaaaaacgcacatgcgaagaaacaggaagtagttgtactggggtcccaggagggcgccatgcataccgcactgacaggagctacggaaattcaaaatagtgggggcacgtcaattttcgctggtcatctaaaatgtagactaaagatggataaattagaactcaaaggaatgtcatatgctatgtgtactaatacgtttgtattaaagaaagaagtctctgaaacgcagcatggaacaatactaataaaggtagaatataagggagaagatgtaccctgtaagatacctttctctaccgaagatggacaaggcaaagcacacaatggaaggctaataacagcgaatcctgtcgtaactaagaaagaagaacctgtgaatatagaggcagaaccaccctttggagaatccaatatagtaattggaataggtgataatgctctcaaaattaattggtataagaaaggatcaagcattggtaagatgttcgaagcaacagctcggggcgcaagaagaatggccatacttggagatacagcatgggactttggatcagttggtggagttttgaatagcctcggtaaaatggtacaccaaatatttggctctgcgtatacagcattattttcaggagtcagctgggtaatgaaaataggcattggagtattattaacgtggataggtctcaattctaaaaatacatcgatgtccttttcatgtatagcgatcggtataatcaccctctacctaggagctgtagtacaagccgatatgggatgtgtaattaattggaagggcaaggaattaaaatgtggctcaggtatattcgtgacaaacgaagttcatacgtggactgaacaatacaaattccaagcagattcccctaagaggctcgcgacggccatagccggagcttgggaaaacggagtatgcggcattcgctctactacacgaatggaaaaccttttatggaaacaaatagcgaacgaacttaactatatattatgggagaacaacataaagttaacagtagttgtaggtgacacaataggagttcttgagcaaggaaaaagaacgcttactcctcaaccgatggaattaaaatatagttggaagacatggggaaaagccaaaatagttacggccgaaacacagaatagttcgtttattattgatgggcctaatacccccgaatgtccaagtgcaagcagagcctggaatgtttgggaggtagaagattatggatttggagtgtttacgacaaacatttggttaaaactaagagaggtatatacacagttatgcgaccacaggttgatgtctgcagcggtgaaagatgagagagctgtccacgcagatatgggctattggatagaatcacagaaaaacggatcctggaagctggaaaaagcctcgttaatagaagtcaaaacatgcacttggccaaaatcacacacattatggtctaacggcgtcctagaatcagacatgataattccaaaaagtttagcaggtccaatctctcagcacaattacagacccggctaccacacgcaaacagcgggtccctggcatttgggcaaactcgagttggatttcaattattgtgaagggacaacagtagtaataaccgaaaactgtggaacaagaggatcgtcactcagaaccacgacggtaagtggtaaactaatccacgaatggtgttgtaggagttgcaccttgcccccattaagatacatgggagaagacggatgttggtacggtatggagataagacccatatcggaaaaagaagaaaacatggtaaaatccttagtttcagcgggctctggtaaagtagacaactttacaatgggagtactttgtttagcaattctatttgaagaagttatgagaggtaaatttgggaagaaacacatgattgcaggagtactttttactttcgtacttctactaagtgggcaaattacttggcgtgatatggctcataccctgatcatgataggcagtaacgctagcgatagaatgggaatgggtgttacctacctagcactgattgcaacctttaaaattcaaccatttttagcattaggattctttctgcgaaaactaactagcagagaaaacttattactaggagtgggtctagctatggcaacaactttacagttgccagaagatatagaacaaatggcgaatggaattgcattagggctaatggcattaaaacttaccacacaatttgagacatatcaactgtggactgcactaatttcattaacgtgtagtaatactatattcacacttactgtagcatggcggaccgccacccttatattagctggtgtttctttactgccagtatgtcaaagtagctctatgagaaaaactgactggttaccgatgactgtagcagcgatgggagtacccccgctccctctatttatattttcacttaaagacacattaaaacgcagatcctggcctttaaatgaaggcgtcatggctgtaggactggtgtctatattagccagctctttactaaggaatgacgtaccaatggctggaccactcgtagctggtggcttactaattgcatgctatgtaataacaggtaccagtgccgacttaaccgtagaaaaggcggcagacgttacatgggaagaagaagcagaacaaaccggtgtaagccataacttgatgatcacagtagacgatgacggaaccatgcgaataaaagatgatgaaacagagaacatcttaacagtattgttaaagactgcattacttattgtaagcggcattttcccatattccattcccgcgactctactggtttggcacacatggcaaaaacagacgcagagaagcggagtactgtgggacgtaccttcacctcccgaaacgcaaaaagccgaactggaagaaggagtttatagaattaaacagcagggaatatttggtaaaacgcaagtaggagtaggggtacaaaaagagggtgtatttcatacaatgtggcatgtaacacgtggtgcagtattaacatataatggaaaaagactggagcccaattgggcaagcgttaagaaagatctgataagttacggagggggctggagactatcagcgcagtggcaaaaaggcgaagaagtacaagtgatagcggtggaacctggcaagaatcccaaaaattttcaaacaatgccgggcacattccaaacaaccacaggagaaataggtgctatagcgctagactttaagcctggaacaagtggaagcccaattatcaatagggaaggtaaagtggttgggttatacggaaatggtgtggtaactaaaaatggaggctacgtgtcaggaatagcgcagacaaatgctgagcctgacggaccgacaccagaacttgaagaagaaatgttcaaaaagcgaaatctcactattatggatctacatccgggatctggtaaaacaagaaagtatttgcccgcgatcgtgagagaagctatcaaacgccgattaagaaccctcatattggccccgacccgcgtcgtggctgcagaaatggaagaggcactaaaagggttacctattagatatcaaacaacagctacgaaatcggaacatactggtagagaaattgtcgatttgatgtgtcatgcaacattcactatgcgtttattatcaccagtgcgtgtgccaaattataacttaataattatggatgaggcacatttcactgaccccgcatcaatcgcggcccgggggtatatttcaacacgagtaggaatgggagaggccgctgcgattttcatgacggcaacacccccaggtactgcagacgcatttccccaatcgaatgccccaattcaagatgaagagagagatataccggaaaggagttggaatagcggaaacgaatggatcactgacttcgccggtaaaacagtatggtttgtccctagtatcaaggcaggaaacgatattgctaactgcctacgaaagaatggcaaaaaggtgatacaattaagtagaaaaacatttgatactgaatatcagaaaacaaaactgaatgactgggattttgtcgtaacaactgatatatcagaaatgggtgcaaatttcaaggcagacagagtgattgaccctagacgttgtttaaagcccgtaatactgacagatggtcctgagcgagtaatactagcaggtccgatgccggtaacagctgcaagtgctgcacaaagaagaggaagagtgggcagaaacccacaaaaggaaaatgaccaatatatatttaccggtcaaccactaaacaacgatgaagaccacgcccattggacggaagccaaaatgctattggataacataaacacacctgaaggcattattccagccctgtttgagccagaaagggagaaaagcgcggccatcgatggagagtatagactgaagggagaaagtagaaaaactttcgtggaattaatgagacgtggagatttaccggtctggttagcacataaggttgcttctgaaggcataaaatacacagatcggaaatggtgcttcgatggacaacgaaacaaccaaatactggaagaaaacatggacgtggaaatttggacaaaagaaggcgagaagaagaaactacgccctcgatggcttgatgcccgcacatattctgaccctcttgctttaaaagaatttaaagattttgcagcaggaagaaagtccatagctttagatctagtaacagaaattggaagagttccaagtcacctagcccataggacaaggaacgctttggacaatttggtcatgttacacacgagcgaacacggaggcaaagcctaccgtcatgcagtagaagagttgccagaaacgatggaaacgctgttgttattaggactaatgatattactaacaggaggtgcaatgctttttctaataagtgggaagggaattgggaagacaagtataggattaatctgcgttattgcatcgtctggtatgttatggatggcggaaattcctcttcaatggatagcaagtgcaatagtcttggaatttttcatgatggtccttctgataccagagcccgaaaaacagagaacaccgcaagacaatcagttagcatacgtagtaattggaatacttacactagcagctatcatagcagcaaatgagatgggcctattggagaccactaagcgggacctaggtatgtctaaggaacccggggttgtgagcccaacctcttacctcgatgtggatttacatccagcatcggcatggaccctttacgctgtagcgactactgttatcaccccaatgttgcgacatactatcgagaatagcactgcgaacgtgtctctagctgccatagctaatcaagcagttgtactaatgggactagacaaaggatggccaatatctaaaatggacctcggagtacccctcttagcactaggttgttactcacaagtaaatccactaaccctaacagcggctgtattattgttaatcactcactatgctataatcggtccaggtttacaagcaaaggcaacgcgcgaagcccaaaaacgcacagccgcaggtattatgaaaaatccaactgtggatgggatcatgacgatagatttagaccctgttatttatgactcaaaatttgagaaacaactaggccaagtcatgttactcgtattgtgtgcagtccaattactcctaatgaggacttcatgggctctttgcgaagcgttgacattagcgacgggaccaattacaacactttgggaaggttctccgggaaaattctggaacactacgattgctgtatcgatggcgaacatattccgcgggagttatcttgccggcgctggactagccttttctatcatgaagtcagtcggtacgggcaaaagagggaccgggagtcaaggagaaaccctaggcgagaaatggaaaaagaaactcaatcaactatcacgaaaagagtttgatttatataaaaagagtggtatcactgaagtagatagaaccgaagcaaaagaaggtctaaagcgaggtgaaataacacaccacgcagttagcagaggctcggccaaacttcagtggttcgttgaaagaaacatggtgatacctgaaggtagggtcattgacctcggatgtggtagaggaggttggagctattactgcgcaggactaaagaaagtaaccgaagtaagaggttacacaaaaggtggaccggggcatgaagaacccgttcctatgtctacttatggatggaacattgttaaattaatgtcaggaaaagacgtattttatcttcccccagagaaatgtgataccttattgtgcgatataggtgaatcttcaccttcaccaacagttgaagaaagtcgtacaattcgagttttaaaaatggttgaaccttggctcaaaaataatcaattttgtatcaaggtattaaatccctacatgcccactgtaatagaacatctagaacgattgcaacgaaagcatggtggaatgttagtaagaaacccactgagccgcaactcaactcatgagatgtactggataagcaatggtaccggaaatatagtagcatctgttaatatggtgagtagactacttctcaataggttcacaatgactcatcgacgaccgacaatcgaaaaagatgtagatctaggtgctggcacacgacatgtcaacgcagagcccgagactccaaacatggacgtgatcggtgaaagaatcaaaagaataaaggaagaacataattctacttggcactatgatgatgagaacccttacaaaacgtgggcatatcacggttcatacgaagttaaagcaactggatcagcgagttcaatgataaatggagtggtaaaacttttaacaaaaccgtgggacgtagtgccgatggtcacacaaatggccatgacagatactactccattcgggcaacagcgggtattcaaagagaaagtagacacaagaacaccaaggtcaatgccggggacgagacgagttatgggaataaccgcggaatggttatggcgtactttgggaagaaacaaaaagcctagattgtgtacccgtgaggagttcaccaagaaagtacgtactaatgctgcaatgggagcagtctttacagaagaaaaccagtgggattcagcaaaagcagccgtcgaggatgaagacttttggaaattggtagatcgagaacgcgaattacataaactaggcaagtgcggctcatgcgtatacaatatgatgggaaaaagagaaaagaaattaggtgaatttggaaaggctaaaggatctagagctatatggtatatgtggcttggtgcgagatacctagaatttgaagcactcggtttcttaaacgaagaccactggttttcaagagagaatagttattccggcgtcgagggcgaagggttacacaaacttggctatattctaagggatataagcaaaattccaggaggtgcaatgtatgccgatgatactgcaggatgggatacaagaataacagaggatgatctgcacaatgaggaaaagataacacaacaaatggatccagaacatagacaattagcgaatgctatatttaaattaacataccaaaacaaagtggtcaaagtccagagaccaaccccaacgggcacagtcatggatataatcagtagaaaggatcagcgcggatctggacaagttggtacgtacgggcttaacacgtttactaacatggaagcgcaacttatcagacagatggagggggaaggagtactgtctaaggcagatttagaaaatcctcatcttcccgagaagaaaattacgcaatggcttgaaactaaaggagtagaacgattaaagcgtatggcaatatcgggcgacgactgtgtagtcaaaccaatagatgatcgatttgctaacgcattattagccttgaatgatatgggaaaagttaggaaggatatcccgcagtggcagcccagtaaaggatggcatgactggcaacaagtaccattttgtagtcaccattttcatgaattgataatgaaagatggtcgtaaattagttgttccatgtagaccccaagatgaactaatagggcgagctcgcatatcgcaaggggcgggctggtcgctgagagaaacagcatgtttaggaaaagcatacgctcaaatgtggagcttgatgtactttcatagacgagatttacgactggctagcaatgcgatatgtagtgcggtacctgtacattgggtccctacctcaagaacaacatggagcattcatgcgcaccatcaatggatgactactgaagacatgctgactgtctggaatagagtctggatagaagacaacccatggatggaagataaaaccccagttacaacatgggagaatgtaccgtacctcggtaaacgagaggatcagtggtgtggtagcttaattggcctcacaagtcgggcaacttgggcacagaatataccaacagcaatacaacaagttcggtcactgatagggaatgaagagttcctagactacatgccctctatgaaaaggtttcgcaaagaggaggagtcggagggagcgatatggtag

SEQ ID NO: 23357 - RNA, 9873 nt, synthetic construct
  misc_feature 1..9873: note = derived and/or modified CDS sequence (opt6) from DENV-3__FJ410177__SS-prME
  source 1..9873: mol_type = other RNA
acatctttatgtttgatgatgattcttccagctgccttggcatttcatctgacatcaagggacggagaaccaagaatgatcgtaggtaaaaacgaaagaggaaaaagcctattattcaaaacagcaagcggaataaatatgtgtaccctaatagcgatggatttgggagaaatgtgtgatgataccgttacttataaatgcccgcacataaccgaagttgaacctgaagacatcgattgttggtgcaacctaacgagtacctgggtaacttatggaacatgcaaccaagccggagaacataggcgtgataaaaggtctgttgcactcgcccctcatgtgggaatgggattagatacacgaacacaaacttggatgagtgctgaaggtgcatggcggcaagtagaaaaagttgaaacgtgggcacttcgccatccaggattcaccatattagccctatttctcgcacattatatcggtacaagtttaacccagaaagtagtaatctttatacttttgatgctggtaacaccaagcatgacaatgcgatgtgtaggagtcggaaaccgggattttgtagagggactaagcggggcaacatgggtcgacgttgtactggaacatggaggatgtgtgactacaatggctaaaaataaaccaacattggacattgaacttcagaaaaccgaagcgacgcaactggcaacattgagaaaactatgtatagaaggaaaaataactaacataaccacagacagtcgttgcccgacacagggtgaggctgtattaccagaggaacaagatcaaaattatgtatgtaaacatacatatgttgacaggggttgggggaacggttgcggactcttcggaaaaggaagtttagtgacgtgtgcaaaatttcaatgtctcgaaccgatagaagggaaagtagtccaatatgagaaccttaaatatacagttatcataaccgtacacacaggtgaccaacatcaggtcggcaatgaaacacagggtgtcactgcagagataacaccacaagcatcaacaaccgaagcaatattaccagagtacggcacgcttggtctagaatgttcaccccgaacgggccttgatttcaacgaaatgatcttgttaaccatgaaaaataaagcatggatggttcatcgtcaatggttctttgacctccctttaccatggacaagtggcgccacgacggaaactccgacgtggaatagaaaagaattgctagtaacctttaagaatgctcatgccaagaaacaggaagtagttgtcttgggatctcaggagggagcaatgcacactgctttgacaggcgcaacagagatccagaacagtggaggaacctcaatatttgccggtcatttaaaatgccgcttgaaaatggataaattggaacttaaagggatgtcatacgctatgtgtacaaacactttcgttctaaagaaagaagtatcggaaacacaacatggtacaattctaatcaaagtagagtacaaaggggaggacgttccttgtaaaataccgtttagcacagaggatggtcagggaaaagctcataacgggagacttataacagccaatccagtagtaacgaagaaagaagaaccggttaacatagaggcggaacctccttttggtgagagtaatatcgttatcggaattggagacaatgcgctgaaaataaattggtataaaaagggatcctcaataggaaagatgtttgaagcaacagctaggggagcgagaaggatggcaatcttgggagataccgcatgggattttggtagcgtaggaggtgtcttaaatagccttggtaagatggttcaccaaatttttggatcagcatatacagctctcttttccggggtcagttgggtcatgaaaataggcataggtgtattattaacttggattggtcttaatagcaaaaatacgtcgatgagttttagttgtattgctataggaattataacattatatttgggtgcggtggtgcaagcggatatgggttgtgtcatcaattggaaggggaaagaattaaaatgtggatccggcatttttgtcacgaatgaagtacacacttggaccgaacaatataagttccaagcggacagccctaaaagacttgctacagctatagcgggtgcttgggaaaatggtgtatgtggtattcgaagtacaacaaggatggaaaacttattatggaaacaaatagcgaacgaactgaactacatcctatgggaaaacaatattaaacttactgtcgtcgtcggcgatacgataggtgttttggaacaaggaaagcgaacgttaacacctcaacctatggagttaaagtattcttggaaaacatggggaaaagcaaaaatagtgacagcagaaacccaaaactcttcttttataatcgatgggccaaacactcccgagtgtccatctgcatcaagagcatggaacgtatgggaagtggaggactatggattcggagtatttaccaccaatatatggctaaaacttcgtgaggtatatactcagctctgtgaccatagacttatgtcagcggcagttaaagatgaacgagcagtacacgcagatatgggttactggatcgaatcgcagaaaaatggtagctggaagttagaaaaagcctccctaattgaagtaaaaacatgcacttggccaaaaagccacactctctggtcaaatggcgtgttagaaagcgatatgattattccaaaatcgctcgccggtccgatctcacaacataattatagacccggttaccatactcaaaccgcgggaccctggcacttaggcaaactggaattagattttaactactgcgaaggaacaactgtagtgataacagaaaattgcggcactgggggccctagtctaagaaccaccactgtctcaggaaaacttatccacgaatggtgctgtcgatcttgtaccttaccgccattacgatatatgggagaagatggctgttggtatggaatggagataagaccaatttcagagaaggaggaaaatatggtgaaaagcctggtatcagctggttcaggaaaagttgataatttcacaatgggtgtgctatgtctggctatactatttgaggaagtaatgaggggcaagttcggcaagaaacatatgatcgcgggtgtattctttacatttgtattattacttagtggacagataacatggagggatatggcacatacgcttataatgataggtagcaatgcttcggatcgcatgggaatgggtgtgacatacctagccttaatagcaactttcaagatacaaccctttctagcactcggcttctttttaagaaaactaacaagccgggaaaacttactactaggtgttggtttggcgatggccaccacgctgcaattacctgaagatatcgaacaaatggcaaacggtatcgccttgggactcatggcgcttaagctgaccactcaatttgaaacgtatcaactatggacagccttaatttcattaacttgttcaaacacaattttcaccctaaccgtggcatggcgaactgccactctaattttagctggagtaagtttgctacctgtatgtcaatcgagcagtatgagaaaaactgattggctaccaatgacagttgccgcaatgggagtcccaccccttcctctctttatattttcactgaaagatactttaaaacgtaggtcatggccattgaatgaaggagtaatggcagtaggattagtttccattctggcgagttccctactgcgaaacgacgttcccatggcaggaccattagtcgcagggggtttactgatagcatgttacgtcataacagggaccagcgcggaccttacagtcgaaaaggcagctgatgtaacttgggaggaagaagcagaacaaactggggttagccataacttaatgattacggtggacgacgatggaacgatgagaatcaaagatgatgaaacagaaaacattctaaccgtactcctgaaaacagcacttttgatagtatcgggaatcttcccttactcaatccccgctacattattagtatggcatacatggcagaaacaaacgcaacgtagtggagttctttgggacgtaccttccccacctgaaacacagaaagccgagctagaagagggggtatatcgtattaagcaacagggaattttcggtaaaacacaagttggcgtgggcgtacaaaaggagggggtgttccatacaatgtggcacgtaaccaggggcgcagtgctgacatacaatgggaagagattggaacccaattgggcctcagtaaagaaagaccttatatcatatggcggaggttggagactaagcgcccagtggcaaaagggtgaagaagtacaagtcatcgcagttgaaccaggaaagaacccgaaaaactttcaaacaatgccagggacatttcaaacgacaaccggagaaattggtgctatagcactagacttcaaacctggaacttccggttctccaattataaacagagaaggaaaggtggtaggcttatacggtaacggcgtcgtaacgaagaatggtgggtatgtttcgggtattgctcaaacaaatgctgaaccagatggccccactcccgaactagaagaagaaatgttcaagaaaagaaatttgaccataatggatttacatcccggtagtgggaaaacgcgcaaatacctccctgctatagtaagggaagcgataaaacggcggcttcgcactctgatattggcgccaacacgagtagtagcagcagaaatggaagaggcacttaagggtttaccaataagatatcaaactactgcaacaaaatccgaacacactggacgagaaattgtagacctaatgtgtcatgccacatttactatgaggttattgtctcctgtacgagtacctaactacaacctgatcatcatggacgaagctcattttaccgaccctgcctcgatagccgcacgcggatacatatcaacaagagtaggcatgggtgaagcagcagcgatcttcatgactgcaactccacctggtacagcagatgcttttccacagagcaatgcacctatacaggacgaggagagagatatacctgagcgctcctggaactctgggaacgaatggattaccgattttgctggaaaaactgtatggttcgtcccgtcaatcaaggccggaaacgacatcgcaaattgccttcgtaaaaatggcaagaaagtaatacaattgagtaggaaaacttttgatacagaatatcagaaaacaaaattgaatgactgggattttgttgttaccacagatatctcggaaatgggggctaatttcaaggctgatagagtgattgatccacgaagatgtcttaagccagttatcttgaccgatggacctgaacgcgtcatattggcaggccccatgcccgtgacagcggcttcggcagcgcaaagacgtggacgcgtcggcagaaatccacaaaaagagaatgaccaatatatatttaccggacaaccactaaataatgacgaggaccatgcacattggaccgaagcaaaaatgttactagataatatcaatactccagaaggtataattccagcattattcgaacctgaaagggaaaagtccgctgcaattgacggggaatacaggttaaaaggagaaagtcgaaaaacattcgtcgaattaatgaggagaggtgatctcccagtgtggctggcgcataaagtggcctccgaaggtataaagtatactgatcgaaaatggtgtttcgatggtcagagaaataatcaaatattagaggaaaatatggatgtagaaatttggacaaaggagggagagaagaagaaacttagaccaaggtggttggatgctagaacttattcagatcccttagctcttaaagaatttaaagactttgcagcaggaagaaaatcaattgcgcttgatcttgtaacggaaattggacgcgtaccctcacatctggcacatagaacacgtaacgcgctagacaatctcgtaatgttgcacacatcagaacatgggggtaaagcgtacagacacgcggtcgaagaattacctgaaaccatggaaacacttttattactgggtttgatgatactcttaacaggaggtgcaatgctatttcttatatctggtaaaggaatcggcaaaacttcgattgggttaatatgcgtaatcgcctccagtggaatgttatggatggcagaaattcctcttcaatggatagcttcagcaattgtactagagtttttcatgatggtactcttaatcccggagccggaaaaacagagaacgcctcaggacaatcagctagcatacgttgttatagggattctcaccttagcagcgataatagcagcaaacgaaatgggtctgctagaaactacaaaacgagatttaggcatgagcaaagagcccggagtagtatctccaactagctacctcgatgttgatttacatcctgcctcagcttggacattatatgctgtcgcgacaacagtaatcacacctatgcttagacatactatcgagaacagtactgccaatgtttcgctagccgccatagctaatcaggcagtagtacttatgggcttggataagggatggccaataagcaaaatggacctaggtgtaccacttcttgcactagggtgttactcacaagtgaaccccttgactctgactgctgcggtgttattgttgataacacattatgcgattataggacctggactgcaagcaaaagcgacaagagaagcccaaaagcgaacggcagcaggaatcatgaagaatccgaccgtcgatggcatcatgaccatagatctagaccccgtcatatacgattcaaaatttgagaaacaacttgggcaggtcatgctactggtactatgcgccgttcaattacttctaatgcgcacctcatgggccttatgcgaagccttaaccctggcaactggcccaataactactttatgggaagggagcccgggaaaattttggaacacaactattgctgtaagcatggctaatatcttccgaggatcgtatttagccggtgctggactcgcattctccataatgaaatcagtaggtactggaaagcgggggaccgggagccaaggagaaacgctcggagaaaaatggaaaaagaaattaaaccaattgtccagaaaggaatttgatctatataagaaatccggaataactgaagtagaccgaactgaggcgaaagaaggactcaaacgtggagaaataacgcaccatgcagtgagtagagggtctgcgaaactacagtggttcgtagaacggaacatggttattccagaagggagagtaatagatctaggatgcggtaggggaggatggtcctactattgtgcaggattaaagaaagtcactgaagtacgtggttacacaaaaggaggtccgggtcacgaagaacctgttccgatgtcaacttatggctggaacattgtaaaattaatgtctggtaaggatgtattttatttaccgcctgaaaaatgtgatactcttctatgtgacataggagaatcatccccatcgcctacagtcgaagaaagtagaactatacgcgtactgaagatggtagaaccatggctcaaaaataaccagttctgtattaaagtactaaacccttacatgccaactgtaatagaacacctagaacggttacagagaaaacacggagggatgctagttcggaatcccctttctcgaaactctactcatgaaatgtactggatatccaacggaactggaaacatcgtggcaagtgttaacatggtgtcgcggcttctgttaaataggtttacgatgacgcatcgaaggcccaccatcgagaaagatgttgatctgggggcaggaacacggcatgtaaacgctgagccggagacccccaacatggatgtcataggggagagaatcaaaaggataaaagaagaacataactccacatggcactatgacgatgaaaatccatataaaacctgggcataccacgggagttacgaagttaaagcaacagggtcggcaagcagtatgataaatggggtagtaaaattgcttacaaaaccgtgggacgttgttccgatggtaacacaaatggcaatgaccgatacgacaccctttgggcaacaacgagtattcaaagaaaaggtagacactcgaacgccacgatcaatgccggggacgcgcagagtgatgggtataactgcagaatggctatggcggacactaggtagaaataagaaacccagactgtgcacaagagaggaatttactaagaaagtaagaaccaatgcggccatgggtgccgtattcacggaagaaaaccagtgggacagcgctaaagcagcagtcgaagacgaagatttttggaagttagtagatcgcgaaagagaacttcacaaactaggaaaatgcgggagttgtgtatacaacatgatgggcaaacgtgaaaagaaactcggagagttcggaaaagcaaagggatcaagagcgatctggtatatgtggctaggtgctaggtacctagagttcgaagcgttagggtttctcaatgaagatcattggttttctcgggaaaactcctatagcggcgtcgaaggtgaaggtctgcacaaactaggatacatattgcgagacatttccaaaatcccaggtggagcaatgtatgctgatgacaccgcgggatgggacactaggattacagaagatgacttgcataacgaagagaaaatcacgcaacaaatggaccccgaacaccgtcaactagcaaacgcaatttttaaacttacataccaaaataaagtagtgaaagtacaaagaccaacaccaaccggaacagtaatggacataatttcacgaaaagatcaaagagggagcgggcaggttggcacatatggtttgaacacttttaccaatatggaagcacaattgatcaggcaaatggaaggcgaaggcgtcttaagtaaagcagatcttgagaatccacatttaccagagaagaaaattacccaatggttagagacaaagggcgttgaaagattaaaaagaatggccataagcggagacgactgtgtagtaaaaccaatagacgaccgatttgctaacgctttattagcccttaatgatatgggcaaagtacggaaagatataccacaatggcaaccgtcaaaagggtggcatgactggcaacaagtaccattctgctcacatcactttcatgaattgattatgaaggatggcagaaaattagtagtgccttgtaggccacaggatgaactaatagggagagcacgcataagtcaaggagcagggtggtcccttcgagaaacggcatgtctaggtaaggcttatgcccaaatgtggagtctgatgtactttcaccgaagagacctaagattagcttcaaatgcaatctgcagtgcagtacccgtgcattgggtcccaacatcgcggaccacatggagtatccacgcacaccatcagtggatgacaacagaagacatgctaacggtgtggaatcgagtatggatagaagacaatccttggatggaagacaagacccctgttacaacatgggaaaatgtcccctatttaggaaaaagagaggaccaatggtgtggatccttaatcgggctcacaagtagagccacctgggcccaaaatattcccacagccattcaacaagtgcgttcattaatagggaatgaggagtttctggattatatgcccagcatgaaacgctttagaaaagaagaagaatcagaaggtgcgatatggtga

SEQ ID NO: 23358 - RNA, 9873 nt, synthetic construct
  misc_feature 1..9873: note = derived and/or modified CDS sequence (opt6) from DENV-3__FJ547072__SS-prME
  source 1..9873: mol_type = other RNA
acaagtctttgcctaatgatgattctacccgctgctctagctttccatctaacttcccgtgacggagagcccagaatgattgtcgggaaaaacgaaagaggacggtctctgctgtttaagaccgcatcagggatcaacatgtgcacattaatcgcaatggacttgggagaaatgtgtgacgacacagtcacatataaatgcccccatataacggaagtagaacccgaagacattgactgctggtgtaatttaacaagtacatgggtcacatatggcacgtgcaaccaagccggagaacatagacgagataaaagatccgtggcgttagcaccacacgtaggaatggggctagatacacgaactcagacatggatgagtgctgaaggggcttggagacaggtagaaaaggtagaaacatgggcactacgacacccgggattcaccatacttgctctctttctagcacactatattggtacctcactaacgcaaaaagttgtaatctttatactcctgatgctagttactccatctatgacaatgaggtgcgtaggagttggaaacagagatttcgtggaaggcctaagtggggctacatgggtggatgtagtattagaacatggcgggtgtgtcactacaatggcaaaaaacaagcccactttagatattgagctacaaaagacggaagctactcagttggcaacgctccgaaaactatgcattgagggaaaaatcacaaacattactactgactctcgatgtcctacccaaggtgaagcagtcctcccagaggagcaagatcaaaattatgtatgcaaacatacatatgtagaccgcggctggggcaatggatgtggcttatttggcaagggatctttggttacatgtgccaagtttcagtgtctagaacccatagaaggcaaagtagtacagtatgagaacctgaagtacacggtcataatcacagtacacacaggcgatcaacaccaagttggtaatgaaacacaaggtgtgacagctgaaattacgccacaggcttcaacaacggaagccattttaccagaatatgggactcttgggttggaatgcagcccgcggacgggtcttgatttcaacgaaatgattctcttaacaatgaaaaacaaggcttggatggtccatcgacaatggttctttgatcttcctttaccgtggacctcaggagctacaaccgaaactccgacatggaacagaaaagagttactagttactttcaaaaacgcgcatgcgaaaaaacaggaggtcgtagtattaggatcacaagaaggagctatgcatacggccctaactggggcaaccgaaatacagaacagcggtgggacctctatttttgcagggcacttgaaatgtcgactaaagatggacaaattagaactaaaaggaatgtcgtatgctatgtgtacaaacacgtttgtattaaagaaagaagtaagtgaaacacaacatggaacaatccttattaaagtagaatataagggagaggacgtgccatgcaaaatcccattttcaacagaagacggccagggtaaagcccacaatggcagattaatcacggcgaatccagttgtgacaaaaaaggaggaacccgtaaatattgaggcagaaccgcccttcggagaaagcaacattgtaatagggatcggagataacgcgctaaaaataaattggtacaaaaaggggagctccataggaaagatgtttgaggccactgcacgtggtgctcgcagaatggctatactcggagatacagcatgggacttcgggagtgtgggcggcgtattaaattcactcggtaaaatggtgcatcagatttttgggtctgcatacactgcactatttagtggagttagttgggtaatgaaaataggaattggcgtcctgttaacatggatcggattgaattcaaaaaatacatctatgtcgttttcatgcatagtgataggtattatcaccttgtatctaggtgccgtggtgcaagccgatatgggttgcgtcataaattggaaaggaaaagagttgaaatgtggatcaggcatattcgttactaatgaagtccatacttggacagaacaatataaatttcaagcagatagtccaaaaagattagctaccgccattgctggagcgtgggaaaatggagtatgtgggatcagatcgaccaccagaatggaaaatcttctatggaaacagatagcaaatgagttaaattatatactatgggaaaataacataaaactgaccgtcgtggtaggtgatataataggagtactagaacaaggaaaacgaacgctaaccccacaaccgatggagctaaaatattcatggaaaacatgggggaaggctaaaattgtaacggccgagacgcagaacagtagctttattattgacggcccaaacacaccagagtgcccatctgcgtctcgagcttggaatgtatgggaggttgaagattacggttttggtgtatttacaacaaatatttggctaaaactgagggaggtatacacccaactttgtgatcacaggctaatgagtgctgctgtgaaagatgagcgtgcggtacatgctgacatgggctactggatagaatcacaaaaaaatggtagctggaaattagaaaaagccagtctaattgaagttaaaacgtgcacttggccaaagagtcacacactttggagtaatggcgtcttagagagcgacatgataatcccaaaatctttagcaggtccaatctcacagcacaactacagaccaggataccatacacaaacggccggaccctggcatctaggaaaattagagttggacttcaactattgtgaaggaactactgttgttataacagagaattgcggaacaagaggccctagtttacgaacaacaacagtatccggaaaattgatacacgaatggtgttgtaggagttgcacactgccgcctttaaggtatatgggagaagacggatgctggtatggaatggagatcaggccaataagcgagaaagaggaaaatatggtgaaatctttagtctcagccggaagtgggaaggtagacaattttactatgggagttttatgcctagccatactttttgaagaggtaatgcgaggtaagtttgggaaaaaacatatgatagctggtgtattttttactttcgtcctccttttgtccgggcaaataacttggagagacatggcacatactctaataatgatcggatcaaacgcttctgaccgaatgggtatgggtgtaacatatttagctctaattgccaccttcaaaattcaaccatttctagctttaggttttttcctacgaaaactaacttcaagagaaaatctattgctgggagttggactcgctatggctacaacgctacagttaccagaggatatagaacaaatggcaaacggcatcgccttaggattaatggcgctaaaattaataactcaattcgaaacttatcaattgtggacagctttaatctcactaacgtgctcgaacactatttttacattaacggtagcttggcgaacggccacattaattctagctggagtctcactactacccgtgtgccaaagtagctcaatgcgcaaaaccgactggctgccaatgacagtagcagctatgggtgtacctcctctgccgctcttcatatttagtttaaaagatactttaaagcgccgtagctggccacttaatgagggggtaatggctgtgggcctagtctctatactagcaagctcattactaagaaatgacgtacccatggcagggccactagttgccggaggcctcttaatagcttgttatgtcatcactggaacatctgccgaccttacggtggaaaaggcagctgatgtcacgtgggaagaggaagcagaacaaacaggggtaagccacaacttgatgattacagtcgatgatgatgggactatgcgaatcaaagacgatgaaacagagaatattctgacggtgctactaaaaactgcattgcttatagtgtccgggatattcccttattcaattccagcaactttattagtttggcatacctggcaaaaacaaacacaacgatcaggagtattgtgggatgtcccatccccgccagaaacacaaaaagccgagttggaagaaggtgtgtatcgcattaaacaacagggtatatttgggaaaactcaggtgggcgtaggagtacaaaaggagggagtattccacactatgtggcatgttacgagaggagctgtattaacctacaatgggaaaagacttgaacctaattgggcttcggtgaaaaaagatttaatatcctatggcggcggatggcgactatcagcacaatggcaaaaaggcgaggaggtacaagtaatcgcggtagaacctggaaaaaatcctaaaaatttccagacgatgccagggacatttcaaactacaactggtgaaatcggggctattgcattagattttaagccaggaacctcaggaagtccaatcataaatagagaaggaaaagtagtagggctttacggaaatggagtggtaactaagaacggtggttacgtttctggaatcgctcaaaccaacgccgagcccgacggtcccaccccagaattagaggaagaaatgtttaaaaaaagaaaccttacaataatggacctacacccaggatccggtaaaaccagaaagtacctgccagcaatagtgagggaggcaattaagagaagacttcgcactctaatattagcgcctacgagagttgttgccgcggaaatggaagaagcacttaaagggttacctatacggtatcaaactactgctacaaagtctgaacatacaggtcgggaaatcgttgacctaatgtgtcacgctacatttacaatgagactattaagtccggtgagagttccaaactataacttgataattatggatgaagcacacttcacagacccagcatccatcgcagcacgaggatatataagtacaagagtaggcatgggggaagccgccgccatattcatgacagcaacaccacctggaacggccgacgcatttccacaaagcaacgcgcctatccaagacgaagaacgagatatcccagaaaggtcatggaattcaggcaatgagtggataacagattttgcaggtaagacggtatggtttgtaccttctattaaagcaggaaacgatatcgccaactgcctccgaaaaaatggtaaaaaggtaatacaattatctcgaaaaacatttgataccgaatatcaaaagacaaagttgaatgactgggatttcgtcgttacaacagacatttccgaaatgggagctaattttaaagctgaccgagttatagacccccgacgttgtttaaagccagtcattttaacagacggtccagagagggtcatactggcagggccaatgccagtaaccgcagcatcagctgctcagcgcagagggagagtaggcagaaatccacagaaagaaaacgatcaatatatattcactggacaaccattaaataatgacgaagatcatgctcactggacagaagctaaaatgttattagataatataaacacaccagaaggtattattccggcgttgttcgaacccgaacgcgagaaatcagctgcaatagacggggagtatcggttaaaaggagaatctagaaaaacgtttgtagaattgatgagacgaggtgatctccctgtgtggttagctcataaagtggcttcagagggcataaaatacacagatcgtaagtggtgctttgacggacaaagaaataaccaaatacttgaggagaacatggatgtagaaatatggacaaaggaaggagaaaaaaaaaagttaagacctagatggctagacgctagaacttactcagatcctctagcattgaaagaatttaaggatttcgcagcggggagaaaaagtatagcattagatttggtaacggaaattggtagggttcctagtcatctggcgcatagaactcgaaacgcgttggataacttggtaatgcttcacacctcagaacatgggggaaaggcgtaccgacacgcggtggaggaactgccagaaaccatggagaccctgctcttattaggactgatgatactactaacaggaggagctatgcttttcttaattagcggaaagggaattggaaagacaagcatcggtcttatctgtgtcattgcatcaagtggaatgttatggatggcagaaataccgctacaatggattgctagcgcaatagtattagaattctttatgatggtactcttaatacctgaacccgaaaaacaaagaacgccacaagataaccaacttgcctatgtggtcataggtatcctgactttagcagcaataatagcagcaaacgagatgggactattagaaacaacgaaaagggatttaggcatgtcgaaagaaccgggagtggtttcaccaacatcctaccttgacgtagatcttcaccccgcgtctgcatggacactttatgcagtcgctactacggtcattactccaatgctacgacataccatagagaatagcacagcaaatgtatctttagccgccatagcaaatcaagcagtagtattaatgggtttagataaaggttggcctatatccaaaatggatctaggagttccattgttagcattaggttgttattcccaggtaaacccccttacattaacagcggcagtactacttctaataacccattacgctatcatagggcccgggcttcaagctaaggcgacacgcgaggcacaaaagcggactgccgcgggaatcatgaaaaacccgacagtagatggcataatgactatagatttggatccagtgatttacgactcaaagttcgagaaacaacttgggcaggtgatgcttttagttctttgcgccgtgcaactcttgttgatgcgtacttcatgggccctttgtgaagccctgacattagcaactggtccaataaccacgttatgggaagggtcgcctggaaaattctggaataccactatagccgtttcgatggccaatatatttcgaggctcttatttggcgggagcaggactcgcattctctattatgaaaagtgtgggtacagggaagcgaggaacagggagtcaaggtgaaacattgggagaaaagtggaagaaaaaattaaaccagctgagtaggaaagaatttgacctatacaaaaaatcaggaattactgaagtagaccgaactgaagcaaaagagggtttaaaacgtggggagattacccatcacgcggtttccagggggagcgcaaaattacagtggttcgtagaaaggaacatggttatcccagaaggtagagtcatcgatttaggttgtgggagaggcggttggtcatactattgcgctggattaaagaaagtaacggaagtaaggggttacaccaaaggtggccctgggcacgaagagccagtaccaatgtccacatacggatggaatatagtaaaattaatgtccggcaaggatgttttttacttgccaccagagaaatgtgacaccttattgtgtgacataggtgagtcgagtccatcaccaactgtagaagaatccagaactattagagttcttaagatggtagaaccatggcttaaaaacaatcaattctgcataaaagttctaaacccttatatgccaactgttatagaacacctagaaaggcttcaaaggaagcatgggggtatgctcgtgagaaacccattaagtaggaactcaacacatgaaatgtattggatttcaaatggaacaggaaatatagttgcatccgtaaatatggtatcccgtttactactaaatagattcactatgactcacagacggccaactatagagaaagatgtagacctaggcgctggaaccaggcatgtgaatgcagaaccggaaacaccaaacatggatgtcataggtgaaagaatcaaaaggattaaagaagaacacaactctacatggcactatgatgacgaaaatccttataagacatgggcatatcacggatcttacgaagtcaaagccacaggcagtgcatcaagtatgattaacggcgtggtgaaactactaacaaaaccatgggacgtggtaccaatggtaacacaaatggcaatgactgatactacaccgtttggacaacaaagagtttttaaagaaaaggttgacactcggactccgcgtagtatgccgggtaccagacgcgttatgggaattacagctgagtggctctggaggaccttaggtcgcaataaaaagccacgactttgcacaagagaagaattcactaaaaaagtcaggacaaatgcagcaatgggcgcagtattcacagaggagaatcaatgggattcagctaaagcagctgtggaggacgaggatttctggatattggtagacagggaacgtgaactccataaactgggaaagtgcggttcttgtgtttataacatgatgggaaagcgtgaaaagaaactcggagaatttggaaaggcgaaaggaagtcgtgcaatttggtatatgtggcttggagccagatatctagagtttgaagctttgggcttcctaaatgaggatcactggttctcaagagaaaacagctatagtggagtagaaggtgaaggccttcataaattgggatacattctaagagatataagtaaaattcctggcggagcgatgtatgctgatgatacagctggatgggatactcgaatcacagaagatgatcttcacaacgaagagaagattacccaacagatggatccagaacaccgtcagctcgcaaacgcaatatttaaactcacttatcaaaacaaggtagtgaaagtacagagaccaacccccactgggacggtgatggatattataagtcgaaaagatcaacgcgggtcaggtcaggtcggaacgtacgggttgaacactttcactaatatggaagctcaactaatacggcaaatggaaggagaaggtgttttaagcaaagcggatttggaaaacccccatcttccagaaaaaaagatcacgcaatggctagaaacaaaaggagtagaaagattaaaaagaatggctatatcaggcgatgactgcgtagtcaaacctatcgacgaccgctttgcaaacgcgcttttggctttgaatgatatgggtaaggttcgaaaagatataccgcaatggcagcccagtaaaggttggcacgactggcaacaggtaccgttttgcagtcaccatttccatgaactgataatgaaagacggtagaaaattggtcgtaccttgtagacctcaagatgaattaataggcagagcgagaatttcacagggtgctgggtggtccttacgagagacagcatgtctaggaaaggcttatgcacaaatgtggagccttatgtatttccatcgtcgtgacctgagactagctagtaatgctatatgcagtgcagtacctgtccattgggtcccaacatcaagaaccacgtggtcaatccacgcgcatcaccaatggatgacaaccgaagatatgttaacagtttggaacagagtatggatagaggacaacccatggatggaggataaaactcctgttactacatgggaaaacgttccgtatttgggaaaaagagaagatcagtggtgcggttcactaatcggcttgacaagccgtgcaacatgggcacagaacataccaaccgctatccaacaagtacgtagtttaataggcaacgaagaatttctagactatatgcccagtatgaagagatttcgaaaagaagaagaatctgagggagcgatctggtga

SEQ ID NO: 23359 - RNA, 9873 nt, synthetic construct
  misc_feature 1..9873: note = derived and/or modified CDS sequence (opt6) from DENV-3__FJ547073__SS-prME
  source 1..9873: mol_type = other RNA
acaagtctgtgcttaatgatgatcctaccagccgcactagccttccacctaacttcccgagatggtgaaccaagaatgatagtagggaaaaatgaaagaggaaaatccttactattcaaaacagcaagtggaatcaacatgtgcactttaatcgcgatggatctaggcgaaatgtgtgacgatactgtaacttacaaatgtccccatataactgaagttgaacctgaagatatagactgctggtgtaacttgacgtctacatgggttacttatgggacgtgtaatcaagctggggaacaccgaagagacaaaagatcagtcgcacttgcaccccatgtagggatgggactggatactcggactcaaacatggatgtctgctgaaggtgcatggcgacaagttgaaaaagttgaaacttgggccttacgccatccaggttttactatcctagctcttttcctagcacattacatcggaacgtctctaacgcaaaaagtcgttattttcatactactgatgcttgtaacaccatcgatgacgatgagatgtgtaggagttggtaatagggattttgtcgaagggcttagtggagcgacttgggtcgatgtagtattagaacacggcggatgtgtgaccacaatggccaaaaataaaccgactttggacattgaacttcaaaagactgaagccacgcaacttgcaacacttagaaaactgtgtatagaagggaaaattactaacataacaacagattctcggtgtcctacgcaaggagaagcagtgctcccagaggaacaagaccaaaactacgtttgcaaacatacttatgtcgacagaggatggggaaatggatgcggactttttggtaaaggatcattagttacttgcgcgaaattccaatgtctagaacctatagaaggcaaagtagtacaatatgaaaatctaaaatacacggttatcataacagtacacacaggagatcaacatcaagttggtaatgagacccaaggagtaactgctgagataacgccacaggcttcaacaactgaagctatactaccggaatatggaacattaggactagaatgcagtccacgaacaggcctagactttaacgagatgatattgttaactatgaaaaataaagcgtggatggtacaccgtcaatggttctttgatcttccgttgccatggacatcaggtgccacaactgaaaccccaacatggaatcggaaagagctacttgtaacgttcaaaaacgcacatgctaagaaacaagaagtcgtcgttcttggttcacaagaaggagctatgcatactgcattgacaggagctacagagatccaaaactcgggtggaacctcaatatttgccggccacctaaaatgtcgattaaaaatggacaaattagaattaaaaggaatgtcatatgcaatgtgtacaaatacatttgtcttgaagaaagaagtttcagagacacaacatggaactatcctcataaaagtcgagtacaaaggcgaggatgtaccatgcaaaataccattttcaactgaagatggacaaggaaaagcacataatggaagattaatcactgcgaatccagtagtgaccaagaaagaggagcctgtaaatatagaagccgaaccgccttttggagaaagcaatatcgtaataggtataggtgataacgcgctcaaaataaattggtataagaaaggcagttctattgggaaaatgtttgaagcgacggcccgaggagcacgcagaatggcaatactaggagataccgcctgggattttggctcggttggtggcgtactgaactcactcggtaaaatggttcaccaaatattcggaagcgcttacactgcgttgtttagtggggtaagctgggttatgaagataggaataggcgttcttctaacatggataggattaaattctaaaaacacatctatgagctttagttgtattgtcatcgggataatcaccctttatctgggagctgtggtccaggctgacatggggtgtgtaatcaactggaaaggtaaagaactgaaatgcggatctggtatttttgtaacgaatgaagttcatacatggactgagcaatacaaatttcaggcagacagtcccaaacgattggcaaccgcaatagctggcgcatgggagaacggagtatgtggaatacgctcaaccacaagaatggagaacctactatggaaacagatagctaacgaattgaactatattttgtgggaaaacaatataaagttaaccgtagtggtcggcgatataataggcgtattagaacaaggaaaaaggaccctcacaccgcaacctatggaactgaagtacagttggaaaacttgggggaaagcaaaaatcgtcacggccgaaacacaaaattcctcatttataattgatggacctaacactcccgaatgtccgtcagcatccagagcctggaatgtgtgggaagttgaagactatggctttggagtctttacaacaaacatttggttaaaattgagagaggtatatacacagctctgtgaccacaggcttatgtcagctgcagtaaaagacgaacgcgcagtacatgcagacatgggatactggatagaatctcagaaaaatggttcatggaaacttgaaaaggcttcattgatcgaggtgaaaacctgtacctggccgaaatctcatacgctctggagtaacggtgtattagagtcagatatgataataccgaaaagtcttgcaggacctatctcacaacataattatagacctggctatcatacccaaaccgccggcccttggcatctcggcaaattagaactggactttaattattgtgaaggtacaacagtcgtaatcactgaaaactgcggaacaagggggccttcattaagaacaacaacagtaagtgggaaacttattcatgaatggtgctgccgctcatgcacgttaccccctcttagatacatgggagaagatggatgctggtatggaatggaaataagaccaatatcggagaaagaagaaaatatggtgaaatcattagtaagtgcgggtagcggaaaggtagataatttcaccatgggagtactatgtctagctattctatttgaagaggtaatgagaggcaagtttggcaagaaacatatgatagctggcgtattcttcactttcgtactgcttttgtcaggacaaataacgtggagagacatggcccatacgttaatcatgattggtagcaacgcatccgataggatgggaatgggagtgacatatttagctctaattgcgacattcaaaatacaaccatttttagcccttggctttttcctacgtaagttaacatcaagggaaaacctacttttaggagtcggactcgcaatggcaaccacattacaattgcccgaagatatcgaacagatggcgaatgggattgctcttggattaatggccttaaaattaataactcaatttgaaacttatcaattgtggaccgcattaatctcgctaacatgctcaaatactatatttacattgactgtagcatggcgtacagctactcttatcttggctggtgtaagtttactaccggtatgccaatcgtcatcaatgaggaaaaccgattggttgccaatgacagttgcggcgatgggagttccacccctgcctctgtttattttctcactaaaggacactctaaagcgacggagctggccgttaaacgaaggtgtaatggctgtaggcttagtcagtatacttgcatcaagtctactaagaaatgatgtgccgatggctggtcctcttgtggccggaggcctgttaattgcatgttatgtaataactgggacaagcgcagatcttacggtcgaaaaggccgccgatgtgacttgggaagaagaagccgagcaaacgggagtatcacacaatttaatgataacagtagacgacgatggtactatgagaatcaaggacgatgagactgagaatatactaactgtcttactgaagacagcattactaatagtctcaggaatattcccatatagcataccagcaacactgctagtatggcatacatggcaaaaacagacacaaagaagtggcgtgctatgggacgtaccgtccccacccgaaacacaaaaggctgaactagaggagggtgtatatcgtattaaacagcaaggtatattcggaaaaacgcaagtaggcgttggtgtacaaaaggagggtgtcttccatacgatgtggcacgtaacgcgaggagcggttcttacttataatggtaaaagactggaaccgaattgggcgtcggtgaaaaaggatttaattagctatggaggcggatggagactttcagcacaatggcagaaaggagaggaagtacaagttatagcggttgaacccggcaaaaatcccaaaaactttcaaacgatgcccggaacatttcaaacaaccacaggagaaataggagcaatagcattggattttaaacccggtacatcaggaagtcctattataaatcgtgaagggaaagtagtaggattatatggaaatggggtagtcaccaagaacggcggttatgtatcaggtatcgcacagacaaacgccgagcctgacgggccgacgccagaattggaagaggaaatgtttaagaaaaggaacttgaccataatggatcttcatcccggatcaggcaaaacgcgcaaatatcttccggcgatagttcgtgaagcaattaaacggagattacgaactctcatactcgcacccacacgtgttgttgcagcagaaatggaagaagccttaaaaggcctacccatacgatatcagactacagcaacaaagagtgaacataccgggagagagatagtagacttaatgtgtcacgcaacatttacgatgagattactatcaccggtacgtgtacctaattacaatctaatcattatggatgaggcacattttactgacccagcatcaattgccgccagaggatatattagcacaagggttggaatgggagaagctgcggcaattttcatgactgcaacaccaccaggaactgctgatgcgtttccacagagcaacgcaccaatacaagatgaggagcgagatatcccggagcgaagttggaatagtgggaatgaatggataacggactttgcaggaaaaacggtgtggttcgtaccgtcaattaaagcaggaaatgatattgcgaactgcttacggaaaaacggtaagaaagtcatccaactaagtcgtaaaacctttgatactgagtatcagaaaacgaaactaaatgattgggattttgtcgtaactactgatattagcgaaatgggtgctaatttcaaagctgatagagtaatcgatccaagaagatgcctaaaaccagtaatattaacggatggtccagagcgtgttatattagcaggaccaatgccagtaaccgcggcatctgctgctcagaggagaggaagagtcggcagaaaccctcaaaaagaaaatgaccaatatatattcacgggccaaccgcttaataatgatgaggaccacgcccattggacggaagcaaaaatgctccttgataatataaataccccggaaggaataataccggctttgttcgagccagaaagagagaaaagtgcagcaatagacggtgaatatcgactgaaaggagaatcacgaaagacatttgttgagctgatgagacgaggtgatttacccgtatggttagcacacaaagtagcatcggaaggtatcaagtacactgatcgaaagtggtgcttcgatggccaaagaaacaaccaaatcctagaagaaaatatggacgtcgagatttggacaaaagaaggggaaaagaagaaactgagaccaaggtggttagatgccagaacttacagcgatccattggctttaaaggaatttaaagactttgcagctggccggaagtccatagcgcttgatctggttaccgagataggaagggtaccgtctcatttggctcatcgcacaagaaatgcattggataatcttgtaatgctacacacttctgagcatggaggtaaggcttatagatatgctgtagaagaattgcccgaaactatggaaacacttttactgctggggctcatgatcttgcttacagggggagcgatgctgtttttaataagtggtaaaggcataggcaaaacaagcattggattaatatgcgtgatagcttcaagcggaatgttatggatggctgagattcctctgcagtggatagcttcagctattgttctcgaatttttcatgatggtattactgataccagaacccgagaaacaaagaacccctcaagacaatcagctggcctatgtcgttataggaattttgacattagccgccatcattgcggcaaacgaaatgggtctgctggaaacaacgaaaagagatctaggtatgagtaaagagccaggtgttgtgtcgcccacaagttatttagacgttgatttacatccagcgagcgcttggacactatatgcagtcgcaactacagtaattacccccatgttacgccatacaatagaaaattctacggcgaatgtgtctttagcagcaatagcaaatcaagcagtcgtactaatgggattagataaaggctggcccatcagcaagatggatctaggtgttccattactcgcattaggatgctattcacaagttaatcctctcacattaactgccgctgtattgttgcttataacccactacgcaattattgggccgggactccaagcgaaggctaccagagaagcacaaaaacgaacagccgctggaataatgaagaatccaacagttgatggcataatgactatagatttagacccagtaatatatgacagcaagtttgaaaaacaactaggacaagtaatgctcctagtgctctgtgccgttcaactactccttatgcgtacttcgtgggccctatgtgaagcactaacattagctactgggccgataaccacattgtgggaaggctctccggggaaattttggaataccacaattgcggtctctatggcgaacatttttcgcgggagctacctggcaggcgctggtttagcgttctcgataatgaaatcagtgggtaccgggaaaaggggaacgggcagccagggagaaacgctaggtgaaaaatggaaaaagaaacttaatcaattatcacgtaaggagttcgacttatacaagaaaagcggcataacggaagtagacaggaccgaagctaaagaaggtctgaagagaggggaaataacacaccatgcagtttcgaggggcagtgctaagttgcaatggtttgttgaacgaaatatggtaatacccgagggtagagtaattgacctcggatgcggtcgaggaggctggagctactactgcgctgggttaaagaaagtaaccgaagtaagaggttacacaaagggagggccaggtcacgaggagccagtcccaatgagtacttacgggtggaatattgttaaactaatgagcggtaaagacgtattctaccttccacccgaaaaatgcgatacacttctatgtgacataggagaatcatcacccagtcctacagttgaggagtctagaacaataagggtactaaaaatggtagaaccttggctcaaaaacaatcaattctgtatcaaagtcctgaatccatatatgcctaccgtgatcgaacatctagaaagattgcaaagaaaacatggcgggatgttagttagaaatcctttgagcagaaattcaacccacgagatgtattggatttcaaatggaacaggtaatatagtagcgtctgttaatatggtatcacgactgctactaaatcgatttactatgacacacagaaggcctaccatagaaaaggacgtagatctaggagcgggcacgaggcacgttaatgccgaaccagaaaccccaaatatggatgttatcggtgaacgaattaagcggattaaggaagaacacaattcaacttggcactatgatgacgaaaacccgtacaaaacatgggcctatcatggaagttacgaggtaaaagcaacggggtcagcaagtagcatgatcaacggcgttgtcaaactcttaacgaagccttgggacgtagtacccatggtaacccaaatggcaatgactgatacgaccccctttggtcagcagagagtttttaaggagaaagtagacacccgtacccctcgcagtatgcctggaacaagaagggtaatgggaataacagctgaatggctgtggagaacactcggtcggaataagaagcctcgtctatgcactagggaagaatttactaagaaagttagaacaaacgccgcgatgggggcggtttttactgaggaaaatcaatgggactcagcaaaagcagcggttgaagatgaagatttttggatattagtagatcgagagagagaactacacaaattagggaaatgtggttcttgtgtttataatatgatgggtaaaagagagaagaaacttggcgagttcggtaaagcaaaaggatcaagagcaatctggtatatgtggttaggggctagatatttagagtttgaagcattaggatttttaaatgaagatcattggttctcaagagaaaactcctattctggtgtagagggagagggtctccataaacttggatatattttaagagacatatctaaaattccaggaggagctatgtatgctgacgatactgcgggatgggacacgagaataacagaagacgacctgcataatgaagagaaaattacacaacaaatggacccggagcatcgacaactggcaaatgcaatattcaaattgacgtaccaaaacaaagtagtcaaggtacagagaccaactccaacgggaactgtaatggatatcatcagtagaaaagatcagaggggttctgggcaagtgggtacttatggtctaaacacattcacaaatatggaagcgcaactaataaggcaaatggagggcgaaggggttctctcaaaagctgaccttgaaaatccacacctacccgagaagaaaataacccaatggcttgaaacaaaaggcgtggagagactaaaacgaatggccattagcggagatgattgtgtcgttaaacccatagacgatcgttttgctaacgctcttttagctttgaacgatatgggaaaagtgcgaaaagacatcccgcagtggcagccttccaaaggttggcacgactggcaacaagtcccgttttgtagccatcacttccatgagttaataatgaaggatggaagaaagctagtagtaccttgtcgtccgcaggatgaattaataggtagggcgagaatatctcagggagcgggatggtccctacgcgaaactgcatgtttaggaaaagcatatgcgcaaatgtggtccctcatgtactttcatcgaagagatttacgattagcgtctaatgcaatctgttctgcagtacctgtacattgggttccgacatcaaggaccacttggtctattcatgctcaccatcaatggatgaccacggaagatatgctaactgtttggaacagagtctggatagaagataatccttggatggaagataaaacacctgtgactacatgggaaaacgtcccatacctcggaaagagagaggaccaatggtgtggcagtttaatcggtctaacatcacgagctacatgggcacaaaacattccaactgctatacaacaggtgagatctctaatcggaaatgaagagtttctagactacatgccgtcgatgaaaagattcagaaaggaagaggagtcggaaggggctatatggtag

SEQ ID NO: 23360 - RNA, 9873 nt, synthetic construct
  misc_feature 1..9873: note = derived and/or modified CDS sequence (opt6) from DENV-3__FJ547074__SS-prME
  source 1..9873: mol_type = other RNA
acaagtctgtgtttaatgatgatattaccagcggcattagctttccatttgacttcaagagacggagaaccgagaatgatagtaggcaaaaatgaaagaggtaagagcttgttgttcaaaacagcatctggtatcaatatgtgtacattaattgctatggacctaggagaaatgtgtgatgacacagtaacatataaatgtcctcatataacagaagttgaacctgaagacatcgattgctggtgtaatttaacttctacgtgggttacttatggtacctgcaaccaagctggtgaacacaggagggataagcgatcggttgccttggcccctcacgtgggcatgggtctagatactagaacacaaacatggatgagtgctgaaggtgcttggcgtcaagtagaaaaagtagaaacatgggccctacggcatccaggcttcactatactagctctgtttttggcacactatattggtacctctttgactcaaaaagttgtgatatttatattacttatgctggttactccttcaatgacaatgcgttgcgttggagtggggaatagagattttgtggaaggactatcaggtgcgacgtgggttgacgtagttctggagcatgggggatgtgtaacaacgatggccaaaaataaaccgactctggacattgaattacagaaaactgaagctactcaattagcgacactaagaaaactatgtatagaaggaaaaattacgaacataacgacggacagcagatgtcccacccaaggagaagctgtactgcctgaagaacaagatcaaaactatgtatgtaaacatacctatgttgaccgtggctggggtaacggttgtggattatttgggaaaggatctttagtgacatgtgcgaaatttcaatgtttagagcctattgaagggaaagtagtgcaatacgagaacctcaaatatacagtaataatcaccgtacacactggagaccaacatcaagtaggcaatgaaacccaaggagttacagcagaaattactccccaagcaagtactacagaagctattttaccagaatacggaacgctagggttagaatgcagcccaagaacagggctcgattttaacgagatgatcttgttaactatgaaaaataaagcgtggatggtccacagacaatggttctttgatctacccttgccatggacaagcggagctacaacagagacaccaacatggaacagaaaagagttgcttgtaacattcaaaaacgcacatgcaaagaaacaagaagtagtcgttcttggtagccaagaaggagcgatgcacaccgctctaaccggcgccacagagatacaaaattcgggagggacttctatctttgcagggcacttaaaatgtagactgaaaatggataaactagaactcaaaggtatgtcgtacgcaatgtgtactaatacgtttgtgctaaagaaagaagtgtcagaaactcaacatggaacgatcctcattaaagttgaatacaaaggcgaggatgtcccgtgcaaaattccatttagtaccgaagatggacaaggaaaagctcacaacgggcgtctaataactgctaatccggtagtaacaaagaaagaagaacccgtaaatatagaagctgaaccgccttttggtgaatcaaacatcgtaataggtataggagacaacgcattaaaaataaactggtataagaaaggctcaagcattggaaaaatgtttgaagcaacagctcgaggtgcgagacgcatggctatactaggcgataccgcatgggattttggttcagtaggaggagttttaaattctttgggcaaaatggtacatcaaatctttggatcagcttatacggcactttttagtggagtatcatgggtaatgaaaattgggattggagtcctgcttacctggattggtctcaactccaaaaatacatcaatgagtttttcatgcattgtaataggtataataactttatacctgggagccgtggtacaagccgatatgggttgtgtcatcaactggaaaggaaaagaactaaaatgtggaagcggaatatttgtaacaaatgaagttcatacttggacagaacaatacaaattccaagcagactccccaaaacgactggctacagctatagccggtgcttgggaaaatggagtttgcggcattagatctaccacgcgaatggaaaacttactttggaaacagattgcaaatgaactaaactatatcttatgggaaaacaatattaaactaaccgtggtggtgggcgatattataggagtgttagaacaaggcaaaaggactcttaccccgcaacccatggagctaaaatattcgtggaaaacatggggaaaggccaaaatcgtgacggctgaaacccaaaatagttcatttataatagatggtcccaatacacccgaatgtccatctgccagtcgagcatggaacgtttgggaagtcgaagattacggttttggtgtatttactaccaatatatggctaaagttaagagaagtgtacacgcaactctgtgatcacagattaatgagtgcagcagtcaaagacgaacgtgcagtgcacgccgatatgggctattggatcgagagtcagaaaaatggtagttggaaacttgagaaggcctctctaatagaagtaaagacctgtacatggccaaaaagtcatactctctggagcaatggtgtgctagaaagcgacatgatcataccaaaatccctagcagggccaatatcgcaacataattataggccaggatatcatactcaaacggcaggcccatggcatctagggaaattagaattggattttaactactgtgagggtacaacagtcgtaatcaccgaaaattgtggtacacgggggccaagtttacgtactacaacagtctctggcaaattgatacacgaatggtgttgtaggtcatgcacccttccccctctaagatatatgggggaagatggttgctggtatggcatggagattcgcccaatctccgaaaaagaagaaaatatggtaaaatcgcttgtatccgcgggtagcggaaaagttgataatttcacaatgggcgtactttgcttagctattttatttgaggaagtcatgcgaggaaagttcggcaagaaacatatgatagctggcgtgttctttacatttgtcctgttgctgtcaggacagattacatggcgcgacatggcccacacactaattatgataggatccaatgctagcgataggatgggcatgggagttacatacttggcgttgatagctacctttaaaatccaaccattcttagcattaggattctttctaagaaaactaacgtcccgagaaaatctgctactaggagttgggttggccatggccacaaccctccaactcccagaagatatagaacaaatggctaatggcatagcacttggattaatggctttaaaattaataacccagttcgagacatatcaactctggacggcgctcatatctctcacgtgcagtaatactatatttacattaacagtagcatggagaactgcaacactaatattagcaggagtatcgctattaccagtttgccagagctcatcaatgcgtaaaaccgattggttacccatgactgttgcagcaatgggagtaccacccttacctttatttatcttttcactaaaagatacattaaaaagacgttcgtggcctcttaacgaaggagttatggcggtcggtctagtctcaattctcgcttcaagcctattaaggaacgacgtgccgatggcagggccattagtagcgggagggttactaatagcttgttatgtaatcactggcacgtctgctgatctaacggtagaaaaagcagctgatgtcacatgggaggaagaagcagagcaaacaggagtctcacataatttaatgattactgtcgacgacgatggaactatgcgaataaaagatgatgaaacggaaaatattctaacagttttactgaaaacagcactcttgatagttagcggcatcttcccttatagcataccagctacactcttagtttggcacacctggcaaaaacaaacacaaagatccggagttttatgggacgtaccttcacctccagaaactcaaaaggccgaacttgaagagggagtttaccggataaaacaacaaggtatatttggcaagacacaggtgggagtaggcgtacagaaggaaggagtttttcacacaatgtggcatgtgaccagaggtgctgttcttacgtacaatggcaaacgtttagagcctaactgggctagtgttaagaaagatctaatttcttatggaggcggctggaggctcagcgcccagtggcaaaaaggagaagaagttcaagttatagccgtagaacctgggaaaaatcccaaaaatttccaaaccatgcctggaacatttcagacaacgacgggggaaattggcgcaattgcactagattttaaaccaggtacatcgggatcaccaattataaacagagaggggaaagtagtgggactatacggaaatggagtcgtaacgaagaatggaggatacgtttctgggattgcgcaaacaaacgcagagcctgatggtcccactccagaattagaggaagaaatgtttaagaaaagaaatttgactataatggaccttcatcccggaagcggaaaaactagaaaatatttaccggctatagtacgagaggcaataaagcgtcgcctacgaactttgatacttgcccctaccagagtcgtagcagctgaaatggaggaagcattgaagggattaccaataagatatcaaactactgcgacgaaatcagaacacaccgggagggagattgtagacttaatgtgccatgctacatttaccatgagattgttatctccagtgcgggtacccaactacaatctaataatcatggatgaagcgcatttcactgatcccgcaagtattgcggctcgtggctatatttctactcgcgtagggatgggcgaagccgcggccatatttatgacagcgacgcctcctgggacagctgacgcattccctcaaagcaacgcaccgattcaggacgaagaacgggacatacctgagcgaagctggaactctggaaatgaatggataactgatttcgcaggtaaaaccgtctggtttgtcccatccataaaagcggggaacgatatcgcaaactgtttaaggaaaaatggaaagaaagtaatacaattgagccgtaaaacttttgatactgaatatcagaaaacgaaacttaacgactgggatttcgttgtgacgacagacataagcgaaatgggagcaaattttaaagcggaccgagtcatagaccctcgacgctgtctgaagcctgtgatactgacggatgggccggagcgcgttatattggctgggccgatgcccgtaacagcagcttctgcagcacaacgccgaggcagagtcggaagaaacccgcaaaaagaaaacgatcagtacatattcaccggacagcccctaaataatgatgaagaccatgcacattggactgaagctaagatgcttttagacaacattaacacccctgaaggcataataccagcgttatttgaaccagaacgagagaaaagcgcagcaatcgatggtgagtaccggctaaaaggagaaagcagaaaaacgtttgtggagctaatgagacgaggtgacctaccagtatggctagctcataaagtagcatcggaaggtatcaagtacacggaccgtaaatggtgtttcgatggacagcgcaacaaccagatactagaggaaaacatggatgtcgagatttggacaaaagagggcgagaagaagaaattacggccaagatggctagatgcaagaacttatagcgatccgttagctttaaaagaatttaaagattttgctgccggtcgaaaatcaattgcgttagacttagtgactgaaattggacgtgtaccatcacacctggctcacagaacacgaaatgctctagataacttggtaatgttgcatacttcagaacatggaggaaaagcctaccgccacgcggtggaggaattaccagaaacaatggaaaccctattattattaggattgatgatattactaacgggaggtgccatgttatttttaataagcggtaagggtatcggcaaaacttccataggtttgatatgcgttatagcatctagtgggatgttgtggatggcagaaatcccgctccaatggatcgcgagcgcgatagttctcgagttctttatgatggtgctactaatacctgaacccgaaaaacagagaactccacaagacaatcaattggcctatgtcgttataggaatattaaccttagcagcgataattgctgccaatgagatgggattattagagacaactaaacgagaccttggaatgtcaaaagaaccaggcgtcgtttccccaacttcgtacttagatgtggacctacaccctgcatccgcatggaccctttatgcggtggcaacaacagttattacaccaatgctgagacacacaatagagaatagtacagctaacgtatcattggcagctatcgcaaatcaagccgtcgttttaatgggtctagataagggatggcccatttcaaagatggatttaggagtaccgttattagcgcttggttgttattcacaagtcaatcctctaacactgacagcagcagttctcttgttaattacacactatgcaataattggcccaggattgcaggcgaaagcaacccgtgaagcacagaaaagaacagcagcaggtattatgaaaaatccgaccgtagacggaataatgacgatcgatttggaccctgtcatctatgatagtaaattcgaaaaacagctaggacaggttatgcttctcgtcctctgtgccgtgcaacttttactcatgaggacttcatgggcgctatgcgaagccttaactctagcaacagggcctatcacaacactatgggaaggttcgccaggaaagttttggaacacaacaattgcagtatcaatggcaaatatattccgaggaagctacttagcaggagcaggattagcattctctataatgaaatccgttggcacaggtaaaagaggaacaggttctcaaggtgagaccctcggagaaaaatggaagaagaaattgaatcaattgtcacgtaaagaatttgatttgtataagaaaagtgggattactgaggtagatagaacagaagcaaaggaaggactgaaacgaggagaaattacacatcacgcagtaagtcgagggagcgctaaacttcaatggtttgtcgagaggaacatggttataccagaagggagggtgattgacctaggttgcggtcgaggcgggtggtcatactactgtgcaggccttaagaaagtaactgaagttcgaggttatacgaaaggagggcctggacatgaggagcccgtgcccatgagcacttatggatggaatatcgtaaaactcatgtcaggaaaagacgtattttatttacctcccgaaaaatgtgatacattgctttgcgatatcggcgagagttccccgtcaccaactgttgaagagtcccgaacaataagagtgctgaaaatggtagaaccttggttgaaaaataaccaattctgcataaaagtgttaaacccctatatgccaacagtcatagaacatctagagagactacaaaggaaacatgggggtatgctcgtacgcaatcctttatcgagaaactcaacacatgaaatgtattggatcagcaatggcacaggaaacatcgttgcatctgtcaacatggtctcaagattactactcaacaggttcacaatgacgtacagacggccgactatagaaaaagatgtcgttctaggagcgggaacacgccatgtaaatgcagaaccagaaacccctaatatggacgtcattggtgaacgcattaagcgtattaaggaagaacataattcaacgtggcattatgatgacgagaatccatacaaaacgtgggcttatcatggaagctatgaggtcaaggctactggatcggctagcagcatgatcaatggcgtcgtgaaactcctaacaaaaccatgggatgtcgtaccaatggtcacccagatggcaatgactgacactacaccttttggacagcaacgggtatttaaagaaaaggtggatactcggactccccgctccatgccaggaactagaagagtcatgggtataacagcggaatggctatggagaacccttgggcgtaacaagaaacccagactatgtacgcgggaagaatttaccaagaaagtacgtacaaatgcagctatgggagctgtattcaccgaagagaatcaatgggacagtgcgaaagctgcagtagaagacgaagacttctggatattagttgacagagaaagagaattgcataaattgggaaagtgtggaagctgcgtatataatatgatgggcaagcgtgagaagaaattaggggaatttggtaaagcgaagggcagcagagccatatggtatatgtggttaggagcaagatacttagaatttgaagcccttgggttcctcaatgaagaccactggttttcaagagaaaattcgtatagcggagttgagggggaaggattgcacaaattgggatacatcctccgcgatattagtaagatccccgggggagcaatgtatgccgacgatacggcaggatgggacacgcgaataacggaagacgatcttcataacgaagagaaaatcacgcagcaaatggatccagagcacagacaactcgccaatgctatatttaagttgacatatcaaaataaagtagtaaaagtgcaaagaccaacccccacggggactgtaatggacataattagtaggaaagatcaacgcggaagcggacaagttggaacatatggtctaaatacattcacaaatatggaggcacaacttatacgccagatggaaggagaaggcgtgctttcaaaggctgacttagaaaatcctcatcttcctgagaagaaaataacacaatggcttgagaccaaaggagttgaaagactaaagcgaatggctattagcggagatgactgtgtcgtaaaacctatagatgatcgtttcgcgaatgctctcctggctttaaatgatatgggcaaagtaagaaaagatataccacagtggcaaccgagcaaaggatggcatgattggcagcaagtccctttttgctctcatcacttccacgaactaattatgaaagacggaagaaaacttgttgtaccatgcagaccacaagatgaacttatagggagggcaaggataagtcaaggagcgggatggagcctaagagaaaccgcgtgcctgggtaaagcgtacgcacagatgtggagtcttatgtatttccatagacgggacttgcggctggctagtaatgcaatatgtagtgcagttcccgtgcattgggttccaacctccaggacaacgtggagcatacatgcacatcatcaatggatgaccacagaagacatgctcactgtatggaatagagtatggatagaagataatccatggatggaagacaaaacaccagtcacgacttgggaaaacgttccatatttgggcaaacgcgaagatcaatggtgtggctcgctaattggactcacttctagggcaacgtgggcacaaaacatacccactgcaatacaacaagtaaggagcttgattggtaatgaagagttcttagattatatgccatctatgaagcgattcagaaaagaggaagaatcagagggcgcaatttggtag

SEQ ID NO: 23361 - RNA, 9873 nt, synthetic construct
  misc_feature 1..9873: note = derived and/or modified CDS sequence (opt6) from DENV-3__FJ547075__SS-prME
  source 1..9873: mol_type = other RNA
acctcgttatgtcttatgatgatattaccagcggcactagcattccatcttactagccgtgatggggaacccaggatgatagtagggaaaaatgaaagaggaaaatctttacttttcaaaaccgcatcggggataaatatgtgcaccttaatagcgatggatttaggtgaaatgtgcgatgatacagtaacgtataaatgtccccatataacagaagttgaacccgaagatatcgactgttggtgtaacttaacatcaacgtgggtaacctatggaacctgcaatcaagcgggcgaacaccgtagagataaacgttcagtagcactggcgcctcacgttggcatgggattagacacccggacacaaacatggatgtcggcagaaggagcttggcgacaagttgaaaaagtagaaacatgggcccttaggcacccgggcttcactatattggcgctctttctagctcattacatcgggacatctctcactcaaaaagtagtaattttcattttgctaatgctggtaactccatcaatgacaatgcgctgcgtaggtgtaggaaatagagattttgtagaaggcctatcgggtgcaacgtgggttgatgtcgtacttgaacatggtggttgtgtcacaactatggcgaaaaacaaacctacgttggatatagaactccagaaaactgaagcaacacagctagctaccttaaggaaattgtgcatcgaaggaaaaattactaatattacgacagacagtagatgcccgacgcaaggagaagcagtattacctgaagaacaagatcagaactacgtgtgtaaacatacatatgtagatcggggctggggtaatggatgtggtctatttggaaaaggatcacttgtaacgtgtgcaaaatttcaatgtttagaaccaatagaaggaaaagtagtgcaatatgagaatctaaaatacactgtaattattacggtacatacaggcgaccaacatcaagtaggaaacgagacgcaaggtgtaactgctgaaataacaccacaagcaagtactactgaggcaatattacccgaatacggaacactcggcctagaatgtagcccacgaaccggtttagactttaatgaaatgattttgttaacaatgaaaaacaaagcatggatggtacacagacaatggttctttgatcttcctttaccatggacttctggggcgacgacggagactccaacctggaacaggaaagaactattagtaacctttaaaaatgcccatgccaagaaacaagaagtcgttgttttaggatcccaggaaggagctatgcatacggcactcacaggagcaactgaaatccaaaatagcggtggaaccagcattttcgccgggcacctaaagtgcagacttaaaatggataaactagaattaaaaggcatgagctacgctatgtgtacaaatacatttgtgctgaaaaaggaggtatccgaaacccaacatggcaccatattaattaaggtcgaatacaagggcgaagatgtgccatgcaaaataccgttctcaacggaggacggtcaaggaaaagcgcataatgggagattgataaccgcaaacccagttgtaacaaagaaagaagaacccgtaaatattgaagccgagccacctttcggtgaatcgaacattgtaattggaataggagataacgcgctgaaaataaactggtataaaaagggctcatctattggcaaaatgtttgaagcaactgcaagaggtgcacgaagaatggcgatcttgggggatactgcctgggactttggatccgtcggtggagtactcaacagccttggaaaaatggtgcaccaaattttcggatctgcatatacggccttattttctggggtatcttgggtcatgaaaatcggaataggggtactacttacgtggataggactaaatagcaaaaacacaagtatgagtttttcatgcatcgtgataggcataataaccttatacttaggtgcagttgtacaggctgacatgggatgcgtcataaactggaaagggaaagaattaaaatgcggaagcggcatatttgtcactaatgaagtacatacttggaccgaacaatataaattccaagcagattcgccaaaaaggctggcgacagctatcgcaggcgcatgggaaaacggcgtgtgcgggataagatctaccactagaatggaaaatcttctatggaagcaaatagccaatgaacttaactatatactttgggagaacaacatcaaactgacagtggttgttggagatattattggggtgctcgaacaagggaaaagaacacttacaccccaaccgatggagttaaaatatagttggaagacttggggaaaagcaaagatagtaactgctgaaacacaaaatagcagctttataatagatggacccaacacgcccgaatgccctagcgcatctagggcatggaatgtctgggaagtcgaagattacggattcggggtttttacaacaaatatttggctaaaattacgggaagtgtatacacaattgtgcgaccataggttaatgtcggcagcagtcaaagacgaaagggcagttcatgcggacatggggtattggatagaaagccaaaagaacggttcatggaaactagaaaaagctagtctcatagaagtcaaaacctgcacttggccaaaaagtcatacgctgtggtcaaatggcgtattagagtcggatatgataatcccaaaaagtctagcaggaccaataagtcaacacaactacagacctggctaccatacacagactgcagggccttggcatctaggaaaactcgaactagattttaactactgtgaaggcacaacagttgttataactgaaaattgcggaacgcgtggaccctctcttcggacgactacagtaagtgggaaattaatccacgagtggtgttgtagatcatgtaccttgcctcctctcagatacatgggtgaagacggttgttggtatgggatggaaattaggcctatcagtgaaaaagaggagaatatggtcaagtcattagttagtgctggcagtggcaaagtagacaactttacaatgggtgtactatgtcttgcaattctgtttgaagaagtcatgaggggaaagtttggtaagaaacatatgatcgccggagtgtttttcactttcgtacttctattatctggtcaaatcacatggcgtgatatggcacatacattaatcatgattggaagtaatgcatccgacagaatgggcatgggagttacgtatcttgcattaattgcaacgtttaaaatacaacccttcttggcattgggatttttcctaagaaaattaacttccagggaaaacttattactcggtgtgggtcttgctatggcaacgacactacaattgccagaagacatagaacaaatggcaaatggaatagctcttggattgatggctctgaaacttataactcaatttgaaacttatcaattatggacggcactaatctccttgacctgttcaaacaccatttttacattaacggtagcatggcggactgcaacacttatactagcaggcgtgtcactactaccagtatgtcaaagttcatcaatgcgaaaaacggactggcttcctatgaccgtcgcagcaatgggagtaccacctctacctcttttcatcttttccctcaaagatacattgaagaggcgaagctggccacttaacgagggtgtcatggcagtcggactggtatcaattctagcgagctcgttacttcgaaatgacgttccgatggcaggtccattagtagcaggaggattactaattgcttgttacgttataacaggtacgagcgccgacttaacagttgagaaagcagcagacgtaacatgggaagaggaggcggaacaaacgggggtcagtcataatctaatgattacagtagatgatgacggtacgatgagaattaaagatgatgaaacagaaaatatattaacagtattgctcaaaactgcgttactgattgtttcgggcatatttccttattcaatccctgcgacacttttggtttggcatacctggcaaaaacaaacacagagatccggagtattatgggatgtccctagtccccctgaaacccaaaaagccgaattggaagaaggagtatatcgtattaaacaacaaggaatatttggtaaaacgcaagtaggagtaggcgtacaaaaggagggtgtgtttcacactatgtggcatgtgactagaggtgcagttttgacttataatgggaaacgattagaaccaaactgggcctctgtcaagaaagatttgattagttacggaggtggatggagacttagtgcacaatggcaaaaaggtgaggaagtgcaagtaatcgcagtagagccaggcaaaaaccccaaaaattttcaaactatgcccggaacgttccagacaacaacaggtgaaattggagcgattgcacttgactttaaaccagggacatcgggatctcctataataaacagagaaggaaaagtcgtaggattgtatgggaatggagtagtgaccaaaaatggaggttatgtatctggcatcgcacagacaaacgcagagtccgacggtcccactcctgaactagaagaagagatgttcaagaaaaggaatctcactatcatggatctacatccgggcagtggtaagacgcggaaatatttgccggccatagttcgcgaagccataaaaagaagactaaggaccctaatattggctcctacccgtgtcgtagctgctgaaatggaagaagcacttaaaggactcccaattcgatatcaaacaacagccaccaaatctgaacacaccggacgagaaatagtcgacttgatgtgtcacgctacctttactatgaggcttttaagcccggttagagtgccaaattacaacttaatcataatggacgaagctcacttcactgaccctgcatctatagccgctcggggatatatctcaaccagggtaggcatgggtgaagcagcagcgatattcatgaccgcgacgcctcccggcactgcggatgcatttccgcaaagcaacgctcctattcaagacgaagagagagatataccagagagatcttggaactcaggcaatgaatggataactgattttgcaggaaaaacagtttggtttgttccttcaattaaagctggtaacgatatcgctaattgcctccgaaagaatggaaagaaagtaattcaattgagtagaaaaacattcgacactgaataccagaaaactaaactgaatgattgggacttcgtcgtaacaacagacatctcagagatgggagccaatttcaaagctgatagagtaatcgatcctagaagatgtctaaagccagtgatccttacagatggtccagagcgagttatcctcgcaggtcctatgcctgtaacagcggcttctgctgcacaaagacgcgggagagtgggcagaaacccacaaaaagagaacgatcaatacatattcaccgggcagcccttaaacaatgacgaagatcatgcacactggactgaagcaaaaatgctgctcgacaacattaatacacctgaagggataatacctgctctctttgaaccagaacgggaaaagtcagctgcaatagacggagaatataggctgaaaggggagtcacgaaagacatttgttgaattaatgcgtagaggagatcttcccgtttggctagcgcataaggttgctagtgaaggaatcaaatacacggatcggaagtggtgttttgacggtcaaagaaataaccaaatactagaagaaaatatggacgtagaaatttggacaaaagaaggagagaagaagaaattaagaccaagatggttagacgcacgcacttatagtgatccactggctttgaaagagttcaaagactttgcagccggacgcaaatcgatcgccttagatcttgttacagaaatcggcagagtcccgtcccacttagcacacagaacacgcaatgctctagataatttagtaatgttgcacacctccgaacatgggggaaaggcttatcggcatgctgttgaagaattaccagaaacgatggaaacattattattattaggcttgatgattctcctgaccggaggcgctatgttatttttaataagtggaaaagggatagggaaaacaagtataggattgatatgcgtcatagcatcatctgggatgctatggatggccgaaatcccactgcaatggattgcctccgcgattgtgctagagttcttcatgatggtgctgttaattcccgagcctgaaaaacaacgaacaccacaagacaatcagttagcatatgtcgtaataggtattttgaccctggccgcaatcatagccgcgaatgaaatgggcctcctagagacgactaaacgcgacttaggaatgtcgaaagaaccgggcgttgtttcaccgacaagttatttagatgtagacctacacccggcaagcgcttggactttatacgcagtagcgacaacagtaataacgccaatgttaagacacactatagagaactcgacagcaaatgtatcactagcggctatagcaaatcaagctgtcgtactgatgggtttagacaaaggttggcccatttctaaaatggacttgggtgtaccattactagcactaggctgttactcccaagtaaatccattgacactaacagcagccgtactattactgataacacattacgcgattataggtcccggattacaggcaaaagccacacgagaagcgcagaaaagaactgccgctggtataatgaagaatccaactgtagatgggataatgacaatagatcttgacccagtaatatacgactctaaatttgaaaagcaattaggccaggtaatgttgctcgtattatgtgctgttcaactactactaatgcgaacatcgtgggcgctatgtgaagcccttaccctagctaccggaccgataactacattgtgggaaggaagtccaggtaaattttggaacaccacaattgcagtttcaatggccaacatattcagaggcagctatctcgctggagcgggactagcatttagtatcatgaagtcagttggaacggggaaacgaggaacgggatctcaaggcgagactcttggtgaaaagtggaagaagaaattgaaccaactttccagaaaagagttcgatttatataaaaagagtggcattacagaagtagacaggacagaagcaaaggagggactaaaacgaggcgagataacacatcatgctgtatctagaggctcagctaagctccaatggtttgttgaacgaaatatggttatacctgaaggaagggttatagacttgggatgtgggcgaggtggttggagctattattgcgctggtcttaagaaagtaacggaagtcagaggttataccaagggaggacccggacacgaagaaccagtacctatgtcgacgtatggctggaatatcgttaaattaatgtctggtaaagacgttttctacttacctcctgaaaaatgcgatacgctactgtgtgacattggcgaatcatcaccttcacctacagttgaggaatcgcgaactattagagtactcaaaatggtagagccatggttgaaaaacaatcaattctgtataaaagttttaaatccttatatgcccacggtaatagaacatttagaaaggctccagcgaaagcatggcggaatgctcgtacgaaaccccctctccagaaattccacacatgaaatgtattggatctcgaatggcactggaaacatagtagcatcggtcaacatggtaagtcggcttttactcaatagatttacaatgacgcatcgacgccccactatagagaaagacgtagacctgggagcaggaacaagacacgttaacgctgaaccggaaacgccaaacatggatgtaataggtgaaagaataaaaagaattaaagaggagcataattcgacttggcactacgatgatgaaaacccctataaaacgtgggcataccacggcagttacgaagtgaaagcaactggaagtgcatcttcaatgataaacggcgtagtaaaacttctaactaaaccctgggacgtcgttccaatggttacacaaatggcaatgactgatacaaccccctttggtcagcagcgcgtttttaaagagaaagtagatacacgtacaccgcgctctatgccgggtacgcgtagagtcatgggaatcaccgcagaatggttgtggcgaactttaggaaggaataagaaacctagactatgtactagggaagagtttactaagaaagtaagaacaaatgccgcaatgggagcagtcttcacggaggagaaccaatgggatagcgcaaaagccgcagtagaagacgaagatttctggatccttgtcgatagagaacgggaactacataaactaggcaaatgcggctcttgcgtatataatatgatggggaaaagagaaaagaaattgggtgagtttggcaaagcgaaaggatcgcgagcaatctggtatatgtggctaggggcaagataccttgaatttgaagcactggggttcctaaacgaggaccactggtttagccgagaaaattcctactcaggggttgagggagagggactacataaacttggatatatactaagagatatctctaaaatacctggaggcgcaatgtacgccgatgatactgcgggttgggatacacgcataactgaagacgatctgcataatgaagagaaaataacgcaacagatggatccagaacaccgtcaactagctaatgcaatcttcaagctaacctatcaaaataaggttgtcaaggtacaaaggccgacaccaacaggaacagtgatggacatcatatctagaaaagatcaaagaggaagcggccaagttggtacgtatggtctaaacacatttactaatatggaagcccagctaataagacagatggaaggcgaaggtgtactatctaaagcagatttggagaaccctcatctaccagagaagaaaataacacagtggttggagacaaaaggagttgagagactaaaacgcatggcaatatcaggtgatgactgtgttgtaaaacccatagatgacagatttgccaacgcattgttggcattaaacgatatggggaaagtacgaaaagatattccacaatggcagccatcaaagggatggcacgattggcagcaggttcccttttgtagtcatcactttcacgaattaatcatgaaggacggtcgtaaactcgttgtgccgtgtagaccacaggacgaactaataggtagggcaagaataagtcaaggagctggttggagtcttcgagagactgcatgtctcggtaaagcctacgcacagatgtggagtcttatgtacttccataggagggacttacgattagctagcaatgctatttgcagtgctgtccccgtccactgggttcctacaagcagaacgacttggtcaatacacgcgcaccaccagtggatgacaacggaagacatgttaacagtatggaatagagtatggattgaagacaatccatggatggaagataaaactccagtaactacctgggaaaatgtcccatatcttggtaaacgagaggatcaatggtgtgggtcattgataggactcacttcacgcgcaacttgggcacaaaacataccaacagcaatacagcaagtccgctccttaattggtaatgaggagttcttagactatatgccatccatgaagcgtttcaggaaagaggaagagtcagaaggagcgatatggtaa

SEQ ID NO: 23362 - RNA, 9873 nt, synthetic construct
  misc_feature 1..9873: note = derived and/or modified CDS sequence (opt6) from DENV-3__FJ547076__SS-prME
  source 1..9873: mol_type = other RNA
acgagcctctgtcttatgatgattttgccagcagccttagcctttcacctcacttccagagatggggaaccccgtatgatcgtgggcaaaaacgaaagaggaaaatcgctgctatttaaaactgctagcggtatcaacatgtgcactttgattgcaatggatttgggagaaatgtgcgacgatacggtgacttataaatgcccacatattacggaagtagaaccagaagatatcgactgttggtgcaatctaacaagcacatgggtaacttacgggacttgcaaccaagccggtgagcatagaagagataaaaggagcgttgcactagccccacacgttggaatgggtctggacaccaggacacaaacatggatgtcagctgaaggagcatggagacaagtagaaaaagtagagacatgggcgctccgacacccaggatttaccatattagccctattcctagcgcattatataggaacaagtctaacacaaaaagtggtgatatttatattgttaatgctagtaacaccgtcaatgaccatgaggtgcgtcggagtaggaaatcgcgactttgttgaagggctaagtggtgccacatgggttgatgtcgtcctcgaacacggtggttgcgtaacaacaatggcgaaaaacaaacctacccttgacatcgagcttcagaaaactgaggctactcaacttgcaacgttacgtaaattgtgtattgaaggaaaaataactaatatcaccactgattctcgctgccctacccaaggagaagctgtactcccagaagaacaagaccaaaattatgtatgtaaacacacctacgttgataggggttggggtaacgggtgtggattattcggaaagggttctctagtaacttgcgcaaaattccaatgcttggagcctatcgaaggaaaagtggtgcaatatgaaaacctgaaatatacggtaataattacggtacacacgggggatcaacaccaggtagggaatgaaacacaaggagtaacggccgaaataacgccacaagcatcaacaacagaagcaatccttccggaatacggcaccctagggctagaatgttcaccaagaacgggcttggactttaatgaaatgatactattgacaatgaaaaataaagcctggatggttcatagacaatggttctttgacctacctctaccgtggacctcaggagcgactacagaaacaccaacttggaacagaaaagaactattagtgacatttaaaaatgcacacgcaaagaaacaagaggtagtagttttagggagccaagaaggggcaatgcatacagctttgacaggcgcgacagaaattcaaaacagtggaggaacaagtatatttgcaggacatttaaaatgtcggttaaaaatggataaattagagctaaaaggaatgagctatgctatgtgcacaaatacttttgttttgaaaaaggaagttagcgaaactcagcacgggacaatacttataaaagtagagtataagggagaagatgttccatgcaaaattcccttttctacggaagatgggcaaggaaaagctcataatggacgcttaatcacggcaaacccggttgtaactaagaaggaagaacctgtcaacattgaagcagagcctccgtttggcgaaagcaatatagtaataggaataggcgataacgcactaaaaattaactggtataagaaaggcagttccataggaaaaatgtttgaagccacggccaggggagcacgcagaatggccatcctaggtgatacagcatgggacttcggctcggttggaggagtacttaactctctgggaaaaatggtccatcaaatattcggatccgcttatacagctttattttcgggggtatcatgggtaatgaagatcggaataggggtgcttttaacatggatcggactaaatagtaaaaatacaagtatgtcgtttagctgcattgcaattggaattataactttatacttaggtgcagtagtacaggcggatatgggatgtgtcatcaattggaaaggaaaagagttaaaatgcggatcaggaatatttgtcacaaatgaagttcacacttggacagaacaatataagttccaggctgactctccaaaaaggctagccacagcaatagccggtgcttgggaaaatggagtgtgtggcattcgctcgacgactcgtatggagaatcttctatggaaacagatcgctaatgaactcaattacatactttgggaaaacaacattaaattaacagtagtggtaggagatatcattggcgtacttgaacaaggaaaaaggacactgacaccgcaacctatggaattaaaatatagttggaaaacatggggaaaagctaaaattgttactgcagaaactcaaaactcaagttttattatagacgggcccaatacaccagaatgtccatcggcatcccgagcgtggaacgtttgggaagtagaagattacgggttcggagtatttacaactaacatttggttaaaactcagagaagtctatactcagttgtgtgatcaccgactgatgtctgcggctgttaaagacgaaagagccgttcacgcagatatgggctactggatagaatcacagaaaaacggcagttggaaactagaaaaagcgtcattaattgaagttaaaacttgtacgtggccaaaaagtcatactttatggtcgaatggagttttggaatccgatatgataattcctaaaagtctcgcaggaccaattagtcaacacaattatagacccggctatcatactcaaactgcaggaccatggcatctagggaaattagaactcgattttaactactgtgagggtacaacggtagtaataactgagaactgtggaacaagaggtccatcgctcagaactaccactgtatcaggaaagttaattcacgagtggtgctgcagatcatgtaccctacctccacttagatatatgggagaggatggatgctggtatgggatggagatacgaccagtatcagaaaaggaagaaaacatggttaaaagtctagtgagcgcgggatcgggtaaggtagataatttcaccatgggggtactctgccttgcaattctttttgaagaagttatgagaggcaaattcggaaagaaacacatgattgcgggcgtcttctttactttcgtccttctattgagtggacaaataacgtggagagacatggcacatactctaattatgatcggttcaaatgcgagcgatcgaatgggaatgggggttacatatttagctctgatagcgacatttaaaatacaaccgttcctagctttaggatttttcttaaggaaactaacaagtcgggaaaatcttttactaggagtaggcctcgccatggcaactacattacaactgcctgaagatattgagcagatggctaacggtatcgcactgggtttaatggcacttaagttaataacacaatttgaaacttatcagctatggactgcattgatatcccttacatgctcgaacacaatatttaccttgacggtagcatggagaactgcaacactgatacttgcaggagtgtccctcttaccagtatgtcagagttcctctatgagaaaaactgattggctcccgatgacggtagctgcgatgggcgtaccaccgttacctttattcatattttcgttgaaagacacactaaaaagaaggtcatggccactcaacgaaggagtaatggcggtaggattagtatctatactagcctcttcattacttaggaatgatgtacccatggcgggtcccttagtagcgggcggattattgatagcgtgttatgtaataacaggaaccagtgccgatttaaccgtagaaaaagccgcagatgtgacatgggaagaggaagccgaacaaacaggtgtcagtcataaccttatgataaccgtagatgacgatggaactatgcgtatcaaggatgatgaaacggaaaatatactaacagttcttctaaaaaccgccctcctgatagtcagcggaatttttccatatagtatccctgcgacattgctcgtttggcatacatggcaaaaacaaacccaaagaagtggcgtcttatgggatgtccctagtccacccgaaacgcaaaaagccgaacttgaagaaggggtttataggataaagcaacagggaatttttgggaaaacacaagtcggcgtcggtgtacagaaagagggagtattccacactatgtggcacgttactcggggtgcagtactcacatataatggcaaaagactcgaaccgaattgggcgtctgtcaagaaagacttaatctcttatgggggcggatggcggcttagcgctcaatggcaaaaaggggaagaagtacaagttatcgccgttgaaccaggaaagaatcccaaaaatttccaaacaatgcccgggactttccaaacaacaaccggagagatcggggccatagcattggattttaaaccagggaccagtgggagcccgattataaatcgggaggggaaagttgtgggcctatacggaaatggtgtggtaactaaaaacggaggatatgtatcaggcattgcgcaaacaaacgcagaaccggacggcccaacacccgaactagaagaagagatgtttaaaaagagaaatcttacaataatggatttacacccagggagtggaaaaactagaaaatacttacctgcaatagtacgtgaggccatcaagcgccggcttagaacattgatactagcacctactagagtggttgccgctgaaatggaagaggcattaaaaggattacctataaggtatcaaaccactgcgacaaaatcggaacacaccgggcgagaaatagtggacctaatgtgccatgctacatttacaatgcgactcctaagccctgtcagagtgcctaactataacctaattataatggacgaagctcactttacagatccggcgagcatcgcagcacgcggttatatatcgacacgagtagggatgggcgaagctgcggctatattcatgacagctaccccgccgggtacagcagacgcttttccacaaagcaatgcacctatacaggacgaagaacgagatatcccggagagatcttggaatagtggcaatgagtggataactgacttcgcaggcaaaacagtctggtttgtacctagcataaaagcagggaatgatatagcaaattgtctaagaaagaatggtaagaaagttattcaactatctaggaagacatttgataccgaatatcaaaagacaaaactaaacgactgggatttcgtagttacaacagatataagtgagatgggagcaaatttcaaagcggaccgagtgatagatccacgaagatgcctaaagcccgtgatattaacagatggaccagaaagggtaattcttgcaggaccaatgcctgttaccgcagcatctgcagcccagaggcgcggaagagtaggtaggaaccctcagaaagagaacgaccaatatatctttacaggacagccccttaataatgatgaggatcatgcacactggacggaagcgaagatgctactagataatataaataccccagagggcattatcccagcattatttgagccggagagggaaaaatcggcagcaattgatggggaataccgtttgaaaggagaatcaaggaaaacatttgtagaattaatgaggagaggtgatttaccagtgtggctagctcacaaagtagcgagtgaaggaattaaatatactgatcgcaaatggtgtttcgacggtcaaaggaacaaccagattttggaagaaaatatggacgttgagatatggacaaaagaaggcgagaagaagaaattgcgtccccgatggctagacgctagaacttactccgatccactcgccttaaaggaatttaaagatttcgctgcggggaggaaatcaattgccttggaccttgtaactgagatcgggagagtgccatcccatcttgctcataggacacgaaatgcgcttgataacttggtcatgttgcacacttctgaacacgggggtaaagcctataggcatgccgttgaagaacttcccgaaaccatggagactttgttactcttagggttgatgatattactcacaggaggggcaatgttatttctgattagtggtaagggcatcggaaagacttctataggcctgatctgcgtaatagcgtcaagcggaatgttgtggatggctgagatccccctacaatggattgcttcagcaattgttctggagtttttcatgatggtgttattaattcctgaaccagagaagcaacgaacaccgcaagataatcaattagcttatgtagttattggcattcttacactggctgctataatagcggcaaatgaaatgggcctattagaaacaacaaaacgtgatcttggaatgtcaaaagaaccaggagttgtgagtccgacttcgtatttagacgtagatttacacccagcgagtgcatggacgctttatgcggtcgcgacgactgttataactccaatgcttagacatactattgaaaacagtacggctaacgtatcattggccgccatcgcaaatcaagcggttgtgttaatgggattagacaagggatggcccatttctaaaatggatctcggagtgccattactagcactaggatgctactcacaagtcaaccctctaacattaacggcagccgtactcttgcttataacgcattatgctataataggacctggtctccaagcgaaagcaactagagaagcacaaaagagaacagctgcaggaattatgaagaaccctaccgttgatggtataatgaccatagatttggatccagttatatacgatagcaaattcgaaaaacagctgggccaggtaatgttactcgtactctgcgctgtacaattattacttatgaggacaagctgggctctctgcgaagctctaaccctagccacaggaccgataacaacactctgggaggggtcaccagggaaattttggaatacgactatagctgtaagcatggctaatatcttccgaggaagctatctcgccggcgccggattagcgttttcgatcatgaaaagcgtaggaacaggaaaacgcggaaccggttcgcaaggagaaaccctcggagaaaagtggaaaaagaagttgaaccagctatcaagaaaggaatttgatttgtataaaaagtcaggtattaccgaagtagaccgaacagaggcaaaagagggactgaagagaggcgaaattacacaccatgccgtaagcagaggtagcgcaaaactgcaatggtttgtagaacgcaacatggtaatacctgaaggaagagttatagatctaggatgcggaagaggtggctggagttattactgtgcagggctaaagaaagtgacagaggtaaggggttacaccaaaggcggaccaggccatgaggaaccggtaccaatgagtacatacggatggaatattgtaaagctcatgtcggggaaagacgtattctaccttcctccggaaaaatgcgacacactactatgtgacataggagaatcatccccatcaccaactgtggaagaatcaaggacaattagggtgttgaaaatggtagagccatggctcaaaaacaatcaattttgtatcaaagttctcaatccctacatgcctacagtgatagaacatttagaaagactacagagaaaacatggaggcatgttagtccgaaacccactaagcagaaactcaactcacgaaatgtattggataagtaatggtactggaaacatagtagcgagtgtaaatatggtaagcagattattattgaaccgtttcaccatgacgcacagaagaccaacaatagagaaagacgtagatctaggagcaggtactcgacatgtcaacgcagaaccagagacaccaaacatggatgtaataggcgaaagaataaagcgtatcaaagaagaacacaacagtacatggcactacgatgatgaaaacccatataagacgtgggcctatcatgggtcttacgaggttaaagctacaggttcagcatcctctatgataaatggtgttgtaaagctcctaacaaaaccatgggatgttgtacctatggtaactcagatggcaatgacagataccactccgtttggccaacaacgagtctttaaagaaaaagtagatactcgtaccccaagatccatgccgggcactcgaagagtgatgggcatcacagctgaatggttgtggcgaaccttggggcgaaataagaaaccgcgtctatgcacaagagaggagttcactaagaaagtgcgcacgaacgcagcaatgggagctgttttcacagaagaaaatcaatgggacagcgccaaagcggccgtcgaagacgaagatttttggaaactggtagaccgtgaaagggaacttcacaaactgggtaaatgtggttcgtgtgtttacaacatgatgggcaagagagagaaaaagctaggtgaatttggaaaagcgaaaggaagccgagcaatatggtacatgtggctgggggcgagatatttagagttcgaggctctaggattccttaatgaggaccattggtttagtcgtgaaaacagttattctggtgtggaaggagaaggacttcacaaactggggtatatactaagggatataagcaaaataccaggaggtgctatgtacgcagacgatacggcaggttgggataccagaattactgaggatgatttgcataatgaagaaaagattacgcaacaaatggacccagaacatcggcagttagcaaatgcgatattcaaattgacatatcaaaataaggtagttaaagtacaaagaccaacaccaacgggaacagttatggacattatcagtcgcaaggaccaaaggggtagcggccaggtaggcacttacggactaaacacttttaccaacatggaggcacagctcattagacaaatggaaggggaaggagtcttatctaaagccgacctagaaaacccacacttacctgagaagaaaataacacaatggcttgaaactaagggtgtagaaagactgaaacgaatggctatctctggagacgactgtgtagtgaaacccattgatgatagatttgctaacgcattattagcactaaacgacatgggaaaagtaaggaaagacatcccccagtggcaaccatcgaagggctggcacgactggcagcaagtacctttttgttctcaccactttcatgaactaataatgaaggacggtcgaaaattagttgtaccttgcagaccacaagatgaattaataggacgtgcgagaatatcacaaggtgccggttggtcattaagagaaacagcctgtctaggaaaagcatatgcacaaatgtggtcactaatgtattttcacagaagggacctcagactagcttcaaatgctatttgtagtgcagttccagtgcactgggtacccacgagccggactacatggagtattcacgcacatcaccaatggatgaccactgaggacatgttaacggtatggaatagagtgtggattgaagacaatccatggatggaagacaagactcctgtaacgacatgggaaaatgttccataccttggaaagagagaagaccaatggtgtggctccctaataggtctaacaagccgagcgacctgggcacaaaatataccgacggccattcaacaagtgcgatctctaattgggaatgaagaatttctggattacatgccatcaatgaaaagattccgtaaggaggaagaaagtgaaggtgcaatatggtag

SEQ ID NO: 23363 - RNA, 9873 nt, synthetic construct
  misc_feature 1..9873: note = derived and/or modified CDS sequence (opt6) from DENV-3__FJ547077__SS-prME
  source 1..9873: mol_type = other RNA
acaagtctgtgtttaatgatgatattaccagctgcattagcatttcatcttacgagtcgagatggcgaaccgagaatgattgttggcaaaaacgaacgaggaaaaagtttgctatttaaaacagcaagtggtattaacatgtgcacccttatcgcgatggatcttggagaaatgtgtgacgatacggtaacttataaatgtccccatataaccgaagtagaacctgaagacattgactgttggtgtaatttgacatcaacttgggtcacgtatggaacatgtaatcaagcgggagaacatcgtcgggacaaaagatcggttgcactagcgcctcacgttggcatgggattagatacacgaactcaaacatggatgagcgcagaaggagcttggagacaagtagaaaaagtagaaacttgggcactacgacatccaggcttcacaattttggcactatttttggctcattatataggaacctcactaacacaaaaagtcgttatttttatattgctaatgctagtcactccctccatgacaatgcgatgcgtcggtgtcggaaatagagattttgtagaaggcctaagtggtgcaacatgggtagatgtagtcctagaacatggaggctgtgtaactactatggccaaaaataaacctactttggatatagaactacagaaaacggaagctacacaacttgctacgcttagaaaattgtgtattgaaggcaaaataacaaacattactactgattcaaggtgccctacacaaggagaggcagtactccctgaagaacaagaccaaaactacgtttgcaaacatacgtacgttgacagaggatggggaaacggatgtggactattcggtaaagggtctctcgttacatgcgcaaaattccaatgccttgagcccatagaaggaaaagtcgtacaatacgagaacctcaaatatacagttataattacagtgcatactggagaccaacaccaagtaggcaacgagacacaaggagttacagcagaaataacaccccaagcgagtactacagaagcaattctccctgaatacggtactcttgggctagaatgcagtccacggacaggtcttgactttaatgagatgatattgctaacaatgaagaataaggcgtggatggtccatcgccaatggttctttgacttacctcttccatggacatcgggcgctacaactgaaactcctacctggaaccgaaaggaactccttgtaacgttcaagaatgctcacgcaaagaaacaagaagtagttgtgttaggctcccaagagggtgccatgcacacggctttaactggagcaacagaaattcagaatagcggaggaacttccatttttgcagggcatttaaaatgtagattaaaaatggataagctagaactaaaaggaatgtcatatgcaatgtgcacaaacacattcgtactgaagaaggaagtgtcagagacacagcatggaacaatactaataaaagtagagtacaaaggtgaggacgctccatgtaaaataccgttttcaaccgaagacggccaaggtaaagcacacaatggacgcctaatcacagctaatcctgtggtaactaagaaagaagaacctgtcaatattgaagcagaaccacccttcggagaatcaaacatagttatcggaataggtgacaatgccttaaagataaattggtataagaaaggaagttcgattggaaaaatgttcgaggccacagctagaggagctcgtagaatggcaattttaggagatactgcatgggattttggctcagttggcggagtcctaaattccctaggaaaaatggtacaccaaatatttggatctgcgtatactgcactatttagtggggtaagttgggtcatgaaaattggcataggtgtgcttcttacttggatagggctaaattccaaaaatacttcgatgagtttttcgtgtatagcaataggaataattactttgtacttaggagcagttgtacaagcggacatgggctgcgttatcaattggaaaggtaaagaattgaagtgcggaagtggcatttttgtaacaaacgaagttcatacttggacagaacaatataaattccaggccgattcacctaaaagattagcaactgctatagccggtgcatgggaaaatggcgtttgtggaatccggtctacgacaagaatggaaaatctcctctggaaacaaatcgcaaacgaattaaactatatactctgggagaacaatattaaactaacagtggtagtaggtgatatcataggtgtattagaacaaggaaaaagaaccctaacacctcaaccaatggaactgaaatattcgtggaaaacatggggaaaagcaaaaattgtgacagccgaaactcaaaattcatccttcataatagatggtccgaacaccccagaatgcccctcagcgagtagagcatggaatgtatgggaagtcgaagactatgggttcggagtatttacaactaatatctggctaaaactaagggaagtatacactcagttatgtgatcataggttaatgtcagctgcagttaaagatgaaagagcagtccatgctgacatgggttattggatagaaagtcagaaaaacggttcgtggaaattagaaaaagccagcttaatagaggttaaaacatgtacgtggccgaaatctcataccctgtggtcaaacggcgtgctcgaatcagacatgattatacccaaatccttagcaggccccataagtcaacacaattaccgaccaggctatcatacacaaacggcaggcccatggcatttaggaaaattggaattggactttaactattgtgaaggtacaacggtggttatcacggaaaactgtggaacaaggggcccatcgctaagaacgactacagtttcaggtaagttgatacatgaatggtgttgtagatcatgtacactgccccctctaagatatatgggggaagatgggtgttggtacggcatggaaattcgacctataagcgaaaaagaagaaaatatggttaaatcactggtgtcagccggatcaggaaaagtcgataactttacaatgggagtactatgtttagcaattttgttcgaagaggtaatgagaggaaaatttggcaagaagcatatgatagccggtgtattctttacattcgtactgctactttcaggtcagataacatggagggacatggcacacacgttaataatgattggctccaatgcatcagatcgtatgggtatgggagtaacatatctcgcgctaatagctacattcaagattcaaccgtttttggctctggggtttttcttaaggaaacttacctcacgggaaaacctccttctgggtgttggcttggctatggccactacactccagcttccggaagatatagagcagatggctaatggcatagcactcggtttaatggctttaaaactgataacacagtttgaaacatatcaactatggacagccttaatatcattgacttgttccaacacaatctttaccctgacggtggcttggagaactgcaacgctaatcttggcaggagtttcacttttaccagtatgccagtcctcatcaatgagaaagacagattggttgcctatgactgtggcggcaatgggagttccaccgttaccgctgtttatcttctcgctgaaagatacacttaaacgtcggtcttggccacttaacgaaggggtaatggctgtcgggcttgtgagtatcctcgcaagctctcttttacgtaatgatgtaccgatggcaggaccattggtcgccggtggactgctaattgcgtgctatgtaattacaggtacatctgcggatttaacagtcgaaaaagcagcagacgtgacatgggaagaagaagccgagcaaacaggagtttctcacaacttaatgataaccgtcgacgacgatggaactatgcgtattaaagatgatgagacggaaaatatattaacagtgcttttaaaaacggctctccttatagtgtctggaatcttcccttactcaatacctgcaacactcctagtatggcatacatggcagaaacaaactcagcgtagcggggtactgtgggacgtaccatctccccctgagacacaaaaagccgaactggaagaaggtgtataccgtataaaacaacaaggcatttttggtaaaacacaagttggagttggcgtacaaaaagaaggcgtatttcacacgatgtggcatgtgacgcgaggcgcagtattaacttataatgggaaacgacttgaaccaaattgggcctctgtgaaaaaggatttaattagctacggaggaggttggagattgagtgcccaatggcaaaagggcgaagaagtccaagttatagctgttgaacctgggaaaaatcccaaaaatttccaaacgatgcccggaaccttccaaacgaccacaggtgaaataggtgcaatagctcttgactttaaaccaggtacttctggctctccaataattaatcgcgaaggaaaagtagtaggattatacggaaacggagtagtgactaaaaacggagggtatgtgagcggcatagcgcaaacgaacgctgaacccgatggcccaacacctgaattggaagaagaaatgtttaaaaagcgaaatctgacaataatggacctccatccaggaagtggaaagactcgaaaatacctacccgccattgttcgtgaagcgataaaaaggcgtttaaggaccttaattttggcgcctacacgagtagtggcagctgaaatggaagaagcacttaaaggtttgccaattagataccaaaccactgcaacaaagtccgaacacaccggacgtgaaatagtcgatttaatgtgccacgcgactttcacaatgagattactctcaccagtgcgcgttccaaactataatttaatcataatggatgaggctcattttactgatccggcatcaatcgctgctagaggatatatatcaacccgggtaggaatgggggaagcagccgccatcttcatgaccgctacaccaccagggacggcagatgcattccctcagtccaacgctccaattcaagatgaagaaagagatataccagagaggtcgtggaactccggcaatgaatggataacggactttgcgggcaaaaccgtttggtttgtcccatcaatcaaagctggcaacgatatcgctaactgcttaaggaaaaatggcaagaaggtaatacaattgtcaaggaagacgtttgacacagagtaccagaaaacgaaactaaacgattgggattttgttgtaactactgacattagcgaaatgggcgcaaattttaaggcagatagagtcattgatcccagaagatgcctcaaaccggtgatccttacagatggtccggaaagagttatacttgcaggaccaatgccggtaactgcagcaagcgcagcccagcgtcgtggtcgcgtcgggcgtaacccccagaaagaaaatgaccaatacatttttactggtcaaccattgaacaatgatgaagatcatgctcattggacagaagcaaaaatgttgttagacaacataaatacgccagaaggtataattccagccttattcgaaccagaacgagagaaaagcgcagcaatagatggtgagtacagactgaaaggcgaatcccgaaaaacatttgttgaactaatgcgtcgaggcgatctaccagtttggctagcacataaggtggcatctgaaggtataaagtacacagaccgaaaatggtgcttcgatggacaaagaaacaaccaaatcctagaggaaaatatggatgtagaaatttggacaaaagaaggcgagaaaaagaaactaaggccaagatggctcgacgctcgaacatattcggacccactcgctctaaaagagtttaaagacttcgctgctgggcgtaaatccatagcattagaccttgtaacagaaatcggacgcgtcccctctcatttagctcatagaacacgtaatgctctagacaaccttgtgatgttacataccagcgagcatggcggaaaggcttatagacacgccgtggaggaactaccagaaacaatggaaaccttactcttactaggcttaatgatattgctgacagggggagcaatgcttttcttaatatcaggaaaaggtatcggaaaaacttccataggcttgatatgcgttattgcaagcagcggaatgttatggatggccgaaatacctctacaatggattgcatctgctatagtccttgagttctttatgatggtcttactcataccagaaccagaaaaacagagaacgccacaggataatcaacttgcatacgttgtaataggcatactaactctagctgctacaatagcagccaacgaaatgggattattagagacaacaaaacgggaccttggaatgtcaaaagagccaggtgtcgtgagtccgaccagctatttggatgtagacttacatccagcatctgcttggacactttatgcagttgcaacaacggtaataacaccgatgttgcgtcatacaattgaaaatagtacagcaaatgtgagtctggcggcaatcgccaaccaggccgtagtcttgatggggttagataaaggatggccaatatctaaaatggatttgggagtaccattactagcgctggggtgttacagccaagtcaacccacttactctaacagccgctgtacttctgcttataacacattacgcaatcatcggtcctggtctacaagcaaaagcaacacgggaagcgcagaaaagaacagccgcagggataatgaaaaatcccacagtagatggaataatgacgattgacttagatcctgtaatatatgattcaaaatttgaaaagcaattaggccaggtgatgttattagttctttgtgcagtacaactgttattaatgcgcacctcatgggctctatgtgaagcactgacgttagccactggtccgataaccaccctgtgggaaggatcacctgggaaattttggaacaccactatagcagtatcgatggcgaacatattcagaggatcttatctagctggagcgggattggcattttcaataatgaaatctgtaggtacaggaaaaagagggactggttcccaaggggagacgctgggagaaaagtggaaaaagaaattaaaccagctttcaagaaaagagttcgacctttacaaaaagtctgggataactgaggtggacagaacagaagcgaaagaggggctaaaaagaggcgaaataacacaccacgcagtatcaagagggtctgcaaaactgcaatggttcgtagaacgtaatatggtaatcccggaaggaagagtaatagatctaggctgcggtcgaggcggatggtcatattattgcgccggacttaagaaagtaacagaagtacgtggctacacgaaaggaggccctggccatgaggaacccgttcctatgtccacttatggatggaatatcgtaaagttgatgtcaggtaaagatgtattctacctaccccctgaaaaatgcgatacattactttgtgatatcggggagagttcaccaagcccaacggtagaagaatccagaactatacgtgtcctaaaaatggtcgagccttggctcaaaaataaccaattctgcataaaagttctaaacccttatatgccaacagttatcgaacatttagagcgactacaaaggaagcacggaggtatgttagtgagaaatcctctaagccggaactcaactcatgaaatgtattggatatcaaatgggactggaaatatcgtggcttcggtaaatatggtatcgaggttactgcttaatagatttacaatgactcataggaggccgactatcgaaaaggacgttgatttaggcgctggaacccgtcacgttaacgccgaaccggaaaccccgaacatggatgtaatcggagaacgaataaaacgaataaaagaagaacataatagtacatggcattatgacgatgaaaacccgtataagacatgggcgtatcacggatcctatgaagtgaaagccacaggtagcgcttcatcgatgattaatggtgtggtgaaacttttgaccaaaccctgggatgtagttccaatggtaacccagatggccatgactgacactaccccatttggacagcaacgtgtctttaaggaaaaggtcgacacacgaacacctcggtccatgccaggtaccaggagagtaatgggaattacagccgaatggttatggcgcaccttgggaaggaacaagaaaccaagactatgcacacgtgaagaatttaccaagaaagtgaggactaatgcagcgatgggagccgtattcactgaggaaaaccaatgggatagtgctaaggcagcagtagaagatgaggatttctggaaacttgtggatcgcgaaagagaattacacaaattgggtaagtgtgggtcatgtgtttataatatgatgggaaaacgtgagaaaaagctaggagaatttggtaaagccaaaggatcacgcgcgatatggtacatgtggcttggagccagatatctagaatttgaagcattaggattcctaaatgaagatcattggttttcgagagaaaacagttattcaggcgtagagggagaaggcttgcacaagttgggctacattctgcgtgatatatctaaaataccaggaggagcgatgtatgccgatgacacagctggctgggacacaagaattacagaagacgacttacataatgaagagaaaataacacaacaaatggatccagagcatagacagttagccaatgcaatatttaaactaacataccagaacaaagttgtgaaagtacagcgaccgaccccaacgggaaccgtgatggatataataagccgaaaagaccaacggggatcgggccaagtaggcacctatggtttgaacacgttcactaacatggaggcacagctcatcaggcagatggaaggcgaaggagtattatcaaaagcagatttagaaaaccctcaccttcctgagaagaaaataacgcagtggctggaaactaaaggtgtggagagattaaaacgaatggcaatatcaggcgatgactgcgtagtaaaaccgatagatgatcggttcgctaacgccttacttgcccttaatgacatggggaaagttagaaaagatatccctcaatggcaaccctctaagggatggcacgattggcagcaggtaccattttgcagccaccactttcacgagttaataatgaaagatggccgtaaattagtagtaccttgccgaccacaagacgagctaatcggacgcgcaagaatttcgcagggagcgggatggtcattaagagaaaccgcatgtttggggaaagcatacgctcagatgtggaacctaatgtatttccacagacgggacctaagattagcctcaaatgcaatatgtagtgctgttccggttcactgggtcccgacttcccgtacaacttggagcattcatgcacaccatcaatggatgacaactgaggatatgctaactgtctggaacagggtatggatagaagataacccttggatggaggacaaaactccagttactacgtgggaaaatgtaccgtacttgggcaagagagaagaccaatggtgcggctcattaattggattaacgtcacgagcgacttgggctcaaaacatacctactgctattcaacaagtcagatcactgataggaaacgaagaatttctcgactatatgccctccatgaaaagatttcgaaaggaagaagaaagtgaaggtgcaatatggtaa

SEQ ID NO: 23364 - RNA, 9873 nt, synthetic construct
  misc_feature 1..9873: note = derived and/or modified CDS sequence (opt6) from DENV-3__FJ547078__SS-prME
  source 1..9873: mol_type = other RNA
acgagtctttgtttgatgatgattttgccagccgcactcgcctttcacttaacttcccgagatggtgaacccaggatgattgtcgggaaaaacgaacgagggaaatctttgctattcaaaacggcctcagggataaacatgtgtactcttatcgcgatggatctgggcgaaatgtgtgatgatacagtcacctacaaatgtccgcacattactgaagtagaaccagaagacatagattgttggtgtaatcttacaagcacttgggtgacctatggaacttgcaatcaagctggagaacatagacgcgataaaagatccgtcgctttagctcctcatgtaggcatgggtcttgataccagaacacaaacctggatgtccgcagagggagcatggcgtcaggttgaaaaagtagaaacgtgggccttacgacatccaggatttacaattctcgcactatttttagcacactacataggaacgtcactaacgcaaaaagtggtaatatttatactattaatgctagttacgccctcaatgacgatgaggtgtgtaggagtaggaaatagagacttcgtagagggtctatccggagcaacgtggatagacgtagtacttgaacatggcggttgcgtgaccactatggctaaaaataaaccgacgcttgacatagagctacagaaaactgaagcgacacaattagccacactaagaaaactttgtatagagggaaaaataacaaacattactactgactctagatgtccgacacaaggcgaagccgtcttacccgaagaacaagaccaaaattatgtatgtaaacacacgtatgttgatcgtgggtggggtaacggctgtggactatttggtaaaggtagtctcgtgacatgtgctaaatttcaatgtctcgaacccattgaaggaaaagttgtgcaatatgagaatttaaaatacacagtaataataacggttcatacaggagatcaacatcaagtcggaaatgagacccaaggtgtaacggccgaaataacgccacaagcaagcacaaccgaagccatattacctgagtacggtacactaggtttagaatgttcaccccggacggggctagattttaatgaaatgattctacttactatgaaaaataaagcctggatggtgcataggcagtggttcttcgacttaccacttccgtggacatcgggagccactacagaaactcctacctggaatcgtaaagaacttttggtaacatttaaaaatgcacacgctaagaaacaagaagtagttgtacttggtagtcaagaaggcgcaatgcatacagctctgacaggggcgaccgagatacagaacagtggaggcacctcaatatttgcaggacacctcaaatgccgtctgaaaatggacaaacttgaactaaaaggcatgtcgtatgctatgtgtacaaatacatttgtgcttaagaaagaagtaagtgaaacacagcatggaacaatattaataaaagttgaatataaaggagaagacgttccttgcaaaatcccatttagcaccgaggatgggcaaggaaaagcacataatgggcgtcttataacagcgaaccccgttgtgaccaagaaagaggaacccgtcaatatcgaagcagagcctccgtttggagaatccaatattgtcatcggtatcggggataacgcattaaaaattaattggtacaagaaaggatcatcgattggaaaaatgttcgaagctaccgccagaggggctcgtagaatggcgattttgggagacacagcatgggatttcggaagtgtaggaggggtgttgaactccctaggaaaaatggtacaccaaattttcggttccgcttatactgcactattctcgggagtaagttgggtcatgaaaataggaattggtgttttattgacatggataggactaaactcgaaaaatacctcaatgtcttttagttgtatagcaattggtataattaccctatacttaggagcggtagttcaagctgatatgggatgtgtcataaactggaaaggaaaagagcttaaatgtggttcagggatatttgttacaaacgaggtacatacttggactgaacaatataaattccaagcagactcaccaaaacggctggcaaccgctattgcgggagcgtgggaaaatggcgtgtgtgggattcgatccacgacgagaatggaaaaccttttatggaaacaaattgcgaatgaattgaactacatattgtgggaaaacaacataaaattaacagtcgttgtaggagatatcataggcgtgctggaacaaggtaaacgtactctaactccccaaccaatggaactaaaatatagttggaaaacctggggtaaagctaagattgtcaccgccgaaactcaaaactcttcattcataattgatggtccaaacaccccggaatgtccgtcagcatcaagagcatggaacgtatgggaggttgaggattatggattcggagtgttcacaacaaatatatggctaaaacttcgagaagtttatactcaactttgcgaccaccgcttgatgtcggcggcagtaaaagatgaacgggctgtacatgctgatatgggatactggattgaatctcagaaaaatggttcgtggaaattagaaaaagcatctctaattgaagtaaaaacttgcacatggccgaaatctcatacattatggtcaaatggtgttttggaatctgatatgatcatcccgaaatcgttagcgggtccaatcagccagcacaattatcgcccagggtaccacacacaaaccgcaggaccgtggcatctaggcaaactagaattagactttaactattgcgaaggaacaacggtcgtgataacggagaactgcggaactagaggaccatctcttcggacaacgactgtatcgggcaaattgatccatgagtggtgctgccggtcctgtaccttaccacctttgaggtatatgggagaagacgggtgctggtatggcatggaaatccgcccaataagtgaaaaagaagagaatatggtaaaatcactggtctctgccggtagcgggaaagtcgacaacttcacaatgggagttctttgtttagcaatattgtttgaggaagttatgagaggaaagttcggtaagaaacacatgatcgctggggtattctttaccttcgtgttactgctttcaggacaaataacctggcgggatatggcccacactttaatcatgataggatccaacgcctcggatcgtatgggaatgggagttacttatctagccttgattgccacattcaagatacaacctttcttagcccttggattcttcttgcggaaactcacttcaagagagaacctccttctgggggtgggtctagcaatggcgactacattacaactaccagaagacatagaacaaatggcaaacggaattgccctagggttaatggcactcaaattaattacccaattcgaaatctatcaattatggaccgcgctgatatcgttgacatgctcaaataccatattcacactaacagtagcctggaggacagcaacacttattctggccggggtatcgctcctcccagtatgccaaagctccagtatgcgtaagactgactggctgcccatgactgttgccgctatgggggtgccacctctccccctatttatattcagcttaaaagatacattaaagcgtagatcctggcccctaaatgaaggcgtaatggctgttggtcttgtctctatcctagcatcctcattactcaggaatgatgtgccaatggcaggacctttagtagcagggggactgttaatagcgtgctatgtaattacaggtacatctgcggacctcacagtggaaaaagctgcagatgtaacttgggaagaagaagctgaacaaacaggcgtttcacataatttaatgataactgtagacgatgacggaacaatgagaatcaaagatgacgaaactgaaaatatactaacagtattattaaaaacagcactattgatagtatcagggatattcccatattcaataccagctacattgctcgtctggcacacctggcaaaagcaaacgcagagatcgggtgttttatgggacgtaccatcaccaccagaaacacagaaagctgagcttgaggaaggtgtataccgaattaaacaacaaggcattttcgggaaaacgcaagttggcgtgggggttcaaaaagagggtgtatttcacactatgtggcatgtaactagaggagcagtattaacttacaatggcaagagattagaacccaactgggcatcagtgaagaaagacctaatttcatacggaggaggatggagactatcagcacaatggcaaaagggcgaagaagtacaagttatagcagttgaaccaggaaagaacccgaaaaacttccaaaccatgccaggtacttttcagactaccacaggggaaataggggcaatagcattggattttaaaccggggacaagtggatcaccaataatcaatagggaaggaaaagtagttggtctttatggcaatggcgtggtgacaaagaatggagggtacgtttcgggcatcgcgcaaaccaacgcagaaccggacggtccgactcccgagctggaagaagaaatgtttaagaagcgaaatttaaccattatggatttgcatccaggctcgggaaaaacgcgcaaatacttaccagcaattgtaagagaagccattaaacgtagattgcgaaccttaatactagctccgacccgtgttgtcgcggctgaaatggaagaggctttgaaagggttgccgatcagatatcaaactactgctacaaaatcagaacatacaggtagagaaattgtagaccttatgtgtcatgctacattcacaatgcggcttttaagtccagtgagagtccccaattacaatttgataataatggacgaagcacatttcacggatccggcaagcatagcggcacgaggatacattagcacaagagtcggtatgggcgaagccgccgctatcttcatgacggcgacaccacctgggacggctgatgcgtttcctcaaagcaatgcacctatacaggacgaagaacgtgacataccagaacgaagctggaactccggaaatgaatggataacagattttgcgggtaaaaccgtatggttcgtgccatccataaaagctggaaatgatatagcaaactgccttagaaagaatggtaagaaagtaatacaattatcgagaaaaacttttgatacagaatatcagaaaacaaaactaaatgattgggacttcgttgtaaccactgatatttcagaaatgggagcgaatttcaaagcagatagggttattgatcccagaagatgcttgaaaccggtcattttgacagatgggcctgaaagagtaatacttgctggaccaatgccagtaacagctgcatcagcagcacaacgaagaggaagagtaggtagaaatccacaaaaagaaaatgatcaatatatctttactggccaacccttaaacaatgatgaagatcacgcccattggaccgaggccaagatgttgctagataacataaacacaccagaagggataattccagcattatttgaaccagagagggagaaaagcgcggcaattgacggagaatatagactaaaaggggagtcaagaaaaacttttgtggaactgatgcggagaggagatctacctgtgtggttggctcataaggtagctagtgaaggtatcaaatacactgatcgtaaatggtgttttgatggccaacgtaacaaccagatactcgaagaaaacatggatgtagaaatatggacgaaggaaggagagaaaaagaaactgcggccaagatggcttgatgcccgaacatattctgatccacttgcactcaaagaatttaaagattttgcggcaggacgcaagtctatcgcgttggatttagtaactgaaataggcagagtacccagccacttggctcacagaacaaggaacgctcttgacaacttagttatgctacacacaagcgaacatgggggaaaagcctacagacacgcagtagaagaattacccgagactatggaaacattgttacttcttggtcttatgattctgttaacaggaggggctatgctctttctaatttcagggaaaggaatcggtaagacgtccataggactaatatgtgtaattgcaagtagcggcatgctatggatggcagaaatcccattgcaatggatagcctcagcgattgtcttggagttctttatgatggtactattaataccggaacccgaaaaacaacgtacgccacaggataatcagttagcctacgttgtgatcggaattttgactcttgcagccattatcgctgcgaacgaaatgggcttattggaaacaacaaagagagatcttggtatgtcaaaagaacctggcgttgtatcacccacatcatacctagacgtagacttacatccagcgagcgcatggacactttatgcagtagcaacaacagtaattacacctatgctaagacatactatcgaaaattctaccgctaatgtatcactagctgcaatcgcaaatcaagcagtagtgctcatgggactcgataagggatggcccattagtaaaatggatcttggtgtccctttattagctctgggatgctattcacaagtaaatcccttgacattgacagcagcagtcctactgcttattacacactacgctattatcggtccagggcttcaagcgaaggccacgagagaggctcagaaaagaactgcagcggggataatgaaaaacccgacggttgacggtattatgaccatagatttggaccctgtgatctatgatagcaaatttgaaaaacagctagggcaagtaatgttacttgttttatgtgccgtccaattacttctaatgaggaccagctgggcactatgcgaagctctaacattggctaccggccctataactactctgtgggaaggctcaccaggcaagttttggaatactacgatagcagtgtctatggccaatatttttagaggttcctatctagcaggagctgggctggccttttcgataatgaagtccgtcggaacagggaaaagaggtacaggttcacaaggtgaaacattgggcgaaaagtggaagaagaaacttaatcagctttcaagaaaggaatttgacctatataagaaaagcgggataactgaggtggatagaacagaagcgaaagagggactaaaacgaggagaaataactcatcacgcggttagtcgaggctccgcgaaactgcaatggtttgtagagcgaaacatggtcataccagaaggtcgagtaatagatttaggatgtgggcggggcggatggagttactactgtgccggactcaaaaaggtaactgaagtgagagggtatactaagggaggaccaggccatgaggaacccgtaccaatgagcacatacgggtggaatatcgtaaaattaatgtcgggtaaggacgtcttctatttacctcccgagaaatgtgatacgctgctctgtgacatcggagagagttcaccctctcctacagtggaggaatctaggacgataagagttctgaagatggttgaaccttggctcaaaaacaatcagttctgcattaaagtactaaacccgtatatgcctacagtcatagaacacctagaacgtctacagagaaagcatggcggaatgttggttaggaacccgttaagccgtaacagcacccacgaaatgtattggatttctaacggaaccggaaatatcgttgcttccgtaaatatggtctcccgcttattattgaacagattcactatgactcatagaagacctacaattgagaaagatgtggacttaggcgcaggcacgagacatgttaacgcggaaccagaaactcctaatatggatgtcatcggggaacgaatcaaacgaataaaagaagaacataattccacttggcactacgacgatgaaaacccttataagacctgggcatatcacggtagctatgaagtaaaagccactggaagcgccagctcaatgataaatggagtagttaaactgttaacaaaaccttgggacgtggtaccaatggtaacgcaaatggcgatgacagacaccacaccgtttgggcaacaaagagtctttaaggagaaagtcgatacaagaacgccaaaatcaatgcccggtactagaagagtaatgggtataacggccgaatggctctggaggacattagggcgtaataagaaaccaaggctgtgtacgagagaagaatttacaaagaaagtaagaacaaatgcagccatgggggcggtgtttaccgaggaaaatcaatgggactcggcaaaagccgcagttgaagacgaagatttttggaaattggtcgatcgcgaacgggaattacataaactaggtaaatgtggaagctgtgtctacaatatgatgggcaagagggagaagaaattaggggagttcggaaaagcaaaaggcagccgagctatatggtatatgtggctgggagctagatatctagaatttgaagctctaggattcttgaatgaggaccactggttttcacgagagaactcatattctggggttgaaggcgaagggttacataaacttggatacattttgcgagatattagtaaaattcctggaggagcaatgtatgcggacgataccgctggttgggatacaagaataaccgaagatgacctacacaacgaagagaaaatcacccagcaaatggatcccgaacatcgacaacttgctaatgcaatattcaagctaacctatcaaaacaaagttgtaaaagtacaaagacctacaccaacagggaccgtgatggatattatatcaagaaaggaccagcgagggtccggacaggtaggaacgtatgggctcaatacatttaccaatatggaggcgcagctcatccgtcagatggaaggagaaggagtattatctaaagcggatctagaaaatccccacttgcccgagaagaaaatcacgcaatggttggaaaccaagggcgtagaaaggttaaaacgtatggcgatatctggcgatgattgtgtcgtaaaaccaatagatgatcgctttgctaatgctttgctagcccttaacgatatgggaaaagtgaggaaggatataccgcaatggcaaccatcaaaggggtggcatgactggcagcaagtacccttctgctcacatcattttcatgaactaatcatgaaagacggtagaaaattggtcgtaccctgtagacctcaagatgaactgattgggcgggcaaggatttcacaaggtgcaggatggtcactgagagagactgcatgtctcgggaaggcttatgcacaaatgtggtccctgatgtactttcatagaagagatttaaggttagcatcaaatgccatttgttcagctgtacccgttcattgggtaccaacttcacggaccacatggtcgattcacgcacatcaccaatggatgacaacggaggacatgttaacggtttggaatagagtttggatagaagacaatccttggatggaagataaaaccccagttacaacatgggaaaatgtaccatacttaggcaaaagagaagatcaatggtgtgggtcactaatcggtcttaccagtcgagcaacatgggcacagaatatacctactgcaatacaacaggtaaggtcactgattggaaacgaagaatttttagattatatgccttcaatgaaacgttttcggaaagaagaagaatctgaaggtgccatatggtag

SEQ ID NO: 23365 - RNA, 9873 nt, synthetic construct
  misc_feature 1..9873: note = derived and/or modified CDS sequence (opt6) from DENV-3__FJ547079__SS-prME
  source 1..9873: mol_type = other RNA
accagtttatgtctaatgatgattttacctgcagctttagctttccatcttacttcccgagatggggaaccacgtatgattgtaggcaaaaacgaaagaggaaaatcactactattcaaaactgcgtctggtatcaacatgtgcacgctgatagcaatggatttaggagaaatgtgtgatgataccgtcacatacaaatgcccccatataacagaagtagaaccagaagacatagattgttggtgtaacctcacatcaacctgggtaacttatggcacatgcaatcaagcaggagaacaccgccgcgacaaaaggagtgtggcattagctccccatgttggaatgggtcttgacacaagaacacagacgtggatgagcgcagaaggagcgtggaggcaggtagaaaaagtagaaacttgggcattacgtcacccgggatttacaattctagctttgtttttagctcattacataggaacatccctaacgcaaaaagtagttatatttatattattaatgctcgtgaccccctctatgaccatgcgatgcgtaggagttggaaatcgggattttgtggaaggattgtctggggcaacttgggtagacgtcgtattagaacatgggggatgtgttacgactatggccaaaaacaaaccaacgctcgatatagaactccagaaaacagaagcgacccaattagctacattaaggaaactctgcatagaaggaaaaatcacgaacattactactgatagtcgctgccccactcaaggtgaagcagtcttacctgaagaacaggatcagaactacgtgtgtaaacatacctatgtagacaggggatggggaaatgggtgtgggctttttggaaaagggtctctcgtaacttgtgccaaattccaatgcttggaaccaatcgaagggaaagtagtgcagtacgagaatttaaaatatactgttataattacagttcatactggagaccaacatcaggtaggaaatgaaacccaaggagtaacggcagaaattacccctcaagcctcaaccacggaagccattctaccggagtacgggactttaggacttgaatgtagtccaaggactgggttagactttaatgaaatgattcttctgacaatgaaaaataaagcatggatggttcatcgtcaatggttctttgatctaccattgccatggacgtcaggggcgactacagaaacgccgacatggaatagaaaagaactattagttacatttaaaaatgctcatgctaagaaacaagaggtagtggtccttggaagtcaagagggcgctatgcataccgccttgactggtgcaacagagatacagaactctggcggtaccagtatcttcgctggacacttaaaatgtcgccttaaaatggataaattggaactaaaagggatgagttatgctatgtgtaccaatacattcgtcctcaagaaagaagttagtgagacacagcacggtactatactaataaaagtagaatataaaggtgaagatgtcccttgcaaaattccattttcaacagaagacgggcaaggtaaagcacataatggtagattaattacggcaaaccccgtagttactaagaaagaagaacctgttaatatagaagccgaaccacctttcggagaaagcaatattgttataggcataggtgacaacgccttaaaaattaattggtataagaaaggaagttcaattggaaaaatgtttgaggcgacggcacgtggtgccagacgcatggccatccttggcgacacagcatgggattttggttcagtaggaggggtactaaattccctaggcaaaatggtccaccaaatattcggatctgcctacaccgcattattttcaggcgtatcatgggtcatgaaaataggtataggcgtacttctaacttggatagggttaaatagcaagaacacatcaatgtctttttcatgcatagcaataggtattattacactctatctaggggcagtagttcaagctgacatgggttgcgtgataaactggaaaggcaaagaactcaaatgtggctccggtatcttcgtcacaaacgaagtccacacctggactgaacaatacaaatttcaagcagattccccaaaacgcctagccacagcaatagccggtgcgtgggaaaatggcgtgtgtggaatccgttcgacaactcgtatggaaaatttactgtggaaacaaatcgcaaacgaattaaactatatattatgggagaataatattaaacttactgtagtggtaggagacatcattggagtcctcgagcaaggaaagagaactttgacccctcagccaatggaactgaagtactcatggaaaacatggggaaaagcaaaaatcgtcacagcagaaacgcagaactctagttttataattgatggtccgaacacgcctgaatgtccaagcgcgtctcgagcttggaacgtgtgggaagtagaagattatggttttggagttttcaccacaaatatctggttgaaactacgtgaagtatacacacaattgtgtgaccacaggcttatgagtgctgcggtaaaggacgaacgtgcggtccatgccgacatgggatattggattgaatcccagaaaaacggatcatggaaactggaaaaagccagtctaatcgaagtcaaaacttgtacatggccaaagagtcacacactttggtctaatggggttttggaatcggatatgataatacctaagagcttagcgggcccaatatcacaacataattaccggccgggataccatacccaaacggcgggaccatggcacctcgggaagttagaacttgatttcaattactgtgaaggcacgacagtcgtcataactgaaaactgcggaaccagaggtccatcattgagaactacgactgtaagcggcaagttaatccacgaatggtgttgtagatcctgtactcttccaccattaaggtacatgggagaagatggttgttggtatgggatggagatcagacctatctccgaaaaagaagagaatatggtaaaaagtctagtatccgctgggagtggaaaagtcgataacttcactatgggagtcttatgtcttgcgatactgtttgaagaggtgatgcgcggtaagtttggaaagaagcatatgatcgcgggtgtgttctttacatttgtcctacttctttctggacaaataacatggcgagacatggcacatactttaataatgatcgggtccaatgcctctgatagaatgggaatgggagtcacgtatctcgcattaatcgcaaccttcaaaattcaacccttcttggcgctagggttctttcttagaaagctaacatcacgagaaaatttactgttaggagtcggtctcgcaatggctaccacacttcagcttccggaggatatagaacaaatggcaaatggaatagcgcttggcttaatggcactaaaactaataacacaatttgaaacgtatcaactatggacagcgttaatcagtttaacgtgtagcaatactatatttaccctaacagtagcctggcgtactgcaacgctaattttagccggggtctcgttattgccggtttgccaaagctccagcatgagaaaaaccgattggttacctatgaccgtggccgctatgggagttccaccgttgccattatttatttttagtttaaaagatacattaaagaggagatcatggcctcttaatgagggagtaatggctgttggacttgtgagtattttagcatccagcttactcaggaatgatgtaccaatggcggggcctctagtagcaggagggctgcttattgcctgttatgtaattactgggacctcagctgacctcacagttgaaaaagcagcagatgtcacttgggaagaagaagccgaacaaacaggagttagccacaatctgatgataactgtagacgatgatggtacaatgagaattaaagacgatgaaacagaaaatattctcacggttttactcaagacagctctcttgatcgtaagcggaatcttcccatattcgattccagcaacattgcttgtatggcacacatggcacaaacagactcaacggagcggagtcctttgggatgttcccagtccacctgagactcagaaagcggagcttgaagagggagtttatcgaattaaacaacagggaatatttgggaaaacacaagtaggcgtaggtgtacaaaaggaaggtgtttttcacacaatgtggcacgtaacacgtggtgctgtcttgacatacaacgggaaaaggttggaaccaaattgggcaagcgtgaagaaagatttgatttcttatggaggcggttggcgtctgtcggcacaatggcaaaaaggcgaagaagtacaggttatagccgtagaacccgggaaaaacccgaaaaacttccaaacgatgcctggtacgtttcaaacaacgaccggtgagataggagccatagccttagactttaaaccgggtacaagcgggtcaccaataataaatagagaaggtaaagtagtgggtctatatggaaatggcgttgttaccaaaaatggaggttacgtcagtgggattgctcaaacaaatgcagagccagatggaccaactcccgaactagaagaagaaatgtttaagaaacgaaatctaacaatcatggatctacacccaggatcgggtaagactcggaaatacttgccagcaatagtgagagaagcaattaaacgtagactcagaacactaatattagctcctacccgtgtagtcgctgcggaaatggaagaagcattgaaaggtttaccaatccgatatcagacgacagctacaaaaagtgaacatacaggccgagaaatagtagacctaatgtgtcatgcaacgtttactatgcggcttttatcgccagtgcgcgttcctaattataatctaatcattatggacgaagctcatttcaccgacccggcatctattgcggctaggggctatatcagcactcgtgtaggaatgggtgaggcggcagcaatttttatgactgcaacaccccctggtacggccgacgcatttccccaaagcaatgcacctatccaagacgaagagagagacataccagaaagatcatggaactcaggaaacgaatggattacagacttcgcagggaaaacagtttggtttgttccgtcaataaaagcaggtaatgacatagctaattgtttacgtaaaaacggcaagaaagttattcaactgtcgagaaagacctttgacactgaatatcagaaaacgaaattaaacgactgggattttgtggtgacaactgatatctcagaaatgggagcaaatttcaaagccgatagagttatagatccacgtaggtgtttaaagcctgtaatactaacagacggaccagagagggtgattttagccggacctatgccagtaacggcggcatcagccgcacaaagacggggacgagtgggaaggaacccacagaaagaaaatgatcaatacatcttcacagggcaaccattaaacaatgatgaggatcatgcacactggaccgaagcaaagatgttattagataatatcaacactccagagggtatcattcctgccctgttcgaaccagaacgagaaaaatcagctgctattgacggcgaatatcgactaaaaggagagagtcgaaagacattcgtagaattaatgagaagaggagatctccctgtgtggctagcgcataaagtcgcatcggaaggaatcaaatacaccgatagaaaatggtgcttcgatggccagcgtaataatcagatattggaagagaatatggatgtcgagatatggaccaaagaaggagagaaaaagaaacttcgtccgcggtggctagacgcaaggacttattcagatccactagcgttaaaagaatttaaagatttcgcagcgggtcgtaagtcgatagcattagacctagtaactgagataggccgtgtgccgagccatctagctcatcggaccagaaatgcactagataatttagtaatgttacatactagcgagcacggaggaaaggcatacagacatgctgtagaggaactacccgagacaatggaaacattactattactgggtttaatgatattacttactgggggcgctatgctttttctaatatctggaaaaggcataggcaaaactagcataggtttaatatgtgttatagcctcgtcaggaatgctttggatggctgaaattcctttacaatggatagcaagcgctattgtcctcgagtttttcatgatggtgttactaataccagaaccagaaaagcagcgcactccgcaagataatcaacttgcttatgtggtgattggaatcctaaccctagctgcgatcatagccgcgaacgagatgggactattggaaactacaaaaagggacctaggaatgtcaaaagaaccaggggtagtttcgccaacctcttatttggatgtagaccttcatccagctagtgcctggaccttgtatgctgttgcaacaacagttataactccaatgttgagacatacaatagaaaattcaaccgcaaacgtaagccttgcagcaattgcaaatcaagcagtagtactgatgggactggataagggatggccaatctctaaaatggatcttggagtaccacttcttgcccttggatgttattctcaagtaaatcctctaacattaactgctgcggtcctattgctaataacacactacgcaataataggacccgggctacaagctaaggctacaagggaagctcagaagcgtacagcagcagggattatgaaaaatcctacggtagatggaatcatgacaatcgatttggatccagtaatatatgacagtaaatttgaaaagcaactaggtcaggtcatgctgctcgtactatgcgcagttcagcttctcctaatgcgaacttcctgggcgctgtgtgaagccctcactctagccacgggaccaataacgaccctttgggaaggatcaccaggcaaattttggaatacaacgatagccgttagtatggcgaatatattccgagggtcttatttagccggtgctggcctagcgttcagcattatgaaatcagtcggaaccggtaaacgcggcaccggatcgcaaggtgaaactctcggtgaaaaatggaagaagaaacttaatcagttgtcaagaaaagagttcgacctttacaagaaatctggcataacagaagtagaccgaacagaggctaaagaagggctaaaacgtggtgagatcactcatcatgccgtaagtagaggtagtgccaaattacaatggtttgtggaacgtaacatggtcatcccagaaggcagagtaattgatttaggatgtggtcgaggagggtggtcctattactgcgcgggactcaagaaagtgacagaagtaaggggatatacaaagggcggccctggacatgaggaacctgtaccgatgagtacttacggttggaacatagtcaaactgatgagtggtaaagatgtattttacctacctccagaaaagtgcgatactttgttatgcgatattggcgaaagctcacccagcccgacagtagaagaatcaaggacgatccgagttttaaagatggtggaaccatggttgaaaaataaccagttttgcattaaagttctaaatccatatatgcctactgtgatagaacacctagagagattacaacgaaagcatgggggaatgctagtacgcaacccattaagccgtaactcaacacatgaaatgtactggatatcgaacggcacaggtaatatagttgcaagcgtcaatatggtatcacgcctattactgaatagatttactatgacgcatagaagaccaaccattgaaaaagacgtggacctcggcgcaggaactcgacacgttaatgcggaacccgaaacacccaatatggatgtaattggagaaaggatcaaacgtatcaaagaagaacataattcgacttggcattacgacgatgaaaatccatataaaacatgggcctatcatggatcgtacgaagtaaaggctacaggatcagcttcatccatgatcaatggtgtagtcaaactcctgactaaaccgtgggatgtcgttccaatggttacacaaatggcaatgacagacacgactccttttgggcagcaacgagtatttaaagaaaaggttgacaccagaacaccgcgatcgatgccaggcacgagacgggtcatgggaataactgcggaatggctctggagaactttagggagaaataagaaaccacggctctgtactagagaagagttcaccaagaaagtgcgaactaatgcagcaatgggagccgtctttacagaagaaaatcaatgggatagtgccaaagcggcggtagaagatgaagatttttggaagttggttgacagggaaagggaattacataagttgggcaaatgtgggtcatgtgtttataacatgatgggaaaacgtgaaaagaagttgggtgagtttggaaaagcaaaaggcagtcgcgccatttggtatatgtggttaggagcaaggtacctagaatttgaagcattaggatttctaaatgaagatcattggttctccagagaaaattcctattctggagttgaaggagaaggactgcacaaactaggatatattctcagagatattagtaaaataccaggaggagcgatgtacgcagatgatacagcaggatgggatacacgaataacggaggacgaccttcataacgaggagaaaataacccaacagatggacccagaacatagacagttggctaatgcaatatttaagctaacttaccaaaataaagtagtaaaagttcaaagacctacaccaactggaacggtaatggatattatctcacggaaagatcaaaggggaagtggccaagtaggtacatatggtctcaacactttcactaacatggaggcacaattaatacgtcaaatggaaggcgaaggtgtcctttcaaaagccgatctagagaatccacatttaccggagaagaaaatcacccaatggcttgaaacaaaaggtgttgaacgattaaagagaatggcaatttcgggcgatgattgtgtcgtgaaacctatcgacgacagattcgcaaatgcattacttgcattaaatgacatgggcaaggtaaggaaggatattccacaatggcagcctagcaagggttggcatgattggcaacaagtccccttctgcagtcatcactttcatgagcttataatgaaagatggaagaaaactcgttgtgccatgccgaccacaagatgagttgatagggcgagcacgaattagtcagggggcaggatggtcactacgggagactgcatgtctggggaaagcgtatgcacaaatgtggtcactcatgtattttcataggcgcgatctgcgcctcgcatcaaacgcgatatgcagcgctgtaccggtccattgggtacctacaagtaggacgacatggagcattcatgcccaccaccagtggatgacaacagaagatatgttaacggtttggaatcgcgtatggattgaggataatccatggatggaagataagacccctgttactacctgggaaaatgttccatatttaggtaaaagggaagatcaatggtgtggatccctaataggcctcacctcaagagctacttgggcgcaaaatataccaactgcgattcaacaggtgaggagtctgataggaaacgaggaatttttggactatatgccgagtatgaaaagatttagaaaagaagaagaatcagaaggggccatttggtga

SEQ ID NO: 23366 - RNA, 9873 nt, synthetic construct
  misc_feature 1..9873: note = derived and/or modified CDS sequence (opt6) from DENV-3__FJ547080__SS-prME
  source 1..9873: mol_type = other RNA
acgtctttgtgccttatgatgatattaccagccgcattggcgttccatttaacctccagagatggagaaccacggatgatcgtggggaaaaatgagagggggaaatccctactttttaaaacagctagtggaatcaacatgtgtacgctaatagctatggatcttggagaaatgtgtgacgatacggtaacttataaatgtccgcatataactgaggtcgaaccggaagacatagactgttggtgtaacctaacgagcacttgggtcacctatggaacctgtaaccaagctggagaacatcgacgcgataaacgatcggtggctcttgcacctcatgtaggaatggggctagacacaagaacacaaacatggatgagcgcagaaggtgcttggcggcaagtagagaaagttgagacatgggcccttagacatccaggatttacaattctggcgttattcctggcacattacattggcacctcactgactcaaaaagtcgtgatatttattctactaatgttggtgaccccctctatgacaatgaggtgtgtgggggtagggaatagagacttcgtcgaaggattgagcggagcaacttgggtagacgttgtcttggaacacggaggctgtgttacaactatggctaaaaataaaccaaccctagacatagaactacagaaaacagaagcgacacaattagccacgttacgtaaactctgcattgaaggcaaaataacaaatataactaccgacagtcgctgcccgacgcaaggggaagccgtactaccagaagaacaagaccaaaattatgtatgcaaacacacatacgttgatagggggtggggtaacgggtgtggactatttggtaaaggctcgctagttacgtgtgccaaattccaatgtctagaacctattgagggaaaagtagtacaacacgaaaatctaaaatacacagtaataataactgtacacaccggagatcaacaccaagttggaaatgaaactcaaggagtcaccgcagaaataaccccacaggcaagcacaaccgaggctatactaccagaatatggaacactgggccttgaatgcagcccacgaactggattagattttaatgaaatgattctattaactatgaaaaacaaggcttggatggtacatagacaatggtttttcgacttgccattaccttggacttcgggagctaccactgaaactccaacctggaataggaaagagcttcttgtaactttcaaaaatgcacacgctaagaaacaggaggtagttgttctaggttcacaagagggagcaatgcacactgcgttgacaggagcaacggaaattcaaaattcaggagggacgtcaatttttgccggccacctaaaatgccggttgaaaatggataagttagaacttaaaggaatgtcatacgcgatgtgcaccaatactttcgtgctaaagaaagaagtgtcagaaacccaacatggaaccatactaataaaagtagaatacaagggagaggacgtaccatgcaaaataccatttagtactgaggacggccaaggcaaagctcataacggtcgactgataacagcgaaccccgtcgtaacgaagaaagaagaacctgtcaatatagaagcggaaccaccctttggggagagcaatatcgtcatcggaataggtgacaatgctctaaaaatcaattggtacaagaaaggtagtagtatcgggaaaatgttcgaagcaacagcaagaggtgccagacgaatggctatcttaggagataccgcgtgggatttcggatcagtaggaggtgtactaaattcactcggaaaaatggttcatcaaatatttggaagtgcatatacggccctattctcaggcgtatcatgggtgatgaaaattgggatcggtgttttacttacatggatcggtttaaatagcaaaaacactagcatgtcttttagctgtatcgtgattgggataatcactctgtatcttggtgcagttgtgcaggccgacatgggttgtgttatcaattggaagggaaaagaattaaaatgcggaagtggaatttttgtaacaaatgaagtgcacacgtggactgagcagtataaatttcaagcagatagtccaaaacgcttggccactgcaatagcaggcgcttgggaaaatggtgtctgtggtattaggtcaacaacaaggatggaaaatttactttggaaacaaattgctaatgaactaaactacatcttgtgggaaaataacataaaactaacagtagtcgtcggagacataataggagtacttgaacaagggaaaaggacgttgaccccgcaaccaatggagttaaaatactcatggaagacgtggggtaaggctaaaatagtaacggcagaaacacaaaattccagcttcataatagatgggccaaacacgcctgaatgtccatccgcaagtagagcatggaatgtctgggaagttgaagattatggttttggggttttcactacgaatatatggttaaaattgcgcgaagtttacacccaactgtgtgaccatcgattaatgagtgcagcagtaaaagatgaaagagccgtacatgccgacatgggatactggatcgaatcacagaagaatggttcatggaaactcgaaaaagcaagtttaatcgaagtgaaaacctgtacttggccaaagtcacacacactttggagcaatggtgtgttagagtccgatatgataatccctaaaagtttagccgggccgatatctcagcataactatagacccggttaccacactcaaacagcagggccgtggcaccttggaaaattggaattagatttcaactactgcgaaggtacaactgtagtgattacagaaaattgcggaactcgcggcccaagtttaagaactactaccgtatcaggtaaacttatccatgaatggtgttgtagaagttgcaccctgccaccactacgctatatgggagaggatggatgttggtatggcatggaaattcgccccatatctgaaaaagaagagaatatggtaaaaagtttagtatcagcaggatcagggaaggtagataatttcacaatgggtgtcctctgcttagcaatattatttgaggaagtaatgcgaggtaagtttggtaagaaacatatgattgcgggggtattctttacttttgttctattgttatctgggcagattacatggcgggatatggcacacacgctaattatgataggcagtaatgcctccgatcgcatggggatgggggttacgtacttagctttaattgctacctttaaaattcaacctttcttagccttaggcttctttttaagaaagttaacctcacgtgaaaacctacttcttggagtgggattagcaatggcaactactttacagttaccagaggatatagagcaaatggcaaatggcatcgcacttggtttaatggccctcaagctaattacacaattcgaaacgtatcagctttggacagcactcatatctctaacatgttcgaacactatatttactttaacggttgcctggagaactgctaccctaatcctggctggggtcagccttctaccagtttgtcaaagttcatctatgaggaagacagactggttgcctatgactgttgcagcaatgggagttcctccactacccttattcatatttagtttgaaggataccctcaagagacgaagttggcctctaaacgagggtgtgatggcagtaggtcttgtatctattcttgcctcgtcattattaagaaacgatgttcctatggccggacctcttgtagctggaggcttactaatagcatgctatgtaataactggaacatcagccgatcttacggtcgaaaaagccgcagacgtaacatgggaagaggaggcggagcaaacgggagtatcacataatcttatgattacagttgatgatgacggtacgatgcgcataaaagacgatgaaactgaaaatattttaactgtattattgaagacagcgttattaatagtaagtggaatcttcccctactccatacccgcaactctattagtttggcacacctggcagaaacaaacacaacgctcaggagtactttgggatgttccttcgcccccagaaacccaaaaagctgaactagaagaaggggtttacagaataaaacaacagggaattttcggcaagacacaagtaggtgtaggagtacagaaagagggtgtatttcacacaatgtggcacgtgactaggggagcagtattaacatataatggtaagcgattagaaccaaattgggcctcagtcaagaaagaccttataagttacggaggtggttggagattaagtgcacaatggcagaagggggaggaagttcaagttatagctgtagaaccaggcaaaaatccgaaaaattttcaaacgatgccaggtaccttccaaacaacaacaggagaaatcggcgcaatagcattagattttaaacccgggacatcaggttctccaataataaacagagagggaaaagtagtggggctttatggtaatggagtagtaaccaaaaatggcgggtacgtttcagggatagcacaaaccaatgcagaaccagacggaccaacaccagagttagaagaagagatgtttaaaaagaggaacttaacaataatggacctacatccaggaagcgggaaaaccagaaaatacctgcctgcaattgttagggaagcaataaaaagaagattacgaactctgatattggcaccgacaagagtagtagccgctgaaatggaagaagctctgaaaggactacccattagataccaaacaacagcaacaaagagcgaacacacaggccgagaaatagtagacctaatgtgccacgctacatttacgatgcgattacttagtcctgtgagggtgcctaactataacttaataattatggacgaagcgcattttactgaccctgcatcaattgcagcgagaggctatatctcgaccagagttggaatgggcgaggcagcggcaattttcatgacagcgacaccacctggaaccgctgatgcctttcctcaatcaaatgcacctatacaagacgaagaacgcgacatcccagaacgctcatggaactctggcaacgaatggataaccgatttcgcaggaaaaaccgtatggttcgtcccttccataaaagctggcaacgatatagctaattgtttgcgcaaaaatggtaagaaagtcattcaactctccagaaaaacgtttgacaccgaataccagaaaacgaaattaaatgactgggattttgtcgtaacaaccgatatttccgagatgggagcaaactttaaagccgatcgagtaattgatccaaggcgttgtctcaaaccggtaatacttacagatggaccagagcgagtgatactggcaggtccaatgcctgtcacagcggctagtgcggcgcagcgtcgcggaagagtaggacgtaatccaagaaaagaaaacgatcaatatatttttaccggacaacctttgaacaatgatgaagatcatgctcattggacagaggcaaaaatgctcttagataacattaacacaccagaaggaattatacccgcattatttgaacctgaaagagagaaatctgcagcaattgatggagagtacagactaaaaggagaaagcagaaaaacctttgtagagttgatgagaaggggagatttaccagtatggctcgcacataaagtagcgtctgaagggataaaatatactgaccgtaagtggtgttttgacggacagcgaaataaccagatcctagaggagaacatggatgttgaaatttggaccaaagaaggggaaaagaagaaactacgaccgcgttggttagacgcgagaacatatagtgatccgttggcattaaaagagtttaaagatttcgcagccggaagaaaatcaattgccctagacctagtcaccgagataggaagagtaccttcccacctggcacatcgcactcgcaacgctttagataatctggtaatgttgcatacctcagaacacggaggaaaggcatatagacacgcagttgaagaactaccagaaacgatggagactctattactattaggactgatgatcttattaactggtggcgcgatgctgttccttatcagtggaaagggtatagggaaaacatctataggtctcatctgtgtgatagcctcttctggcatgctatggatggcagaaattccactccaatggatcgcctccgcaattgtactagagttctttatgatggtacttttaataccagaacccgaaaaacaaagaaccccgcaagacaatcaattagcatacgtagtgataggaatactaactcttgcagccatcatagctgctaacgagatgggtcttctcgagactactaaaagggaccttggaatgagtaaggaacctggcgttgtgtcaccaacgtcctacttagatgtggatcttcaccctgcatcagcatggacattatacgccgtggctaccactgttataactcccatgctacggcatacaatagaaaattctacagcaaatgtatcactagctgcgatagcgaatcaagctgtcgttttgatgggtttagacaaaggatggccaatttccaaaatggacctaggtgtccctctacttgcgttaggatgctattcacaagtaaatcctctgacacttacagccgcagtactgttattaattactcattatgctattatcggccccggtctgcaagcaaaggcaacaagggaagcccagaaaaggacggctgcaggcattatgaaaaatcctacagtagatggtataatgaccatcgacttagacccagttatatacgacagtaaattcgagaaacaattgggacaagtgatgctcttagttttatgtgcagttcaattattgttgatgcggaccagttgggctttgtgcgaagcattaacgctagctactggacctataactactctttgggagggttcgccaggcaaattctggaacaccacgatagccgtatctatggcgaatatatttcgcggtagttacctggcgggggcaggattagcttttagcattatgaaatcggtagggactggtaagcgaggaacaggtagtcaaggagagacgctcggcgaaaagtggaagaagaaactaaaccagttatcacgaaaagaatttgacctatataagaaatctggcataactgaggtagatcggacagaagcaaaagaaggcctaaagcgtggcgaaataacacatcatgcagtatctcgcggatctgccaaactccaatggtttgtagaacggaacatggtgattcccgaaggaagagtcatagatctaggatgtggacgcgggggatggtcgtattactgtgcagggctgaaaaaggttactgaagtacgcggatacacgaaaggtggaccgggacatgaggaacccgtccctatgtcaacatatggctggaacatcgttaaactgatgagtggaaaagacgtattttatttgccaccagaaaaatgcgacacacttctgtgcgacataggtgagtcatccccttccccgacggttgaagaaagtagaactatacgtgtattgaaaatggtcgaaccctggctcaaaaataatcaattttgtataaaagttcttaacccttatatgcccactgtaatagaacacctcgaacgattacaacgaaaacacggtggtatgctcgtacggaatccactttctagaaacagcacacacgaaatgtattggataagcaatggaactggtaatattgtagcatctgttaacatggtctcacgactacttctaaataggttcaccatgacacatcggagaccaaccatcgaaaaggatgtagacctgggtgcaggaacacggcacgtaaacgcagagccagaaactccgaacatggatgtaattggtgagcgcataaaaagaataaaagaggaacacaatagtacctggcattatgatgatgaaaatccgtacaagacatgggcttatcacggttcatatgaagtaaaagcgaccggatctgcaagtagcatgattaatggtgtagtaaaactgttgaccaagccatgggacgtagttcccatggtgactcaaatggcgatgactgacacaacaccatttggtcagcagagagtttttaaagaaaaagttgatacgagaacacctaggagcatgcccgggacaaggagagtcatgggaatcacagctgaatggctatggcgaacgttaggccgcaacaagaaaccaaggttatgtacaagagaagagttcacaaagaaagtgcgtacaaacgcagctatgggtgcggtatttaccgaggaaaatcaatgggatagtgcgaaagctgcagttgaggatgaagatttttggatccttgtggatcgagaaagagaactgcacaaactaggaaaatgtggatcttgtgtttacaacatgatgggaaaaagagagaagaaattaggtgaatttggaaaagctaaaggtagtcgcgccatttggtacatgtggctaggcgcccgctacctagaatttgaagcattaggattcctaaacgaagatcattggttttcaagggaaaattcgtattcgggagtagaaggtgagggtctccataaacttggttatatcttaagggatattagtaaaatacctggtggagcaatgtatgcagatgatactgcgggttgggatacacgtattaccgaagatgatctgcataatgaagagaaaataacgcagcaaatggaccccgaacaccgacagcttgctaatgctatatttaaactaacatatcaaaataaggtggttaaggtccagagacctacaccaactggaacagtaatggacatcatcagccgaaaagatcaaagaggatcaggccaagttggtacctacggactgaatacatttacaaatatggaagcacaactcattagacagatggaaggtgaaggtgttcttagtaaggcagatctagaaaacccacatttaccggaaaagaaaataacacaatggcttgaaacgaaaggtgtcgaaagattaaagagaatggcgatatcgggagatgactgtgttgtcaaacctatcgatgatagatttgcaaatgcactacttgctttaaacgatatgggaaaggtgaggaaggatatacctcagtggcaaccctctaaaggttggcacgactggcagcaagtcccattctgcagccatcacttccatgaattaataatgaaagatggccgcaaattagttgtcccatgccgaccacaagatgaattgataggtagggcgcgcatctctcaaggcgccggctggtccctaagagagaccgcttgtctcggtaaggcttatgctcaaatgtggtcattgatgtatttccatcggagggatctcaggctcgcatctaacgctatatgctcagcagtgcccgtgcactgggtccccactagcaggacaacatggtctattcacgcacatcaccaatggatgaccactgaagacatgttaacggtttggaacagggtatggatcgaggataacccttggatggaagataagacacctgtaaccacatgggaaaatgttccatatttgggaaaaagagaagatcaatggtgtggttccttaattggactaacatcccgggctacatgggcccaaaacattcctacggcgatacaacaagtaaggtcactcattggcaacgaagagtttctagattatatgccatctatgaaaaggtttaggaaagaagaagaaagtgaaggagccatatggtaa

SEQ ID NO: 23367 - RNA, 9873 nt, synthetic construct
  misc_feature 1..9873: note = derived and/or modified CDS sequence (opt6) from DENV-3__FJ547081__SS-prME
  source 1..9873: mol_type = other RNA
acatcattatgtctaatgatgatcttaccggcagctttggcatttcatttgacatcaagggatggggaacctaggatgatagttggcaaaaacgaacgcggaaaaagtcttttgtttaaaacagctagcggaattaatatgtgcacacttattgctatggatctaggtgaaatgtgcgatgatacagttacgtacaaatgccctcacataacggaagttgaaccggaagacatcgactgttggtgcaatctgaccagtacttgggtaacttatggaacttgtaaccaagcaggagaacatcggcgtgacaaaaggtctgttgcactggcaccgcacgttggaatgggtctagatactcgaactcaaacatggatgtcagcggaaggagcatggcgtcaagtggaaaaagtcgaaacgtgggcacttaggcacccgggatttacaattctagctttattcctagcacattatattggtacaagccttactcaaaaagtagttatctttatcctattaatgcttgtgacaccatcgatgacgatgcgttgtgtcggggtgggaaatagggacttcgttgaaggattatcaggagcgacttgggtagacgttgttttggaacacgggggatgtgtaactacaatggctaaaaataaaccaacgctagatatcgaattacagaaaacggaagcaacccaactggcaacactgaggaaactatgtatagaaggaaaaatcactaacattacaacagactcccgatgtccaacacaaggtgaagcggttttgccggaagaacaagatcaaaactacgtgtgcaaacatacatacgtagatagaggatggggcaatgggtgcgggctctttggcaaaggaagcctagtaacgtgtgcaaaatttcaatgccttgagccaatagaaggcaaagttgtacaatatgagaatttaaaatatactgtaataataacggtgcatacaggtgaccagcatcaggtggggaatgaaactcaaggagtaacagctgaaataacacctcaagcgtcgacaacggaagcaatcctaccagaatatggaactctcggccttgaatgtagtcctagaactggactagatttcaacgaaatgatacttctgacaatgaaaaataaagcatggatggtacatagacaatggttctttgaccttcctttaccatggacgagtggagccacaacggaaacaccaacttggaacaggaaagaactattagtaacttttaaaaacgcgcatgccaagaaacaagaggttgtagttttagggtcacaagaaggagctatgcacacggcattaaccggagccacagaaatacaaaatagtggaggcacatccatattttctggacatttaaaatgcaggctcaaaatggataaattagaattaaaaggcatgtcatacgctatgtgtacaaatacttttgtgttgaagaaagaagtatcggaaacacaacatggcactattctaataaaagttgaatacaaaggtgaagatgtaccatgtaaaatcccgttttcaactgaagatgggcaaggcaaagctcataatggaaggttaattactgctaatcccgtggtcacaaagaaagaggaacccgtaaacatagaagcagagcctccgtttggggaaagtaatatcgttattggaataggtgacaatgcccttaaaataaattggtacaagaaaggttctagtataggaaaaatgttcgaggcaactgctcgtggagcacgacgaatggcaatacttggagatacagcatgggacttcggttccgtaggaggagttctaaattccttaggtaaaatggtccaccaaatttttggatcagcctatacagcgctattctcaggggtatcctgggtcatgaaaattgggataggagtattattaacatggattgggttaaatagcaaaaatacttcaatgtcattctcgtgtattgcgataggcataattacattatacttgggagcagtagttcaagcagacatgggttgcgtaattaattggaaaggcaaggaacttaagtgtgggagcggaatttttgtaacaaatgaagtacatacctggactgaacagtacaaatttcaggcagacagcccgaaaagattagcaactgcaattgcaggggcatgggaaaacggagtatgtggaattaggagcactactaggatggagaatctactttggaagcaaattgcaaatgaattgaactacatactatgggaaaacaatatcaaacttacagtagtagtaggggatataattggggtattagaacaaggaaaacgaactctaacaccgcagcccatggaactcaaatactcgtggaaaacatggggaaaagccaaaattgttacagcagagactcaaaattcctcattcataattgacggacccaatacacctgagtgccctagcgctagtcgtgcgtggaacgtatgggaagtggaggattatggatttggagtatttaccacaaatatttggctgaagttacgtgaagtgtacacccaactgtgcgatcatagattaatgagcgcagcagtaaaggatgaacgcgcagttcatgcggatatgggatactggatagaatcccagaagaatggaagttggaaactagagaaggcttcccttatagaagtaaaaacctgcacctggcctaaatcacacacattatggtcaaacggggtactagagagtgacatgattattcccaaatcattggcagggccgatatcacaacataactatagaccaggctatcatacacaaacggctggaccatggcatttaggtaaacttgaattagatttcaactattgcgagggaaccaccgtcgtaattacagaaaactgtggtacccgaggaccatctctacgaaccacaacagtatctggcaaattaatacatgaatggtgctgtagaagttgtactctgcctcccttacgatatatgggtgaagatggatgctggtacggaatggaaattagacccatatcagaaaaggaagagaacatggtaaaaagcctagtttcggccggttccggaaaagttgataattttactatgggagtcctttgtctagctattctctttgaagaggtgatgagaggtaagtttggcaagaaacatatgatagccggtgtgttctttacgtttgttttactattaagtggacagattacctggagagacatggcacatactctaataatgataggttcaaatgccagtgacagaatgggtatgggtgtaacctaccttgctttaatagccacattcaaaatccaaccattcttggcacttggtttcttcctccgtaaactgacgagtagagaaaatcttttactcggagttggactagcgatggcaactacactgcaactcccagaagatatagaacaaatggctaacggcatagctttaggtttgatgacactcaaacttatcacccagttcgaaacctaccaactttggacggccttgattagtttaacatgctcaaacactatttttacattaaccgtcgcatggcgaacggcaactctaatcttagcaggagtatcattgctaccagtatgtcaatcgtctagtatgagaaagacggattggttgccaatgactgttgcagctatgggtgtgcctccactacccctgtttatattctctctcaaagataccttgaaaaggagatcttggccattaaatgaaggtgtcatggcagtcggcttagtttctatactagcctcctctctactcagaaatgacgtccctatggcgggacctcttgtcgcaggcgggctcctcattgcttgttacgttattaccggcacgagtgctgatctaacagtagaaaaagcggcagatgttacatgggaagaagaagcggagcagactggtgtttcacacaatttgatgattacagtagacgacgacggtacaatgagaataaaagatgacgaaacagaaaatattctaacggtactattaaaaacagcacttctaattgtatcgggtatttttccatattccatcccagcaaccctgcttgtctggcacacgtggcaaaaacaaactcaaaggagtggggttctatgggatgttcctagccctccggaaacccaaaaagccgagctggaagaaggagtgtaccggataaagcaacaaggcatttttggaaaaacacaagtaggcgtcggcgtacaaaaagaaggtgtatttcatacaatgtggcatgtaaccagaggtgcagtacttacttataatgggaaaagactcgaaccaaactgggctagcgtgaaaaaggatctcatttcatacggaggaggctggagactaagcgcccaatggcagaagggagaagaggtacaagtgattgcagtcgaaccaggtaaaaaccctaaaaattttcaaacaatgcctggaacctttcaaacgacaactggcgaaataggtgccattgctctagacttcaaacctggtaccagtggatccccgataattaatagagaggggaaagtggttggactgtatggaaacggggttgttacaaagaacgggggctacgtctctggcattgctcaaacaaacgcggaaccagatggacctacacctgagttagaagaagagatgttcaaaaagagaaatctcaccattatggatctacaccctggttcaggtaaaacccgaaaatatctaccagccattgtcagagaagccatcaagagaagactgcgtacattaattctagcgccaacgcgagtagtggccgcagaaatggaagaagccttaaagggtctacccatccgttatcaaacgacagctacgaaatcggaacatacaggacgtgagatagtcgacttaatgtgccatgcaaccttcacaatgcgattgttgtcacccgtaagagtacctaattataaccttataataatggacgaagcacattttactgaccctgcctccatcgccgctagagggtatataagcaccagagtagggatgggagaggcagcagcaatatttatgactgctacgccaccaggtactgcggatgccttccctcaaagtaacgcccctattcaggatgaggaaagagatataccagaaaggagctggaactctggaaatgaatggatcaccgactttgctggcaaaaccgtttggtttgttccttccataaaggcgggaaatgatatagcaaattgcttaaggaaaaacgggaagaaagttatacagttaagccgaaagacctttgataccgaatatcaaaagaccaaattaaatgattgggattttgtggttacaacagatatatctgagatgggagcaaactttaaagctgatagagttatcgatccacggagatgtctcaagccagtaattctgacggatgggcccgagcgtgttatcctagctggaccgatgccagttacggcagcatcagcagcccaaagaagaggaagagtcggaagaaacccacaaaaagaaaatgatcaatatatatttacgggacagccgcttaataatgacgaagaccatgcccactggacggaggctaaaatgctacttgataacatcaacactccagaaggaataatccctgcactttttgaaccggagagagagaaaagtgccgctatagatggtgagtatcgacttaaaggagaaagccgtaagacattcgtggaactgatgcgcagaggggacttacctgtatggcttgctcacaaggtagcaagtgaaggaatcaaatacgctgaccgaaagtggtgtttcgatggccaacgaaataaccagatccttgaggagaatatggatgtagaaatatggacaaaggaaggcgagaagaagaaactgaggccacgttggttagacgcacgaacatattcggatcctttagcactcaaggaatttaaagactttgccgctggaagaaaatcaattgctttagacttggtaacagaaattggaagagtcccatctcacctggctcatcgaactagaaatgcgttagataatctagttatgttacatacgagtgaacacggaggaaaagcataccgtcatgccgtagaagaactaccggaaactatggaaacgctactattgcttggattaatgatcttacttacagggggtgctatgttattcttaatttccggaaaggggattggaaaaacatccataggtcttatatgtgtcatagcttcgtctggcatgttatggatggcggagatcccactgcaatggatagcctcggctattgtattggaatttttcatgatggtacttctgataccagaacctgaaaagcaacgaacaccacaagacaatcaacttgcgtatgtagtaatcgggatactcactttagctgcaattatagctgctaacgaaatgggccttttagaaacgacaaagagagatttaggaatgtctaaagaaccaggagtagtctcatcgacatcctatcttgatgtagatttgcacccggcgtccgcatggacgttatatgctgtagcaactacagttataacaccgatgttaagacacacgatagaaaattcaacagcgaatgtatcgctagcagctatagctaatcaagcagtagttctaatgggactagataaaggctggcctatcagtaaaatggaccttggagtaccattgttagcgttagggtgttattctcaggtaaaccctttgaccctaactgctgcagttctattacttattacccattatgcgataataggacccggtttgcaagcaaaggccactagagaagcacagaaaagaacagccgctggcatcatgaagaatcccactgtagatggcattatgactatcgacctggatcctgttatttacgattcaaaatttgaaaaacaactaggccaagttatgttattagtactgtgtgcagttcagctgttattgatgagaacttcgtgggccttatgcgaagcattaacgttagcaacaggcccaattactactttgtgggaaggttcaccaggaaaattttggaatacaacaattgcagtatctatggcaaacatatttcgcggtagttatctggccggcgccgggcttgcatttagcataatgaaaagtgtagggactgggaagaggggaactgggagtcaaggagagacactaggagaaaaatggaagaagaaattgaaccaactatcccgaaaagaatttgacttgtataagaaaagcggaataactgaagtagaccgcaccgaggccaaagaagggctaaaacgtggagaaattacacatcatgcagtatcacgaggatctgcgaaattgcaatggttcgtagaacgaaatatggtcattcccgagggaagagttatagatctgggatgtggcagagggggatggtcgtattattgcgctggactaaagaaagtaacggaagtgaggggatatacgaaaggtggacctgggcatgaagaacccgttcctatgagcacgtatggttggaatattgttaaactcatgtccgggaaagacgttttctatctaccaccggaaaaatgtgatactctgctttgtgacatcggcgaatccagtccgtcacctacggtagaagagtcacgaacaatacgagtactaaaaatggtagaaccatggctgaaaaataaccaattttgtatcaaagtgctcaatccttatatgccaactgttatagaacatctggaaagattacaacgtaaacatggtggcatgttagtacgtaacccactttcaagaaactctacacacgagatgtattggatatctaatggtactggaaacatcgttgcctcagttaacatggtgtcaaggctacttttaaatagatttacaatgacacacagaagacctacaatagagaaagatgtggatttaggcgcgggaacaaggcacgtaaatgctgaaccggaaacccccaatatggacgtgattggtgaaagaattaaaaggatcaaggaagaacacaacagtacttggcactacgacgatgaaaatccctataaaacatgggcgtaccatgggtcatacgaagttaaagctaccgggtctgcgagctcaatgattaatggagtggtcaaacttctaaccaaaccgtgggacgtagttccaatggttacacaaatggcaatgacagatactaccccttttggtcagcagagggtatttaaagaaaaggttgacacaagaaccccaaggtcaatgccgggaacgagaagagtaatgggaataactgccgagtggctttggagaacattgggcagaaacaagaaaccgagactatgtaccagagaagagttcaccaagaaagtaagaacaaacgcagcgatgggagcggtatttacggaagaaaatcaatgggactccgcaaaagcggccgtagaagatgaagatttttggaagttggtagaccgtgagagagaactacataagttaggtaagtgtggatcatgtgtatataatatgatgggtaaaagagaaaagaaactgggggaatttggaaaagcaaagggatcgcgagcaatctggtatatgtggttgggtgcaaggtatttagagttcgaagctctaggctttctcaatgaagatcattggttttctagggagaatagttatagcggtgtagaaggagaaggcctgcataaattaggttatatattaagagatattagtaagataccaggcggagccatgtacgccgacgacacagcgggatgggatacacgtataacggaagacgacctacataatgaagagaaaataactcaacagatggatcccgagcatcgacagttggctaacgcaatatttaaactcacttatcaaaacaaagtcgtcaaagtacaaagaccgacgcccacaggtactgtaatggacataatatcgcgcaaagatcaaagaggaagcggccaagtgggtacgtactcgcttaataccttcaccaacatggaagctcaactaatacgacaaatggagggagaaggtgttttaagtaaagctgatcttgaaaatcctcatctccccgagaagaaaataacgcagtggttagaaacaaagggggttgaaaggttgaaaagaatggccataagtggagatgattgcgtagtaaagccaatcgatgaccggttcgcaaacgccttgttggcactgaatgatatgggaaaggtccgtaaagacatccctcaatggcaaccctcgaagggatggcatgattggcagcaggtacctttttgcagccaccattttcacgagttaataatgaaggatggcagaaagctggtagtcccatgtcgacctcaggacgagctcataggtcgagctagaataagccaaggtgcgggatggtcattacgagaaacagcgtgtctgggaaaggcttatgcacaaatgtggtcacttatgtacttccatcgccgcgatctcagacttgctagtaatgccatctgcagtgccgtcccagtacactgggtaccaacatcacgaacgacatggagcatacatgcacatcatcaatggatgactacagaggacatgttgacagtttggaatagagtatggattgaagacaacccatggatggaagataaaacccctgtaacgacgtgggaaaacgtaccatatttaggaaaaagggaagatcaatggtgtggcagcttaattggattaacatctcgagcgacatgggcgcaaaatatacccacagcgatccagcaagtccggagtcttataggaaacgaggaatttcttgactacatgccttctatgaaacgattccgcaaagaagaagaaagtgaaggggccatatggtaa

SEQ ID NO: 23368 - RNA, 9873 nt, synthetic construct
  misc_feature 1..9873: note = derived and/or modified CDS sequence (opt6) from DENV-3__FJ547082__SS-prME
  source 1..9873: mol_type = other RNA
acaagcctctgtctcatgatgattttgccagcagcattagcatttcatttgactagccgagatggagaacccagaatgatcgttggtaaaaatgaaagagggaaatcgctgttatttaaaacggcaagcggtataaatatgtgtacgctaattgctatggatttaggagaaatgtgtgacgatacagttacatacaaatgtccgcacattgccgaagtggaaccagaagacatcgattgctggtgcaatttaacatcaacatgggtaacatacggaacatgtaatcaggcaggagaacatcgacgggataaacgatccgttgcattagcaccccacgtggggatgggtttagatacacgaacccagacctggatgagtgctgaaggggcatggcgccaagtagaaaaagtggaaacatgggctttacgacatcctggctttacaatattagccctatttttggcgcactatatagggacctctttaacccaaaaagtagtgatctttatactactaatgctagtaacaccaagtatgactatgagatgtgtgggcgtgggaaatcgcgactttgtagaaggcttatctggagccacctgggtggacgtagtgttggaacacggcggatgtgtcacaacaatggcgaaaaacaaaccgactttagatatagaattacagaaaactgaagctacccaactagccacattaaggaaactttgcattgagggtaaaataacaaacattactacagatagccgatgtccgacacaaggtgaagcagttttaccagaagaacaggatcagaactacgtatgtaaacacacatacgttgatcgaggttggggtaacggatgtggactatttggcaaaggatcacttgtaacctgtgctaaatttcaatgcctcgaaccaatagaggggaaagtcgtgcaatatgaaaatcttaaatatacagtaatcatcactgtgcacactggggaccaacatcaggtaggtaatgagacccaaggcgtcacggcggaaataacacctcaagcatctacaactgaggccatcttaccagaatacggtacacttggattagaatgtagtccccgtactggactagactttaacgaaatgatactcttaacaatgaaaaataaagcatggatggtgcacagacagtggttctttgacttgcccctaccatggaccagtggcgctacaactgagaccccaacatggaacagaaaagagcttctcgtaacttttaaaaacgctcacgctaagaaacaagaagtagtagttttgggaagtcaggaaggtgcgatgcatacagccttaactggcgccactgaaatacaaaatagtggtggaacttcaatatttgcaggacatctcaaatgcagactgaaaatggataaactagagctaaaagggatgtcctacgcaatgtgcacaaatacgttcgttctaaagaaagaagtttcagaaacacagcacggtacaatattgataaaagtagaatacaaaggggaagacgttccatgtaaaatccctttttcaactgaagatggccaaggaaaagctcataatggcagactgataaccgctaaccctgttgtgaccaagaaagaagaaccagttaatatagaagcggaacctccgtttggagagagcaatatagtaattggcatcggagataatgcattgaaaattaactggtacaagaaaggaagtagcatagggaaaatgtttgaagcgactgctcgaggtgctcgaagaatggcaatcttaggagatacggcttgggatttcggaagcgtcggtggtgtacttaattctcttggtaaaatggttcaccaaatattcggatccgcatatactgctcttttctcaggtgtgtcgtgggtgatgaaaatcggaataggcgttttattaacgtggataggcctcaacagtaaaaatacgtccatgagtttttcttgcattgcaattggtataataacgctatacctaggcgctgttgtacaagcagatacagggtgtgttataaattggaaaggaaaagaacttaaatgtggatcaggaatctttgtaaccaacgaagtacatacatggacggaacagtacaaatttcaagctgactcgccaaaaagattggctactgcgatcgctggagcctgggaaaatggagtatgcggcataaggtctaccaccagaatggaaaaccttttgtggaaacaaatcgctaatgagctaaactacatactatgggaaaataacattaaactgacagttgttgtaggtgatataataggagttttagaacagggaaaacgtacattaacccctcaaccaatggaactcaaatattcttggaaaatgtggggcaaagcaaaaatagtgacagctgaaacacaaaattcttcgtttataatagatggacccaacactcctgaatgcccgtcagcatcacgtgcttggaatgtatgggaagttgaagactatggttttggcgtgttcacaacaaatatctggcttaaattaagagaagtttatactcaactatgcgatcatcgacttatgtcagcagctgttaaagatgaacgagccgtccatgcagatatgggatactggatagaaagccagaaaaatggatcatggaaattggaaaaagcctctctaatagaagtaaaaacatgcacatggccaaaaagccacacattatggtcgaatggagtgctagaaagcgacatgattatacctaaaagcctagcagggcctatttcacaacacaattatcgtccagggtatcatactcaaacggcaggtccttggcatctaggtaaactagaattagatttcaactattgtgaaggcacaaccgtagtgatcacggaaaattgcggtacaaggggtccaagtttaaggacaacaaccgttagcggaaaactcatccatgaatggtgttgcagatcctgcacccttccacctttgcgatatatgggcgaggacggttgttggtatggaatggaaataagaccgatatctgaaaaagaagaaaatatggtgaaaagcctagtctctgcagggagcggtaaagtcgacaattttacaatgggcgttctctgcttggcgatattgttcgaagaagttatgagaggcaaatttgggaagaaacatatgattgcgggtgtattctttacatttgtcctacttctttctggacagatcacttggcgtgacatggcccacacccttataatgataggctctaacgcatcagatagaatgggtatgggcgtgacttatcttgctctaatagcaacgtttaaaattcaaccctttctagcacttggattctttttacgaaaattaacctctcgtgaaaatttgttgctaggtgtcggattagcgatggcgacgacgttacaattaccggaggatatagagcaaatggcaaatggaattgcattaggactgatggctttgaaactcataacacaatttgaaacatatcaactctggaccgcattgatatccctaacgtgttcaaacacaatatttactttaaccgtagcctggaggacagctacattaatattagccggtgtcagcctactacctgtatgtcagtcatcatctatgaggaagtccgattggctaccaatgacagtggccgcaatgggtgttccaccgctgccactcttcatttttagcttaaaagatacccttaaaaggaggagttggccattgaatgaaggagtaatggcggtaggattagtgagcatactagcatcatcgctacttcggaacgatgtaccgatggcaggacccttagttgcaggcggattactaatagcatgctatgtaataacgggaactagcgcggatttaactgtggaaaaagcagcagacgtaacttgggaagaagaggcagaacagacaggcgtatcccataatctaatgattacagtcgatgacgatggtacaatgcgaataaaagacgatgaaactgagaatattctcaccgtcttactgaagacagctttgctaatagtaagcggtatcttcccttactcaatcccagcaaccctattagtatggcatacatggcaaaagcagacccgtaggtcaggagtactatgggatgttccatcaccacctgaaacacaaaaagcagaattggaggaaggagtctacagaataaaacagcaagggatatttggaaaaacccaggtaggcgtaggcgtacaaaaagaaggcgtctttcacacaatgtggcatgtcactaggggtgctgtattaacgtataatggaaaacgtttagaaccgaattgggcatcagtcaagaaagatctgatatcatatggcggaggttggagactaagtgcacaatggcaaaaaggagaagaagtacaagtaatagccgttgaaccaggaaagaatcccaaaaatttccaaactatgccaggcacctttcaaacaaccacaggggaaatcggtgctatagcactcgacttcaaaccaggtacgtctggtagccctatcataaatagagaaggtaaagtagtgggactatacggtaacggagtcgttaccaagaatggaggctatgttagtggaattgcacaaacaaatgcagaaccagatggtcccacccctgaactagaagaagagatgtttaagaaaagaaacttaacgattatggatttacatccaggatctggaaaaacccgaaaatatcttcccgccattgtacgagaggcaatcaaaagacgattaagaacacttatattagcaccgacacgagtggtcgcagccgaaatggaagaggctttgaaaggactaccaattaggtatcagactactgccaccaaatcagaacacacaggcagagaaattgtggacttaatgtgtcacgcgacatttactatgaggctgttatcaccggtcagggtgcctaattacaatctaattataatggacgaagctcacttcactgatcccgctagtatagcagcgaggggttacatcagtacgcgagttggaatgggagaagccgcagcaatttttatgaccgctacgcctcctggaactgccgatgcttttccccagtcaaacgcaccaatccaggatgaagaaagggacattccagaaagaagttggaactctggaaatgagtggatcacggattttgccggaaaaactgtatggtttgttccaagtataaaagccggtaatgatatagccaattgcctaagaaagaacggtaagaaagtaatacaactgagtcgcaaaacatttgatactgaatatcagaaaactaagctaaacgattgggatttcgtagtaacaactgatatatcagaaatgggagccaatttcaaagcggacagggtaatcgatccgagaaggtgtttaaaacccgtaatattaactgacgggcccgaaagggtaatattggcaggacctatgccagttaccgcagcaagtgcagcccagaggcgagggcgcgtcggtaggaatccacaaaaagaaaacgatcaatatattttcacaggccaacctttaaacaatgacgaagatcacgcacactggacagaagctaagatgctcctggacaatataaatacgccggaggggataataccagcattatttgagccggaaagagagaagtcagccgcaatagatggagagtatagactaaaaggcgaatctaggaagacgttcgttgagttgatgcgaagaggtgatttaccagtctggttagcacacaaagtagcttcagagggcattaaatacacagacagaaagtggtgcttcgacgggcaaagaaacaaccagatcctagaagaaaatatggacgttgaaatatggacaaaagaaggtgagaagaagaaacttaggcctagatggctagatgctcgaacatactctgacccgttagctctcaaagaatttaaagattttgccgctggtcgaaaaagtatagcactagacttagtaacagaaatagggcgtgtgcccagtcatctagcgcatcgtacaagaaacgcgctagataacttggtcatgcttcatacaagcgagcacggaggcaaagcatatagacacgctgtggaagaactcccagaaacaatggagacactattattactcggcctgatgatattactgactgggggtgcaatgctctttttaatatccgggaaaggcataggcaaaacgtccataggattaatatgcgtaatagcatcatctggaatgttatggatggccgaaatacccctccagtggattgcgagtgcaatagttctagagttctttatgatggttctattaattccggaaccagagaagcagcgtacaccacaagacaaccaactagcatacgttgtcattggaatactaacactggcagccataatagccgcaaatgaaatgggcctactggaaaccacaaaaagggacttggggatgtcaaaagaaccgggggtagtttcacctacaagttacctagacgtggacttgcatcctgctagtgcttggaccttatatgcggttgcaacaacagttataacaccgatgcttcgccatacgatcgaaaacagtaccgcaaatgtcagcttagcagccatagccaatcaagctgtggtcttaatggggttggacaaaggatggcctatatcaaaaatggacctgggggtgcccttactcgccctgggctgttacagtcaagtcaacccgttaacccttacggctgcggtcttattattaatcacacactatgcaattatagggcctggactacaagctaaagccactcgagaggcccaaaaacgaacggctgcaggtataatgaaaaaccctacggtagacggaataatgactattgatttagacccagttatatacgacagtaagtttgaaaagcaattaggccaagtaatgttgcttgtgttgtgcgcggttcagctcttactaatgagaacctcctgggcgctctgtgaggctttaacccttgccaccgggcctataacgacgttatgggagggatctccgggaaaattttggaacacaacaatagcggtaagtatggcaaacatctttaggggttcgtatttagctggagctggcctcgcgtttagtattatgaagtctgtagggaccggaaaacgtggtacaggtagtcagggtgaaacactgggagagaaatggaagaagaaattaaatcagctcagccggaaagaatttgacctctataagaaaagtggaataaccgaagttgatagaacagaagcaaaagagggactaaaaaggggagaaataacccatcatgcggtttcgagaggatctgcgaagctccaatggttcgttgaacgaaatatggtaattcctgagggaagggtgattgacttaggctgcggtcggggaggatggtcttactattgcgcgggtcttaagaaagttacagaagtcagaggttatacgaaagggggacctgggcacgaggaaccggtcccgatgtcaacatacggttggaacatagtcaaacttatgtcaggtaaagatgtcttttaccttcctccagaaaagtgcgataccctattatgtgacataggcgaatcctcgcctagccctaccgttgaagagtcccgtacgatacgagtattaaaaatggtagagccctggttgaaaaacaatcaattttgcataaaagtactaaacccatatatgccgaccgttatagaacatctagaacgtctgcaacgcaagcacgggggcatgcttgtcagaaatccgctaagccgcaactctactcacgaaatgtattggataagtaatggcaccggtaacatcgtcgcctcagtcaacatggtttctagactgttactaaataggtttactatgacccaccgacggcctactatagagaaagacgtcgatctaggcgccggaacccgtcatgtaaacgctgaaccagagacaccaaatatggatgttataggtgagcgaataaaaaggataaaagaagaacacaactccacctggcattacgatgacgagaatccatataaaacatgggcgtatcacggttcatatgaagtaaaggccactggaagtgcaagtagcatgattaatggagtagtaaaattgctaacaaaaccctgggacgttgttcctatggttacgcaaatggctatgacggatactacaccttttgggcaacaacgagtcttcaaagaaaaagttgacaccaggacacctcgttctatgccaggcacaagaagagtaatggggatcacggcggaatggctatggagaaccttagggcgaaacaagaagcctcgtttgtgcactcgtgaggagttcaccaagaaagtaagaacgaatgcagcaatgggcgccgttttcacagaagaaaaccaatgggactccgcgaaggcggcagtagaagacgaagatttttggaaattagtcgacagggaacgtgaattacacaaattggggaaatgtggctcttgtgtctacaatatgatgggtaagcgtgagaagaaactaggggagttcggcaaagccaaaggatctcgggcgatttggtatatgtggttaggagcacgataccttgagttcgaagcactcggttttctaaatgaagatcactggttcagtcgtgaaaactcttattccggtgtagagggggaaggtttacataaactagggtatatcttacgagatatctcgaaaatcccaggaggagccatgtacgctgatgatacagctggttgggacacaaggatcacagaagacgatctacataatgaagaaaagattacacaacagatggatccagaacatagacaattagctaacgccattttcaagctcacttatcaaaataaggtggttaaagtacagcgaccaacgccaaccggcacagttatggatatcatcagccgcaaagatcaacgcggtagcggacaagtgggtacgtatggattaaacacttttactaacatggaagctcaattaataagacagatggaaggagagggtgttttatcgaaagctgacctggaaaacccacatttatctgagaagaaaatcactcagtggctggaaacgaaaggagtagaaagattaaaaagaatggctatttccggcgatgactgtgtagtgaaacctatagacgaccgttttgctaacgcacttttagccttaaacgatatgggcaaagtacgaaaagacattccacaatggcaaccatccaagggatggcacgattggcaacaagtgccattctgttctcatcactttcatgagttaattatgaaggatggaagaaaattagtggtaccttgtcggccccaagatgaactaatcggtagagcccgaataagtcagggcgcaggctggtcactaagagagacagcatgtctagggaaggcttatgcacaaatgtggtctctaatgtattttcatagaagggatctccgcttagcctcaaatgcaatatgttcagctgtgcctgtacattgggtaccaaccagcaggactacgtggagtatacatgcacaccaccaatggatgactacggaagatatgctgacagtttggaaccgagtttggatagaggacaatccatggatggaagacaaaaccccagttacgacatgggaaaacgtaccctatttaggcaaaagagaggatcaatggtgtggcagcttaattggattgactagcagggccacttgggcacaaaatataccaacggcaatacaacaagtccgatcactaatcggaaatgaggaatttctagactatatgccatccatgaaacgtttccggaaagaagaagaatcagaaggcgccatatggtaa

SEQ ID NO: 23369 - RNA, 9873 nt, synthetic construct
  misc_feature 1..9873: note = derived and/or modified CDS sequence (opt6) from DENV-3__FJ547083__SS-prME
  source 1..9873: mol_type = other RNA
actagcctctgtttaatgatgatattaccggcagcactagcgttccacctcactagcagagatggagaacctcggatgatagttgggaaaaatgaacgtggaaaatcgctgctatttaaaaccgcaagtggaataaatatgtgtacactcatagcgatggatctaggagaaatgtgtgacgatacagttacgtacaaatgccctcatattacagaagtggaaccagaagacatagattgctggtgtaacttaacttctacctgggtaacttacggtacatgtaatcaagcaggagaaagaagacgagataaacgctcggtagcattagctccacatgtaggaatgggcctcgatacacgcacacaaacgtggatgtcggcagaaggagcgtggagacaagtggaaaaagtcgaaacgtgggcactcaggcaccccgggtttactatcctcgcactgtttttagctcattacataggtacctccttgacacaaaaagtagtcatattcatacttctcatgttagttacaccatctatgactatgagatgcgtcggtgtcggaaatcgagattttgtagaaggtttaagcggcgcaacttgggtagatgttgtattagaacacggtgggtgtgtaacaactatggctaaaaataaacctacactagacatagaattacagaaaacagaagctacacagttagctacgctaaggaaactatgcattgaaggaaaaattactaatataactactgacagccggtgtccaacccaaggtgaagccgtgctccctgaagaacaagaccagagctacgtatgcaaacatacatacgttgacaggggctggggaaatgggtgtggcttattcggcaaaggtagtttggttacctgtgctaaattccagtgtttagagcctatagaaggaaaagtagtccaatatgaaaatcttaaatatactgtaattattaccgttcacacaggagaccagcaccaagtaggcaacgagacacaaggagtaactgctgaaatcacacctcaagcaagtactacggaggccatattgcctgagtacggtacacttggtttagaatgttctccaagaactggacttgactttaacgagatgatattgctaactatgaaaaacaaagcatggatggtgcaccgtcaatggttcttcgatttacctttaccctggacaagcggggctacaacagagactcctacatggaacaggaaagaacttttagttacattcaaaaatgcgcacgccaagaaacaagaagttgttgtcctaggttctcaagaaggggcaatgcataccgcattaacgggcgctaccgaaatccagaactccgggggtacctctatattcgctggtcatctcaaatgccgtttaaaaatggacaaactagaactaaaaggaatgagttacgcaatgtgcacgaatacttttgtactaaagaaagaggtatcagaaacccaacatggtacgatccttataaaagtagagtacaaaggcgaagacgcaccgtgtaaaatacccttttcaacggaagatggacaaggaaaagcacataacggccgtcttattacagcaaaccctgtggtaaccaagaaagaagaaccagtaaacatagaggctgaacctccatttggagaatcgaatattgtgataggaataggagataatgcgttaaaaatcaattggtacaagaaaggtagtagtataggaaaaatgttcgaagctacagctcgaggagcgagacgaatggcaatattaggggatacagcatgggattttggaagcgtaggaggggtgcttaactcgttagggaaaatggtgcatcagatcttcggaagtgcatatacagcactatttagcggagtgtcatgggtaatgaaaatcggaatcggagtattgttgacttggattgggctgaacagcaaaaacacgagcatgtctttctcttgtatcgcgataggaataattactttataccttggtgctgttgtccaagcagacatgggatgtgtaataaattggaaaggcaaagaactcaaatgcggttctggtatattcgttaccaatgaagttcacacatggactgagcaatacaaattccaagcagactcgcctaaaagactagcaacagcaatagccggagcatgggaaaatggtgtatgcggcattcgttctacaacgaggatggaaaatcttctgtggaagcagattgcgaacgaacttaactacatactttgggaaaataacattaaactaacagtcgtagtaggtgacaccataggtgtgttggagcaaggaaaaagaacattaacaccacaacctatggaattaaaatatagctggaagacatggggtaaagcgaaaatagtgacagcggaaactcaaaactcatcatttatcattgacggaccaaacacaccggaatgcccttctgcgtccagagcatggaatgtctgggaagtagaggattacggattcggtgtcttcacaacgaatatctggcttaagttgagggaagtatacacgcaattatgcgatcatcgattaatgtcagcggcagttaaagatgaaagagctgtacacgcggatatgggatattggatagaaagccagaagaatgggagttggaaactcgaaaaggccagtcttatcgaagtaaaaacgtgcacttggcccaaatctcacacactctggtcgaatggagtattagaaagcgatatgattattcctaaaagcctagcgggtcctataagtcaacataatcacagacctggctatcatacgcaaacggctggcccttggcatttaggaaaactagagttggatttcaattattgcgaggggactaccgtggtaattacagaaaattgtggcactcgaggaccatcattgaggacgactaccgtatcaggaaaactaatacatgaatggtgctgtagatcttgtactcttcccccgttaagatacatgggagaggacggatgttggtatgggatggaaatccggccgatctctgaaaaagaggaaaatatggttaaatcactggtatcagctggttcaggaaaagtagacaactttacaatgggagtattatgtttagctatattattcgaggaagtaatgcgtggtaagttcggcaaaaagcatatgatcgcaggagtgttctttactttcgtcctgttattgtcggggcaaataacatggcgagacatggcgcatactctaattatgattggatcttcagcgagtgaccgaatgggtatgggggtaacgtatctcgcacttatagcaacatttaaaatacaaccatttcttgccctaggcttctttttaagaaaactaacgagtagagaaaaccttctactgggtgttggtttagctatggcgaccacgctacaattaccagaagacatcgaacaaatggcaaacgggatcgcattgggcttgatggcactcaaactaataacccaattcgagacatatcagttatggacagctctgataagtctgacatgttcaaatacgatgtttacgttaaccgtcgcttggagaactgcaacattaattttagccggtgtgagtctgttgccagtatgccaatctagctcaatgagaaaaaccgattggttaccaatggcagtagcggcaatgggagttccaccactacccctatttatattctcactaaaagatacccttaaacggagaagttggccgttaaacgagggcgtgatggccgtaggcctcgttagcatcctcgcatcaagtttacttcgcaacgacgttccgatggcaggacctctggtagcaggaggattattaattgcctgctacgtgatcacaggcacatcagcagacctcacggttgagaaagcagcagacataacgtgggaagaagaagcagaacaaacaggagtttcacataatttaatgatcaccgtagatgatgacggaacaatgagaattaaagacgatgaaacggaaaacatcttgaccgttttattgaaaactgctttactaatagtaagcggagtatttccatatagtataccagcgacgttactcgtctggcacacttggcaaaaacaaacacaacggtcgggagttctttgggacgtaccatcaccacccgaaactcagaaagcagaattagaggagggagtttaccgaattaaacaacaagggatattcggaaagactcaagtcggggtgggggtacaaaaagaaggagtttttcacacaatgtggcacgttaccagaggggcggttcttacatacaatggcaaacgattagaacctaattgggcaagcgttaagaaagatctcatatcatatggagggggatggagattaagcgctcaatggcaaaaaggtgaggaagtacaggtgattgccgtagagcctggcaaaaaccccaaaaacttccaaacgatgccggggacctttcaaacaacaacaggagaaatcggtgccatcgcattagattttaaacccggaacttccggaagtcctataataaaccgagagggaaaggtagtcggtctatatggaaatggggtcgtaactaaaaacggaggatacgttagcggtattgcacagacaaatgcagagccagatggtccaaccccagagcttgaggaagaaatgtttaaaaagagaaacctcacgataatggatttacaccctggctcgggaaaaacacgaaaatatctaccagccatcgtacgtgaagcaattaaaagacgactaagaaccctaatattagctccaacacgcgtagttgcagccgaaatggaagaggctctaaaaggcttacccatacggtatcaaacaactgccacaaaaagtgaacatacgggcagagaaatagtcgatttgatgtgccacgccaccttcacaatgagattactatcacctgtacgagtgccgaattataacttaatcatcatggatgaagctcattttacggatcctgccagtatcgcagcccgtggctatatttccactcgggtaggaatgggcgaggcggcagctatattcatgacagccacacccccgggcacagcagacgcatttccgcaaagtaatgcaccaatccaagacgaagaacgagatattccagaaagatcttggaatagtggaaacgaatggatcacagatttcgctggaaaaactgtttggttcgtaccaagtatcaaggcaggaaatgatatagctaactgtctcaggaaaaatggtaagaaagtaattcagttatcaagaaaaacgttcgatacagagtatcagaaaacgaagctgaacgactgggattttgttgttacaaccgacattagcgagatgggagcaaactttaaagcggacagagtaattgatcctcgtagatgcctaaagccggtaattttaactgacggaccggaaagagttatcttagcgggtcctatgcccgtaactgcggcgtccgcagcacaaagaaggggtcgggtcggaagaaatccacaaaaagaaaacgaccaatacatattcaccggtcaacccttgaacaacgatgaagatcatgctcattggacggaagcaaagatgcttctagacaatatcaataccccagaaggcattattccagcactctttgaaccggaaagagagaaaagcgctgcaatagatggagaataccggctcaagggagaatctcgaaaaacgtttgtggagcttatgagacgcggagacctccccgtgtggttagcacacaaggtagcatcagaaggtataaaatatactgacagaaaatggtgttttgatgggcaaagaaataatcagattttggaagaaaatatggacgtagaaatctggacaaaagagggagagaagaagaaattgagacctcgctggttagacgcaagaacgtactccgatcctttagctttgaaagaatttaaagactttgcggctggcagaaagtcaatcgcgctggatttagtgacagagataggtagggtaccaagtcacttggcgcatcggacccggaacgctttagataatctagttatgttacatacatctgaacatggaggcagagcttatcgacacgccgtagaggaacttcctgaaacaatggaaaccttactattattaggattgatgatacttttgacaggaggcgcgatgttgttcttaatctccggcaaaggaataggcaaaacttccataggtctaatctgcgtcatagcctccagcggaatgttatggatggcagaaatacctcttcaatggatagcgagcgctatagtactcgagttctttatgatggtactcttaataccagaacctgagaaacaacgaacgccacaagacaatcagcttgcttacgttgtgatcgggatacttacactagccgcgattatagcagctaacgaaatgggcttactggaaactacgaaacgggacctgggtatgagtaaagaaccaggagtcgttagcccaacaagttacttggatgtagaccttcatccagcttcggcctggaccttatatgctgtggcgaccactgtgattacaccaatgctaaggcacactatagaaaactcgactgcgaatgtctcattagctgcaatagcgaatcaggcagttgtattgatggggttagataaaggatggccgatctccaaaatggacttgggagtaccgctattagcactaggctgttattctcaggtaaatccattaaccttgaccgcagccgttctattactaataactcattacgcaataataggcccgggactacaagcaaaagcaactcgggaagcacaaaaacgaacagcagccggcataatgaagaacccaacagtagatggcataatgactattgacctagacccagttatatatgactcaaaattcgagaagcagttaggccaagtaatgctattggttctttgcgcagtacagttattattaatgagaacaagttgggccctctgtgaagcgctcacgctagcaaccggaccaattacaactttgtgggaaggctcgcctggcaaattttggaacacaaccatcgcagtatccatggcaaacattttcaggggatcatatcttgcaggcgcaggcttagcgttctcaatcatgaaaagtgtaggtacgggaaaacgaggaaccggatcacaaggagaaacccttggtgaaaaatggaagaagaaattgaaccaactaagcagaaaagagtttgatttgtataagaaatcaggtattacagaggtagacagaacagaagctaaagagggattaaagagaggagaaataacccatcacgcagtatctagaggttcagcaaaattacagtggttcgtagaacgtaacatggtaatcccagagggacgagtaatagatttagggtgcggtagaggtggctggtcctattactgcgcggggctgaagaaagtgactgaggtcaggggctataccaaagggggcccaggacacgaagaaccagtccctatgagcacgtacggttggaatatcgtgaagttaatgagtggcaaagatgtattttacttaccaccagaaaaatgcgacacactattatgcgatataggggaaagtagtcctagccccacagtagaagaaagcaggaccattagagttctcaagatggtagagccatggctgaagaataaccagttctgcataaaagtcctaaacccatatatgccgaccgtaattgaacatttagagcgacttcaacgaaagcatggcggcatgctagtcaggaaccctttatctaggaatagcacgcacgaaatgtattggatctccaatggaacaggtaatatagttgcgagcgttaacatggtttcgcgtttactattgaatagatttacaatgacacacagaaggccaaccatcgaaaaggacgtagatctcggtgctgggacgagacacgtaaacgctgagccagaaacccccaatatggacgtaattggagagcggataaaacgaattaaagaagaacacaactcaacttggcactacgatgacgaaaatccttataagacgtgggcttaccatggcagctatgaggttaaagctacggggagtgcttcaagcatgattaatggagtagtaaaattactcacaaagccatgggatgttgtgccaatggtcacacaaatggctatgactgatacaactccatttggacaacaaagggtattcaaggagaaagtagacactcgaacaccacgatcgatgcctggtactagacgagtcatgggcataacggcggaatggttatggagaacactagggcgaaacaagaaaccgagattatgtacaagggaagaatttacaaagaaagtgcgaacgaacgcagcgatgggagccgtcttcacagaggaaaaccagtgggactcagcaaaagcggcagtggaagacgaagatttctggaaattggtagacagagaacgagaactacataaactaggaaaatgtggtagctgcgtctataatatgatgggcaaacgtgagaagaaactcggcgaatttggaaaagccaaaggtagtagagccatatggtacatgtggcttggagccagatatctagagttcgaagcattggggtttttaaatgaagatcattggttttcacgagaaaatagttattcaggggttgaaggcgaaggcttgcacaaactaggttacatactacgagatatttctaaaatcccgggaggcgctatgtatgcggatgatacagcgggatgggacacccgaattaccgaagatgatctccataacgaagagaaaattacacaacagatggatcccgaacacaggcaattagccaacgcaatatttaaactgacatatcagaataaagtagttaaggttcagagacctactcctacaggtacggtcatggatatcatcagtcgtaaggaccaacgggggtccggtcaagttggaacatacggattgaacacattcacaaatatggaagcacaacttatacgacagatggaaggagaaggagtcctatcgaaagcagacttagaaaaccctcatttgccagagaagaaaattacacaatggctagagactaaaggtgtagaaaggttaaaacgaatggctatcagcggagatgattgtgtagttaaaccaattgacgatcgctttgccaacgcgttactggcattgaatgatatgggtaaagtccggaaagacatccctcaatggcaacccagtaagggttggcatgattggcagcaagtccccttctgcagtcaccattttcatgaattaataatgaaggatgggcgcaagttagttgtgccgtgcagaccccaagatgaattaattgggagggctagaatctcacagggtgctggctggagtctaagggagaccgcatgcttgggaaaggcttacgcccagatgtggtctctcatgtatttccatagacgtgacctaagactcgcaagtaatgctatatgttctgctgttcccgtccattgggtgccaacgtccagaaccacatggtctatacatgcacatcaccaatggatgactacggaggatatgctaactgtttggaaccgtgtttggatagaagacaatccctggatggaagataaaactccagttactacatgggaaaatgtaccctatttaggcaaacgagaagaccagtggtgtgggtcactcataggattaaccagtagggcgacatgggcacaaaatatacccaccgcgattcaacaggtgcgatcattaataggaaacgaggagttcttagactacatgccatcaatgaagaggtttcgtaaagaagaggaaagcgaaggtgcaatctggtag

SEQ ID NO: 23370 - RNA, 9873 nt, synthetic construct
  misc_feature 1..9873: note = derived and/or modified CDS sequence (opt6) from DENV-3__FJ547084__SS-prME
  source 1..9873: mol_type = other RNA
acttctctatgcctaatgatgatactacctgctgcgcttgcctttcacttaacaagtcgagatggagaaccaaggatgattgtgggcaaaaacgaaagaggaaaaagtctgttatttaaaacggcatctggaataaacatgtgcactttaatcgcgatggacctaggagaaatgtgcgatgacacagtgacatataaatgcccccacataaccgaggtagaaccggaggatatagactgttggtgtaaccttacatcgacgtgggtaacatatggtacatgtaaccaagccggagagcataggagggataaaagatcagtagctttagcaccccatgttgggatgggtcttgacacacgcactcaaacatggatgtccgcagaaggggcttggcgacaagtcgagaaagtagagacctgggctctaagacatcctgggtttacaatactagctttgtttttagctcattatataggcacatcactaactcaaaaagtagttatatttattctacttatgctcgtaactcctagtatgactatgagatgtgtgggtgtcggaaatagagattttgtggaaggtcttagtggagcgacctgggtggatgtagtgttagaacacggcgggtgtgttacgacaatggcgaaaaacaaaccaactctagacatagagcttcagaaaacagaggctacacaactagctacacttcgaaaattgtgtattgaaggcaaaattactaatataacgactgactctagatgccctacgcaaggtgaagcagtactaccggaagaacaagatcaaaattatgtttgtaaacatacatacgtagaccgaggttggggaaacggttgtggcctcttcggtaaaggatccctggtgacatgtgcgaaatttcaatgtctggaacccatagagggaaaagtagtacaatatgaaaatttaaaatacacggtgattataacagtgcacacaggagatcaacaccaagtaggaaatgaaacccaaggagtaacagccgaaataactcctcaagcctctacaacagaagcaatactgcccgagtacgggacactaggtctagagtgcagcccaaggaccggcttagactttaatgaaatgatcctcttaacgatgaaaaacaaagcgtggatggtacaccgacaatggttctttgatttaccactcccttggacgagtggagcaactacagaaacgccaacatggaaccgtaaagagctattagtgacatttaaaaatgctcacgcgaagaaacaagaggtagtggtcttgggatctcaagaaggcgcaatgcacactgccttaactggcgcaacagaaatccaaaatagtggagggacgtctatttttgcaggccatctaaaatgtcgtttaaaaatggataaattagaattaaaaggaatgtcttatgctatgtgtacaaacacattcgtactcaagaaagaggtatcagaaacacagcacggtactatacttataaaagtagaatacaaaggtgaagatgtaccttgcaaaattccttttagcaccgaagacgggcaaggcaaggcgcataatggcaggctgataacagcaaatcctgtcgtaactaagaaagaagaaccagtcaatattgaagctgaaccgccatttggtgaaagtaacatcgtcattggtataggtgacaatgcattaaaaataaactggtacaaaagagggagtagcataggtaagatgtttgaagcgacagcaaggggtgcaagacgtatggcaatcctcggcgatacggcatgggatttcgggtcggtcggaggtgtacttaacagtttaggaaagatggtacatcaaatatttggatcagcttatacagctttattctcaggcgtgtcgtgggtgatgaaaattggaataggagttttattaacctggataggacttaacagtaagaataccagcatgagtttcagttgtattgcaataggtatcataaccctgtatttgggcgcagttgtgcaagcggacatgggttgtgtaattaactggaaaggaaaagaactgaaatgtggcagtggaatattcgtaactaatgaagtacatacatggacagaacaatataaatttcaagcagatagcccaaaaaggttggcaacagcaatagccggagcatgggaaaatggagtatgcgggattcgttctacaactagaatggagaacctcttatggaagcaaatagctaatgaactaaattacatattatgggaaaataatatcaaacttacagttgtagtaggtgacacaatcggtgtgctggagcaaggaaaaagaactctaacgccacaaccgatggaattgaagtactcctggaaaacatggggaaaagcaaagatagtaactgcggaaacccagaatagcagtttcattatagacggccccaacaccccagaatgtccaagcgccagtcgggcctggaatgtttgggaagtcgaagattacggcttcggagtgttcaccacaaatatatggcttaaattacgtgaagtttatacacaactttgtgatcatagattaatgagcgcagccgtaaaagacgaaagagcggtacacgctgatatgggctattggattgaatcacagaaaaacggaagctggaaattagaaaaggcgtcccttatcgaggttaaaacttgcacgtggcccaaatcacacaccctatggtcgaatggtgtcctcgaatccgacatgataataccaaaatcgctcgctggtccgattagtcagcataactacaggcccggctatcatacgcaaacagctggcccatggcatttgggaaagctagaactcgacttcaattattgcgaaggcacgactgttgtaattacagaaaattgtggaactcgtggtccttcgctaagaacgacgactgtaagtggcaaattaatccatgaatggtgttgtcgatcttgtaccttaccgccacttcgatacatgggagaagacggttgctggtacggtatggagattagaccgatatcggaaaaggaagaaaatatggttaaatctctagtcagcgctggaagtggaaaagtagacaatttcacaatgggcgtattatgtctcgctatattatttgaagaggttatgcggggaaaatttggcaagaaacatatgattgttggtgtattcttcacgttcgtgctcctcctttccggacaaataacatggagagacatggcacacacactaattatgatcggatcaaatgcctcagatagaatgggcatgggagttacttatctagcccttatagcgactttcaaaattcaacccttcttggctctgggattctttttgaggaaattaacctccagagaaaatctcttactcggcgtaggtttggctatggctacaactctacagttacccgaagatatagaacagatggccaatggaattgccttgggactgatggcgctaaaactaaccacgcaatttgagacgtaccaattatggaccgcgctcatctcgcttacttgctcaaatacaatctttaccctaacggttgcctggagaacagcaacgcttatattagctggggtaagcctactacctgtatgtcaatcaagttcaatgcggaagacagattggttgcccatgacggtagcagcaatgggcgtgcctccattacccttattcatattcagtctgaaagacacccttaagagacgctcttggccactgaatgaaggggtaatggctgttggattagtttctatcttggcttcatctctattacgcaacgatgtaccaatggcagggccgttagttgctggtggcttattaatagcttgttatgtaatcacggggacaagtgctgatcttactgttgaaaaagccgcagatgtaacatgggaggaggaagcggaacaaacgggagtaagtcataacttaatgataacagtggatgacgacggaactatgagaataaaagatgatgaaacagaaaacatacttacagtacttttaaaaacagcgctactcatcgtgtccggaatcttcccctacagcataccggctacgctcctggtatggcatacatggcagaaacaaacacaacggtcaggagtgctttgggatgttccgtcacctccggagactcagaaagcggaactagaggaaggtgtatacagaataaaacaacaaggtattttcggcaagacgcaagtaggtgtcggcgtacaaaaggaaggagtctttcacactatgtggcacgtcactagaggcgcagtcttgacttataacggaaaacgtctagagccaaattgggcaagtgtcaagaaagatttaatatcttatggagggggttggaggcttagtgcccaatggcagaaaggggaggaggttcaggttattgcggtagaaccaggcaaaaatccaaagaacttccaaacaatgccgggtacctttcaaactacgactggcgaaataggggcaatagcccttgatttcaaacctggcacttcgggttcgcctataataaatcgggaaggcaaagtagttgggttatacggtaacggggtagtaaccaagaatggtggctacgtaagcggaattgcacagactaatgcagagccagatgggccaacgccagagttggaagaagaaatgttcaaaaagcggaacttaacaattatggatctccatccagggtcaggaaaaactcgtaagtatctacctgcaatcgtaagagaggcaataaagcgtaggcttagaactttaattctcgcacccaccagagtcgtagcggcagaaatggaagaagcactaaaaggactaccaataagataccagaccacggccactaagagtgagcacacaggaagggaaattgtcgatcttatgtgtcatgcaacatttactatgcgattattatcaccagtccgagtgcctaattacaatctaataattatggatgaagcccacttcacggatccagcatccattgctgccagagggtatatatcgacgagagtaggaatgggagaagccgcggcaatatttatgacagccacaccgcccggcactgccgacgcgtttcctcaaagtaatgcacccatacaggacgaagaacgcgatataccagaacgctcatggaacagtggcaatgaatggataactgattttgcgggaaaaactgtatggtttgttcccagtatcaaagcaggaaatgatatcgccaattgcttgagaaagaatggtaagaaagtgatccaattaagccggaaaacttttgacaccgagtaccagaaaacaaagttaaacgattgggatttcgtcgtaacgactgacatttcagaaatgggagctaactttaaagccgatcgagtcatagatccccggcgttgtctcaaacccgtaatattaacggatggaccagaacgcgtaatattagccgggccgatgcccgttactgcggcaagtgctgctcaaagaaggggaagagtaggcagaaatcctcagaaagaaaatgaccaatacatatttacggggcagcctcttaataatgacgaagatcatgcacattggacggaagcaaaaatgttgcttgataatataaataccccagaaggaatcattcccgccttgtttgaaccagaaagagagaaatcagccgcaatcgatggagaatatagattaaagggggaaagcagaaaaacgttcgtggaattaatgagaagaggcgacttacccgtgtggctcgctcacaaggtcgcgtctgaaggtatcaaatatactgacagaaagtggtgtttcgatggacaacgcaataatcaaattcttgaagagaatatggatgtagaaatatggacaaaggagggcgaaaagaagaaattaagaccaagatggttagatgcaagaacttactccgatccactagccctaaaagaatttaaagattttgcagctggaaggaaaagtatagcactcgacctagtcacagaaataggtcgtgtaccatcccatctagcacaccgaacaagaaacgctttagacaacctggttatgctacacacgtccgaacatggcggcaaagcatatcggcacgccgtagaggaactcccagaaacaatggaaaccctacttttgttaggcctcatgattttgctcacaggaggagccatgctattcttaatctcaggcaagggtattgggaaaaccagtatcggattaatctgtgtgatagctagtagcggaatgctttggatggcggagataccacttcaatggatagctagtgccattgtattagagttctttatgatggtactcctgataccagaacccgaaaaacagcgtaccccacaagacaaccaactggcttacgttgtaataggaatacttacactggcagcaattatagcagctaacgaaatggggcttttagaaaccacgaagagagacttaggaatgtcaaaggagcctggtgtggtatctcctacatcttatcttgacgtcgatctccatcctgcttctgcttggacattatacgccgttgcaactacagtaataaccccaatgttaagacacacaatagaaaatagtactgctaatgtctcactagcagcaatcgcaaatcaagcggttgttttaatgggtctagataaaggatggccgatatccaaaatggacttaggagtccctttattagctctaggctgttactcccaggtaaaccccctcacactaacggctgccgtgctactcttaataacacattacgcaataataggacccggcttgcaagctaaggccacccgggaagcacagaaacgcacagcagcgggaataatgaaaaatccaacagtagacggaataatgacaattgatctagatccagttatctatgattcgaagtttgagaaacaactaggacaagtaatgctattggtgttatgcgcagttcaactattgctaatgagaacaagctgggcactatgtgaagcattaacccttgcaacgggacccattactaccctatgggaaggttcaccgggtaaattctggaatacaaccatagcagtttcgatggccaacatttttcgtgggtcgtatctagctggtgcaggactagcatttagtataatgaaatcggttggcactgggaaacgaggaacagggagtcagggcgaaacattaggagaaaagtggaagaagaaattgaatcagctttccagaaaagaatttgatctttacaagaaatcaggaatcaccgaagtagatcgtacagaagccaaagagggtttaaaaagaggagaaataactcatcatgcagtgagcaggggaagtgcaaaacttcaatggtttgtcgagaggaatatggtaattcctgaaggccgcgtaatagatcttggctgtggtcgaggtggatggtcatattattgtgctggactcaagaaagtaacagaagtcaggggctataccaaaggaggacctggacacgaggaaccggttcccatgtccacatatggttggaatatcgttaaactaatgtcaggcaaagatgttttctatttaccaccggaaaagtgtgatacacttctatgcgacataggagaaagtagcccatcacccactgtagaagaatcgagaacgataagagtattaaaaatggttgaaccatggctgaaaaataaccaattctgcataaaagtattaaacccatacatgccaacggtaattgagcacttagaacgtctacaacgtaaacacggagggatgctggtaagaaatcccttatctagaaattcaacgcacgaaatgtactggatcagtaacggaacaggcaatatagtagcatctgtgaatatggtatcacgtttactacttaatagattcacgatgactcaccggagacccacaattgaaaaagacgtagatttgggtgcgggtactaggcacgtaaacgcagaaccagagacacctaatatggatgtcattggtgaacgtataaaaagaattaaggaagaacataactctacttggcactacgatgacgaaaacccttacaaaacatgggcctatcacggaagctatgaggtcaaagcgactggatcagctagtagcatgataaatggagtggtaaagttattaacaaaaccttgggacgttgttccaatggtgactcaaatggcaatgacagacactacgccgtttggacagcagagggtatttaaagaaaaagtagatacaagaacgccccggtccatgccaggtaccagacgggtgatgggaatcaccgcagaatggttatggagaaccctgggtcgaaataagaaacctagattgtgcacacgggaagagtttacaaagaaagtgcgtactaatgcggcaatgggtgcagttttcaccgaggaaaaccaatgggacagtgcaaaagccgcggttgaagatgaggatttctggaaattagtcgatcgcgaaagagagttacacaaactaggaaaatgtgggagttgtgtatataatatgatgggcaagagagaaaagaaacttggcgaatttggcaaagcgaaagggtcaagagcgatatggtacatgtggctaggtgcccgttatctagagttcgaagccctaggctttcttaatgaagatcactggttctccagagagaactcatacagcggagttgagggagagggattacataaattaggttacatacttcgagatatttcaaaaataccaggcggtgccatgtatgcagatgacacagctggttgggatacacggattacagaagacgatcttcacaatgaagagaaaataactcaacaaatggatccagaacacagacaacttgcaaatgcaatatttaaactgacatatcagaacaaagtagtcaaagtccaacgcccgaccccaacaggcacagtgatggacataatatctagaaaggatcagagaggaagtggacaagttgggacttacgggctcaatacatttacaaacatggaagcacaattgatacgtcaaatggagggggagggagtgttgagtaaagcagaccttgaaaatccccatctgccggagaagaaaataacccaatggctagaaacaaaaggagtcgaacgactaaaacgaatggcaatatcaggagatgattgcgttgtaaaaccaatagacgatcgctttgcaaacgcactacttgctttgaatgacatgggtaaggtgagaaaagatatccctcaatggcaaccaagcaaaggctggcacgactggcaacaagtaccattttgtagtcaccatttccacgaattaataatgaaggacggtcgcaaattggtagtaccttgcagacctcaagatgagctaattggtagagcccggataagtcaaggagcaggatggtcgttaagggaaacagcatgtctaggcaaggcatatgcccagatgtggagcctcatgtatttccaccggcgggatcttcgtctggcaagtaatgccatatgttcagctgttccggtgcactgggtaccaacgtcaaggactacatggtccatacatgcgcatcaccaatggatgacgactgaggatatgttaaccgtatggaatagagtctggatcgaagacaatccatggatggaggataaaaccccggtcacaacatgggaaaacgtaccttatttaggcaagcgtgaagatcaatggtgcggatctttgataggtctcacttctagggcaacttgggcacagaatattccaacggctattcaacaagttaggtcacttatcgggaatgaagagtttttagattatatgcctagcatgaaacgattcagaaaggaggaggagagcgaaggcgcaatttggtaa

SEQ ID NO: 23371 - RNA, 9873 nt, synthetic construct
  misc_feature 1..9873: note = derived and/or modified CDS sequence (opt6) from DENV-3__FJ478456__SS-prME
  source 1..9873: mol_type = other RNA
acaagtttatgtctgatgatgatactaccagcagctctagcatttcatttaacatcgcgagatggggaaccaagaatgatagtcggcaaaaacgaaagaggtaaaagtcttttattcaaaacagcatcggggataaacatgtgcacgctgattgcaatggatttgggagaaatgtgtgatgatacggttacatacaaatgtccacacattgcagaagtagaaccagaagatattgactgctggtgtaacttaacatctacgtgggtaacctatgggacttgcaaccaagccggtgaacaccgaagagacaaaagatcagtggcactagctccccatgttgggatgggattagacactcgaacacaaacttggatgagcgcagagggtgcatggagacaagttgaaaaagttgagacgtgggctctacgtcatccaggattcaccatattagcattgttccttgctcactatataggaacaagcctaacacaaaaagttgtgattttcatactattaatgttggttactccgagtatgacgatgagatgcgtgggagtcggaaacagagacttcgtcgaaggattatccggagccacctgggtagatgtcgtactagagcatggaggatgtgtaactacaatggccaaaaataaaccaacattagatatagaactacagaaaactgaagctactcaacttgcaactttgagaaaactatgcatagaaggaaaaataacgaatataaccaccgattctagatgccccacgcaaggggaagcagttctaccagaagaacaagatcaaaactatgtttgtaaacacacgtatgttgatcggggatggggaaacggatgcggtttatttggaaaaggatctttagttacatgcgcgaaatttcagtgtctagaaccaatagaaggcaaagtagttcaatatgagaatctaaaatatacggtcatcataactgtgcataccggtgatcagcatcaagtgggaaacgaaacgcagggcgtaacagcggagattacacctcaggcttccactacagaagctattctaccagagtacggcactttaggattagaatgttcgcctcggacgggcctggattttaacgaaatgatcttactaactatgaaaaacaaggcttggatggtacatagacagtggttctttgacctaccattaccttggacttccggcgcaacgacagaaacaccaacatggaatcgaaaagaattgctagttacctttaaaaatgctcatgcgaagaaacaggaagtggttgtgctaggatctcaagaaggagcgatgcacacggcattaacaggagctactgagatacaaaactctggaggaacatccatatttgctggtcatttaaaatgccgattgaaaatggataaattagagttaaaaggtatgtcttacgcaatgtgcacaaatacattcgtccttaagaaagaggtttcagaaactcaacatggaacaatactgataaaagtagagtataaaggtgaagacgtaccatgcaaaataccttttagtactgaagatggccagggtaaagcccacaacggcaggctaataacagcaaatcctgtggttactaagaaagaagaaccagtcaatattgaagctgaacctccattcggtgaatcaaatatagtgataggaataggtgataatgcacttaaaatcaattggtataagaaaggcagtagtatagggaaaatgttcgaagctacagccagaggagctcgaagaatggcaatactgggagatactgcatgggactttgggtcagtaggtggtgtgctcaatagcctgggaaaaatggtacaccaaatcttcgggagcgcatacactgcactgtttagtggagtttcctgggtaatgaaaataggtataggtgtattattaacatggattggcttaaacagcaaaaataccagtatgtccttttcatgcattgcaataggtataatcaccttgtacttaggagctgttgtacaggcggatacgggatgtgtaataaattggaaaggaaaagaattaaaatgtggatccggaatattcgttacgaatgaagttcatacttggacagaacaatacaaatttcaagcagattctccaaaaagattagctacggccatcgctggcgcttgggaaaacggggtttgtgggattagaagcactacccgcatggagaacctactttggaaacaaatcgccaatgaactgaattacatcctctgggaaaacaatattaaattaacagtagttgtgggtgatattataggagtcttagagcaggggaaaagaacattaactcctcaacccatggaactcaaatattcatggaaaacgtggggaaaagctaaaattgttacagctgagacacaaaatagtagctttattattgacggccctaatacaccagaatgcccatcagcatccagagcatggaatgtgtgggaggtagaagactatgggttcggtgtatttacaaccaatatttggttaaaacttagagaggtttacacacaactctgtgatcatagattaatgtcggcagcagtaaaagacgaacgcgcagttcatgcagacatggggtactggattgagtctcagaaaaacggctcatggaaactagagaaagcgtcgcttatagaggtaaaaacctgcacatggccaaagagtcatacactatggagtaatggagttcttgaatccgatatgattatcccaaaaagtctagcaggaccaatctcgcaacataattatagaccagggtatcacacacaaacagctggaccgtggcatttaggcaaactagaattagattttaactactgtgaaggaacgacagtggtcattacggaaaattgtgggacgagaggaccgagcctaagaacgacaacagtgtcaggcaagttaatacacgaatggtgttgtagaagctgtacattaccccctctaagatacatgggagaagatgggtgctggtatggaatggagatccgcccaatatcagaaaaagaagaaaacatggttaagagtctggtatcggccggtagcggaaaagttgataatttcacgatgggtgtcctgtgtcttgctatcttattcgaggaagtcatgagaggcaaattcggcaagaaacatatgatagctggtgtattctttacattcgtattactcttatcaggccaaataacttggagagatatggcacataccctaattatgattggtagcaatgcttcggacagaatgggaatgggtgtaacttatttggcattgattgcaacattcaaaattcaaccgttcctagcactaggtttctttctgaggaaattaacttcaagggaaaatttactacttggagtcggattagcaatggcaacaacacttcaattgccagaggacatagaacaaatggctaatggaattgctttggggctaatggcattgaaactgattacacaatttgaaacttatcaactatggactgcgctaatctcattaacatgtagtaataccatatttacacttactgtagcttggagaaccgcaactttgattcttgccggggttagcattctgccagtgtgccaaagttcgtctatgcgaaaatcagactggctacctatgacggtagcagctatgggtgtaccaccacttcccctatttatatttagccttaaagatacactcaaaagaagatcatggccactgaatgaaggtgtgatggccgtaggtctcgttagtatcttggcctctagtctgctacgaaatgacgttcctatggcaggaccccttgtcgcaggaggtttacttatagcatgctacgttatcacaggcacatcagctgatctaactgtagagaaggcagctgacgtaacctgggaggaagaagcggaacaaacgggggtctcacataatttaatgattacagttgacgatgacggcacgatgcggattaaagatgatgaaaccgagaacattctaacagtactgttaaagacagccttactaatagtaagtggcattttcccctactcaataccggctactctattagtgtggcacacatggcagaaacaaacaaggcgatctggcgtcctctgggatgtaccaagtccacccgaaacacagaaagcagagcttgaagaaggtgtttatcggattaaacagcaaggtatttttggaaaaacccaagtgggagtcggcgttcaaaaggaaggagtattccatacgatgtggcacgttacaagaggtgcagtcttgacatacaatggtaagaggcttgaaccgaattgggccagtgtcaagaaagatctcatttcgtacgggggcggctggagactttcggcccagtggcaaaaaggagaggaagtccaagtcattgctgtcgagccaggcaaaaaccccaaaaacttccaaacaatgcccggaacgtttcagactacaactggtgaaattggggcgatagcgttagacttcaagcctggaaccagcgggagtccgataatcaaccgagaaggtaaagtggtgggtctatatgggaacggtgtagtaacgaagaacggaggatatgtatcggggatagctcagactaacgcagagcctgatggaccgacccctgaactagaggaagaaatgttcaagaaaagaaaccttacaataatggatttacatccgggatcaggaaaaactcggaaatacttaccggcaatagtcagagaagcaattaagcgacgtcttagaacgctgattttagccccaactagagtagttgccgctgagatggaagaggcattaaagggacttccgataaggtatcaaacgacagccacaaaatcggaacatacaggaagggaaatcgtagatttaatgtgccacgcgaccttcacaatgcgcctgctatctccagttcgagtacctaactataacttaataatcatggatgaagcacactttacagatccagccagtatcgcagcaagaggatatatatctacccgagtaggaatgggagaagctgccgcaatattcatgaccgcaactcctccaggcacggccgatgcgtttccacagtctaacgccccgatccaggatgaagagagagatataccggaacgaagttggaactctggtaacgagtggataacagactttgcaggaaaaacagtatggttcgtaccatccatcaaagctggaaacgatatagcgaattgtctcaggaaaaacggtaagaaagtaatacagttgtcaagaaaaacattcgatacggagtatcagaaaacaaaactcaacgattgggatttcgtggtaacaacagatatatccgaaatgggagctaacttcaaagccgatagagtaattgacccaagaagatgtttaaaaccggtgatactcacagacgggcctgaaagagtgatattagctggtccaatgccagtaacagcagcatcagcggcacagagacgtggccgggttggcagaaatcctcaaaaagagaacgatcaatatatttttactggacagccactaaataatgatgaagatcatgcacactggaccgaagctaaaatgttgttagataatattaacacgccagaaggaataatccctgctttgtttgaacctgaaagggagaaaagcgcggcaattgatggtgaatataggttaaaaggggaatctagaaaaacatttgtcgagttaatgagaaggggagatctacctgtatggttagcccacaaagtagcaagcgagggaatcaaatatactgaccgaaaatggtgctttgacggccagagaaataaccagatactggaagaaaacatggacgttgagatctggaccaaagaaggagagaaaaagaaattacgaccacgttggcttgacgcccgtacgtactctgatcccctggcattaaaagaatttaaagacttcgctgctggacgaaaaagcatcgcactagacctggtgacagaaatagggcgagtaccttcacacttagcacatcggaccaggaatgccctcgataacttagtgatgttacatacaagtgaacacggcggaaaagcctatcgtcacgcggtagaagaattgccagagacaatggaaactctcctactattgggcttgatgattcttctcaccggaggggctatgctattcctaataagtgggaaaggaatagggaagactagcattggattaatttgcgtaattgctagttctgggatgttgtggatggcggaaatacccctccagtggatagcgtctgcaattgttctcgagttctttatgatggtacttttaattccggaaccagaaaaacagagaacacctcaggataatcaactagcctacgtcgtgataggtattcttacgctggctgcaattatcgctgcaaacgaaatgggtcttttagaaactacaaaaagggacttaggcatgagcaaagagcccggagtagtatcacccaccagctacctagacgtagatcttcatccggcgagcgcatggaccctatatgctgtagcaacgacagtaataacccctatgttacggcatacaatagaaaatagcacggcgaatgtgagcctggcagctatagctaaccaagcggtggtcctaatgggcctagataaaggatggccgatttccaaaatggatttaggggtaccactattggcccttgggtgttatagccaagtaaatcccctaacacttactgctgcggtcttactgttaataacacattacgccataataggacctgggctccaagcaaaagcaacaagagaagcacaaaaacgcacagcggctggtattatgaaaaacccaaccgtcgacgggataatgacgattgatttagacccggtgatttatgacagcaaatttgaaaagcaattaggacaggttatgcttctagttctgtgcgcggtgcaacttctactaatgagaacttcatgggcattgtgtgaagcacttactttggcaacaggtccaataaccacactatgggaaggttcaccaggcaaattttggaatacaaccattgcagtgtcgatggctaatatattcagaggatcatatctggccggagcaggtttagccttctccatcatgaagagtgtaggaacaggaaaaaggggaacaggttctcagggggaaacattgggagagaaatggaagaagaaactgaatcaactatcaagaaaggaatttgacttatataagaaatcagggattacggaagtggatcgtacagaagcaaaagaagggcttaagaggggtgaaatcacacatcacgctgtatcacgaggttcagccaaactacaatggtttgtggaacgaaacatggttattccggaaggaagagtcattgacctcggatgtggccgaggtggatggagttattactgcgcaggactgaagaaagtcactgaggttcgaggttatacgaaagggggcccgggacatgaggaacctgtacccatgtcaacttatggatggaatatcgtgaaacttatgagcggaaaagatgtattctacctacctcctgaaaaatgtgatacgttgttatgcgatataggagagtcatcaccttcgccaacagtagaagaaagcagaacaataagagtactgaaaatggtggaaccatggctcaaaaacaatcaattctgtataaaggttctaaacccatatatgcctacggtgattgaacatcttgagcgcctccaaaggaaacatggcggcatgttagttagaaacccactatctagaaattcgacgcacgaaatgtactggatatccaatggtactggtaatatagtagcgtcagttaatatggtgtccagactcctcctcaaccgatttaccatgacgcataggagacctactatagaaaaagatgttgatttaggagcagggacgaggcatgttaatgctgaaccagaaacaccaaacatggatgtaattggtgagcggattaaacggattaaagaagaacacaattccacatggcactatgatgacgaaaatccgtataaaacctgggcctatcatggaagctacgaagtaaaagcaacggggtcagccagttcaatgataaacggagttgtgaaactactgacaaagccatgggacgttgttccgatggtaacacagatggccatgacagataccactccatttggtcaacagagagttttcaaagaaaaggtagatacaaggacgccgagaagtatgccaggaacaaggagagttatgggcataactgcagaatggctatggagaaccttaggaagaaacaaaaagccacgtctgtgtacaagagaagaatttaccaagaaagtcaggacaaatgcagccatgggtgcagtttttactgaggaaaatcaatgggactctgccaaggcagccgttgaagatgaagacttttggaaattagtagatcgggaaagggagctgcacaagttaggcaaatgtgggtcgtgtgtttacaacatgatgggtaaaagggagaagaaactaggtgaatttggaaaagctaaaggctctagggctatttggtacatgtggctaggagcacggtacctagaatttgaagcattaggatttctgaatgaagatcactggttctctcgggaaaatagctattccggtgtagaaggggaaggtttgcataaactgggatacatactcagagatatatctaaaattcccggaggagctatgtacgcagatgataccgctggatgggacacccgtatcacagaggatgacctccacaacgaagagaaaataactcaacagatggacccggaacatcgtcaactagcgaacgccatttttaaactaacttatcaaaataaagttgtcaaggtgcagagaccaacacccaccgggacagtaatggatattatatcacgaaaagaccagagaggaagcgggcaagtcggtacttatggcctcaatacctttaccaacatggaagcacagctaatcagacagatggagggggaaggagtattaagcaaggcggatctcgaaaatccacacttaagtgagaagaaaattacccaatggctagaaacgaaaggtgtagaacgactgaaacgtatggcgatcagtggagatgactgtgtagtaaaaccaatcgacgaccgattcgctaatgcactattagctttaaacgatatgggtaaggtacgtaaagatattcctcagtggcagcctagtaaaggatggcacgactggcagcaagtcccattttgttcccaccactttcatgagctaattatgaaggatggtcgcaagttggtggtcccatgcagaccccaagatgaactaataggtagagctagaatatctcaaggcgcagggtggagtctcagagaaacggcctgtctcgggaaagcatacgcgcaaatgtggtcgctgatgtatttccaccgacgagacttaagactcgcatcaaatgcaatatgctcggctgttccggtgcactgggtgccgacatctagaacaacctggtccatacatgctcaccaccaatggatgacaacagaagacatgctaactgtgtggaatagggtgtggatcgaagataacccgtggatggaggataaaacccccgtgactacatgggaaaacgttccatacttagggaaaagagaagaccagtggtgcgggtctttgataggattaacatcgagagctacatgggctcaaaatataccgactgccattcagcaagtcagatcgttgataggaaatgaagaatttttagattatatgccatcaatgaaaagattccgaaaagaagaagaaagtgaaggtgcgatatggtag

SEQ ID NO: 23372 - RNA, 9873 nt, synthetic construct
  misc_feature 1..9873: note = derived and/or modified CDS sequence (opt6) from DENV-3__FJ547085__SS-prME
  source 1..9873: mol_type = other RNA
acttcactatgcttgatgatgatactacctgcagcactggcctttcatctaacatctagagacggggaaccgcgtatgatagtaggtaaaaacgaaagaggaaaatcactattatttaaaactgctagcggtatcaatatgtgtacattaattgccatggacttaggtgaaatgtgtgatgatactgtaacatacaaatgtccgcacatcacagaagtagaacctgaagatatagactgttggtgtaatctgacctccacatgggtaacttatggtacttgcaatcaggcaggcgaacatagaagagacaaacgttcagttgcactggcccctcacgtgggaatgggtctagacacaagaacgcaaacatggatgtctgcagaaggagcatggcgccaagtagaaaaagtggaaacttgggcactgaggcacccaggatttactatcctcgcgttgttcttagcacactacataggaacgagtctgacccagaaagtagttatttttatattacttatgcttgtaacaccatcgatgacaatgcgatgcgtaggagtgggtaatcgcgacttcgttgaagggttaagcggcgcgacatgggtagatgttgtactagaacacgggggctgtgtaactacgatggccaaaaataaacctacgttagatatcgaacttcagaaaacggaagcgactcaactggctacactacgcaaactatgcatagaaggtaaaatcactaatattactacagactcgaggtgtcctacacaaggggaagcagtccttcctgaagaacaagatcaaaactatgtatgcaaacatacgtatgtagatagaggttggggcaacgggtgtgggttatttggcaaaggttcgctagtaacttgcgccaaattccaatgtcttgaaccaattgaaggaaaagtcgttcagtatgagaatctaaaatacacagttattataaccgtacatactggagatcaacatcaagtcggaaatgaaactcaaggagtaacagccgaaataacccctcaagctagtaccactgaggcgattctaccggaatacggcacactggggctagagtgtagtccacgaacaggtcttgattttaatgaaatgattcttctaactatgaaaaataaagcatggatggtacacagacagtggtttttcgatctacccttaccatggacgagtggagccacaacagaaactccaacttggaatagaaaagagctattagtaacatttaaaaacgcccacgccaagaaacaagaggtagtggtcttgggcagtcaagaaggagccatgcatacggcgctcactggagctactgaaatacaaaactcaggtggcacaagtatatttgcaggacacctaaaatgcagactgaaaatggacaaattagagttaaaaggaatgtcttacgctatgtgcactaataccttcgtactaaagaaagaggtgtcagaaacgcagcacggtaccatcctaataaaagtagaatataaaggagaggacgtgccatgcaaaataccgttttcaacagaagatgggcaaggaaaagcacataacggtcgactaataacagcaaaccccgttgtgacgaagaaagaagaaccagtgaacatagaagcagaaccacccttcggtgaatcaaatatcgtaattggaataggggacaatgccctgaaaatcaattggtataagaaagggagctccatcgggaaaatgttcgaagcaacagcaaggggagcaaggagaatggcaatactcggcgacaccgcttgggatttcggtagcgtaggtggtgttctcaattccctaggaaaaatggtccatcaaatatttggtagcgcatatacagcacttttcagcggtgtaagctgggttatgaaaatagggatcggagtactacttacttggatcggacttaactctaaaaacacatctatgtcgttctcgtgtatcgcaatcggaatcataaccttatacttgggagcggtagttcaagcagacacaggatgcgtaataaactggaaagggaaagaattaaaatgcgggagtggaatctttgtcacgaacgaggtacacacatggaccgaacagtataaattccaagcagattctccaaaaagacttgctacggcgatagctggagcttgggagaatggagtatgcggaatccgatccacgactaggatggaaaatcttctttggaaacaaatagcgaacgagttaaattacatactatgggagaataatataaaactaacagtcgttgtgggagacattataggggtacttgaacagggcaagagaacactgactccacaaccgatggaattgaaatattcatggaagacatggggcaaagcaagaatagtcaccgcagaaacccaaaattcgagctttatcatagacggtcctaacacccctgaatgcccaaatacaagtcgcgcatggaatgtatgggaagtcgaagactatggatttggggtgtttactacaaatatttggcttaaattgagagaggtatacactcaactgtgcgatcataggttaatgtcagccgctgtaaaggatgaacgagcagtacacgcagatatgggatattggatcgaatcgcaaaagaacggtagttggaagctggaaaaggcatccctaattgaggttaaaacttgtacatggccaaaaagtcatacactatggtctaacggtgttttagagagcgatatgattatacccaaatcattagcaggaccaataagccagcataactatcgccctgggtaccatacgcaaactgctggcccatggcacttaggcaagctcgaacttgacttcaattactgcgaaggaactaccgttgtaataacagagaattgcggtaccagaggaccttcactgaggacgactacagtctcaggcaaactgattcacgaatggtgctgtagatcatgtacgctgccgcccttacggtatatgggtgaagatggatgctggtacggaatggaaatacggcccatctctgaaaaagaagaaaacatggtgaaatcattggtttcagcaggtagtggagaggtcgacaattttacgatgggtgtattatgcctagctattctgtttgaagaagtcatgagaggaaaatttgggaagaaacatatgatagcaggggtgttctttaccttcgtgttgttactaagtgggcaaattacgtggcgtgacatggctcacactttaattatgatcggctcgaacgcgacagatcgaatggggatgggcgtgacgtatctcgcattaatagcgacctttaaaattcaaccattcttagcattaggcttctttttaaggaaacttaccagcagggaaaacctactactgggcgttggattagccatggcaaccaccctacaactgccagaagatatcgaacaaatggcgaatggcattgccttaggacttatggcactaaaacttataacgcaattcgaaacctatcaactatggacagctttaatttctttaacgtgttctaataccattttcacactcacggtagcttggagaacagcaactttaatactggctggtgtcagtttattaccagtgtgccaatcatcttcaatgagaaagacagactggttaccgatgacagtagcagcaatgggcgttccaccgcttcctttattcatttttagtctcaaagacacgctaaaaaggagatcctggccactcaatgagggtgttatggctgttggcctcgtttcgatactagcgtcgagtcttttaagaaacgatgtcccaatggctggacccctagtagcaggcgggctccttatcgcttgttacgtaattactggaacatcggcagacttaacggttgagaaggcggcagatgtgacttgggaagaggaagctgagcaaacaggcgttagccataatctaatgataacagtggatgacgacggaaccatgagaattaaagacgatgaaacagaaaatatattaaccgtattattaaaaactgccttactaatcgtaagtggaatctttccatatagtataccagcaacattattggtctggcatacctggcagaagcaaacgcaaagaagcggcgtgctctgggatgttccatctccgccagagacgcagaaagcagaattagaagagggggtctatagaataaaacaacaaggcatttttggtaaaacccaagtaggggtaggagtccaaaaagaaggagtatttcatacaatgtggcacgtaacacgaggcgccgtattaacgtataatggaaagcggctagagcccaattgggcaagcgtgaaaaaggaccttatatcgtatggcggaggatggcgtctatcagcacagtggcaaaagggagaggaggttcaggtaattgccgtggagccaggtaaaaaccccaaaaactttcagactatgcctggaacatttcaaactacaacaggtgagataggcgcaatagcactggacttcaaacctgggacatccggtagtcccatcataaacagagagggaaaagttgtgggcctctatggcaatggggtagtgactaaaaacggaggctatgtatcaggcattgcacaaacaaatgcagagccagacggaccaacaccagaactagaagaagaaatgttcaagaaacggaacttaaccattatggatttacacccaggatctggaaaaactaggaagtatcttcccgcgatagtacgcgaagccataaaaagacgactacgaacgcttattttagcacccacaagggttgtggcagcggaaatggaagaagctctaaaaggtttgcctatacgttatcaaacaacagctacgaagtctgaacatacaggaagagaaatagtcgatctgatgtgtcatgcgactttcaccatgaggctcttatcgcctgtaagagtcccgaattataacttaataataatggatgaagcccatttcactgaccctgcgagtattgccgctcgtggctatattagtacaagagtaggtatgggtgaagcggcagccatctttatgacagccacgccaccaggaacggctgatgcgttccctcagagcaatgcccctatacaagatgaagaaagagacataccggaaaggagctggaatagtggaaatgagtggataacggactttgccggcaaaacagtttggtttgttccttcaattaaggccgggaatgatatcgcaaattgtttaaggaaaaatggcaagaaagtaatacagttatctagaaagacctttgacaccgaataccagaaaacgaagttgaacgactgggatttcgtagtgacaactgatatcagtgaaatgggagcaaacttcaaagcagatagggtaatagatccccggaggtgccttaagcctgttattctcacagacggaccggaaagagttattcttgcaggtccaatgccggtaactgccgcatcagcagctcaaagacgaggaagggtgggacgaaatcctcagaaagagaacgatcaatatatttttactggacaaccgttaaataatgatgaggatcatgctcactggaccgaggcgaaaatgttactcgataatataaatacaccagagggtataatacctgcactatttgaaccagaaagggagaaatcggccgcaatagacggtgagtataggttgaagggagaaagtagaaaaacattcgtagagctgatgaggagaggggatcttccagtatggttagcgcacaaagtagccagtgaaggtattaagtacacggacagaaaatggtgcttcgacgggcaaagaaataaccaaatactagaagaaaacatggacgttgagatttggacgaaagaaggagagaagaagaaattacgcccaaggtggttagatgcaagaacgtatagtgatccacttgccctaaaggagtttaaagattttgcagcggggagaaaatcgatcgcactagatttagtaacagaaataggacgggttccaacacatttagcgcaccggaccagaaatgctctagataacttggtcatgctacatacgtccgaacacggcggcaaagcctacagacatgctgtagaagagttgcctgaaactatggaaacactactgctacttggcttaatgattttgttgacaggaggagcaatgttatttttaatcagtggcaagggaataggtaaaacgtcaatcggtctaatatgcgtaatagcaagcagtgggatgttatggatggcagaaataccactacaatggatcgcctcggctatcgtattggaatttttcatgatggtcttactaatcccggaacctgagaagcaaagaacacctcaggataatcaattagcatacgtggtaattggcatattaacattagctgcgataattgcagcaaacgagatggggctactagagacaacaaaaagagatttggggatgagtaaagaacccggtgtggtttcaccaacaagttacttggacgtcgatttacaccccgcatcggcatggacattatacgcagtagcaactactgtaataacaccgatgttaagacatacaattgaaaattctacagccaacgtttccttagccgcaatagcgaaccaagcagtagtcctgatgggtctcgataaaggatggcccatcagcaaaatggacctaggggttccattgttggcacttggatgctactcacaagtgaacccattaacgctgacagctgctgtgttgctactcataacacactacgcaataatcggacctggcttgcaggcaaaggcaacacgcgaggcacaaaaacgtaccgctgcgggcatcatgaagaatcctacggtagatggaattatgacaatcgatttagaccccgtcatatacgattcaaaattcgaaaaacagttgggccaagtaatgctcttagtattatgcgcagtgcaattattgttaatgaggacaagttgggcactttgcgaagctctcactttagctacgggaccgattaccacgttatgggaaggtagtccaggtaaattctggaatactacaatagcagtatcaatggcaaacattttccgtggatcatatctagccggtgcgggcttagcttttagcattatgaaatccgtcggcaccggaaaaagaggtactggatcgcagggagaaacattaggggaaaaatggaaaaagaaactcaatcaattatccagaaaagagttcgatttatacaagaaatcaggaataactgaagtagatagaacagaagctaaagagggattaaaaagaggggaaattactcatcatgcggtaagccgaggaactgctaaattacagtggtttgttgaacgaaacatggtcattccagaaggcagagtaatagatcttggatgtggtcgaggaggatggtcatattattgtgcaggtttgaagaaagtcactgaagtacgaggatacacaaaagggggaccgggtcacgaagaaccagtgccaatgtcaacgtatggatggaatatcgtaaaactcatgtcggggaaagacgtcttttacctcccaccagaaaaatgcgacactctgttatgtgatataggagaaagttcgccttccccaactgtagaagaatcacggaccatcagagtacttaaaatggttgaaccatggttaaagaataaccaattttgtataaaggtacttaacccttatatgccagcagttatagaacatctcgaacgtttacaaagaaaacatggaggtatgttagtacgaaatccattgtcgcgaaacagcacccatgaaatgtattggattagtaacggaactggtaacatagtagcatcagtgaacatggtatcaagattattactaaacagatttacgatgacccatcgcaggcctactatagaaaaagatgttgatctaggtgcgggtacccgccacgtcaacgccgagcctgaaacaccaaacatggatgtaatcggggagagaattaaacgaataaaggaagaacacaactcgacatggcattatgatgatgaaaacccttataaaacttgggcatatcatggctcttatgaagtgaaagcaactggatcggcgagctcaatgattaacggagtggtaaaattattaacaaaaccatgggatgtcgtacctatggttacgcaaatggccatgacagacactacaccgttcggacaacagcgcgtgtttaaggagaaagttgacacgagaacgccgcgttccatgccgggcacaagacgagtaatggagataaccgcggaatggctatggagaactcttggtaggaataagaaacctagactgtgtacgcgggaagaatttaccaagaaagtcagaacaaatgcagcaatgggcgcggtcttcaccgaggagaatcaatgggattcggcgaaggcagcggtcgaagacgaagacttttggaaattagtggaccgagaacgtgagttgcacaaacttggcaaatgcggaagttgtgtttacaatatgatgggaaaacgagagaagaaactaggtgaatttggaaaagcaaaaggcagtagggccatttggtacatgtggttgggcgcaagatatttagaatttgaagcattaggttttcttaatgaagatcactggttctccagggaaaacagttatagtggagttgagggagaaggtttgcataaattgggttatattttaagagacataagcaaaattcccggaggtgctatgtatgcagatgatactgctggatgggacactcgaataacggaagatgacttacacaatgaagagaaaattacgcaacaaatggatccagagcatagacaattagccaatgcaatctttaaacttacatatcaaaacaaagtggtgaaagtacaacgacctacacctactggaacagtaatggatattatatctcgaaaggaccaacggggtagcggacaagtcggaacgtatggtctaaatacttttacgaacatggaagctcagttaattcgtcaaatggagggagaaggtgtattatcaaaagctgacctcgaaaatccccatttacccgagaagaaaataacgcaatggttagaaacaaaaggagtcgaaagactaaagcgaatggctataagtggagacgattgcgttgtaaagccaatagacgaccgtttcgcaaatgcattattagctcttaatgatatgggcaaagttcgaaaagacatacctcaatggcaacctagcaagggatggcatgactggcagcaagtaccattttgtagccaccacttccatgagctaataatgaaagatgggaggaaacttgtagttccgtgcagaccacaagatgaattaataggacgagctcgcattagtcaaggcgcaggctggtccttaagggaaacagcttgtcttggaaaagcgtatgctcaaatgtggagtttaatgtacttccatagacgagatctgcgacttgccagtaatgctatctgctcggcggtaccagttcactgggtaccaaccagcagaacaacttggtcgatacatgcgcaccaccaatggatgacaactgaagacatgctcacagtctggaaccgggtatggattgaagacaatccatggatggaagataaaactccagttactacgtgggaaaatgtaccatatttaggcaagagagaagatcaatggtgtggttccctaattggacttacaagccgggctacatgggcccagaacataccgactgccatacaacaagttaggagtcttattggcaatgaagagtttttggattacatgccgtccatgaaacgtttccgaaaagaagaagagagcgagggtgctatctggtaa

SEQ ID NO: 23373 - RNA, 9873 nt, synthetic construct
  misc_feature 1..9873: note = derived and/or modified CDS sequence (opt6) from DENV-3__EU482595__SS-prME
  source 1..9873: mol_type = other RNA
acatcattatgtctgatgatgatgcttcctgctgcactagcttttcacttaacaagtcgggatggggaaccaaggatgatagtcgggaaaaatgaacgaggaaaaagtttgctttttaaaacggcatcaggaataaatatgtgcacgctgatagctatggacctgggggaaatgtgtgatgacactgttacatacaaatgcccacacatcacggaagtagaaccagaagatattgattgttggtgcaatttaacgagtacatgggttacgtatggtacatgcaaccaagctggggaacacaggagagacaaaagaagtgtagcgctagctccacatgtaggaatgggcctggatacacgaacgcaaacctggatgtcggcagaaggggcatggaggcaagttgaaaaagtagaaacttgggcgcttcggcatcccggatttactattttagcactatttttagcacattatgtcggaacaagtttaactcaaaaagtcgtcatatttattctcctgatgctagtaacaccaagtatgacaatgagatgcgttggagtgggtaaccgagactttgtagaaggtttgagtggagctacctgggttgacgtggtactagaacacggcggatgtgtcaccaccatggccaaaaataaacctacgctagacatagagttacagaaaactgaggcaacacaattagcaactctacgcaaactttgtatagaaggcaaaattacaaatattactacagacagtcgctgtcctacacaaggcgaagccgtgttacccgaagaacaagatcaaaattatgtgtgcaaacatacgtacgttgatcgagggtggggaaacgggtgtgggctctttggtaaaggcagtctagtgacatgtgccaaatttcaatgcctagaaccaattgaaggaaaagtagtacaatatgaaaatctaaaatatacagtaatcatcactgtacatacgggggatcaacatcaggtaggtaacgagacacaaggagtgacggctgaaatcacaccacaggcttctacaacagaagcgatactccctgaatatggtacattgggactcgaatgttcaccaagaactggtcttgacttcaacgaaatgatattattaaccatgaaaaataaagcatggatggtacatcgccagtggttctttgatttgccattaccctggacctctggggcaactaccgaaactcctacctggaacaggaaagaactgctagtgacatttaaaaatgctcacgcaaagaaacaggaagttgtagttctaggtagtcaagagggagctatgcacacagcactaacgggagccacagaaatacaaaatagcggcggcacatctatattcgctggtcatttgaaatgccgattaaaaatggacaaattagaacttaaaggaatgtcatatgcaatgtgcacaaacacatttgtcctcaagaaagaagtttccgaaacacaacacggtaccatattaataaaggtggaatataaaggcgaagatgtgccatgtaaggtgccattttcaaccgaagatggacagggaaaagcgcataacggacgattaataacggcaaatccagttgtgaccaagaaagaggagcctgtaaatatagaagcggaaccacccttcggtgaatcaaacattgtaatcggaattggagacaacgcactaaagattaattggtacaagaagggatcttccatagggaaaatgtttgaagcaacagcacgaggggctcgccgtatggctattctcggagacacagcttgggactttgggagtgtcggcggtgtgctaaattccttagggaaaatggtacatcaaatatttggaagtgcctatactgctttgttttccggtgtatcatgggttatgaaaataggaataggtgtattgctaacgtggataggcttgaatagtaaaaacacttccatgagcttctcctgtattgttataggcattattactttgtatctaggagcggttgtgcaagctgatatgggatgtgtcataaattggaaaggaaaggagctcaaatgcggatcaggtatattcgttacaaacgaagtgcatacatggactgaacaatataagtttcaagctgattcacccaaacgactggcaaccgcaatagctggagcatgggaaaacggagtctgtggaattaggagtactacacgtatggagaacctcttgtggaaacaaattgcaaatgaactaaactatattctatgggagaataacatcaaattgactgtagtggtaggtgacattataggtgtattggaacaaggtaagagaatcctcacaccgcaaccaatggagctgaaatatagctggaagacttggggtaaagctaagatcgtaacagcagaaactcagaactcatcatttattattgatggaccgaatacacccgaatgcccgagcgccagtcgagcttggaatgtttgggaagttgaggattacggctttggtgtattctccactaacatatggttaaaattaagagaagtatatacccaattatgtgatcatcgattaatgtccgccgccgtcaaggatgaaagagcggtccacgcagatatggggtattggatagagagccaaaagaacggaagctggaaactcgaaaaagcaagtttaattgaggtaaagacctgcacttggccaaaaagccacacactatggagtaacggagtacttgagagcgatatgattataccaaagagcttggcaggccccataagccaacataattataggccaggttaccatacccaaacagccggtccttggcacctgggcaaattagaactagactttaattactgcgaaggaactactgtagttataactgagaattgtggcactagagggccctctctgcgaacaacaacggtgagcggaaaattaatacacgaatggtgctgtcggtcctgtactttaccaccactgagatatatgggagaagatggatgctggtatggcatggaaatcagaccaatttccgaaaaggaagaaaatatggtcaaaagtttagtatcagcaggatctggtaaagttgataacttcacaatgggagtgttatgtctggccattctattcgaggaagtaatgcgaggaaaatttggcaagaaacacatgattgccggagtatttttcacattcgtactactattgagcgggcagattacatggcgcgatatggctcacacattgattatgatagggtcaaacgcttctgaccggatgggtatgggggtaacttacttagctctgatcgcaacattcaaaattcaaccctttctagctttagggttctttttgagaaaactaacttctcgagaaaatctgttattaggagtaggccttgcaatggcgacaactttacaactacctgaggacatcgaacagatggctaatggaatagccttgggactaatggctttaaaacttattacacaattcgagacgtatcaattatggacggcattaatatcattaacatgctcaaacaccatctttaccttaaccgtagcatggagaacagcgacattaatcctggcaggcgttagtcttcttccagtttgtcaaagttcctcaatgagaaaaactgactggttacctatgacagtagcagcgatgggagtgccaccacttcctctatttatattctctctcaaagatacgctaaaacggaggtcgtggcccttaaatgagggagtgatggcagtgggtctggtctctattcttgcatctagccttctaagaaatgatgtaccaatggcaggtcccctagttgcaggagggctgttgattgcttgttacgtaattactggcacatcagcggaccttacagtagagaaagcagctgatgttacatgggaagaggaggctgaacaaacgggcgtaagccataatctcatgataacggtggatgatgacggcacaatgagaataaaagatgacgaaacggaaaacattctgacagtcctactaaaaacagcacttctaattgtgtcaggcatatttccttacagcataccagccacactattagtgtggcacacttggcagaaacaaacacaaagaagtggtgtactatgggatgtacctagtcccccagagactcaaaaagctgaactagaagaaggagtctacaggatcaaacaacagggtatttttggcaaaacacaggtaggagtaggagtacaaaaagaaggagtatttcacacaatgtggcatgttactagaggtgcggttttaacctacaacggtaaaagacttgaaccaaattgggcttcagtaaagaaagacttgattagttatgggggagggtggcgattaagcgctcaatggcaaaagggcgaagaagtgcaagtaattgctgttgagcccgggaaaaaccccaaaaattttcagaccatgcctggtacattccagacaacaactggcgaaataggcgctatagcccttgatttcaaaccgggaaccagtggcagcccaatcataaaccgcgaaggcaaagttgtaggattatatggaaacggtgttgtaactaaaaatgggggatacgtaagtggtatagcacaaacaaacgctgaacctgacggtcctgcccctgaactggaagaagaaatgtttaagaaaagaaatttgactataatggacttgcatccaggtagcgggaaaacaagaaaataccttccagccatcgttcgagaagctataaaacgaaggctaagaactttaatcctagctcccacaagagtagttgccgccgaaatggaagaagctctaaaaggtcttccgatcagatatcaaacaaccgcaacgaaatctgaacatacagggcgcgaaattgtcgacttgatgtgtcacgcaacattcacaatgagattattaagtccagttagggtaccaaattacaatttgataataatggacgaagcgcattttacggatccagcctccatcgccgcgcggggttatatatcaacacgagtagggatgggagaagccgcagctatttttatgacagcaacaccgcctggcacagcagatgcatttcctcaatcgaacgcacccatacaagatgaagaaagggatatacccgaacgtagctggaactctggcaatgagtggataacggattttgccggaaaaactgtctggttcgttccaagtattaaagcagggaacgatatagcgaattgccttagaaagaatggtaagaaagtaattcaactgtccagaaaaactttcgatacagaatatcagaaaacgaaactcaatgattgggatttcgtagtaacaacagatatctcagagatgggagcgaattttaaagcagatcgagtgattgacccaaggcgctgtcttaaacctgtaatattaacagatggccccgaaagagttatattagcaggaccaatgcctgtcacggcggcttctgcggcacaaagaagaggtcgcgtgggtagaaatccgcagaaagagaacgaccaatatatctttaccgggcaaccccttaataatgatgaagaccatgctcattggaccgaagcaaaaatgcttttagataacatcaacactcctgaaggtataattccagcactctttgaacccgaaagagaaaagtcggccgcgattgatggagaataccggctaaaaggtgaaagtcgtaaaacatttgtagaattgatgcggagaggagacctcccggtgtggttggcacataaagtagcgtcagaaggtataaagtataccgacagaaaatggtgttttgatggccagagaaacaaccaaatattagaggaaaatatggacgtcgaaatatggacgaaagagggtgagaagaagaaactaagacctcgttggttggatgcaaggacttacagtgatcctcttgcacttaaagaatttaaagactttgcagcaggtaggaagagtatcgccctggacctggtgactgaaatagggagagtgccatcacatttagcacatagaactcgaaacgcgttagataacttggttatgcttcacacaagtgaacacgggggaaaagcatatcgtcacgccgtcgaagaacttcctgaaacaatggaaactttgctacttctcggcctgatgattctgctcaccggtggagcgatgttattcctaatttctggtaagggaataggtaaaacctcaataggtctaatttgcgttatcgcaagtagcggaatgttatggatggcggaaatacccttacaatggatagctagcgcaattgttctcgaatttttcatgatggttcttttaatccccgaacctgaaaaacaacgtacgcctcaagataaccaattagcctatgtcgtaattggtatcttaaccctcgctgcaataatagccgcgaacgaaatgggacttctagaaacaacaaagagagatttaggaatgagtaaggagcccggtgtcgtaagtcctacttcatatctagacgttgatttgcatccagcatctgcatggacattatatgctgtggcaacgaccgtaataacccccatgttaagacatacgatagaaaactcaacggcaaatgtttcactggctgcaattgcaaaccaagcagtggtactaatgggcttagacaaaggttggccgatttcgaaaatggatctaggggtaccactactagcattagggtgttactcacaagttaaccccctaacattaacggcagcagtacttctacttattacccactatgccatcataggtccagggctgcaggctaaagccactcgagaggcgcagaaaagaacagccgcagggataatgaaaaatcccaccgttgacggaatcatgactatagacttagatccggtcatatatgattcaaaatttgagaaacagctcggacaagtgatgctattggtcttatgcgccgtccaattgctactaatgagaacaagctgggccctttgcgaagcactaacattagcgacagggcccatcaccactttgtgggaaggttcacctggtaaattttggaacacaactatagcggtgtcgatggcaaacatattccgtgggtcctacctcgccggcgcaggtcttgcattttcaattatgaaatctgttggaaccggtaaaagaggaactggaagccagggagaaacattaggtgagaaatggaagaagaaactcaatcagctgtctcgtaaagaatttgacctctacaaaaagagcggaattacagaagtcgaccgaaccgaagcaaaagaaggtctaaagaggggcgagattacccatcacgccgtttcacgtggcagcgctaagttacaatggtttgtagaaaggaacatggtcatccctgaaggcagagtaattgacttaggatgtggtagaggagggtggtcttattactgcgccggattgaagaaggtaactgaggtacgaggctatacaaaagggggccctgggcatgaggaaccagtgccgatgtctacatacggatggaatatcgtgaaacttatgagcgggaaagatgtattttacttaccaccagaaaagtgtgatactttgttgtgtgacatcggagagagtagtccatcacctacagtcgaagagagcagaactattagagtgttaaagatggtagagccttggttaaagaacaatcaattctgcattaaagttcttaacccatatatgccgactgtcatagaacacttggaaaggttacaacggaaacatgggggaatgttagttagaaacccgctaagtagaaacagcacccatgaaatgtactggatcagtaacggaacaggaaacatcgtagcctcagtaaatatggtttcacgattattactaaatagattcacaatgacccatcggcgaccaacaattgaaaaagacgtagatctgggcgccgggactcgtcatgtgaacgctgagccagaaacgcctaatatggatgtgattggagagcgaataaaaaggattaaagaggaacataatagtacatggcattatgatgacgaaaatccttacaagacctgggcgtatcatggtagttatgaagtaaaagcaacaggatccgctagtagcatgatcaatggcgtagtaaaacttcttacaaaaccatgggacgtcgtgccgatggtaactcaaatggccatgacagataccaccccctttggacaacaaagggtctttaaggaaaaagttgatacaagaacaccgaggagtatgccaggaacgagaagagtcatgggcataacagctgaatggttatggagaaccctaggacgtaataagaaaccgcggttatgcactagagaagagttcacgaagaaagtaagaacaaacgcagctatgggagccgtattcaccgaggaaaatcaatgggattcagcaaaagctgcagttgaagatgaagatttttggatcctagtcgatagagagagagaattgcataaacttgggaaatgcggctcatgcgtatataacatgatggggaaaagagagaagaaactgggagaatttggtaaagcaaaaggctctcgagctatctggtacatgtggcttggcgcaaggtacctagagttcgaggcacttggattcttaaatgaggaccattggttctcccgagaaaactcatattccggagtagaaggagaaggtctccataaattgggatatatcctgagggacatttccaaaattccaggcggtgcaatgtacgcagatgacacggctggctgggacacaaggatcaccgaagacgacctacataacgaggagaaaataacacagcaaatggatcctgagcatagacagctggctaatgccattttcaaattaacttatcagaataaagtcgttaaagtacaacggcccactcctactggtacagtaatggatataatttcgagaaaggaccaacgcggatcgggccaagtggggacatacggattgaacacatttactaacatggaagcacaactaatacgacaaatggaaggagaaggagttttaagcaaagccgacctcgaaaatccacatttaccagagaagaaaataactcaatggttagagacaaagggtgtggagcgattaaaacggatggctattagtggagatgattgtgttgtcaaaccaatcgatgatcgatttgcgaatgcactgctagctttaaacgacatgggaaaagtgagaaaagacataccgcagtggcaaccatccaaagggtggcacgactggcaacaggtgcccttttgtagtcaccactttcatgagctgatcatgaaagatgggcgaaaattagtagtaccttgtagaccacaagacgaattgattgggcgagctagaataagtcaaggcgcgggatggtctctgcgcgaaactgcgtgtttaggaaaagcatacgcacaaatgtggagtttaatgtattttcatagaagagatttgcggctcgcttcgaacgcaatatgcagtgctgtcccagtacactgggtcccaacgtcaagaacaacatggtcaatccatgctcatcaccaatggatgacgactgaagatatgctaaccgtatggaaccgagtatggatagaagacaatccctggatggaagacaagacgccggtgacaacctgggaaaatgtcccttacctaggtaaaagggaagaccaatggtgcggatctttaataggattgacttcccgagcaacatgggcacaaaacatacctacggcaatacagcaagtacgaagtctaatcggaaatgaagagtttttagattatatgccttccatgaaacgcttcagaaaggaagaagagagcgaaggtgccatttggtga

SEQ ID NO: 23374 - RNA, 9873 nt, synthetic construct
  misc_feature 1..9873: note = derived and/or modified CDS sequence (opt6) from DENV-3__EU482596__SS-prME
  source 1..9873: mol_type = other RNA
acttcgttgtgtctaatgatgatattacctgcagctctagcatttcatctaacatctagagacggagaaccccgaatgatcgtaggtaaaaacgaaagaggaaaatcactattgtttaaaacggcaagcgggattaatatgtgtactttgattgcaatggatttgggagaaatgtgtgatgatacagttacatataaatgtcctcacataaccgaagttgaacctgaagatatagattgttggtgtaatcttacttcaacgtgggtaacatatgggacgtgtaatcaagcaggggaacataggcgagataaaagatcagttgcactagcacctcatgtggggatgggtttagatacaagaacacagacctggatgagtgcggaaggagcttggaggcaagtagaaaaagtggaaacatgggcactaaggcatcctggcttcacaatacttgcgctatttctagcacattatattgggacatcactcacacagaaagtcgtaatattcatattactaatgcttgtgactccgtcgatgacgatgaggtgtgttggtgtaggaaacagagattttgtcgaagggttatcgggggccacctgggtcgatgtggtattagaacatggtggctgtgtaaccactatggctaaaaacaaaccaactttagacatcgaattgcagaaaactgaagcaacgcaattggctacactccgaaaactatgtatcgaagggaaaattacaaacatcactactgacagtaggtgcccaacacaaggcgaagccgtcctacctgaggaacaagatcaaaactatgtatgtaaacatacgtatgtcgataggggttggggaaacggttgtggtttgttcggcaaaggatccctagttacgtgcgctaaatttcaatgcttggaacctatcgaagggaaagtcgttcaatacgaaaatttaaaatacaccgtcatcataacagtccatacgggagaccaacatcaagtcggaaatgaaacccagggagtaacagcagagataactccgcaggcgtccactaccgaagcaattctaccagaatacggaactctgggactcgaatgttcgccaaggactggactggactttaacgaaatgatattattgacaatgaaaaacaaagcatggatggtgcacagacaatggttctttgaccttcctctgccttggacgagtggagcaacaactgaaactcctacttggaatcgtaaagagctcttagtgacatttaaaaacgcgcacgcgaagaaacaagaagtcgtcgtcctaggatcacaagaaggtgctatgcatacagcattaacaggagcaacagaaatacaaaattcaggaggcacatcgattttcgccggacacctaaaatgcagactgaaaatggataaattagaactaaagggaatgtcttatgcaatgtgcacgaatacattcgtcctaaagaaagaggtttcagaaacacaacatgggacgattttaataaaagtcgaatacaaaggtgaagacgtaccatgcaagatacctttttctacagaagatgggcaaggaaaagctcataatggaagactaattacagcaaaccctgtggtcactaagaaagaagaacctgtaaatatcgaagcagaaccaccttttggagaaagtaatattgtaatcggaattggagacaatgccctaaagataaactggtataagaaaggatcgagtataggaaaaatgtttgaggctacagcacgaggagccagacgcatggcaatattaggagataccgcctgggacttcggtagtgtgggaggtgttctaaattcacttggaaaaatggtacatcaaatctttggaagtgcatacacagcattgttctcaggcgtcagttgggttatgaaaatcggcattggggttttgctaacatggataggattaaattctaagaatacctcaatgtctttcagttgcattgctattgggatcatcactttatatcttggagcagttgtccaagcagatatgggttgtgtgattaattggaaagggaaagaacttaaatgtggctccggtatatttgttactaacgaggtccacacatggacagaacaatataaatttcaagcagacagtccaaaacgactagcgactgctattgcaggagcatgggagaacggtgtatgtggcataaggtcaacaacgcgaatggaaaacttactttggaaacaaatagcaaatgaactaaattacatactatgggaaaacaatataaaattaacggtagtggtaggagatattattggagttctagagcaaggtaaacgcaccttgacaccgcaacctatggagctcaaatactcttggaaaacctggggaaaagcaaaaatagtaacggcagagacccaaaactcaagttttataattgacggtccaaatacgcctgagtgtccaagtgcaagtcgagcgtggaacgtgtgggaagttgaagattatggatttggagtctttactacaaatatctggctaaaactaagagaagtctatactcagttgtgtgaccatcgtctcatgtcagcagcagtaaaagatgaacgggccgttcacgctgacatgggatattggatagagtctcagaaaaatggtagttggaaattggaaaaagcctcgttaatagaggtaaagacctgtacatggcccaaaagccatacgttatggtcaaatggtgttctggaatcggacatgattattccaaagagcttagcaggtccaatcagccaacacaattaccgtccgggctatcatacacaaaccgcaggtccctggcatctaggcaaactcgaactagactttaattactgcgaaggaacaactgttgtaataacagaaaactgtggtactaggggaccgtcactaagaactacgacagtatctggtaaactaatacacgagtggtgctgtagatcttgtacgttaccaccacttagatatatgggggaggacggttgttggtatggtatggaaataagacctatttcagaaaaagaagagaatatggtaaaatccctggtttcggctgggtctggtaaagtagataattttacaatgggtgttctctgcctcgcaattctttttgaggaagtaatgagaggaaagttcggtaagaaacatatgattgccggtgtatttttcacattcgtgttgctcctttccggacaaattacttggagagatatggcccacacacttatcatgataggatcaaacgcatccgatcgaatgggaatgggggtcacttacttagccctgatagctacttttaagattcaaccattccttgctttaggcttctttttgcggaaactcacttcacgggaaaatctattactcggagtcggattagcaatggcgaccacactacaacttcctgaagatattgagcagatggccaatgggatagcgttgggtcttatggcactaaagctcattacacaatttgaaacgtaccaactatggacagcgctaatttcgctaacatgttctaacacgatatttaccctaacagttgcatggagaacggcaaccttaatattagccggtgtatcacttctcccagtttgtcagagtagtagtatgagaaagacagattggttaccaatgacggtagcagcaatgggtgtacctccccttccactctttatcttcagtctaaaagacactctaaagcggagatcttggccactaaatgaaggggtaatggcagttggacttgtaagtatactcgcctcgagtctcttaagaaatgatgtaccaatggccggaccgctggttgctggaggtctactaatcgcctgttatgtaattacaggaacaagtgcggatttgacagtagagaaagctgcagatgtaacttgggaagaagaagccgaacaaacaggggttagccacaacctcatgataactgtcgacgacgatggtactatgcgtattaaagatgacgaaaccgaaaatatacttacagtattactaaaaactgcgttgttaattgtatccggcatattcccctattccatccccgcgactctgttagtatggcatacttggcaaaaacaaactcaacgtagtggcgtgctctgggatgtcccctcaccgcccgaaacacagaaggccgaattagaagaaggagtttatagaatcaaacaacaaggaatctttggaaaaacgcaagttggagtcggtgtacaaaaagagggggtttttcacaccatgtggcacgtaactcgtggtgcggttttgacttacaacgggaagcgcttagaacccaactgggctagcgtaaagaaagacctaatttcatatggaggtggatggcggttgagtgcacaatggcaaaaaggggaagaagtgcaagtgattgcggttgaaccgggcaaaaaccctaaaaattttcaaacaatgcctggaacattccaaacaacaacaggggaaataggagccatagcactagacttcaagcctgggacaagtggctcaccaataataaacagagaaggcaaagtagtaggtttatatgggaatggtgttgtaaccaaaaatggcggatacgtttctggcatagcacaaactaatgcggaacctgatggtccaacaccagaactcgaggaggagatgtttaagaaacggaatctaacaatcatggatctacatcctggaagcggaaaaacaagaaaatacttacccgcaatagttcgagaagccattaagcgcagactaagaacgttgatattggcaccaacacgagtcgttgcagcggaaatggaagaagcactgaaaggattgcccataaggtatcagaccacagcaaccaagagcgaacataccggacgcgagattgtagacttgatgtgccatgccacgtttacaatgcgtttattatcaccggtgagggtccctaattacaatcttataattatggacgaagcccatttcaccgatccagcgtctatagcggcgcggggttatatctcaacccgtgtcggaatgggtgaggcggctgccatttttatgactgctacgccacccgggacagctgatgcgttccctcaatcaaacgcaccaatccaagatgaagaaagggacatacctgaaaggtcgtggaactcgggaaatgaatggattactgattttgctgggaaaacagtatggtttgtaccctctattaaagcggggaatgacattgcgaattgtttacgcaagaatggtaagaaagtaattcagttatcgagaaaaacctttgacacagagtatcagaaaactaagctgaacgattgggattttgtggttaccactgatatctctgagatgggggcgaattttaaagctgatagagttatagatcctagaagatgtctgaaacccgtcatactaacagatggacctgaaagggtcatactagctgggcctatgcctgtaaccgctgcaagtgctgctcaacgacgcgggagagtaggaagaaacccgcaaaaagaaaatgatcaatatatttttaccggacagccactaaataatgatgaagaccatgcacattggactgaagccaaaatgttattggacaatataaataccccggaaggcataattccggcgctgtttgagcccgaacgggaaaaatcagcagcaatcgatggagaatatagactgaaaggagaatcaaggaaaacatttgtagagctaatgcgcagaggcgacttgcctgtatggcttgcacacaaagtggcatctgaagggataaaatatactgatcgcaaatggtgttttgatggtcaaagaaataatcaaatattagaggagaacatggatgtcgaaatctggaccaaggaaggtgagaagaagaaattacgtcctcgatggctagacgccagaacatatagtgatcctttagctctcaaagagttcaaagacttcgcggctggacgtaaatctatagcgctcgaccttgtaacggagatcggacgagtaccatctcatctagcacacagaacgcgaaatgcactagataatctcgtaatgttacatacaagtgaacatgggggcaaagcatatcgacatgccgtagaggaattaccagaaactatggaaaccctcctattacttggtctcatgatactgctaacagggggtgccatgctctttctaataagcggtaaaggtataggtaaaacttctatcgggctaatctgtgtaattgcttcgtcaggaatgttgtggatggcggaaataccactacaatggatagccagcgctatagtcttagaatttttcatgatggtccttctaatccccgaaccggaaaaacaacgaacccctcaagacaatcagcttgcttacgttgtaattgggatattgacgttagctgcaattatagcagcgaatgaaatgggactgttagaaacgacaaaacgggacttaggaatgtcaaaagaaccgggagttgtatctcccacaagctatttagacgtagatctgcatcctgcttctgcctggactctttatgctgtcgcgactacagtgatcactcccatgttacgacacacaatagaaaattctaccgctaatgtatcattggctgcaatcgctaaccaagccgtagtactgatgggtttagacaaaggttggccgattagtaaaatggaccttggagtcccgctattagccttgggatgctattcccaagtaaacccattgacccttaccgccgcagtattgttattgataacacattatgctatcataggacctggactgcaagctaaagcaacacgtgaggctcagaaaagaacagcagctggtataatgaaaaatcccaccgtagacgggataatgacgatagatttagatccagtaatttatgacagcaagtttgaaaagcagttagggcaagttatgcttttagtgttgtgcgcagtccagctccttctaatgagaacttcatgggcattatgtgaagctctgactttagcaaccgggcccataactacactgtgggagggttcaccaggaaaattttggaatacaacgatcgcggtatctatggcaaatatttttagaggttcgtatctggcaggagcagggttagcattttccattatgaaaagcgttggtaccggtaaaagaggtacagggagccaaggtgaaacactaggagaaaaatggaagaagaaactaaatcaactatccaggaaggaatttgatctgtataagaaatctggaatcacggaagtagaccgaacagaagcaaaagaagggttaaagagaggagagataacccatcatgccgtaagtcgaggttcagccaagctgcaatggttcgttgaaagaaatatggttattcctgaaggaagagtaattgacttaggttgtggacgagggggctggagctactactgtgcaggcttgaagaaagtaacggaagtcaggggatatacaaagggtggtccaggtcacgaggaaccagttcccatgtccacatatggttggaatattgtaaaattaatgagcggaaaagatgtcttctacttaccgccggagaagtgtgatactttactgtgtgatataggagaaagttcacctagtccaacggtcgaagagagtagaaccatcagagtattaaagatggtagaaccgtggcttaaaaataatcaattttgtataaaagttctgaatccctatatgccaacagttatcgaacatcttgaaaggttacaaagaaaacatgggggtatgttagtgagaaatcctttatcgagaaactccacacacgagatgtactggatttctaacggaactggaaatattgttgcatccgttaacatggtaagtcgattattgctaaatcgcttcaccatgacacatcgacgtcctacaatagaaaaagacgtggatttaggagctggtacaagacatgtaaacgctgagcctgaaacacccaacatggacgtcataggagagagaatcaaaagaatcaaagaagaacacaacagcacatggcattatgatgatgaaaacccttataaaacatgggcataccatgggtcatacgaagtgaaagctactggcagcgcatcttccatgataaatggagtggtcaaacttctgaccaaaccgtgggatgtggttcctatggtaacacagatggcaatgacagacacaacaccctttggacagcaacgagtatttaaagaaaaggtagatacgaggaccccgcgaagtatgccggggacccgcagagttatggggataaccgctgaatggctatggcgaacacttggtcgtaacaagaaaccacgtttatgtactagagaggagttcactaagaaagtaagaacaaacgctgccatgggtgctgtattcacagaggaaaatcaatgggattcagcaaaggcagcagtcgaggatgaagatttttggaagctggttgaccgagaaagggaattacacaaactaggtaaatgtggaagttgcgtatacaacatgatgggaaaaagagagaagaaactgggcgagttcggaaaagcgaagggatccagggccatctggtacatgtggcttggtgcaaggtacctggagttcgaagctcttggatttctaaatgaggatcactggttttctcgggagaactcttattcaggagtagaaggtgaagggttacataaacttgggtacatcctacgagacatctcgaaaataccgggaggggcaatgtacgcagacgatacggcgggttgggacaccagaatcactgaagacgatttacacaacgaggagaagataactcagcaaatggatccagagcacagacaattagcaaatgcaattttcaaattaacatatcagaacaaagtcgtcaaagtacaacgaccgacgcctaccggcactgtaatggatataatcagtcgcaaagaccaaagaggatccggacaagtaggtacatatgggctaaacacatttacgaatatggaggcacaactaataagacagatggagggcgaaggagtattgagtaaggctgatctagaaaacccccacttaccggagaagaaaattacgcaatggttagaaaccaaaggtgtagaacgtcttaaacgaatggctatctcaggggatgactgtgtggtaaaacctattgacgatcgcttcgcaaacgcgctgttagcactgaacgacatgggaaaagtcagaaaggatataccacagtggcagccttcgaaagggtggcatgactggcagcaggtacccttttgtagccaccatttccacgaactgataatgaaagatgggagaaaattggtggttccctgtagaccacaagacgaactaatagggcgtgcgagaatctcccaaggagctggttggtctctaagagaaacggcatgtctaggaaaggcttatgcacagatgtggtcactaatgtatttccacagaagagatctaaggcttgcttcgaatgcgatttgctccgctgtcccagtacattgggttcctaccagtcgaactacatggtcaatacatgctcaccatcaatggatgacaaccgaagacatgttaacagtatggaatagggtttggatagaagataacccatggatggaggataaaactcccgttacaacctgggagaacgttccgtatttaggaaaacgcgaagatcagtggtgtgggtcgctcattggactgactagcagagcaacgtgggctcaaaatatccccactgctattcaacaagttaggagtcttataggaaacgaggagttcttggattacatgcccagtatgaagagattcaggaaagaggaggaatcagaaggcgccatatggtaa

SEQ ID NO: 23375 - RNA, 9873 nt, synthetic construct
  misc_feature 1..9873: note = derived and/or modified CDS sequence (opt6) from DENV-3__JQ922554__SS-prME
  source 1..9873: mol_type = other RNA
acatccctgtgtctgatgatgatgctacctgctactttagcatttcatttgacatcaagagatggtgaaccacgcatgatagtcggtaaaaatgaacgtggaaaatcactcctatttaaaacggcgtcaggaataaacatgtgcacacttatagctatggatctaggtgaaatgtgcgatgatacagttacatataaatgcccacacataacagaattagaaccagaagacatagattgttggtgcaatctaactagcacgtgggtgacatatgggacatgtaatcaagctggggaacatcgaagagataaaagaagtgtggcactagcacctcatgtaggtatgggactcgacacaagaacgcaaacatggatgagtgctgaaggtgcttggagacaagtggaaaaagtggaaacatgggcattacgacatccaggtttcacaatacttgcactctttttagcacactacataggaaccagcttgacgcaaaaagtagtaatatttatattattaatgttggtgactccgtcgatgacgatgcgttgtgtaggagtggggaaccgcgactttgtagagggcctcagcggtgctacatgggtggacgttgtattggaacatggcggctgcgtaactactatggctaaaaataaaccaactcttgacattgaactacagaaaactgaagcaacacaactagctactttaagaaagctatgtatagaaggaaaaatcacaaatataacgacagacagtcgttgtcctacccaaggcgaagcgatcctacccgaagaacaagatcaaaattacgtgtgcaaacacacctatgtagacagaggctggggaaacggctgcggactctttggaaaaggaagtctagtaacctgtgcaaaatttcaatgcctggagtccattgaaggcaaagtagtacaacatgaaaatttaaaatatacagtcatcattactgtacacacaggagatcaacatcaagtcggtaatgaaacccaaggagttacagcggaaatcacatcacaggcatcaacagcagaagctatactccctgaatacgggaccctagggttagaatgttccccaagaacaggactagattttaatgagatgatattgctgacaatgaaaaacaaagcgtggatggtacaccgtcaatggttctttgatttacctctaccgtggacgagtggagcgaccacaaaaacgcctacttggaataggaaagagctgcttgtcacttttaaaaacgctcatgcgaagaaacaagaagtggtagttctaggaagtcaagaaggtgcaatgcatacggctctaacaggcgcgactgaaatccagacttctggaggaacttcaattttcgcaggacatttaaaatgcaggttaaaaatggacaaacttgaattgaaaggaatgtcatatgccatgtgtctaaatacttttgtacttaagaaagaagtcagtgaaacgcaacatggaacaatattgattaaagttgagtataaaggagaagacgcaccatgtaaaatacccttttcaactgaagacggacaagggaaggcacacaacggacgactgattacggcaaatcccgtggttacgaaaaaggaggagcccgtcaatatagaagctgagccaccctttggtgaatcaaacatagtaatagggataggggacaaagcattaaaaataaattggtaccgcaaaggaagttcaatcggaaaaatgtttgaagcgacagcaaggggcgcacgtaggatggcaattctaggggatacagcatgggattttgggtcggtcggcggggtcctaaattctcttgggaaaatggttcatcaaatatttggaagtgcatatacggcactattcagtggagtatcctggattatgaaaattggaataggcgtgctgcttacgtggatcggcttaaatagcaaaaacacttctatggctttcagttgtattgcaataggtatcattaccttatacgtaggggtagttgtccaagctgacatgggttgcgttattaattggaaaggtaaagaactaaaatgcggaagtggtattttcgtgacaaatgaagtacacacatggacagaacaatacaaatttcaagccgactcaccaaaaagactagctacagcaattgcaggagcatgggagaacggcgtatgcggtatcaggtctacaaccaggatggaaaatctactatggaaacaaatcgccaatgagctaaattatattctatgggaaaacaacattaaattaactgttgttgttggcgacattaccggtgtacttgagcagggagaaagaacactcacaccacaacctatggaacttaagtattcatggaaaacttggggcaaggccaagattgtaacagcggaaacacaaaactcatcatttattattgacggtccatcaacacctgaatgcccaagtgctagtagagcatggaacgtatgggaggtcgaagactatggattcggtgtcttcactactaacatttggttgaaattaagagaagtgtatacacaactatgtgaccacagattaatgtctgctgcggtaaaagatgagcgagccgtccacgccgacatgggatattggattgaatcacagaaaaatggcagctggaaattggaaaaagccagcttgattgaggttaaaacttgcacgtggccgaagtctcacactttatggtcaaacggagtcctcgaaagcgacatgatcattccgaaatcccttgccggtccaatatctcaacataaccatagaccgggctaccacacacaaacagcaggaccctggcacttaggtaaactcgagttggatttcaattactgtgaaggaacgactgtagtaatatcagaaaattgtggtactagaggacctagtttaagaaccaccaccgtatctggtaaactaatacatgagtggtgttgtagaagctgtactctgccaccattgagatacatgggcgaggacggatgttggtatggaatggagattcgacctatcaatgagaaagaggaaaacatggttaagagtctggccagcgccggatccggtaaagtggataatttcactatgggagttctatgcctagctattctcttcgaagaagtaatgcgaggaaagttccggaagaaacacatgatagctggcgtactattcacattcgtactgctactgtccggacagataacctggcgtgacatggcacacacgctaataatgataggctccaacgcaagcgatcgcatgggtatgggagtaacttatttagctttaatagcgacctttaagattcaaccgttcctcgcactcgggttctttttaagaaaattaacttcacgagaaaacctactattaggagttggattagctatggctgcaacgctgagattgccagaagatattgaacaaatggccaatgggatcgctctagggctcatggctttaaagctgattacgcaatttgaaacttaccagctctggacagcccttgtttcactgacgtgtagcaatactatattcaccctcacagtagcgtggagaacagccaccctaatattggcggggatcagcttattgcctgtttgtcaaagttcgagtatgcgaaaaacagattggctaccaatgactgtagcagctatgggggttccacccctgccccttttcatatttagcttaaaggacactctcaaacgcagatcatggcctttaaacgaaggagttatggcagtagggttagtaagcatcctagcatcatcattattacgtaatgatgtaccaatggctggaccgctagtagccggtggtttattaatagcgtgctacgtcattacgggaacttcagctgatttaaccgtagaaaaggccgctgacgtgacatgggaggaagaagctgaacaaactggagtatcacacaatctgatgataactgttgacgatgatggaaccatgagaattaaagatgacgaaacggaaaacatcttgactgtgttgctaaagacggctttgctgatcgtaagtggaatttttccatattctatacctgcaacgttactggtatggcacacttggcaaaaacaaacacaacgctctggggtgctatgggacgtaccgagcccaccagaaactcaaaaagcagagcttgaagaaggtgtataccgaataaaacaacagggaattttcgggaagacgcaggtaggggttggtgtccaaaaagaaggggtctttcatactatgtggcatgtaacgaggggcgctgtcttgactcataacgggaaacgactggaacctaactgggcctctgtcaagaaagaccttattagttatgggggaggttggaggttatccgcacaatgggccaaaggaggagaaacccaagtgatagctgtagaacctggcaaaaatcccaaaaactttcaaaccatgcctggtattttccaaactaccacaggcgaaataggcgcaatagcactagatttcaagcccggaacatctggctcccccataataaacagagaaggaaaagtagtaggtctatacggcaacggagtagtcaccaaaaacggtggatatgtaagtggtattgcccaaactaatgcggaattggatggaccaacaccagaacttgaagaagaaatgtttaagaagcgaaatttgactattatggatttacacccgggttccggtaaaacaaggaaatatttacctgccatcgtacgagaggcgataaagcgacgattaaggacactcatactagctcccactcgagtcgtcgccgcagaaatggaggaagcactaaaaggattaccgataagatatcaaacaacagcaacaaaatccgaacataccggtcgtgaaatagtggatttgatgtgtcatgccactttcaccatgagactattgagtcctgtaagaggcagtaactataatcttatcattatggatgaggctcatttcacggaccctgcatcaatcgcagcaatcggttacataagtaccagagtgggaatgggtgaagcagcggcaatttttatgacagctacaccaccaggaacagtagatgcgttccctcaatcaatacctccgattcaggacgaagaacgcgacatcccagaacgaagttggaactcgggaaacgagtggataacagacttcgtgggaaaaacagtatggttcgttccttccattaaagctggaaacgatatcgcaaactgtctgcggaagaacggcaagaaagttatacaattgagtcgcaagacattcgacactgaatatcagaaaactaaattaaatgactgggattttgtggtaaccactgatatctcagaaatgggtgcaaactttaaagccgatcgggtaatatatttaagaaggtgcttaaaaccagttatcttgactaatggaccagaacgggtgatcttagcaggacctatgccagttacagtcgccagtgccgcccaaaggcggggacgcgtcggacgtaatccccaaaaagagaacgatcagtatatattcatgggacaacctcttaataatgatgaagaccatgcacattggactgaggctaaaatgcttctagataacatcaacacaccagaagggattattccagcgctttttgaaccggaacgtgaaaaatccgccgcaatcgatggagagtatagactaaaaggtgaatcaaggaagacgtttgttgagttaatgaggcgaggagaccttccagtatggttagcacataaagtagcatcagaaggtatcaaatacaccgatagaaaatggtgctttgacggtgaaaggaataatcaaatattggaggaaaatatggatgtagaaatctggactaaggagggagagaagaaaaattggcgaccgagatggttagatgccaggacatatagcgatccattagcactgaaagaatttaaagatttcgcggcagggcggaaatccatagcattagatttagttaccgaaataggaagagtaccgtcacacttagcacacaccgtacgcaatgcattggacaaccttgtcatgttacatacttcagaacacggtggacgtgcatataggcacgccgttgaggaacttccagaaacaatggaaactttgttgctattgggacttatgatactgctaacaggaggtgcaatgctttttctaatttcaggtaagggaataggaaaaacttcaattggattgatttgcgtaatagcgtcatcaggtatgttatggatggctgacgtaccgttacagtggatagcaagtgcaatagtcctggagttctttatgatggtacttttaattccagagccagagaaacaacgcactccacaagataatcaactcgcctatgtagtaattggcatattgacactagcagccattgttgcagctaacgaaatggggctactcgaaactacaaagcgcgatttaggtatgtcaaaagaacctggcgtggttagtcccacaagttacttagacgtcgacttgcatcccgcaagtgcttggaccctgtatgctgttgcgacaccggtaataacaccaatgcttagacatacaatcgaaaattcaacagcaaatgtttcactagctgcgattgccaatcaagctgtagtgctcatggggttagataaaggctggcctatttcaaaaatggacttaggcgtacctttacttgcattaggctgctattcacaagtaaatcctctgacattagcggcagctgtacttctgctagtgacacattatgcgattattggaccaggattgcaagcaaaggctactcgtgaggcacaaaaacggacagcagctggaataatgaaaaaccccactgtagatgggatcatgacaatcgatctagatcctgtaatatacgactcgaagtttgagaaacaattgggtcaagtaatgttacttgtgctttgcgcggttcaattactactgatgcgaacctcatggcctctctgcgaagtattagcgttagctacgggtccaatcacaacattatgggaaggatcccctgggaaattctggaatacaacgatcgctgtcagcatggccaatatatttaggggttcctatttggcaggagcgggattagctttttcaattatgaaaagcgtaggaacgggtaaacgaggaacaggtagccaaggagaaacacttggggagaagtggaagaagaaattaaatcaattgtctcgcaaagaatttgatttgtataagaaaagcgggataacagaagttgatcgtaccgaagctaaagagggattgaaaagaggtgaaattactcatcacgcggttagtcgtggatcggcaaaactgcaatggttcgtagagagaaatatggtatttcctgagggaagagtcattgatctgggatgcggaagaggtggatggtcgtattattgtgccggactcaagaaagttacagaagtgcggggctacacaaaaggcggccctggacacgaagaacccgtgccaatgagtacatatggatggaatatagttaaactaatgtcgggaaaagatgttttctatttaccaccagaaaagtgcgatacattattatgcgacataggcgaaagtagcccgtcaccgactgtggaagaatctcggacaataagagtactaaaaatggtagagccctgggtgaaaaacaaccagttttgcataaaagtacttaatccatatatgccatccgtcattgagcatctagaaaacttgcaaaggaaacatggaggaatcctagtaagaaatccactttcccgaaatagtactcatgaaatgtactggataagcaatggaacgggtaacattgtatcttcagttaatatggtatctagactcctcttaaacagatttaccatgacacatcgaagaccaacgattgaaaaagacgtcgacttaggcgccggaacacgacatgtgaatgccgaaccagagactccaaacatggacgttataggtgaaagaattaagagaattaaagaagaacactcgtctacctggcactatgatgatgaaaatccctacaaaacatgggcttatcatggaagttacgaagttaaagctaccgggtcagcgtcgtcaatgattaacggcgtggtaaaattactaaccaaaccatgggacgtagtccccatggtaacacaaatggctatgacagacacaactccattcggtcaacaacgagtttttaaagagaaggtcgatacacgtactccgcggcccatgccaggtacgcgcaaagtaatggaaattacagcagaatggttatggagaacgctaggacgaaacaaaagacctcgactttgcactagagaagaatttacaaagaaagtacgaacaaacgcagcgatgggggctgtatttacagaagaaaatcaatgggattctgccagagcagcggtggaagatgaagaattttggaaattggtagacagggaacgcgaactacacaaattaggaaagtgtggaagttgcgtatataacatgatgggaaaacgggagaagaaactcggagaatttggtaaagcaaaagattctagggcaatatggtacatgtggttaggcgcccgttatctggagttcgaagcacttggattcttaaatgaagaccactggttcagtagagaaaactcctactcaggagtggagggcgaaggcctacataaactaggatacattttacgagacatatctaaaatccctgggggagcaatgtatgcagatgatacagcggggtgggatacacgtataaccgaagacgatttacataatgaggagaaaattactcaacaaatggcgagagaacatcgccagctagccaacgctattttcaagttgacatatcagaacaaggtcgttaaagtacaaaggccaactccaaaaggaacggtaatggatattatttcacggaaagaccaaagaggtagcggtcaggttggcacctacggacttaacacattcacaaatatggaagcacaattaatacgacaaatggagggggaaggagtgttatcaaaggctgatttagagaatccacacccgcttgagaagaaaataacgcaatggttggaaaccaagggcgtcgaaagattaaagcgtatggcgataagtggcgatgactgtgtggtcaaaccaatagatgacagattcgccaatgcactacttgctttaaacgacatgggaaaagtacgcaaagacattccgcaatggcaaccatccaaaggatggcacgactggcagcaagttcctttttgctcgcatcactttcacgaactaataatgaaagacggacgaaaattggttgtaccgtgcagaccacaagatgagttgctaggaaaagctcggataagccaaggagcgggttggagtctaagagaaacagcctgtttgggtaaggcgtacgcccaaatgtggactttgatgtactttcatagaagagaccttagattagcgagtaatgcaatatgcagtgcagtaccagtacattgggtacctacgtcaaggacaacatggagtatacatgcccaccaccaatggatgacaacagaagatatgctaacagtctggaatagggtgtggatagaggataacccctggatggaagataaaacacccgttaccacctgggaagacgtcccctacctgggtaaaagggaggaccaatggtgtggtagcctaattggattaacaagcagagccacatgggcacaaaatattttaacggccatccaacaagtgaggagcctcataggaaatgaagagtttctcgattatatgccttctatgaaacggttcagaaaagaagaagagtctgaaggtgcaatttggtaa

SEQ ID NO: 23376 - RNA, 9873 nt, synthetic construct
  misc_feature 1..9873: note = derived and/or modified CDS sequence (opt6) from DENV-3__EU529683__SS-prME
  source 1..9873: mol_type = other RNA
acatctctctgtcttatgatgatcctgcccgctgctttagcgtttcacttaacatctagagacggggaaccgagaatgatagtcggcaaaaacgaaagaggaaaatctttattatttaaaaccgcttcaggtataaatatgtgtacattgattgcaatggacctaggcgaaatgtgcgacgatacagtcacatacaaatgtccgcacataacagaagtagaaccggaagacatcgattgctggtgcaacctaacgtcaacatgggttacctatgggacatgcaaccaagccggtgaacacagacgagataaacgaagtgttgcactagcaccgcatgttgggatgggactagacacgaggacacaaacatggatgagcgccgaaggagcttggaggcaagtagaaaaagtagaaacgtgggctctccgacacccagggtttacaatccttgcattatttttggcacattatatagggacaagtctaacacaaaaagtcgtaatctttatcctgttgatgttggtgacaccttcaatgacaatgcgatgcgtaggggtaggtaacagggattttgttgaagggctatctggggctacatgggttgatgtagtactagaacatgggggctgtgtaacaacgatggccaaaaataaacctactttagatattgaactacagaaaacagaagcaacgcaactagcaacgttgcgtaaattatgtattgaaggaaaaataaccaacataacgacagactcacgatgtcctacccaaggcgaggcggtacttccggaagaacaagaccaaaattatgtttgcaaacacacctatgtagaccggggatgggggaatggttgcggtcttttcggcaaagggtcattagtgacatgcgcgaaattccaatgcctagaacccatagaagggaaagtagtacagtatgagaaccttaaatatacagttataattactgtacacaccggagaccaacaccaagtcggaaatgagacacaaggagtcacggctgagattacaccacaagcatcgacgaccgaagctattttgccagaatatgggacactcggtttagaatgttcccctaggactggcttagactttaacgaaatgattctgttgacaatgaaaaacaaagcatggatggtgcatagacagtggttctttgatttaccactgccatggacatccggtgccacgaccgaaaccccgacatggaataggaaagagttgttagtaacctttaaaaatgcgcatgcaaagaaacaagaagtggtagtattgggttcccaagaaggagctatgcacacggcccttacaggtgctacagaaatccagaactcagggggtacttccatcttcgcaggacatctgaaatgtaggcttaaaatggacaaactcgagctaaaagggatgtcttacgcaatgtgcaccaacacatttgttctaaagaaggaagtaagcgaaacccagcatggtacaatactgattaaagtagaatataaaggggaagacgtgccttgtaaaattccattttcaacggaagatggtcaaggtaaagcacataacggcagattaataacagccaaccccgttgtaactaagaaggaagaacccgtcaatatagaagctgaaccaccatttggtgaaagcaacatcgtaatcggaataggggacaatgcacttaagattaactggtataaaaaggggagtagtatcgggaagatgtttgaagctactgcccgtggtgcaagacgtatggcaatccttggtgatacagcatgggacttcggtagtgtaggcggtgtactgaacagtcttgggaaaatggtgcatcaaattttcgggtccgcttatacagcactattcagtggtgtctcttgggtaatgaaaataggcataggtgtgctgttaacatggattggattaaattctaaaaacacctcaatgagtttttcatgcatagcaataggaattattacgctttatttaggcgcagttgtgcaggctgatacaggatgcgttatcaattggaaagggaaggagctaaaatgtggatcgggaatattcgtcaccaatgaagtacatacatggacggaacagtataaattccaagccgattcacctaaaagacttgccactgcaatagcaggagcctgggaaaatggtgtatgcggaataagatcaactacgagaatggaaaacctcttatggaaacagatcgcaaatgaacttaattatattctgtgggaaaacaacatcaaattaacagtagtcgtaggagatataataggagttttagaacaaggtaaaagaacgctaacacctcaacctatggaattaaaatattcttggaaaacctggggaaaggcacgaatagtcacagcggaaacccagaacagtagctttataatagatggaccgaacactccagaatgccctaacacgtcgagagcctggaatgtctgggaagtcgaagactatggttttggagtattcacaaccaacatttggctgaagctaagagaggtatacacgcaattgtgcgatcacagactaatgtccgctgcggttaaggatgaacgcgcagtacatgcggatatgggatactggatagaatcgcagaaaaacggttcttggaagttagaaaaggcttcacttatcgaggttaagacgtgcacctggccgaaatctcacactctatggtccaatggagtgcttgaatcagacatgatcataccaaaaagtttggcaggacctatctcgcaacacaactaccgtcctggatatcatacacaaacagccggaccctggcatttgggaaaacttgaacttgattttaactactgcgaaggaactacggtagtcataacagagaattgcggaactagaggtccaagtttaagaactactactgtatctggcaaactaattcacgaatggtgttgtcggagctgtacgttaccacccttacgctacatgggcgaagatggatgctggtatgggatggaaatacgtcctatatcagagaaagaggaaaatatggtgaaatcgttagtaagcgcggggtcgggcgaggttgacaatttcacaatgggtgtactttgtctagcaatattatttgaagaagtaatgcgtgggaagtttgggaagaaacatatgattgccggtgttttctttacctttgtgttacttctatcgggtcaaattacatggcgcgatatggcacataccctaattatgattggctccaatgctacagaccgaatgggaatgggagtaacctatttagctttgattgcaacattcaaaatacaaccatttcttgccttgggatttttcttaagaaagctgacttctcgcgagaatttgttgcttggggtaggactagcaatggcaacaacattacaacttcctgaagacatagaacaaatggctaacggaatagcccttggactcatggcccttaaattaataacgcaattcgaaacatatcagttgtggactgcccttatcagcttaacatgctctaatacaattttcacactgactgtggcctggcggacagcaacattgattttagcaggagtctcattgctgccggtatgtcagagttcctctatgcgaaagacagattggctaccaatgactgtggccgcgatgggagtaccacccttgccacttttcatattttcattgaaagatacccttaaaagaagatcgtggcctttgaacgaaggagtaatggccgtagggcttgtgagtatactggcgagttcactgctacggaatgacgtaccgatggcaggtccattagtagcaggagggttattaattgcttgttatgttataactgggacgtcagcggatttaacagtagaaaaagcagcggatgtaacatgggaagaagaagcagaacaaacgggggtatcgcataatctaatgataacagttgatgatgatggaaccatgagaataaaagatgatgagactgaaaatatcttaactgtgcttctaaaaacggcgctattaatagtctccggtatattcccatattcgatcccagcaactcttttagtctggcacacttggcagaaacaaactcaaagatcgggtgtgttatgggacgtccctagccctcctgaaactcaaaaggcggaactggaagaaggagtatataggatcaaacaacaaggtatatttgggaagacacaagtaggcgtaggggtacagaaagagggcgtttttcatactatgtggcacgttactagaggtgcggtactaacttataatggtaaaagactagaacctaactgggcttctgttaagaaagatttaatatcttatggcggaggctggagactaagcgctcaatggcagaaaggtgaagaggttcaggtgatagctgttgaacctgggaaaaatccgaaaaatttccagactatgccaggtacttttcaaacgacaacaggagaaattggagctatagcactagacttcaagcctggaacatcaggcagtcccataattaacagagaaggaaaagtagtaggactttacggaaatggcgtagttaccaagaatggcggatatgtatcgggtatcgcccaaaccaacgcggaacctgacggacctaccccggaattggaagaggaaatgtttaagaaacgcaatctcacaataatggatctgcatcctggaagcgggaagacgagaaaatacctacctgcaatcgtgagagaagctataaaacgacgattgagaaccctcatattagcaccgacacgcgtggtagcagcggagatggaagaagcactcaagggactgcccataagatatcaaacaacggcaacaaaaagtgaacatactggccgagaaattgtcgatctgatgtgtcatgcaacattcaccatgagactcctctctccggtaagagtcccaaactataatctaataataatggatgaagcacatttcacagatccggccagcatagcagcacgcgggtatatatcaactagggtaggtatgggtgaagcggctgctatatttatgactgcaacgccacccggaactgcagatgcgtttcctcaaagcaatgcaccaattcaggatgaagaaagagacatccctgaacgaagttggaacagcggtaacgaatggatcacagattttgctggaaagacagtatggtttgttccgagcataaaagcaggaaacgatatagctaattgtttaaggaaaaatggtaagaaagtcatacaactatcacgaaagacattcgatacggagtaccagaaaaccaaactaaatgattgggattttgtagttacaacggatattagcgaaatgggagctaattttaaggctgaccgagtaatagatcccagaaggtgcctaaaacctgtcatactaacggacggaccagaacgagtaatacttgctggcccaatgcccgtaactgcagcctccgcagcacaacgacggggacgggtaggaagaaatccacagaaggaaaatgaccaatacatctttactggccagcccttaaataatgacgaggatcacgcacactggactgaagcaaagatgttattagataacatcaacactccagaaggaataataccagcgctatttgaacccgagagagaaaaatccgccgccatagatggcgaatacaggttaaaaggggaaagcaggaaaacttttgtagagctcatgagacgaggagaccttccagtatggttagcgcacaaagtcgcttctgagggaataaaatataccgatcgtaagtggtgttttgatggacaacgaaataatcaaatactagaggagaatatggatgttgaaatttggactaaggaaggagagaagaagaaacttaggcctagatggttagatgctagaacatattcagaccccttagcactcaaagagttcaaagattttgcagcagggcgcaaatcaatagcattagaccttgttacagaaatcggacgagtacccacgcatctagcacatcgaacccgaaatgctctggacaacttagttatgctccacacttcagagcacggtggaaaagcatatcggcacgcagtggaagaactaccggagacgatggaaacattactgctactgggtttaatgatcttgctaacaggcggagccatgttgttcttaatatcaggaaaaggaattggtaaaacaagtataggtttaatatgcgtcatagcaagctctggcatgctgtggatggcagaaatcccactacagtggattgctagtgccattgtcttggagtttttcatgatggtacttctcatccccgaaccagaaaagcaaaggaccccgcaagataatcaattagcatatgtagtgatcggtatattaaccctggcggccatcatagcagccaacgaaatgggactcctcgaaacgactaaaagggatttagggatgtcaaaggaaccaggagtcgtttcgccaacatcatatttggacgtcgatcttcacccggcctcggcatggacactctacgcagtagccacaacagtaataacacctatgttacgccatactattgagaactccacagccaacgtgagtctagccgcaatcgccaaccaagcggttgttctaatgggcctagacaagggctggccaatttcaaagatggatcttggggttccccttttagctctaggctgctattcccaagtaaaccccttaacactgacagcggccgttcttttactaattacgcattacgctattattggacctggcctacaagcaaaggcgacccgagaggcacagaaaagaacagcggcgggaataatgaaaaatccaactgtagacggaataatgacgatagacttggatccagtaatctatgacagtaaattcgaaaaacaactaggacaggtaatgctcctagttctctgtgccgtacaactgctactgatgaggacgagttgggctttatgtgaagccttgacactcgcaactggacctataacaaccttgtgggaaggttcccccggcaaattttggaacacaaccattgcagtttccatggcaaacatattcaggggaagttacctagccggggccggactcgcgttcagtataatgaaatctgtaggtactggaaaaagagggacaggatcacaaggtgaaacccttggggaaaagtggaagaagaaacttaaccaacttagccgcaaagagtttgatctttacaagaaatcaggaataacagaagtagaccgaactgaagccaaagaagggctaaaacgtggagaaattacacatcatgcggtatctagaggttcagcaaaactacaatggttcgtagagaggaacatggtcattcccgaaggaagagtaatcgatttaggctgtgggagaggaggttggagctactattgcgcaggcctgaagaaagtaactgaagtaagaggttacaccaaagggggtccaggacatgaggagccagttccaatgtcaacatatggatggaatatcgtaaaattaatgtcgggcaaagacgttttctatctacctccagaaaagtgtgatacactcctttgtgacattggagaaagcagtcctagtcccacggtggaagaatcgagaacaataagagttctgaaaatggtagagccatggctcaaaaacaaccaattttgcattaaagtattgaacccatacatgccagcagttattgaacacttagagagacttcaacgtaaacatggtggtatgttagttcgcaatccactgtccagaaacagcactcacgaaatgtactggattagcaacggaactggaaatatcgtggcttctgtaaatatggttagccgacttcttctgaatagatttaccatgacacatcgacgcccaacaatagaaaaagacgtagacttaggtgccggaacaagacacgtcaacgcggaacctgagacacctaatatggacgtaataggagaacgcattaaacgtatcaaagaagaacataatagcacttggcattatgacgacgaaaacccctacaagacctgggcatatcacgggtcttatgaagttaaagccacgggatcagctagttcgatgataaatggagttgtaaaactactaacaaagccatgggacgtggtaccaatggtaacacaaatggcaatgacggatactacaccttttggtcaacaaagggtcttcaaagaaaaagtcgatacaagaacacctcgtagcatgccgggaacgcgaagggtcatggagattacagcagaatggttatggagaaccctgggacgaaataagaaacctagactatgtacccgggaagagttcactaagaaagtgagaactaacgccgccatgggggccgtttttacggaagaaaaccaatgggattctgccaaagccgcagtagaagatgaagacttctggaaactcgtagacagagaaagggaactacataaacttggaaaatgcggatcttgcgtatacaatatgatggggaagcgggagaagaaactgggagaatttggtaaggccaagggctctagagcaatatggtacatgtggttaggtgcacgatatttggagtttgaagcattaggtttcctgaatgaagatcattggttttcgcgagaaaatagctattcgggggtagagggagaaggtttacacaagttgggctacattctaagagatatctcgaaaattccaggtggcgcgatgtatgccgatgatactgccgggtgggacactagaataacggaggatgacctacataacgaggagaaaattacgcaacaaatggacccagaacacaggcagctggcaaacgctatattcaagttgacttatcaaaataaagtcgttaaggttcagaggcctaccccgacaggaacagtaatggacattattagtcgaaaagaccagcgtggaagcgggcaggttggtacgtacggactgaatacatttacaaatatggaagctcagttaattaggcagatggaaggagaaggtgtattgtccaaggcagatttagaaaacccacatctaccggaaaagaaaataactcaatggttagagactaaaggagttgagcgactcaaaagaatggccattagtggagatgactgcgttgtaaaacccatcgatgacagattcgcgaatgcgctactagcactaaatgatatgggtaaagtaagaaaagatattccacaatggcaaccgtcaaaaggatggcacgactggcaacaagttcctttttgttcacatcatttccatgaactaataatgaaagacggacgaaagctagtcgtcccatgcagacctcaagacgaattgattggtcgtgctaggatatcacaaggggcaggctggtcattacgagaaacagcgtgcctgggaaaggcttatgcacaaatgtggagcctaatgtactttcacagaagagatctaaggctagcgtcgaatgcaatttgttcagctgtgccagtacattgggtaccgacaagcaggactacatggagtattcatgctcatcatcaatggatgacaactgaagacatgttaacagtatggaatcgcgtctggatagaggataatccgtggatggaagacaaaacgccagtcacaacatgggaaaacgttccatatttaggaaaacgtgaagatcaatggtgcgggagcttaataggattaacaagtagagctacttgggcacaaaacatacctaccgctatacaacaagttaggtccctcataggtaacgaagaatttttagattacatgccaagtatgaaaagattcagaaaggaggaggagtctgaaggcgcaatatggtga

SEQ ID NO: 23377 - RNA, 9873 nt, synthetic construct
  misc_feature 1..9873: note = derived and/or modified CDS sequence (opt6) from DENV-3__EU529684__SS-prME
  source 1..9873: mol_type = other RNA
acttcactatgtctaatgatgattttgccagcagcattggcatttcacttaacctcaagggacggggaacctagaatgatagttggcaaaaatgaacgagggaaatcacttttgtttaaaacagcatcaggaattaacatgtgtacactaatagcaatggatctaggtgaaatgtgtgacgatacagtaacgtataaatgcccacatataactgaagtggaaccagaagatattgattgttggtgtaatcttactagcacatgggtaacgtacggaacctgtaatcaagcaggagaacatagacgagataaacgatccgttgcattggcaccccacgtaggtatggggctagatactcggactcaaacttggatgagtgcagaaggagcatggcggcaagtagaaaaagtggaaacctgggcacttagacacccaggattcactatattagcgctgtttctagctcactacattggaacctctctaacacaaaaagtagtgatcttcatcctattgatgctagttacaccgtcaatgacaatgagatgtgtgggagtcggaaacagagacttcgtagaaggactatccggagcaacgtgggtggacgtagtactagaacatggaggatgtgtaactacgatggctaaaaataaaccaactttagacattgaattacagaaaacggaggcaacacaacttgcaacactaaggaaactatgtatagagggaaaaattacgaacataacaactgatagtagatgccctacccaaggagaggcagtgctacctgaggaacaagatcaaaattatgtatgtaaacatacgtacgtagacagaggttggggtaacggttgcggactatttggaaaaggttctttagtgacgtgtgcaaaatttcaatgcttggaaccgatagaaggtaaagtggtacaatacgagaatctaaaatacacagtcattataacggtacatacgggggatcaacatcaagttggaaacgagacacaaggagtcacagcagagattaccccacaagcatcaacaacagaagcaatcttaccggagtatggtactctaggcttggaatgtagcccgcgaacaggcttggattttaacgaaatgattctcttaactatgaaaaataaagcatggatggtgcatagacaatggttctttgacttgccacttccttggacgagtggtgctaccactgagactccaacatggaatcgaaaagagctgttagttactttcaaaaatgcacatgctaagaaacaagaggtagtagtcctaggatcacaagagggtgcaatgcacacagcactaacaggcgcgaccgagatccaaaacagtggagggacgtccatatttgccggccatttaaaatgtcgtctcaaaatggataaattagaattgaaagggatgtcgtatgcaatgtgtactaatacattcgtactaaagaaagaggtttccgaaactcaacatgggacaatcttaataaaagtagaatacaaaggtgaggatgttccatgcaaaattcctttcagcacagaggatggacaaggaaaagcgcacaatgggagactaataaccgcaaacccagtagttaccaagaaagaagaacccgtaaatattgaagcagaaccaccctttggagagtcgaatatagtaattggaataggtgacaacgcgttaaaaataaactggtacaagaaaggttcttcgattgggaaaatgttcgaagcgactgcccgaggtgctagacgaatggcaatcctcggtgacactgcctgggactttggttccgtaggaggagttttgaatagtctcggtaaaatggtgcatcaaattttcggatcagcttacacagcactttttagcggtgtaagttgggtaatgaaaatagggatcggtgttctacttacttggataggccttaatagcaaaaatacttcaatgtccttttcatgtattgcgataggaatcataacactttatctgggtgctgtagttcaagctgacatggggtgtgttataaattggaaaggaaaagagctgaaatgcggctccggaatattcgtaacgaacgaagttcacacttggactgagcagtataaattccaagcagactcaccgaagaaactcgcaaccgcaatagccggtgcttgggagaatggcgtttgtggaataagaagtactacacggatggaaaatttgctgtggaaacagatagccaacgaattaaactacatcttgtgggaaaataatataaaactaactgtggtcgttggagatattattggagtattggaacaggggaaaagaacactgacgccccaaccaatggaactaaaatattcatggaaaacatggggtaaagccaaaattgtaaccgcagagacacagaatagtagttttataatagatggccctaatacgcctgaatgcccttcggcatcgagggcgtggaacgtttgggaagttgaagactatggattcggtgtatttacgacaaatatctggttaaagttacgtgaagtatatactcaattatgtgaccatagactaatgtctgcagcagtgaaggatgagagagcagtgcacgctgatatgggatactggatagaaagtcagaaaaatggaagctggaaactagaaaaagctagtctaatagaggttaaaacatgtacatggcctaaaagtcatacattatggagtaatggggtattagaatcggatatgatcatcccgaagtcattagcaggaccaatatctcagcataactacagacctgggtaccatacccaaacagcaggaccatggcacctcggcaaactagaattagactttaactactgcgagggcacaacagtcgtaatcacggaaaattgtggcacgaggggaccgtcactaagaacaaccacagtatcagggaaactcatccacgaatggtgttgcaggtcctgtactctaccgccgttacggtacatgggtgaggacggttgttggtacggtatggaaataagacctatttccgaaaaagaggagaatatggtaaaatcattagtaagcgctggctcaggagaagttgataactttacgatgggcgtattatgtttagccatattattcgaagaggtgatgagaggaaaattcggtaagaaacatatgatagctggcgtgttctttacttttgtcttacttcttagcggacaaataacatggcgagacatggcccacactctaataatgataggtagcaatgcgagcgataggatggggatgggagtcacgtatcttgcgcttattgccacattcaagattcaaccatttttagccttaggcttcttcttgcgtaaattaacaagtagagagaatctgttattaggggtcggcttagccatggctacaaccttacagttaccggaggatattgaacagatggctaatggaatagcactaggactaatggctttgaaactaattacacaatttgaaacttatcaactatggactgccttaatttcgctaacctgttcgaatacaatttttacgcttacggttgcatggagaaccgcaacactgatacttgccggagtcagtttgctacctgtgtgtcaatcatcgtcaatgcggaaaacagactggctgccaatgacagtagctgcaatgggagtgccacctctacctctgtttatattcagcctgaaagacactctaaaacgaaggtcttggcctctaaacgagggtgtgatggcagtgggtttagtctccattttagcaagttcattacttagaaatgatgtacctatggcgggaccgttggtagcgggaggattactgattgcatgttacgttattacaggaacgtctgctgacctaacagtagaaaaggcggccgacgtcacgtgggaggaggaagctgaacaaaccggggtaagtcacaatcttatgataacagtcgacgatgatggaacgatgcgtattaaagatgacgaaacagagaatattctaacggtacttttgaaaacagcattattgatcgtgtcaggaatttttccttacagtatacccgctacgttattggtatggcatacatggcagaaacaaacacaaagatcgggagtgttgtgggatgtacctagcccgccagaaacgcagaaagcagagttagaagaaggcgtatacagaataaagcagcaaggtatatttggtaaaacacaagtgggcgtcggtgtccaaaaagaaggtgtatttcatacgatgtggcatgtcactcgaggggcagtgttaacatacaatggtaagcggttagaaccaaactgggcatcggttaaaaaggacctaattagctacgggggaggatggcgccttagcgcccaatggcaaaagggtgaagaagttcaagtaatcgcagtcgaacccggcaaaaaccccaaaaacttccaaactatgccaggtaccttccaaacaacaactggagaaattggtgcaatagcgttggattttaagccgggcaccagcggatcacctataatcaacagagaaggaaagattgtaggcttatatgggaatggtgtagttactaaaaatggtggatatgtcagcggcattgcgcagaccaacgcagaacccgacggtcccaccccagaacttgaagaggaaatgttcaagaaacgaaatctaaccataatggacctccatccagggtccggtaaaacaagaaaatatttaccggcaatagttagagaagcaatcaaaagaagactcagaactctaatattagctccgaccagagtggtagctgcagagatggaagaagctctgaaaggtttacctataagataccagacaactgccacaaaatcagaacatacaggtcgggagattgttgacttaatgtgccacgcaacgtttactatgcgtttattgtcaccagtaagagttcctaactacaatcttataatcatggacgaggctcattttacggaccccgcaagtattgctgcgcgtggctatatctctacgagagtgggaatgggtgaagcagctgctatatttatgactgcaacccctccgggaactgcagatgccttcccacaatctaacgcacctattcaagatgaagaaagagacattccagaaagatcttggaacagcggaaacgaatggattactgactttgcgggaaagacggtatggtttgtcccgagtataaaagctggtaacgatatagcaaactgtcttaggaaaaacgggaagaaagtcattcaattaagtcgtaaaacttttgatacagaataccagaaaactaaactaaacgactgggactttgtcgtaacaacagatataagcgagatgggcgctaattttaaagcagatagagtaatagacccccgacggtgcttgaagccggtaatcctaactgatggtcctgaaagagttatattagctgggccaatgccagtgactgctgcttcagcggcacagcgtaggggtagggttgggagaaatccgcagaaagagaacgatcaatatatattcacaggacaacctctaaataatgatgaagatcacgcccattggaccgaagctaagatgttactggacaatattaatacgcccgaaggtatcatccctgccctatttgaaccagagcgagagaagtcagcagcgattgacggagaatatcggttgaagggtgaaagcaggaagactttcgttgaattgatgagaaggggcgatttacctgtttggttagcccataaagtagctagcgagggtataaaatacactgatcgcaagtggtgttttgacggacaaagaaacaaccagatattagaagaaaatatggacgtagagatttggactaaggaaggcgagaagaagaaattaaggccaagatggttagacgcacgtacgtatagtgaccctttagccttaaaggaatttaaggattttgcggcgggacgcaaatccattgcgcttgatcttgtaacagaaataggtagagtccctacacatctggcccacagaacgagaacagctttggataacttagtgatgttgcacacctccgagcacggtggaaaggcttatagacacgcggttgaggaactaccggaaactatggaaacgttattactattgggattgatgatattattgacaggaggtgcgatgttattcctaatatcagggaagggaattggaaaaacttccataggtctaatatgcgtgatagcctcgtcaggcatgctatggatggctgagataccgttacaatggatcgcaagtgcaattgtgttagagttctttatgatggtgctgctcattccagaaccagaaaaacagagaacaccacaagataatcaattagcatacgtagttataggaatattaacccttgccgcaattattgcagcaaacgagatgggattactagagacaactaaacgtgatttgggaatgtccaaggagcccggtgtggtgtcgccgacatcatacttggacgtcgatttacaccctgcaagtgcttggactttatatgcggtagctacaacagttatcacccctatgttaaggcacacaattgaaaattcaaccgcaaatgtatcacttgctgcgatagctaatcaagcagtagtactaatgggactagataaaggctggcctattagtaaaatggatctcggtgtacccttgttagcactagggtgttatagtcaagtcaaccctttaacactgactgccgctgtcttgttgctaataacacattatgcgataataggtccgggactacaagccaaagccacaagggaggcccaaaagaggacagccgcgggcataatgaagaatccgactgttgatggtattatgacaattgacttagaccccgtcatttatgacagcaaattcgaaaagcaattaggtcaagttatgctcttagttctatgcgcggtacaattgctattaatgagaacaagttgggccttgtgtgaggcactcactctggccacaggcccgatcacaaccctttgggaagggagtccgggtaaattttggaatacaacaatagcggtatcgatggctaatatttttcgtggatcatacttagccggtgctggtctggcattttccattatgaagtctgtaggcaccggtaaacggggcaccggaagccagggggagaccttaggggaaaaatggaagaagaagctaaatcaattaagtcgaaaagagttcgatttgtacaagaaaagcggaatcactgaagtagatcgaacagaagctaaggaaggtctaaagagaggtgaaattactcatcacgcagtttcaagaggatccgcaaaattacaatggtttgtagaaaggaatatggtaatacctgaaggtagggtcatagatttaggttgtggtcgaggcggttggagttattactgtgcagggctaaagaaagtgacagaggtacgcggatacaccaaaggcggacctggacatgaagaacctgtaccaatgtcgacgtacggttggaatattgtaaaactgatgtcgggtaaagacgtattttatttgcctcctgaaaaatgtgataccttactatgtgacattggagaatccagcccttccccaactgtagaggaatcgcgcactattcgcgttttaaaaatggtggaaccttggctcaaaaataaccagttttgcatcaaggtactaaatccatacatgccaaccgttatcgaacacttagaacgacttcaacgaaaacacggaggcatgctagttagaaatccgctgtcaagaaattcaactcatgagatgtattggatctcaaatgggactggaaatattgtagcaagcgtcaacatggttagcagactactgttaaaccgctttacaatgacccatagaaggcctacgatcgaaaaggatgtcgacttaggagcgggaacgagacatgtaaacgccgagcccgaaacccccaacatggacgtcattggtgaaagaattaaaagaataaaggatgaacacaatagcacctggcattatgatgacgaaaacccatataaaacatgggcttaccatgggagttacgaagtgaaagcaacgggatcagcttcgagtatgattaatggcgtagtaaaacttctaactaagccttgggacgttgtcccgatggtcacacaaatggcaatgaccgatacaacaccctttggtcagcaaagggtatttaaagaaaaagtcgatacaagaacaccaagaagtatgcctggaacgcgacgagtaatgggaataaccgcagaatggctttggagaacgcttggacgcaacaagaaaccacgtttgtgtactagagaagagttcacgaaaaaggtacgaacaaacgcagctatgggagctgtatttactgaagaaaaccaatgggattcggcaaaggccgctgtggaagacgaagatttttggaagctagttgaccgagaacgtgaattgcataaactaggaaagtgcggctcatgcgtttataatatgatgggtaaaagggaaaagaaacttggggaatttggcaaagctaaagggagtcgggcaatatggtatatgtggctcggggccagatatcttgagttcgaagccctaggttttctcaatgaagatcactggttttcgcgtgaaaatagctatagcggagtcgaaggtgagggacttcacaagttaggatatattttaagagatatatcgaagattccgggaggagcaatgtatgcggatgacacagcagggtgggacacgagaatcacagaggatgacctacacaatgaagagaagataacgcaacagatggacccagaacataggcagctagctaacgctatttttaagctaacttatcaaaataaagttgtaaaagtacagagaccgaccccgactgggaccgtaatggatattatctctagaaaagaccaacgaggctcaggccaagtgggaacatatggacttaacacatttacgaatatggaagcacaactgatacggcagatggaaggagagggagtactaagcaaggctgacctagaaaatccacatctacccgagaagaaaatcacgcaatggttggaaacaaaaggagtggaaagacttaaaagaatggctatatccggggatgactgtgtagttaaaccgatcgacgataggtttgcaaacgcgctactggcattgaatgacatgggtaaagtacgcaaagacataccgcaatggcaaccgtctaaaggctggcatgactggcaacaggtaccattttgtagccatcactttcacgaactaattatgaaagatggtagaaaattagttgtgccatgtagaccacaagacgaactaataggcagagctcggatctcacaaggagcgggatggagtctgcgtgagacggcatgtctcggtaaagcctacgctcaaatgtggtcgttaatgtatttccacagaagagacctacgtctagccagcaacgcgatttgcagcgcagtacctgtacactgggttccgacctcgagaactacttggtctatacatgctcatcatcagtggatgacaacagaagacatgttaacagtatggaatagggtctggatcgaggacaatccatggatggaagacaagacaccagttacaacctgggaaaacgtaccatatttaggaaaacgcgaagaccagtggtgtgggtcactaattggtctaacgagccgagctacctgggctcaaaacatacctacagccatacaacaagtgagatctctaataggaaatgaggagttcctggattacatgccatcgatgaaaaggtttcgtaaagaggaagaaagtgaaggtgcaatttggtaa

SEQ ID NO: 23378 - RNA, 9873 nt, synthetic construct
  misc_feature 1..9873: note = derived and/or modified CDS sequence (opt6) from DENV-3__FJ182015__SS-prME
  source 1..9873: mol_type = other RNA
acttcattgtgtctgatgatgatcttgcctgcagcacttgcctttcatctaacttcccgtgacggtgaacctcgcatgatcgtgggtaaaaatgaacgaggaaaatccctcctatttaaaacggcgagtggaatcaatatgtgtactttaattgccatggatctaggtgaaatgtgcgacgacactgtgacatacaaatgcccccacattacagaagtcgaaccagaagatattgattgttggtgtaatcttacatccacgtgggttacttacggtacttgtaatcaagctggggaacatcgtagagataaaaggtcagttgcactggctcctcacgtaggtatgggcttggatacgcgcacacagacttggatgtctgccgagggtgcatggcgacaggtcgaaaaagtggaaacatgggccttgagacatcctggatttactatcctagcgctgtttctcgctcattatattggaacaagtctaactcaaaaagtagtcatatttattctactgatgctagtaactccctcgatgacaatgcgatgcgtgggggtaggtaatcgagactttgttgaagggttaagcggagcaacgtgggtcgacgtggttttagaacacggaggatgcgttacaacaatggccaaaaacaaaccaacccttgacatagaactacagaaaactgaagctacccaactagcaacactccgtaaattatgcatagaaggtaaaatcactaatatcacaacggactctcgatgtccaacacaaggagaagccgtattacctgaagaacaagatcaaaattatgtctgtaaacatacatacgtagatcgaggatggggtaatgggtgtggtctatttggaaaaggaagcctcgtaacatgcgcaaaatttcagtgtctggaaccaatagaaggaaaagtagtacagtatgaaaaccttaaatacacagtaatcataaccgttcacaccggtgaccaacaccaagtaggcaacgagacacaaggagtaactgccgaaataacgccacaagctagtacgactgaggcaatactaccggaatatggaacattggggttagaatgttccccaagaacaggtctggactttaacgaaatgatcctactcacaatgaaaaataaagcgtggatggtccatcgtcaatggttcttcgatctgcctcttccatggacaagtggagcaactacagaaacaccgacgtggaacaggaaagaactattagtaacatttaaaaatgcccacgccaagaaacaagaagtagttgtccttggcagccaggaaggagcaatgcatacagcgttaactggagctaccgaaatccaaaattcaggtggtacatccatttttgcaggtcacctaaaatgccgccttaaaatggacaaactcgaattaaaaggtatgagttacgcgatgtgtactaatacattcgtccttaagaaagaagtttccgaaactcagcacggtacaatactgattaaagtcgagtacaaaggtgaggatgtcccatgtaaaataccgttcagtacagaagatggtcaaggaaaagcccacaatggcagattaataaccgcaaatccagtggttaccaagaaagaagaacctgtaaatattgaggcggaaccaccttttggtgagtctaacatcgtcatcggtattggagacaacgcactaaaaatcaattggtataaaaaggggagctcaatcggaaaaatgttcgaagccacagcaagaggagctcgaagaatggctattttaggcgacacagcttgggattttggatcggtcggcggcgtactaaattcacttggcaaaatggtccatcaaatatttggcagcgcttatacagccttattcagtggagtatcctgggtcatgaagataggaataggcgtcttattaacatggatcggtttgaatagcaaaaacacctccatgtcattttcgtgcatagcgatcggtataattacattgtacttaggagctgtagtgcaagcggatatggggtgcgtaataaactggaaaggtaaagaacttaaatgtggatctggaatatttgtaactaacgaagtgcacacctggacagaacaatacaaattccaagccgattctccaaaaagactagcaacggccatagcaggagcatgggaaaacggagtgtgtggaatcagatctactactaggatggaaaatttgctctggaagcaaatagctaatgaattaaactatattttatgggaaaataacatcaaactaactgttgtagtcggggatattatcggagttcttgagcagggaaagagaacattaacgcctcaacccatggaattgaaatactcatggaagacatggggaaaggcaaaaatagttacagctgaaacgcaaaacagttcctttattatcgatggtcccaacacacccgagtgcccctcagcaagccgagcctggaatgtatgggaagtagaggattacggatttggagtatttaccacaaatatctggctaaaattacgtgaagtttatacccaattatgtgatcaccgattaatgagtgccgctgtaaaagatgaaagggcagtgcacgcggatatgggatattggatagagtctcagaaaaatggcagctggaaactcgaaaaagcaagtctaattgaagtaaaaacctgtacgtggccgaaatctcatactttatggagcaatggagttttggaatcggatatgatcataccgaaatcattagccggcccaataagccagcataattataggccaggatatcacacacaaacagccgggccttggcatttgggtaaactggaattagactttaattactgcgagggaactacggtggtaataaccgaaaattgtggtacaagaggaccaagtctacgaacgacaactgtaagtgggaaacttatccacgaatggtgctgcagatcttgcactttacctcctctccgatatatgggtgaagatggatgttggtacggcatggaaattagaccaataagcgaaaaagaggaaaatatggtaaaatccttagtctctgctggaagtggcgaagtagataatttcactatgggagtattgtgccttgcaatactattcgaggaggtaatgcgagggaagtttggtaaaaagcatatgattgcgggagttttctttactttcgttctcctgttatcggggcagattacatggagagacatggcccacaccctaataatgataggttcaaacgccagtgatcgtatggggatgggagtaacttatttagcacttatcgcaacattcaagatacaaccctttcttgcacttggattctttctaagaaaattaaccagtagagaaaacctactattaggtgtaggtctcgcaatggcaacgactctgcaactgcctgaagatatagagcagatggcaaatggcatagcattgggtttgatggcactcaagctcataacgcagtttgagacataccaattatggacagctttgattagtttgacatgcagtaacacgatcttcaccttgacggtagcttggaggaccgctacattaatattagcgggagtcagcttacttcctgtctgtcaatcatcctcaatgagaaaaacagattggctccctatgacagttgcagctatgggggtacctccactacctctgtttatattttcgctaaaagatacactaaaaagacgaagctggcctctaaatgagggcgttatggcagtaggtttagtaagtatcttggcaagcagcctcttgagaaacgatgtacctatggccggacctctagtcgcaggaggtctgctgatcgcatgctatgtaattacgggaacaagtgctgatctcacagtcgaaaaggctgctgacgtaacatgggaagaagaagccgaacaaaccggagtctcgcataacctaatgataaccgtggatgatgacgggactatgcgaatcaaggatgatgaaacagaaaacatccttacagtcctcctgaagaccgctctattaatagtctcaggaatatttccatattcaattcccgccacactgttagtttggcatacttggcaaaagcaaacacaacgctctggtgttctttgggatgtcccgagtcctccagaaactcagaaagcagagttagaggaaggggtttataggatcaaacaacaagggatctttggcaaaacacaggtcggtgtaggtgtgcagaaagaaggagtgtttcacaccatgtggcatgtaacacgcggggcggtcttaacctacaacggtaagagattagaacctaactgggcatcagtgaagaaagatttaatttcttatggcggtggatggagactttcagcacaatggcaaaaaggagaagaggtacaagtaattgctgttgagccaggcaaaaaccctaaaaacttccaaactatgcctggaacattccaaactaccacaggcgaaataggagctattgcactcgactttaaacctggaaccagcggatcgccaattattaatcgggaaggaaaagttgtaggtctttacggcaatggtgtagttactaaaaacggtgggtatgtatcaggcattgctcaaacaaatgctgaacccgatggtccaacaccagaactggaggaagaaatgtttaagaaaagaaacttgactataatggatttgcatcctggaagcgggaaaactcgaaaatacttgccagcgatcgtacgtgaagcaatcaaaagacgattacgaaccttgatacttgcaccaactagagtcgtagccgctgaaatggaagaagcattaaaaggactaccaattagatatcaaacaacagcaacaaaatccgagcatactggtcgcgaaatcgtagatttaatgtgtcacgccacatttacaatgaggctactcagtcccgtcagagttccgaattacaatctaataattatggatgaagctcacttcactgatccagcaagtatcgctgcacgagggtatatcagcacccgcgtcggaatgggagaggcagctgcgatcttcatgacggctactccacctggaactgcagatgcttttccgcaatcaaatgcaccaatccaagatgaagaacgagacataccagaaaggagctggaactcgggaaatgaatggataactgactttgcgggaaaaaccgtgtggttcgtgcccagtataaaggctggaaatgacatcgctaattgtttaaggaaaaatggtaagaaggtcatccaattaagtcgcaaaacctttgatactgaatatcagaaaacgaaacttaacgattgggatttcgtagtcaccactgatatcagcgagatgggagccaattttaaagccgatagagtcatcgaccctagaaggtgcctcaaaccagtaattttaactgatggtcctgaaagagtgatactggcaggtccgatgccggtcaccgcggcaagtgcggctcaaagacgaggaagagtaggcagaaacccccaaaaagaaaatgatcagtatatctttacgggtcaaccactaaataatgatgaagatcacgcacattggacagaagcaaagatgttattggacaatataaataccccagaaggcattataccggccttattcgaaccagagcgcgagaaaagtgcagcgatagatggagaatatagactaaaaggagagtcaagaaaaacatttgttgaactaatgcgtcgtggcgatctaccagtctggttagcccataaagtagcaagcgaggggataaaatatactgaccgaaaatggtgttttgatggccaaaggaacaaccaaattttagaagagaatatggatgttgagatatggacaaaagaaggagaaaagaagaagttgaggccacgttggctggatgcgagaacgtattctgatccgttagcgcttaaggaatttaaagactttgcagcaggaagaaaaagtatagctcttgatctcgtgactgagataggacgagtacctactcatttagcacatcgtacgaggaacgcacttgataatctagtaatgctgcacacatcagagcacggtggaaaagcatacagacatgctgtcgaggaattgcctgagactatggaaactctacttttgttagggctcatgatattattaacaggaggagccatgctatttctgattagcggaaaaggaataggaaaaacgtcaataggtctaatttgtgtgatagcaagttcggggatgttatggatggcagaaataccactacagtggattgctagtgctatagttttagagttcttcatgatggtgttactaatacctgaacccgaaaagcaacggacaccacaagataaccagttagcctacgtagtaataggcatacttactctagctgctattattgccgcaaacgagatggggttacttgaaacaaccaaacgagatttaggtatgtctaaggaaccaggagtagtgtcgcccacaagctacctagacgttgacttacatccggcaagcgcatggacactatacgcagtagctactacagtgatcactccgatgctgagacatacaattgaaaacagtactgcaaacgtgtcattagcagcaattgcaaatcaagcggttgttctaatgggtttggacaaaggatggccaatctcgaagatggatttaggagttcccttactcgctttaggctgctatagccaagtaaatccattgactctgaccgcagctgtccttttacttattactcattacgcgataattggaccaggcctacaagctaaagcgacccgagaggcacaaaagcgcacagccgccggaattatgaagaatccaacagtggacggaataatgacaatagacctcgatcccgttatctacgatagcaaattcgagaaacaactgggccaagttatgttacttgtgttatgcgcggtgcaacttctactaatgcggacatcttgggcgctttgtgaagcattaacattggcaacgggacctataacaacgttgtgggaaggttccccaggaaaattctggaatacaacgatagcagtatcgatggcaaatatattccgtggtagctatctagctggtgcgggattagcatttagtataatgaaatctgtagggactggcaagagaggaaccggatcacaaggagaaaccctaggcgaaaagtggaagaagaaactgaaccaactgagtcggaaggagttcgatttgtataaaaagtctggaatcaccgaagtagatcgaacagaagcaaaagagggcctaaaaagaggcgagataactcatcatgcagtatcaagaggctcagcaaaattacaatggtttgtagagcgtaacatggtaattcccgaaggtagagtaattgatctaggctgtggtagaggagggtggtcttattactgtgctggacttaagaaagtcaccgaggtaagaggctacacgaagggtggtccagggcatgaagaaccagtacctatgagtacctatggctggaatatagtaaagttaatgtctgggaaagacgtattctatctacctccagaaaagtgcgacaccctcctttgcgatataggagagtcgagcccatcaccaacagtcgaggaatcaagaacaataagagtattaaaaatggtagagccttggcttaaaaacaaccaattttgcataaaagtactaaatccctatatgccaaccgtgatcgaacacctcgagcgacttcagagaaaacatggaggaatgcttgttcgcaacccactatcgaggaactctacccacgaaatgtactggatttcaaatggcacaggcaatatagtagcgtctgtgaacatggtatccaggttactattaaatagattcaccatgacccacagaagaccaactatcgagaaagatgtagatctaggagcgggaacaagacatgtgaatgcagaacctgaaacaccaaacatggatgttatcggcgaaaggatcaagcgaatcaaggaggaacacaactcaacttggcattatgatgacgaaaatccatataaaacatgggcgtatcatgggtcttatgaagtcaaagcaactggttcagcatctagtatgattaatggagtggtcaaattgcttacaaaaccctgggacgtcgttccgatggtgactcaaatggctatgacagatacaactccattcgggcaacaaagagtattcaaagagaaggtcgacacccgaacacctagatcaatgccaggtacaagacgagttatgggtataaccgccgaatggttgtggagaactttgggccgaaataagaaacctcgattatgtacgcgagaagaatttacaaagaaagtacgtactaatgcagctatgggagctgtgtttactgaagaaaatcaatgggatagcgcaaaagctgcagttgaagatgaagacttctggaaattagtcgatagagaaagggaactacacaaattaggtaaatgtggaagttgcgtatacaacatgatgggtaaacgagagaagaaattaggcgagttcgggaaagcaaagggttctagggccatatggtacatgtggttaggtgcacgatatctcgagttcgaagcattagggttcttgaatgaagaccattggttttcacgcgaaaattcctattcaggagtcgaaggtgaaggattacataaacttggttacatacttagagatatatcaaagattccgggaggagccatgtatgctgatgacacggcaggatgggacactcgcataacagaagatgacctacataacgaagagaaaataacacagcaaatggatccagaacacagacaacttgcaaatgcaatatttaaactgacttatcaaaataaagtagtaaaagttcagaggccaacacctacaggcaccgtaatggatatcatatctaggaaagaccaaagaggttccggacaagtggggacctatgggctcaatacattcaccaatatggaagctcaattgataaggcaaatggagggcgaaggcgtactatctaaagcggatttggaaaatccacacctacctgaaaagaaaatcactcagtggttagaaacaaagggcgttgagagacttaaacgaatggcaatatcaggggacgactgtgtggtgaagccaatagacgacagatttgcaaatgctctgctggcgctaaacgatatggggaaagttcgtaaggatataccacaatggcaaccgtccaaaggatggcatgactggcaacaagttccattttgttcacaccatttccacgaactaataatgaaagatggaagaaagctagtagttccatgtagaccgcaagacgagttaataggtagggctaggatatcacaaggcgcgggctggagccttagggagaccgcgtgtctaggtaaagcatacgcacaaatgtggagtcttatgtatttccaccgcagggatctgcgtctggctagtaacgcgatctgttcagccgtacccgtgcactgggtccctacaagtcgtacgacatggagtattcacgcgcaccatcaatggatgacgactgaagatatgttgactgtttggaacagagtgtggatagaagacaatccctggatggaagacaaaaccccggtaacaacatgggaaaatgtaccttatctaggtaagcgggaagatcagtggtgcggttccctgattggactcacaagtcgtgcaacctgggcacaaaacattccaacagctattcagcaagtccggtcacttattggaaatgaggagttcttagattatatgccctctatgaaaaggttccgtaaagaggaagaaagtgaaggggctatttggtaa

SEQ ID NO: 23379 - RNA, 9873 nt, synthetic construct
  misc_feature 1..9873: note = derived and/or modified CDS sequence (opt6) from DENV-3__EU569688__SS-prME
  source 1..9873: mol_type = other RNA
acctcgctatgcttaatgatgatcctgcctgctgcactagcgttccacttaactagcagagatggagaacctcgaatgattgtcggtaaaaatgaaaggggaaaatccttgttgtttaaaactgcgtctggaattaacatgtgcacgttaatagcaatggatctaggagaaatgtgcgacgacactgtgacatataaatgtccgcatattacagaagcggaaccagaagatattgattgttggtgtaaccttacttcaacgtgggtgacttatgggacatgtaatcaagccggtgaacaccgcagagacaaacgatcagtggcgttagcaccacatgtgggaatgggtttggacactaggacacaaacgtggatgagtgccgaaggggcctggcgtcaagttgaaaaagtggaaacttgggcactcagacatccgggatttacaatcctcgccctctttctggctcattatatcggtacgtctcttacacaaaaagtcgttatttttatcttactaatgctagtcacaccctcaatgaccatgaggtgtgttggagtaggaaaccgggattttgtagaagggctatcaggggcaacttgggtagacgttgttttagaacatgggggatgtgttacaacaatggcgaaaaataaacctaccttagatatcgaactacagaaaactgaagcgacgcaattggcaaccttaaggaaactatgcatagaaggaaaaatcaccaatatcacaacagatagtaggtgtccaacgcaaggagaagccgtactaccagaagaacaagatcaaaactacgtatgtaaacacacgtatgttgacagaggatggggcaatggatgtggattatttggaaaaggtagcctggttacctgtgcaaaattccaatgtctggagccaattgaaggaaaagtggtgcaatacgaaaacctaaaatataccgtaatcataacagtccacactggtgaccaacatcaggtaggaaatgagacgcagggtgtcacagctgaaataactccccaggcttcaacgacagaagctatattaccagaatatgggacattaggattagaatgttctccaaggactgggttagacttcaatgaaatgatcttactgactatgaaaaataaagcgtggatggtacatagacagtggtttttcgacctaccgcttccatggacctcaggggctacgacagaaactcctacctggaatagaaaagaacttttggttacattcaaaaacgcccatgcaaagaaacaagaagtcgtcgttttgggcagccaagagggagcaatgcatacagcactgaccggtgcaacagagatacaaaattccggaggcacatcaattttcgcgggtcatcttaaatgcagattgaaaatggataaattagaactaaaaggaatgtcatatgcaatgtgtacaaatacattcgtattaaagaaagaggtttccgagacacaacatgggacaatacttatcaaagttgaatataaaggggaggatgtaccttgtaaaattccattctccacagaagatggacagggtaaagcacataacggtagactgatcacagcaaaccctgtcgtcactaagaaagaagaaccagtaaatatcgaagcagaacctccttttggagaatctaacatagtgatcgggatcggtgataacgcactcaaaataaattggtataagaaaggatcgtcaatagggaagatgtttgaagccactgccagaggggcgcgacgaatggcgatcttgggcgacacggcgtgggattttggttcggtcggaggtgtccttaattcattaggaaagatggtgcaccaaattttcgggtcggcctatacggccttattcagtggtgtatcttgggtaatgaagataggaatcggagttttactgacatggatcgggctcaacagtaaaaacacaagtatgtcatttagctgcattgcaattggaataataacattatatttaggtgctgttgttcaagcagatatgggatgtgttataaactggaaaggaaaagagttaaaatgtgggtcaggaatctttgtgacaaatgaagtacatacctggaccgaacaatacaaatttcaggcagatagtcccaaaagactagcaactgcgatagccggtgcgtgggagaacggcgtatgcggaatacgaagcactacaagaatggaaaatctactatggaagcaaatagctaatgaacttaattacattttatgggaaaataatatcaagctgacagtggttgtgggcgacactattggcgttttagaacaagggaagagaacactaacaccacaacccatggagttaaaatatagttggaaaacatggggcaaagcaaaaatcgtgaccgcggaaacacagaactcatcctttataatcgatggacctaacacgcccgaatgcccatcagccagcagggcctggaatgtctgggaagtggaagattatggatttggagtttttactacaaatatctggttaaaactgagagaagtatatacccaactatgcgatcatcgactcatgtcagctgcagtaaaagatgaacgagcagtgcacgccgatatgggctattggatagaatcccaaaagaatggttcctggaaattggaaaaagcatcattaattgaggtaaaaacttgtacttggccaaagagtcacactttatggtctaacggcgttctggaaagtgatatgataatcccaaaaagtctggcgggccctatatcacaacacaattacagaccaggatatcatacacaaactgcaggtccatggcatttgggaaaattagaactagacttcaattattgtgaaggcacgacggtcgtgataacagaaaactgtggtacaagaggacctagtttacgaacgacaaccgttagcggaaaactgatacatgaatggtgttgtcgtagttgtacattaccaccactgcgctacatgggcgaggatggttgctggtacggtatggagattcgcccaatatctgagaaagaagagaatatggtcaagagcctagtatccgcaggaagcggcgaggtagacaacttcacgatgggagtactctgcttagcgatattatttgaggaagtaatgagaggcaagtttggcaagaaacatatgatagcaggggtattctttacgttcgtacttttattaagcggacaaatcacgtggcgagatatggctcacactctaattatgattggcagtaatgcaagtgatcgtatgggaatgggcgtaacatacctagctctcattgcaacgtttaaaatccaacctttcttggcgcttggattctttttaagaaaactcacttcaagagaaaacctgctccttggggtaggtcttgccatggcgactactctacaactaccagaagatattgaacaaatggcgaacggtattgctttaggcctaatggcattaaaacttataactcaattcgaaacatatcagttgtggacagctctaatatcgttgacctgctctaatacgatctttactttaaccgtagcttggagaaccgcgacgttgatattagcaggcgtctcattgctgccagtgtgccaatcatcgtctatgagaaaaacagactggttacccatgaccgttgcagctatgggagtaccacccttgcctctgtttatattttctcttaaagacaccttaaaacgacgaagttggccactaaatgagggtgtaatggcagtaggcctagtaagcatactggcaagttctttactaagaaatgatgtcccaatggctggacccctagtggcaggagggctccttatagcttgctatgtgataactggaacgagtgctgatttaaccgtagagaaagcagctgacgtcacgtgggaagaagaagccgaacaaacaggagtaagccataatttaatgattacagtggacgatgatggtaccatgcgtattaaagatgatgagacagagaacatacttacggtgcttctcaagactgcactattaattgttagcggcatattcccgtactcgattcccgcaactctactggtctggcatacttggcaaaaacaaacacaacgaagcggagtgttatgggatgtgccgtcgccaccagaaacacagaaagcggaactagaagaaggtgtataccgaataaagcaacaaggtatatttggaaaaacgcaagtaggagtgggagtacaaaaagaaggtgtatttcacactatgtggcatgtaacgcgaggagccgtactaacatataacggaaagaggctagaaccaaactgggcgtcggttaagaaagatctaatatcttacggtggaggttggagactgagtgcccaatggcaaaaaggtgaagaagtccaagtaattgcagtcgaaccggggaaaaaccctaaaaatttccaaactatgcccgggacatttcaaacaaccacaggagaaataggggctatagccttggactttaaacccggaacctcaggatctccgataattaacagagagggtaaggtagtaggactctacggaaatggagtagttaccaaaaacggtggctatgtctctgggattgctcagactaatgcagagccggatggacctactccagaattagaagaagaaatgttcaaaaagagaaacttgacaattatggatctacatcctggctctggtaaaacgcgtaaatatttaccagccattgttcgagaagcgataaagagacgactccgtactttaattctagctccaactcgggtagtagccgcagagatggaggaagcacttaaaggcttacctatacgttatcaaacaacagcgacaaaatctgaacacacagggagggaaatagtagatcttatgtgtcatgcaacatttacaatgagactcctgagccccgtgcgtgtaccaaactacaatttaataattatggatgaggcccattttacagatccagcctctattgccgctcggggttatatatctacaagagtgggaatgggagaagctgcagcaatttttatgacggcaacgccaccgggcactgcagacgctttcccacagagtaacgcaccaattcaggatgaggaacgcgacattccagaaaggagttggaactctggtaatgaatggattacagattttgccggcaagacagtatggtttgtcccaagtataaaagcgggaaacgatatcgccaactgtctacgtaaaaacggcaaaaaggtaatacaactttcacgaaaaacatttgatacagaataccaaaagacgaaactcaatgattgggattttgtggttactaccgatatttcagaaatgggcgcaaatttcaaggctgacagggtaatcgatcctaggagatgtctcaagccggtaattttaactgatggcccagagagagtaatcctagccggtcccatgcccgtgactgctgcaagcgcggcacaacgaagaggacgagttgggagaaacccgcaaaaggaaaacgatcaatatatttttacaggacagccacttaataatgacgaagaccacgcacattggactgaggccaagatgctgctggataacattaatactcctgaggggattattccggctctgtttgaaccagaaagagaaaagagtgccgctatcgatggcgaatataggctaaaaggagaaagtcgtaaaacattcgtagaactaatgagaaggggagacttaccggtatggctcgcacataaagtcgcttctgagggaattaaatataccgaccgaaaatggtgtttcgatggccaacgcaataatcagatattggaagaaaacatggatgtggaaatctggactaaagagggagagaaaaagaaattgagaccacgatggctggacgctagaacttattctgatcccctggcgctaaaagagttcaaagattttgcggcaggaagaaaatctatagctctcgatttagtaactgaaattggaagagtcccaacacatcttgcgcatagaacacgaaatgcgcttgacaaccttgtgatgttgcatacatccgagcacggaggcaaggcttaccggcacgctgttgaagaattacctgagactatggagacactattactactaggattgatgatacttttaactggaggggcgatgctatttctaatatccggtaaaggtataggaaaaaccagtataggattaatttgtgtaatagctagcagcgggatgctttggatggcagaaattcctttacaatggattgcttctgcaatagtgctagagtttttcatgatggtccttcttatcccagaaccggaaaaacaacgcacgcctcaagacaatcaactagcgtatgtagtcataggcatattaacattagcagcaattatcgcggcgaacgagatgggattgcttgaaactactaaaagagacttaggaatgtcaaaagaaccaggagtagtgtcccctacgtcttacttggatgtcgacctccaccccgctagcgcttggactttatatgcggtggctacaacagtaataacccccatgctgaggcacactatagagaatagcacagctaatgtatctctagctgccattgccaaccaggctgtagtattaatgggactagataagggctggcctatatcaaagatggacttaggagtaccattgctagctttgggatgctatagccaggttaatccattaacactaacagctgcagttttactactaataacacactacgctatcatcggtccagggttgcaagcaaaggcaactagggaagcacagaaaagaacagccgccggtatcatgaaaaatccaaccgtggatggaattatgactatagacttagacccagtcatttacgatagtaaatttgaaaagcagctgggacaagtgatgcttttagtgctatgtgcagtacaattattattaatgcgaacaagttgggccttatgcgaggcgctcacgctagcaaccggaccaataacgacactttgggaaggttccccaggtaaattctggaacacaacaattgctgtttccatggcaaacattttccgtggcagttacttggcgggagccggtctagccttttcgattatgaaatctgtaggaacaggaaaaagaggaactggatctcagggagaaacgcttggtgaaaaatggaagaagaaattaaaccagttatcccgaaaggagttcgatttatataaaaagtcaggtattacggaggtcgatagaaccgaagcaaaagaaggactaaaaagaggagagattacacatcatgccgtttcccgcggctctgcaaagttacaatggttcgtggagagaaatatggttattccagaaggaagagtaattgacttaggatgtggacgtggtggatggagttattattgtgcaggactcaagaaagtcaccgaggtaagagggtatacgaaaggaggacctggacatgaagaaccagttcccatgtcaacatacggttggaacattgtgaagctaatgagcggcaaagacgtattctatttgccaccggaaagatgcgatacacttctatgcgatatcggtgaaagcagtcctagtccaactgtagaagaatcaagaacaattcgagtattgaagatggtcgaaccatggttgaaaaacaatcaattttgtatcaaagtccttaacccatatatgcctactgtgatagaacatctagagcgccttcagcgaaaacacggaggaatgctagtgagaaaccccctttctcgaaatagtacgcatgaaatgtattggatttctaatggcacgggtaatatagtcgcgagtgttaatatggtctccagacttctgcttaaccgatttacgatgacacacagaagacccaccatagaaaaagatgtagacctgggagcaggaacacgccatgttaatgcagagcccgaaacaccaaacatggatgtaataggcgagagaataaaaaggataaaggaggaacacaattccacctggcattacgacgacgaaaatccgtacaaaacatgggcataccatggctcatatgaagtcaaagcaacggggagtgcgtccagcatgataaatggagtggtaaaattattaacaaaaccatgggacgtagtaccgatggtcacacaaatggctatgacagacacgacacctttcggccaacaacgagtctttaaagaaaaagtggacactcgaaccccacgatctatgccaggtaccagacgtgtaatgggaattacggcggaatggctttggagaacattaggtagaaataagaaacctagactttgcaccagagaagagttcaccaagaaagtgagaaccaacgctgcgatgggagcggtgtttacagaagaaaaccaatgggactcagccaaagcagcggttgaagatgaagacttttggaaactcgttgatagagagcgagagttacacaaattaggaaagtgtggtagttgcgtttacaatatgatgggtaagagagagaagaaattgggagaatttgggaaagcaaaaggaagcagggccatatggtacatgtggctcggagcaagatacctcgaatttgaggctttgggctttttgaacgaagatcattggttcagtagagaaaattcatacagcggcgttgaaggtgagggacttcataaattgggctatattcttagggatataagcaaaataccaggtggggcaatgtacgcggacgacactgcaggatgggatacacgaattacagaagacgatctgcataacgaagagaaaatcacacaacaaatggatccggagcatcgacaactggcgaatgcgatatttaagctgacatatcaaaacaaagtcgttaaagtgcaaagacccactccaacaggaactgtcatggatataattagcagaaaagaccaaaggggatcgggacaagtagggacatacggtttaaacacttttacgaatatggaggcgcaactcattagacagatggaaggcgaaggcgttcttagcaaagccgacctggaaaatccgcacttacccgaaaagaaaatcacacaatggttggaaacgaaaggcgtagaaaggcttaaacgcatggcgatatcaggtgatgactgtgttgtaaaacccatcgatgacagatttgctaatgcgctcttagcacttaatgatatgggtaaggttcgcaaagacataccacaatggcaacctagtaagggatggcatgactggcaacaagtcccattttgtagtcatcatttccatgaattaattatgaaagatggacgcaaacttgttgttccttgcagaccacaagatgaattaatagggagagcgagaatctcacaaggtgcgggctggtctctacgagagaccgcttgcctaggtaaagcctatgcgcaaatgtggtctctaatgtatttccatcgtagagatctacgattggcttcaaatgcaatctgtagcgcagttcccgtacattgggtccccacaagtcgtactacatggtcaatacacgcgcatcatcaatggatgactactgaggacatgctaacagtatggaatagggtgtggatagaggataacccatggatggaagacaaaacaccagttactacgtgggaaaatgtgccctaccttggaaaacgggaagatcagtggtgcggaagcctaataggactgacatcgcgagcaacatgggcacagaacatacctaccgctattcaacaagtacgatctttaataggaaatgaagagttcttggattacatgccgtcaatgaaaaggtttagaaaagaagaagaaagcgaaggcgcgatatggtag

SEQ ID NO: 23380 - RNA, 9873 nt, synthetic construct
  misc_feature 1..9873: note = derived and/or modified CDS sequence (opt6) from DENV-3__EU529686__SS-prME
  source 1..9873: mol_type = other RNA
actagcttatgcttgatgatgattttacccgctgcattagcattccatctgacatctagggacggagaaccgagaatgatagtcggcaaaaacgaaagaggtaaatcattgttatttaaaacagcatccggaattaatatgtgcacacttatcgcaatggatttaggggaaatgtgcgacgacacagttacttacaaatgtccccatattacagaagtggagcctgaagatatcgattgttggtgtaatttgacttcaacctgggttacatatggtacatgcaatcaagctggtgagcacagaagagataaacgatctgttgcactggctccacacgtaggaatgggtttggacacaaggacacagacatggatgagcgctgaaggcgcctggcgacaagtggaaaaagttgaaacttgggcgttacgccacccaggatttacaatattagctctattccttgcccattacatcgggacaagtttaacgcaaaaagttgtaatattcatactattgatgttagtaacaccgtccatgacgatgaggtgcgttggagtcggaaaccgggatttcgtggaaggattatctggtgcaacctgggtagacgtagttcttgaacatggtggctgtgttacaactatggctaaaaataaacctacactagatatcgaacttcagaaaacagaagcaacacaattagcaacattacgaaaactatgtattgaaggaaaaattacaaacatcaccacagatagtaggtgtccaacacaaggggaagctgttctaccagaagaacaagatcaaaactatgtttgtaaacatacctacgtagatagaggttgggggaacggatgtggtttattcggcaaagggtcattggtgacctgtgccaaatttcaatgccttgaaccaatagaggggaaagtagttcaatacgagaatttaaaatatacagtaattataacagtacacaccggagaccaacaccaagtaggaaacgaaacacagggcgtgacagcagaaattactccgcaggcttccacaactgaagcgattctacctgaatatggaacgctaggccttgaatgcagtccacgaacgggtttggattttaatgaaatgatactcctaacaatgaaaaataaggcttggatggtccaccgccaatggttctttgatttaccattaccgtggactagcggagcaacgaccgaaactcccacatggaacagaaaagaactgttagtaacattcaaaaatgcgcatgcaaagaaacaagaggtagtcgtactaggctcgcaagagggtgcaatgcatacggcgctcacaggagctactgagatacaaaactcgggaggtacgtccattttcgcggggcatttgaaatgtagacttaaaatggacaaactagaattgaaaggaatgtcatacgcaatgtgcacaaataccttcgttcttaagaaagaagtgtcagaaacccagcatggcacgattctaattaaagtagaatataaaggagaagatgtaccctgtaaaataccattttcaacagaagatggacagggaaaagctcataatggccgtttaattacagctaacccggtggtgaccaagaaagaagaacctgtaaacatagaagcagaaccaccttttggcgagtccaatatagttattggtataggggataatgctctgaaaataaattggtacaagaaagggtcaagcataggaaaaatgtttgaagcaaccgcgaggggagcccgaagaatggcaatactaggcgatactgcttgggacttcggcagcgtagggggagttttaaattcactgggaaaaatggtacaccaaatttttggttcagcatatacagcattatttagtggtgtaagttgggttatgaaaatcggcatcggcgtactcctgacatggatcggtctaaattcgaaaaatacctctatgagcttcagctgtatagcaatcggaataatcacattatatctaggagcggttgttcaagcagacatgggatgtgttattaattggaaagggaaagaactaaaatgcggtagtggcatatttgtcacaaacgaagtacatacgtggaccgaacagtacaaatttcaagccgattctccaaaaagattagctacggcaatcgctggagcctgggaaaatggagtttgtggtattagaagtacaacacgaatggagaatctactgtggaaacaaattgcgaatgagttaaattatattctctgggaaaataacataaaattgaccgttgtagtaggggatataataggagttctagaacaaggaaaacgaacactaacgccgcagccaatggaattgaaatactcttggaaaacttggggtaaagcaaaaattgtgacagcagagacacaaaatagctcatttataatagatggaccaaatacacccgagtgtccaagtgcatcacgggcctggaatgtatgggaggtagaagattacggatttggagttttcactaccaacatctggcttaaacttcgagaagtgtacacacaactgtgcgatcaccggctaatgtccgcagcagtaaaagatgaaagagcagtacacgctgatatgggatattggatagaaagtcagaaaaacggatcttggaaacttgagaaagcatctcttatcgaagtcaaaacatgcacttggcccaaaagccatacgctctggagtaacggagtattagaatccgacatgattatacctaagtctttggcggggcctatatcacaacataactacaggccgggttatcacacacaaacagctggtccatggcatttgggtaagttagaactggactttaactactgcgaaggaactactgttgtaataacagaaaactgtggtacaagaggaccatctctcagaactactaccgtgtcaggtaaattaattcatgaatggtgctgcagaagctgcacattacctcccctaaggtacatgggcgaagatggctgttggtacggtatggaaattagaccaatttcagaaaaagaagaaaacatggtcaagagcttagtatccgctggaagcggtgaagttgataactttaccatgggagtattatgtctcgcgatattgttcgaagaggtaatgagaggcaaattcggcaagaagcatatgattgcaggggtcttcttcacatttgtgctacttttaagcggacaaattacgtggcgagatatggcacatacgctaataatgataggttcgaatgctagcgacagaatgggaatgggagtgacatacctcgcccttattgctacattcaagattcagccgtttttggccctaggattcttcttaagaaaattaacaagccgagaaaacttgctattaggggtaggacttgctatggccacaacattgcaactaccggaggatattgaacaaatggcaaacggaatcgctctagggctgatggcattaaagttgataacacaatttgaaacgtaccaattatggactgcattaatatccctaacatgttcaaacacgatatttactttaacggtcgcatggcgtaccgcaacgttaatattagccggtgtctcgctactaccagtatgtcaaagtagttcaatgagaaaaacagactggctaccaatgaccgtagccgcaatgggcgtaccgccgttaccactatttatattctcattgaaagacactttaaagcgacgatcctggccacttaacgaaggagtgatggcggtaggattagtatcaatcctagcaagttcgttactaaggaacgatgttccaatggcaggcccgctagtagcaggcggacttttgatcgcttgttatgttattaccggtaccagcgcagatcttactgtcgaaaaagcggcagatgtaacctgggaagaagaagctgaacaaacaggcgtgtcacataatctcatgataactgtcgatgatgacgggacgatgcgtattaaagacgatgaaacggaaaacattctaaccgtcttgcttaaaacagcccttttaatcgtcagcggtatattcccttattcaatacctgcaaccctgctagtgtggcatacttggcaaaagcaaactcaacggagtggcgtcttatgggatgtaccaagccctcccgagacgcaaaaagccgaacttgaagaaggcgtctatagaataaagcaacaaggtatttttggaaaaacacaagtcggagtgggcgttcaaaaagaaggagtatttcataccatgtggcacgtcacaagaggggctgtgcttacatacaatggaaaaagacttgagccaaattgggcgtcggtaaagaaggatctaattagttacggaggagggtggcggttaagtgcacaatggcaaaaaggcgaagaagtacaagtcatagctgtagaacctggcaaaaaccccaagaactttcaaactatgccaggtacgtttcaaacaactacaggcgaaataggagcaatagctttggatttcaaacctgggacatcaggaagcccaataattaatagagaaggcaaggtggttggcttatatggcaatggggtcgttactaagaatggtgggtatgtatctgggattgcacaaacaaacgccgaacctgacggacctacaccagagctggaagaagaaatgtttaagaaacgaaatttaaccattatggatctacatcccgggtcagggaaaactagaaagtatttacccgcgattgttagagaggccataaaaagaaggcttagaacactgattctagcacccaccagggtagtagccgcagaaatggaagaagcactaaaaggactaccgataagatatcaaaccactgcaacaaaatcagaacatacgggcagggaaatagtggacctaatgtgccatgccacatttacgatgcgcttactgagcccagttcgtgtcccaaactataatctaataataatggatgaggctcatttcactgatccagcaagtatcgccgcgagagggtatatcagtactagagttggtatgggagaagctgcagccatatttatgactgcaacgccaccgggaacagctgacgcatttccacagagcaatgcgccaattcaagacgaagagagggacatcccagaacgcagttggaactcaggcaatgagtggataacagactttgcgggtaaaacggtgtggttcgttccgagtataaaggcaggtaatgatatagcaaattgtcttcggaagaacggcaagaaagttattcagctaagtagaaaaacatttgataccgagtatcaaaagacaaaactaaatgattgggacttcgtggtgacaaccgatatatcggagatgggtgcaaattttaaggcagatagagttatagatccccgtagatgtctgaagcctgttattttaacagacggacccgaacgagttatactcgcaggtcctatgcctgtaactgctgcctcagccgcgcagagacgaggacgggttgggcgtaaccctcaaaaagaaaacgatcagtatatttttacgggccagcctttaaataacgatgaagatcatgcacattggactgaggcaaaaatgttactagataatattaatacacccgaaggaataataccagcactcttcgagcccgagcgtgaaaaatcagcagcaatagacggagagtatagattaaaaggagaaagtaggaagacattcgtggaactcatgcgtagaggtgatctgccggtatggttagcccacaaggttgcaagtgaaggtataaaatatacagatcgtaagtggtgttttgatggacagagaaacaatcagatacttgaagagaatatggatgtggaaatatggacaaaggaaggtgaaaagaagaaacttaggccccgatggttggacgcccgaacctatagcgatccacttgccctcaaagaatttaaggattttgctgcagggagaaaaagcatcgcattagatctggtgacagaaataggtagggttccgacacatttagctcataggactagaaatgccctagataacttagtaatgttgcataccagtgaacatgggggaaaggcatataggcatgcagtagaagaacttcccgaaactatggaaaccttacttcttttgggattgatgatattattaacgggaggggcaatgttatttttgatctcaggtaagggaatagggaagacctccataggtttaatatgtgtaattgcttcttcaggcatgttatggatggctgaaataccattacaatggatcgcttccgccatagtactagagttctttatgatggttcttctaataccagaaccagaaaaacaaaggacgcctcaggacaatcaactggcgtacgtagtcatcggcattttaacgctcgcggcaataattgcagccaacgaaatgggcctactggagacaacaaagcgtgatttaggtatgtcaaaggaaccgggagtagtttctcctacatcatatcttgatgtggatttacatcctgcatcggcatggactttgtacgcagtagcaacaaccgtaataacaccgatgcttcgacatacaatagaaaactcgacagctaatgtatctttagcagcaattgcaaatcaagcagtcgtactcatggggctagacaaaggttggccaatttcaaaaatggatttgggagttcctttgcttgctctcggctgttattctcaggtaaacccgttgactttaaccgcggcagtgcttttattaattactcactacgcgatcataggtcctggtctccaggcaaaggctacaagagaggctcaaaaacgaacggcagctggcataatgaaaaacccaacagtagacggtatcatgacaattgacttggacccggttatttacgatagtaagtttgaaaaacaattaggacaagtcatgttacttgtgctatgtgcagtccaattattattgatgagaacatcatgggcattgtgtgaggctttgactctggcaacaggcccaataactacactttgggaagggtcgccgggcaaattctggaacactacaatagctgtatcaatggctaacatattcaggggtagctatttggcaggagcagggttagcgttcagtataatgaagagtgttgggacggggaaaagaggaacgggtagtcagggagaaaccctgggtgaaaaatggaagaagaaattaaaccaactctcgagaaaagaatttgacttatacaagaaaagtgggatcacggaagtagatagaactgaagctaaagaaggtctgaaaagaggcgaaattactcaccatgcagtaagtaggggttcagccaaactacaatggttcgtggaacggaacatggttatacccgaagggcgggtgatagacttgggatgtggccggggtggatggtcctattattgtgcgggactaaagaaagtaacagaggtaagaggctatactaagggaggcccaggccacgaagaacccgttccaatgtcaacatatggttggaatatagtgaaacttatgtctggaaaggatgtattttatctaccaccagaaaaatgtgacacattactctgtgacataggtgaatctagccctagtccaaccgttgaagaatcacgtacaattcgagtgttaaaaatggtagaaccttggctaaagaataaccaattctgtattaaagttttaaatccgtatatgccaactgttatagaacatcttgaaagactacagaggaaacacggaggcatgttagtcagaaatcccctctcaagaaattcaacacatgaaatgtactggatatcaaatgggacaggaaacattgttgccagcgttaatatggtaagccgtctcctgctaaatcgatttaccatgactcataggaggccaacgattgaaaaagacgtagacctgggagcaggcacaagacatgtgaatgctgaaccagaaacaccgaacatggatgtaataggggaacgaattaaaaggattaaagaagaacataatagcacatggcactacgacgacgaaaatccatacaaaacttgggcatatcatgggagttacgaggttaaagcaactggctcagcatcaagtatgatcaacggagtagtaaaacttctaacaaaaccatgggatgtagtccccatggtaacacagatggcgatgactgatacgactccattcggacaacaacgagtatttaaagagaaagttgatactagaactccaaggtcaatgccgggaactcgacgggttatggggattacagccgaatggttatggcgaacactggggaggaacaagaaaccccgtctatgtacacgtgaagagttcaccaagaaggtccgcactaacgctgccatgggagccgtctttacagaagaaaaccagtgggattctgccaaagccgccgtcgaagatgaaaacttctggaagctagttgaccgggaacgtgaactacataaactcggaaaatgtgggtcatgtgtatacaacatgatgggaaaaagagagaagaaattgggagaatttggaaaagcaaaaggttcacgtgctatctggtatatgtggctgggtgcgagatacctagagtttgaagcacttggattcctgaacgaagatcattggttttcacgagaaaatagttatagtggagtcgaaggagaaggtttacataaattaggatacattctcagagatataagtaagatacccggtggcgcaatgtacgcggatgatacagcgggttgggacacaagaataacagaagatgacctacacaacgaagagaaaatcactcaacagatggatccggagcacagacaactggcaaatgcaatttttaaactaacttaccaaaataaagtagtgaaagtacaacgtccaaccccaacaggaacagtaatggacattatatcaagaaaagaccaaagaggaagtggacaagtaggtacctatggactgaacacatttacgaacatggaggcacaattgatacgacaaatggagggtgagggcgtattaagtaaggcagatctagaaaatagccacttacctgagaagaaaattacacaatggctagaaacaaaaggcgtagaaagactgaaacgtatggctatctctggggatgactgtgtagtgaaacctatagacgatcgatttgcgaacgcattgttagcgctgaatgacatgggcaaggttaggaaagatatacctcaatggcaacccagtaaaggttggcatgattggcagcaagtgccattttgctctcaccattttcatgagctaatcatgaaagatggtaggaaattggtagtcccatgtaggccacaggacgagttaataggtagagctagaatttcacaaggagctggatggagtctaagagaaacagcctgcctaggaaaagcgtatgcacaaatgtggagtttaatgtattttcacaggcgtgatcttagactagcgagcaacgcgatatgctccgcagtgccagtacattgggttcccacttcaagaacaacatggtcaatacatgctcaccaccaatggatgacgactgaggatatgttaaccgtctggaacagggtatggatcgaggacaatccatggatggaagataagacgccggtaacgacatgggaaaatgtgccatatcttggtaagagagaagaccagtggtgcggatcgctcataggattaacatcacgtgctacgtgggctcagaatataccaacagccatacagcaagtgcgatccctaatcggtaacgaggaatttcttgattacatgccctcaatgaagcgatttcgaaaggaggaagaatctgaaggagcaatatggtaa

SEQ ID NO: 23381 - RNA, 9873 nt, synthetic construct
  misc_feature 1..9873: note = derived and/or modified CDS sequence (opt6) from DENV-3__EU529687__SS-prME
  source 1..9873: mol_type = other RNA
acctcattatgccttatgatgatactgccggcggccctcgcatttcatttaacctctcgcgacggggaaccgaggatgattgtgggtaaaaatgaaagagggaaaagtttactgttcaaaaccgcaagcggtattaatatgtgtactctcattgccatggatttaggtgaaatgtgcgatgacactgttacttataaatgtcctcatataactgaagtcgaaccggaagacatagactgctggtgtaatttaacaagcacatgggttacgtacggaacatgtaatcaggctggagaacaccggagagataaaaggtcagttgcgttagcgccacacgtcggaatgggccttgatactcggacgcaaacatggatgagcgccgaaggggcttggcgtcaagtggaaaaagtggaaacatgggcacttcgccaccccggattcacgatcttagcattatttctggcacattacatagggacgagtctaacacaaaaagtagtaatttttatactcctaatgttagtcactccatccatgaccatgcgatgcgttggcgtgggtaatagagactttgtagaaggattatctggagcaacatgggtagacgttgtattagaacatggaggatgcgtaaccaccatggcaaagaataaaccgaccctagatatagaactacagaaaacggaagcgacacagcttgcaacgttaagaaaactttgcatagaaggaaaaattacaaacataacgacagatagtcgatgcccaacgcagggtgaagctgtactaccagaagaacaagaccagaactacgtatgtaaacatacttacgttgataggggatggggtaacggttgtggcttattcggaaaagggtcacttgtaacatgtgctaagttccagtgcctggaaccaatagaaggaaaagtagtacaatacgaaaatctaaagtatacagtaattattacggtacatacgggcgatcaacatcaagtgggcaatgagactcagggtgtaacagcagaaataacaccacaggccagcaccactgaagccatcttacctgaatatggaacactgggcttagagtgctcgcccagaacgggtctagactttaacgaaatgatattgttaactatgaaaaacaaagcatggatggttcaccgacaatggttctttgatctcccattaccatggacaagtggagccacaactgagactccaacatggaacagaaaggaactattagttacattcaaaaatgcccatgctaaaaagcaagaagtggtagtgctaggtagtcaagaaggcgcgatgcacacagcacttaccggtgctactgagatccaaaattcaggcgggacatcgatatttgccggccatttaaagtgtcgcttgaagatggataaacttgagttaaagggaatgagctatgccatgtgtacaaatacgttcgtactaaagaaagaggtatctgagacacaacatggaaccatactgataaaggtggaatacaaaggagaagatgtaccctgtaaaattccctttagcacagaagacggacaagggaaggcacataacggcagactaattaccgctaatcctgtagttactaagaaagaagaacccgtaaacatagaagcggaaccaccatttggtgaaagcaatattgtaattggtatcggagataatgcattaaagataaattggtataagaaaggatcttctatagggaagatgttcgaggcaactgcccgaggtgcacgacgcatggcgatactaggcgacacagcctgggattttgggagtgtcggaggcgtactaaattccctaggtaaaatggttcaccagatatttggtagtgcatataccgcactgttttcaggggtttcttgggtcatgaaaatagggattggtgtattattaacttggataggactgaacagcaagaatacgtccatgagtttcagttgtattgcaataggtataataaccctatatctgggagctgtagtacaagcagatatgggatgcgtcattaattggaagggtaaagagctcaagtgtggaagtggcatttttgtcacaaatgaagtacacacttggaccgaacaatataaatttcaagcggacagtccaaaaagacttgcaaccgcgattgcgggcgcgtgggaaaacggggtttgcgggatacgttcaacaacccggatggagaacttgctttggaaacaaatagcaaacgaactaaattatattctatgggaaaataatatcaaattaacagtggtagttggagacataattggggtattagaacaaggaaagcgaacgctaacaccacaacctatggaacttaaatactcttggaaaacttgggggaaagctaaaatagttactgcagaaacacaaaatagttcatttattatcgatggaccaaatacgccagagtgcccttcggcgtctagggcatggaacgtttgggaagtagaggattatggttttggggtattcacaacaaacatatggctgaaactacgagaagtttatacacaattatgcgaccacagattaatgtcagcagcagtcaaagatgaaagggcggtacacgcagacatgggctactggatcgaatctcagaaaaacggatcatggaaactcgaaaaggcatcgttaatagaagtaaaaacatgcacatggcccaaatcacacactctatggtcaaatggagtgttagagtcggacatgattattccaaaatcactagcgggtccgatatcacaacacaattacaggccaggatatcatactcaaacagctggtccatggcatcttggaaaacttgaactggacttcaactattgcgaaggcacaacagtggtaattacggaaaattgtggaactagaggacccagtttgaggacgactacagtatcgggtaaactaatacatgagtggtgttgtaggtcatgtacactacctccactgaggtatatgggcgaggatggttgttggtatgggatggaaataagacccataagtgaaaaagaagaaaacatggtcaaaagtttagtcagtgcaggttcaggagaggtagataactttacaatgggtgtcttatgcctagcaatacttttcgaagaggtgatgagaggtaaattcggaaagaaacacatgattgccggggtgttctttacctttgtactattgttaagtggacaaatcacatggcgagatatggcacataccctcataatgattggatctaatgcttctgacaggatggggatgggagttacatatctcgctttgattgccacgtttaaaatacaaccgtttttggcacttgggttctttctaaggaaactaacaagtagagaaaatttattattaggcgtcggcttggcaatggccacaactctacaactcccagaagacatcgaacaaatggctaatggaattgctcttggactaatggccctaaaattgataactcaattcgaaacttatcaactatggacggcattaatatccttaacatgcagtaacacgatttttaccttgaccgtagcttggcgaactgctactttgatactagcaggagtttctctcttacctgtatgtcaaagtagttcaatgcgtaaaaccgactggcttcccatgacagtcgccgccatgggagttcctccactaccgctgttcatcttcagccttaaagatactttaaaacgtcgttcttggcctttaaatgaaggcgtcatggcagtaggattagtatcaatactagcctcctcacttttaagaaatgacgtccctatggccggaccactggtcgcaggaggattattgatagcatgttatgtgataacgggtacaagtgcagacctcacggtagagaaagcagcagatgtaacatgggaagaagaagctgagcaaactggagtatcacataatcttatgataacggtcgacgatgacggaactatgagaataaaggatgatgaaacagagaacatcttgacggtactactaaaaacagcactcttgatagtcagtggtatatttccatacagcatccctgcaacactattagtgtggcatacgtggcaaaaacaaacccaaagatcaggagttttgtgggatgttccgagccctccggaaacccagaaagcagaactagaggaaggagtctaccgaataaaacaacagggtatattcggtaaaacacaagttggtgtaggcgtacaaaaggagggtgtttttcacactatgtggcatgttacaaggggcgccgtactcacttacaatgggaaaagattggaacccaattgggcatcagttaagaaagatttaataagctatgggggaggttggaggctcagtgctcaatggcagaaaggcgaagaggtacaggttatcgcggtcgaacctggcaaaaatcccaaaaattttcaaacaatgcccggaacatttcaaactacaactggtgaaatcggagcgatcgcattagattttaaaccaggtacatcgggatctccaattataaacagggaaggaaaagtagtaggtctatacggaaatggtgtggtgactaagaacggaggttacgtgtcaggcattgcccagactaatgcagaaccggacggacctacaccagaacttgaggaagagatgtttaagaaacgaaatctaaccataatggatttacatccgggatccgggaaaacaaggaaatacctaccagccatagtacgggaagcgattaagcgccgactccgaacccttatccttgcaccgacacgcgttgtagctgcagaaatggaggaagctctgaagggtctccccataagataccagactacagcaacaaagtcggaacacactggtcgtgagattgtagatttaatgtgccatgcaacctttacaatgcgactattatcacctgttagagtacctaattacaatttgataataatggacgaagctcattttactgacccagcatcgatagctgcaagaggatacatctctacaagagtagggatgggagaagctgccgcaatttttatgaccgcaacaccaccaggtaccgccgacgcattcccccaatcgaatgctcccatacaagacgaagaaaaggatatacccgaaaggagctggaactctggtaacgagtggatcacagacttcgcaggtaagacggtatggttcgtacctagtataaaagcgggtaatgacatagcaaactgcttaaggaaaaatggaaagaaagtgatacaattatcccgtaagaccttcgacacagaataccagaaaacgaaacttaatgattgggattttgtggtaacgacggatatatcggaaatgggagcaaactttaaagctgaccgagtaatagacccacgcagatgcttaaagccagtaatcctaacagacggccctgaaagggtgattctcgctgggccaatgccggttacagctgccagtgcagcgcaaaggagaggtcgtgtaggtcgcaatccgcagaaagaaaacgatcagtatatatttaccggacagcctttaaacaatgacgaagaccacgcccattggactgaagcaaaaatgctgctcgataatattaacacaccagaggggatcataccagcactatttgaaccagaaagagaaaagtctgcagctatagacggggaatacagattaaaaggtgaatcgaggaaaacttttgtagaactaatgcgaagaggggatttaccggtgtggctcgcgcataaagtagcatctgaaggaatcaaatataccgatagaaaatggtgtttcgatggtcaacgcaataatcaaatactcgaggaaaatatggatgtggaaatctggacaaaagaaggcgagaaaaagaaactacgaccacgatggctagatgctagaacatatagtgatcctctcgcgttgaaagaatttaaagattttgcagctggtaggaaatcaattgcgttggatctagtgacggaaatcggaagagtaccctcccatctcgcacatagaacaaggaatgctttagacaatctagtaatgctacacacaagtgaacatggcggaaaagcatatcgtcatgcagttgaagaattacctgagacaatggaaactttactactccttggtttgatgatcctgttaacgggaggggcaatgctatttttaattagtgggaagggcataggcaagacctcgattggactgatttgtgtaatcgcttcttccgggatgctatggatggcagaaataccattacaatggattgcgtcggcaatcgtattggaatttttcatgatggttcttctaatacccgagccagaaaagcaaaggacgccacaagataaccagttagcctacgttgttattggaatactaactttagcagcaataatagcggcaaatgaaatgggattattagagacgactaaaagagatttaggtatgagcaaagaacctggggtagtatcaccaacgtcgtacctagatgtagatttacatccggcctcagcatggactctatatgctgttgctaccaccgtaataacgccaatgctaagacataccattgaaaactcaactgcaaacgtaagtttggcagccatagctaaccaagcggttgtcttaatgggtttagacaaaggatggccgataagtaaaatggatctaggagttccactactagcactgggatgttattctcaagttaatccattaaccttaacagccgcagttcttctcttaatcacccactatgccataattggcccggggttacaagctaaagcaacaagggaagcccaaaagaggacagcagctgggattatgaaaaaccccacagtagacggtataatgacgattgacttggaccctgttatttatgattccaaatttgaaaaacaactcggacaggtcatgctgttagttctgtgtgcagtgcaattattactgatgagaacctcctgggcactctgtgaggcattgacattagctactggaccgattaccacgctgtgggaaggtagcccaggtaaattttggaatacgactatagctgtaagcatggcaaacatttttagaggaagctacttagcaggcgcaggactagccttttctataatgaaatcagttggaacaggaaagcgaggaaccggaagtcaaggagaaacactcggcgaaaaatggaaaaagaagctaaaccagctctctcggaaagaatttgatttatataaaaagtcagggattacagaggtagatcgcactgaagcaaaagaaggattaaaaagaggggaaattacacatcacgcggtgagtagaggttcagctaaattgcaatggtttgtcgaaagaaatatggtcatacccgaaggacgagtgattgatttgggttgcggtcggggtggctggagctattattgtgctggtctaaagaaagtaacagaagtaagagggtatacaaaaggcgggccaggtcatgaggaaccagtaccaatgtcaacctatggatggaacattgttaagctaatgtcgggcaaagatgtattttacttaccaccagaaaaatgcgacacactactatgtgatataggtgagtcaagtccgtcaccaacggtagaagaaagcagaacgattagggtcctaaaaatggtagagccgtggcttaagaataatcagttttgtatcaaggtactaaatccatatatgcccaccgtaatcgaacacctagaaagattacaacgaaaacatggaggtatgttggtaagaaacccattaagtagaaatagcactcatgaaatgtactggatttcaaacggtacaggtaacatagtggcgtcagttaatatggtgtcaagattactattgaaccgtttcaccatgacacatagaagacccacaatagaaaaagatgtagatttaggcgctggaactcgccacgtcaacgcagaaccagaaacaccaaacatggatgtgatcggtgaaaggatcaaaagaataaaggaagaacataattcaacctggcactacgatgacgaaaatccttataaaacgtgggcataccatggcagttacgaggtaaaggctacagggagtgcttccagtatgatcaatggtgtggtaaaattgttaacaaagccatgggatgtagtaccgatggtgacacaaatggctatgactgatactactccattcggtcaacagagggtcttcaaagaaaaagtagatactaggacgcccagaagcatgccggggactcgtagagttatgggaatcacggccgaatggctatggcgaacgttgggacgaaataagaaaccccgtctctgtactagggaagaatttacgaagaaagttagaacgaacgcagcaatgggtgcagtattcactgaagaaaatcagtgggacagtgctaaggccgctgtagaagacgaggatttttggaaattagtggaccgtgaaagagaactacataaacttgggaagtgtggatcatgcgtttataatatgatgggtaaaagagagaagaaattaggcgaatttggaaaagcaaaaggatcacgcgcgatatggtacatgtggttgggagctcggtatttagaatttgaagcgttaggctttcttaatgaggaccattggtttagtagagaaaacagttattcgggtgttgaaggagaggggctacacaaactagggtatatattacgagatatttcaaagatacccggaggggccatgtatgccgatgacacggccggctgggatacccggataactgaagacgatctgcataatgaagagaaaataactcaacaaatggacccagaacatagacagcttgcaaatgccattttcaaactcacgtaccagaacaaggttgtaaaagtacaacgcccaacacctaccggaacagtaatggatattataagccgtaaagaccagagaggttcaggacaagttggaacatatggcttaaacacctttaccaatatggaagcgcaattaatacggcaaatggaaggagagggagtattaagtaaagccgacttagagaatcctcatcttcctgagaagaaaataactcaatggttagagacaaagggtgtagaacgtcttaaaagaatggccataagtggtgatgactgcgtcgtaaaaccgatagatgatcgttttgctaacgctctcctcgcacttaatgatatgggaaaagttagaaaggacattccacagtggcaaccgagtaaaggatggcacgactggcaacaggtacccttttgtagtcatcacttccatgaactgataatgaaggacggccgtaaacttgtcgtcccttgtaggccacaggacgaactaattggaagggcaagaataagtcaaggggctggatggtcgttaagagaaactgcgtgtctaggaaaagcctatgctcagatgtggtcactcatgtattttcatcgaagagaccttaggttagcatcaaatgctatatgttcagctgttcccgtccattgggtaccaacaagtagaacaacatggtccatacatgctcatcatcaatggatgacgactgaagatatgttaaccgtatggaacagagtatggatagaagataacccgtggatggaggataaaactcccgtaacaacatgggagaatgtgccatacctaggaaaaagggaagatcaatggtgtggctctctaatcggactaacaagtcgggcaacctgggctcaaaacataccaaccgctattcaacaggtacgcagtctcataggtaacgaggaatttttggactacatgccctcaatgaaacgcttccgaaaagaggaagagtcagaaggtgctatctggtag

SEQ ID NO: 23382 - RNA, 9873 nt, synthetic construct
  misc_feature 1..9873: note = derived and/or modified CDS sequence (opt6) from DENV-3__KF955449__SS-prME
  source 1..9873: mol_type = other RNA
acaagcctatgcctaatgatgatactcccagcagcactagcttttcatctaacatcgcgtgatggggaacctaggatgattgtaggcaaaaatgaacgcggaaaatcattattattcaaaacagcatctggaataaacatgtgcacacttatagcaatggatttaggagaaatgtgtgacgatacagtgacatacaaatgtccgcatattacggaagtggaaccagaagatattgactgctggtgtaatctaacctctacttgggtgacatatggtacttgtaatcaagcgggggaacaccggagagacaaaagaagtgtggcacttgcaccacatgttggaatgggattagatactcgaacacaaacgtggatgtcggcagaaggtgcgtggcgacaagttgaaaaagtagagacctgggcacttagacatcctggttttaccattctcgcgctatttctagcgcattatattggcacgtcactgacgcaaaaagtagttatttttgtattattaatgctagtcacgccgtctatgacgatgaggtgcgtaggagttgggaatcgggattttgtcgaaggtttaagtggggcaacatgggtagacgtggtgttagagcacggcggatgcgtaacaacaatggccaaaaacaaacccactttggatattgagctgcagaaaactgaggcaacgcaattagctacactaagaaaactctgtatagaaggaaaaatcacaaatattaccacagattcccgttgtcctacacaaggcgaggcagttctaccagaggaacaagatcaaaactacgtttgtaaacacacatatgttgaccgaggctggggaaatgggtgtggattgtttgggaaaggaagtcttgttacatgtgctaaatttcaatgtctggaacctatagaaggaaaagtcgtgcagtatgagaatttaaaatataccgtaataataacagtgcatacaggtgatcaacatcaagtaggtaacgaaacgcagggtgttactgcagaaattacaccacaagcatcaaccacagaagccatacttccagaatatggaactctaggattagaatgcagtccacgaactggattggactttaatgagatgatattattaacgatgaaaaacaaagcatggatggtgcataggcaatggttctttgatctgccattgccctggacaagtggcgctacaacagaaacacctacatggaataggaaagaattgttagtcacttttaagaacgctcacgccaagaaacaggaagttgttgtgttaggttcgcaggaaggtgcaatgcacacagcgttaacgggggcaacagaaatacagaatagtggtggtaccagtatattcgccggtcaccttaaatgccgcttaaaaatggataaacttgaattaaaaggtatgtcttatgcaatgtgtactaatactttcgtactaaagaaagaggtaagtgagacccagcatggaacgatactgataaaagttgaatataaaggagaggatgtgccctgtaaaattccatttagtaccgaagatggacaaggaaaagcgcataatgggcgactcatcactgctaatccagtagtaaccaagaaagaagaaccagtaaatatagaagccgaacccccattcggggagtccaatatcgttatcggaatcggagacaatgcattgaagatcaattggtataagaaaggatcaagcattggaaaaatgttcgaagcgaccgcgcggggagcacgaaggatggcaatactaggagacaccgcatgggattttgggtcagtaggaggtgtgcttaattcactgggaaaaatggttcaccaaattttcggaagtgcctataccgcactattttcaggagtcagctgggttatgaagataggcattggcgtgttgctcacatggattggccttaatagcaaaaatacctctatgtcgttttcctgcattgccatcggtataattaccttgtacctaggcgcggtagtacaggcggatatgggctgtgttataaattggaaaggtaaagagttaaagtgtggtagcggtatattcgttacgaatgaggtgcatacttggacagaacaatataaattccaggccgactcgcctaagagactcgctacagcaatcgctggcgcgtgggaaaatggggtgtgcggaatcaggagcacgacacgtatggagaacttgctatggaaacaaatcgcaaatgaattaaactatatactgtgggaaaataatatcaaactaacagttgttgtgggagacatcatcggcgtgctagagcaaggtaaacgaacgctcacgcctcagccaatggaattaaaatattcatggaagacatggggaaaggcaaaaatagtaacggccgagactcaaaacagcagcttcataatagatggacccaacaccccagaatgtccttctgcaagtagagcatggaacgtttgggaagtagaagactatggtttcggagtatttacgacaaacatctggctaaaacttcgtgaggtgtatacgcaactttgtgaccatagattaatgagtgcagcagtgaaagacgaacgggcggtacatgcagacatgggatattggattgaatctcagaaaaacggaagctggaagctagaaaaagcgagtcttatcgaggtcaagacatgtacctggcctaagagtcacacactgtggtcaaatggtgttcttgaatcagacatgataataccaaaaagtcttgcggggcctatttcacaacacaattatagacccggatatcatactcaaacggctgggccttggcatctaggaaaactagaattagatttcaactactgtgaggggactacagttgtgataaccgaaaactgcggcacaaggggccctagtttaagaacaactacagtgtcgggtaagctaatacatgaatggtgttgtagaagttgcacccttcctccgttgcgttatatgggcgaagatggatgttggtatggcatggaaattagacccatatccgaaaaagaagaaaacatggtcaagtcacttgtaagcgcaggatctggtgaagtagacaatttcacaatgggagtattgtgtctagcaatcctattcgaagaagtcatgaggggcaaatttggcaagaaacacatgattgccggtgtattcttcacttttgtattattattaagtggtcagattacatggagagacatggcacataccctaataatgatcggatcaaatgcttccgatcgcatgggaatgggtgtgacttatttagcattaatagcaacatttaaaatacaaccatttctagctcttggatttttcctcagaaaacttacctcaagagagaatctattgcttggagttgggctagcaatggcaactacattacaactacctgaagacattgagcaaatggctaacggaattgctttaggcttgatggcattgaaactgatcacccaatttgaaacataccagctatggacagctctgatcagcctaacctgttcgaatacaatattcacgttgaccgtcgcatggaggaccgcaacattaattctagccggagtctctctattacctgtatgccaatcgagttctatgagaaaaacagactggttgccgatgacagtcgcagctatgggggttcctccgttgccactattcattttcagcttgaaagatacacttaaacgaagatcttggcctcttaatgaaggagttatggccgtgggattagtatctatccttgcgagttcactactgagaaatgacgtaccgatggcaggtcccttagtggcgggtggactattaattgcatgctatgtcatcaccggcacaagcgcagacttaaccgtagaaaaagctgcagatgtaacctgggaagaagaagccgaacagaccggggtgagccataaccttatgattacagtagatgatgacggaacgatgcggattaaggatgacgaaacggagaatatactaactgtattacttaaaacggcattactaatagtaagtgggatattcccatactcaatcccagctactttactcgtgtggcatacgtggcaaaaacagactcaacgatcgggagtcttatgggacgttccgagtccccctgaaacgcagaaagcagaattagaagaaggtgtgtacagaatcaaacagcagggaatattcggtaaaactcaggttggggtgggggtacaaaaagaaggagtgttccacaccatgtggcacgtgacaaggggtgcggtattaacctataacggcaaaaggcttgaacccaattgggcaagtgtcaagaaagacctaatttcatacggtggcggatggagattaagtgcgcaatggcaaaaaggtgaagaagtgcaagtaattgctgtagaaccaggcaaaaatcccaaaaattttcaaaccatgccgggtacattccaaacaactacaggcgaaattggggctatagcattagatttcaaacctgggacaagtggctcgccaattatcaatcgagaaggtaaggttgtaggtttatacggaaatggagtggtaacgaagaatggaggctacgtatcaggtattgcacaaactaatgcagagcctgacggccccacgcctgaactagaagaagaaatgttcaagaaaagaaatttaacaataatggacctacatcctggatcagggaaaactagaaaatacttgcctgcaatagttagagaagccatcaaacgacggttacggacgctaatcttggcgcccacgcgcgttgtggctgccgaaatggaagaagcgttgaaaggcttgcctattaggtatcagactacagcaacaaaaagcgagcatacggggagagaaatagtagatctaatgtgtcatgcaacttttacgatgcgattactaagtccggtccgtgtaccaaactataatcttattataatggatgaagcccattttactgatccagcatctattgccgcgcgaggctatatatccactagggttggaatgggtgaagcggcagccatttttatgacggcaaccccgccaggtacggccgacgcattcccccaaagtaatgcaccaattcaagatgaagaaagggatattcctgaacgatcatggaatagcggaaatgaatggataacggactttgcgggcaaaacagtttggtttgtcccatccatcaaggccggtaacgacatagcaaattgcctaaggaaaaatggcaagaaagtcatacaactgagccgaaaaacatttgacacagaataccagaaaacgaaattaaacgactgggacttcgtagtgacaacagacatttctgaaatgggcgctaattttaaagcagatagagttatagatccaagaaggtgtctaaaacctgttattttgacggatggaccggaacgtgtaatacttgcaggacccatgcctgtaacagcagcatctgcagcacagcgcagaggcagagtaggacgaaacccacagaaggagaatgatcaatatatatttacaggacaaccccttaacaatgacgaggaccacgcacattggactgaggccaaaatgttactggacaacataaatacacccgaaggaataattccagctctcttcgagccagaaagagaaaagagtgctgccattgacggcgaatatcgactaaaaggagagtcacgaaaaacttttgtagaattgatgcgtagaggagatctacccgtctggctagcacataaagttgcgagtgaaggaataaaatataccgacagaaaatggtgctttgatggtcaacgaaataatcaaatactggaagaaaacatggatgttgaaatatggacaaaggaaggagagaagaagaaacttaggccaaggtggttggacgccagaacatactcagatccattggcgctaaaagaatttaaagattttgcagccggacgtaaatctatagcactagacctagtcactgaaataggaagagtcccatctcatctagctcatagaacacgtaatgctcttgataatttggtaatgttacacaccagcgagcatggtggtaaagcatatcgtcatgcggtagaagaacttcccgaaacgatggaaaccctactattactcggattaatgatactcctcacaggaggagccatgttattcttaatcagcggcaaaggtataggaaagacttcaataggtctaatatgcgtcattgcatcatctggaatgttatggatggcagaaatcccactacaatggattgcgagtgcaatagtcttagaatttttcatgatggtattattaatacccgaaccagaaaaacaaagaactccacaagacaatcaattggcatatgtcgtcataggaattttaactctagcagccatcatagcagccaatgagatggggttattagaaacaacaaaaagagacttgggaatgagcaaggaaccgggtgttgtttctcccacttcttacttggatgtagatctgcatccggcatcagcttggactttatatgccgtcgcaaccacagttattaccccgatgttacgacatacaattgaaaattcgactgctaacgtaagtctagcagctatagccaaccaagcggtggtactgatgggactagataaaggatggccaatctcgaaaatggatctgggagtaccacttttagcactcggatgttattcccaagttaatccattaacacttaccgccgccgttctacttcttattacacattacgcgatcataggtccaggtctccaagcgaaagcgaccagggaagcacaaaaacgaacggcagcaggtatcatgaaaaacccgacggttgacggaattatgacaatcgatctcgaccctgtcatatacgacagcaaatttgagaaacaacttggtcaggtaatgctgttagttttatgcgcagttcaattactcttaatgcggacctcgtgggctctatgcgaagccctaaccttagctacaggaccaataacaactctatgggaaggatcaccaggcaagttttggaacactacaatagcagtctcgatggctaatatatttcgaggatcataccttgctggagcgggactagcattctcaataatgaaatccgtgggtacagggaagcgaggtacaggaagccaaggggaaactttaggagaaaaatggaagaagaaactcaatcaattaagccgaaaagagttcgacctttataagaaatcgggaatcacagaggtagatcgaactgaagcgaaagaaggcttaaaaagaggagaaatcacacaccatgcagtatcaaggggttcagctaaactacaatggtttgtcgaacgcaacatggtaatcccagaaggaagggtaattgatttgggctgtgggcgaggaggatggtcttattactgtgctggtttgaagaaagttactgaagttagagggtacactaaaggcggccccggtcatgaggaaccagttccaatgtcaacttacggttggaatatagtaaaactaatgagcggtaaagatgtgttctacctacctcccgagaaatgtgatacattattatgcgatataggagaaagttcaccaagtccaacagttgaagaatctaggacgatacgcgtattaaaaatggtagaaccatggctgaaaaataatcaattttgtataaaggtactcaacccttatatgcccaccgtaatagagcaccttgaaagattacaaagaaaacacggaggaatgctagtgaggaatccattaagcagaaattctactcatgaaatgtactggataagtaatggaactggtaatatcgtagccagtgtcaatatggtatctagacttctattgaataggttcacaatgactcatcgtcgacctactatagaaaaagatgttgacttaggagcaggaacgagacacgtgaacgctgaaccagaaacgccgaacatggatgtaatcggtgaacgtatcaaaagaatcaaagaagaacacaactcgacctggcactatgatgatgagaatccctataaaacatgggcgtaccacggttcgtatgaggttaaggctactggatcagcatcatcaatgatcaatggcgtggtaaaactattaacaaaaccgtgggacgttgtcccaatggttacgcaaatggcaatgacagacactacgccgttcggacaacaacgtgtgtttaaggaaaaggtcgacacgaggacgccacgatcaatgccaggaacgagacgcgtgatggggatcacggccgagtggttgtggagaacgttaggaagaaataagaaaccacgactgtgcactagagaagagtttactaaaaaggtaagaaccaacgcggcgatgggagcggtgttcacggaagaaaaccaatgggactcggcgaaagcggccgtcgaagatgaagatttttggaagttagtagaccgggaaagagaacttcataagttgggcaaatgcggatcttgcgtttataacatgatgggaaagagggagaagaaattaggggagttcggcaaagctaagggaagccgagcgatctggtacatgtggcttggagccaggtatctggaatttgaagcgcttggtttcctaaatgaagaccattggttctccagggaaaactcatactcgggagttgaaggcgaaggcctacataaactaggttatatacttagggacatctctaaaattcccggtggtgccatgtatgcagatgatacagcgggatgggacactcgaatcactgaagacgacctgcataatgaggagaaaataactcagcaaatggatcctgaacatcgtcagttagcaaacgcaatttttaaactaacttaccaaaataaagtagtaaaagtacaaagaccgactcctacgggaacagtaatggacataatctcccggaaagaccaacgcggatctggtcaagtaggaacgtacggattaaatacattcactaacatggaagcacaactcattagacaaatggagggagaaggggttctatcaaaggcagacttggagaatccacacctaccggagaagaaaataacacagtggttagaaaccaaaggagtagaacgactgaaacgtatggcgatttcaggcgacgactgtgttgttaaaccaattgatgaccgattcgctaacgcacttttagctctgaacgatatggggaaggttaggaaggatataccgcaatggcagccgtcaaaagggtggcatgactggcaacaagttccattttgctcccatcatttccacgaattaataatgaaggacggaaggaaattagtagtcccttgcagaccccaggatgaattaattggtagagcaaggatctcgcaaggagccggatggtctttaagggaaacggcatgcttaggaaaggcgtatgctcaaatgtggtcacttatgtactttcatagaagagatctaagactagcatctaatgctatttgctcagcggtgccggtgcattgggtaccaacgtcacgtacaacgtggagcatacatgcacatcaccaatggatgacgacagaggacatgttaacagtatggaatcgtgtgtggattgaagacaatccttggatggaagataaaaccccagttaccacatgggaaaacgtcccttatttgggtaaacgagaagaccaatggtgcggtagcctaatcggactaacaagccgagctacgtgggcccagaatattccaaccgctatacagcaagttagaagtcttataggaaatgaagaatttctagactatatgccttcaatgaaacgatttagaaaggaagaggaaagcgaaggagctatctggtag

SEQ ID NO: 23383 - RNA, 9873 nt, synthetic construct
  misc_feature 1..9873: note = derived and/or modified CDS sequence (opt6) from DENV-3__FJ373303__SS-prME
  source 1..9873: mol_type = other RNA
accagcttatgcctaatgatgatacttcctgcagcgctagcatttcacctaacttcacgagacggggaacccagaatgatcgtagggaaaaatgaaagaggtaaatccctactctttaaaactgctagtggtataaatatgtgtacgctaattgcgatggatctaggcgaaatgtgtgacgatacagttacgtacaaatgcccccacattaccgaagttgaaccagaagatatcgattgttggtgcaacctaacctctacatgggttacttatgggacatgcaatcaagctggtgaacaccgaagagataaaagaagcgtagcgctagctccgcatgttggcatgggtttggatacaagaactcaaacatggatgagtgctgaaggagcttggcgtcaggttgaaaaagtagaaacttgggcattacgacaccctggtttcaccatcctagcactatttttggcacattatattggaacgtccctaacccaaaaagtcgtaatatttatccttcttatgctcgtcaccccctctatgacaatgaggtgcgtcggagttggaaatagagacttcgtcgaaggactgtccggtgctacgtgggttgacgtggtattggaacatggcggctgcgttacaacgatggccaaaaataaacctactctagatatagaactacagaaaacagaagctacgcaacttgctacgctaagaaaactatgtatagaaggcaaaatcacaaatataacaactgatagtaggtgtccaacacaaggagaagcagtcctaccagaagaacaagatcaaaattacgtatgtaagcatacatacgttgatagaggttggggcaacgggtgcgggctctttggaaaaggtagtttagttacatgtgcaaaatttcaatgtttagaaccaattgaaggtaaggtcgtacagtatgagaacctaaaatacactgtcataattaccgtgcacacaggggatcaacatcaggtgggtaacgaaacacaaggcgtaaccgcagaaataacgccacaagcatctacaacagaagctattttaccagagtacggtactttaggattagaatgtagtccacgtactggcttagattttaacgaaatgattctgttgactatgaaaaacaaagcatggatggttcacagacaatggtttttcgatttacctttaccgtggacttcaggagcaacaacagagactccaacatggaacagaaaggagttgctagtgacatttaagaacgcacatgccaagaaacaagaagtcgttgtcttagggagccaagagggcgcaatgcacacagcactgacaggcgctactgaaatacaaaacagtggtggtacctcaatattcgcgggacatttaaagtgtagattaaaaatggacaaactcgaacttaaaggtatgtcgtacgcaatgtgcactaatacattcgtattaaagaaagaggtctctgagactcaacacgggacaatcctaattaaagtcgagtataaaggtgaagacgttccttgtaaaataccatttagtactgaggatggacaagggaaggcacataacggcagactgatcactgcaaatccggttgtcactaaaaaggaagaaccagtaaatattgaggcagaaccgccgtttggtgaatctaacatcgtaataggtattggagataatgcgctcaagataaactggtataagaaaggcagctcaattgggaaaatgttcgaagccactgcgagaggcgctagacgaatggcgatattaggtgatacagcatgggactttggaagcgtagggggagtgcttaattcactcggaaaaatggtacatcaaattttcggatcagcctatacagccttattcagtggggtttcctgggttatgaaaatcggcataggggtactattaacctggatcggattgaactcaaagaatacctcaatgagcttctcctgtatcgcaattggtatcataactctttacttgggtgctgtcgtgcaagcagatatgggatgtgttatcaattggaaggggaaagaattgaaatgcgggagtggcattttcgtaacaaacgaggttcatacatggacagaacaatataagtttcaagcggattctcccaagcgattggcaacagcgattgccggagcgtgggaaaatggagtttgtgggatacgaagtactactcggatggaaaacttactatggaaacaaattgctaatgagctaaattacatattgtgggaaaataatgtcaaactcacagtggttgttggagatattattggcgtcttggaacaaggtaagagaactttaactccacaacctatggaactaaaatatagttggaaaacctgggggaaagccaaaatagtaacagctgaaacacaaaattcatcttttattatagatggaccgaacacacctgaatgcccaagtgcgagtcgagcatggaatgtgtgggaggtcgaagactatggctttggagtcttcactacaaatatatggttaaaattaagagaagtttacacacaattatgcgatcatcgcttaatgtctgctgcagtgaaagatgaaagagcagtacacgcagatatgggctattggattgagagtcaaaagaatggaagctggaagctcgaaaaagcaagtttgattgaggtgaaaacttgcacatggccaaagagtcatacgctctggagcaatggtgtattagaatctgatatgataatacctaaaagtctggcgggaccaattagtcaacataattatagacctggatatcatactcaaacagcaggcccttggcatttaggcaagctagagctagattttaactactgtgaaggtacaacggtggttattacagagaactgtggaactcgtggacctagcctacgaaccacgacagttagtggaaaattgattcatgaatggtgctgcagaagctgcacactacctccattacgttatatgggtgaggatggctgctggtacggtatggaaatcagacccatttccgagaaggaagaaaacatggtcaaaagcctggtttcagctggcagcggagaggttgataatttcacaatgggagtgctatgtctagcaatattattcgaagaggtgatgcggggaaagtttggtaaaaagcatatgatagcaggggttttcttcacgttcgtattactactgagcgggcaaattacctggagagatatggcgcatactctaataatgatagggtcgaatgcaagtgatagaatgggaatgggggtcacttatctcgcactaattgcaacattcaaaatccagcccttcttggcccttggattctttttgaggaaattaacgagcagagaaaatcttttattaggtgtggggcttgcgatggctacaaccttacaattgccggaggacattgaacaaatggcgaatggcattgcgctaggtctaatggcattgaaactcataactcaattcgagacgtaccaactatggaccgcacttatttcattaacatgcagcaatactatatttactctaacagtagcgtggcgtactgcaacattaatcctggccggtgttagtcttttaccagtgtgtcaatctagtagtatgagaaaaacagactggctacctatgacagtcgcggcaatgggagttccaccactacctttattcattttctcactcaaagatacactgaaacggaggtcctggcctctcaatgagggagtaatggcggtcggattagtatccattctagcttcatcattacttcgcaatgacgttcctatggcgggtccattggtagctggaggattactcatcgcatgttacgtaataaccggtacgtcagctgacctaaccgtagaaaaagcggcagatgtcacatgggaggaagaggccgaacaaacaggtgtaagccacaatctgatgattaccgtagacgatgatggaacaatgcggattaaggatgatgaaacagaaaatatacttacggtcttactcaagacggccctactaatagtaagcggcattttcccgtacagtataccagccacattattggtatggcatacttggcagaagcaaacacaaagaagcggcgtgctatgggatgtacctagtcccccagaaactcagaaagccgaattagaggaaggcgtataccgaattaagcaacaaggaatattcggtaaaacacaagtaggagtcggagttcagaaagaaggggtattccatactatgtggcacgtgacgagaggtgcagtcctaacctacaacggaaagaggctagaaccgaactgggcaagcgttaagaaagacctgataagttacggtggagggtggcgcctatctgcacaatggcaaaaaggagaggaagtgcaagtgatcgcagtagaacccgggaagaaccccaaaaatttccaaaccatgccaggtactttccagactactactggcgagattggagccatcgccctggactttaaaccaggaacatcgggtagtcctataatcaacagagaaggcaaggttgtgggtttatacggaaatggagttgttaccaaaaatggaggttatgtaagtggaatagcacaaactaacgcagaaccagatggtccaacccccgagttagaagaggaaatgtttaaaaagcgtaatttaacaattatggatctacatccaggctctggcaaaacacggaaataccttccagctatagtgagggaggctataaaacgacgactacgtacgttgatacttgcacccacaagggtcgttgctgcagagatggaagaggcattaaaaggactaccaattaggtaccaaacgacggctaccaaaagtgaacacactggaagagaaatagtggatttaatgtgtcatgcaaccttcacaatgcgtttgttatctccagtgcgagttcccaactacaatctaataataatggacgaggcgcatttcactgatcccgcgtccattgcggctaggggatatatatctacaagagtgggtatgggagaagcagccgcgatttttatgactgcaacaccaccggggacagcagatgcatttccccaatcaaatgctccaattcaggacgaagaaagggatataccagaacgtagctggaactcaggaaatgaatggatcacggatttcgcaggaaaaaccgtttggttcgttccaagtattaaagctggaaacgatattgcaaattgccttaggaaaaatggtaagaaagtcatacagttatcaagaaaaacatttgataccgaatatcagaaaacgaaacttaatgattgggacttcgttgtcactacagatattagtgaaatgggtgctaatttcaaagctgaccgggtcattgatccgcgaagatgcctaaaacccgttattttgactgacggacctgagagggttatattggctggacctatgcctgtaacagcggcgtcggcagcccaacgacgaggacgggtaggtcgaaaccctcaaaaagaaaacgatcagtacatctttactgggcaaccccttaacaatgatgaagatcatgcgcattggacagaagccaaaatgttattagataacatcaatacgccagaggggattatacccgccttatttgaaccagaaagagagaaaagcgccgctatcgatggagaatatagattaaagggagagtctcgaaaaaccttcgtagaattgatgagaagaggcgacttaccagtctggttagcacataaagttgcatctgaaggaatcaagtatacagatcgaaagtggtgttttgacggtcaacgtaataatcaaattttggaagaaaacatggacgttgagatctggaccaaagaaggcgagaagaagaaactacggccaagatggcttgatgctcgaacatatagcgatccgctagcacttaaggaatttaaagattttgcagctgggaggaaaagtatagcactagatctagtgaccgagattggaagagttccgtcacatctggcccatagaacacgcaatgcactagataacttagtcatgcttcatacatcagaacatgggggcaaagcatatagacatgctgtggaagaactaccggagactatggaaacactattactattagggttgatgatactattaacaggtggggcgatgctattccttatttcaggaaagggaatcggaaaaacatcaattggtttaatctgcgtaattgctagttctggtatgttatggatggcagaaataccattacaatggatagcatctgccatagttctagagtttttcatgatggtattactaataccggaacctgaaaaacaaaggacccctcaagataaccaactagcatatgtagtgattggcattttaaccctagcggccattattgccgcgaatgagatgggtcttttagagaccacgaaacgcgacctcggtatgagtaaggaacccggtgtagtgtctcctacatcatatctcgatgtagatttacatccagcctcagcatggaccctttacgcagtcgcgaccactgtaatcactcccatgttgcgacatacaattgaaaatagtacagccaatgtatctcttgcagctattgctaatcaagcagttgtccttatgggattagataaaggttggccgatatcaaagatggatttaggtgtacctctacttgcactaggctgttattcgcaagtcaaccctttaacgttaaccgcagcagttctgcttttgataacacactatgcaattataggacctggtctgcaagccaaagcaacaagagaggcacagaaaagaacggccgcgggtatcatgaaaaatcccacggtcgacggaataatgacaatagacttagatccagtcatatatgacagtaaattcgaaaaacagcttggacaagtgatgttattagtgttgtgtgctgtacaactactcctaatgcgaacatcttgggcactatgtgaggctttgacactagctacaggaccgattacgacactatgggaaggttcaccaggaaaattttggaatacaacaatagcagtgtcgatggcgaatatattcagagggtcctacttagctggagcaggtttagctttttcaataatgaagtctgtaggaacagggaaaagaggtacaggcagccagggagagacactaggagagaaatggaagaagaaactgaatcaactcagtagaaaagaatttgatttatataagaaatctggaataacagaagttgatcggacagaagctaaagaaggtttaaaacgaggagaaattacacatcacgcagtttccagaggaagtgctaagttgcaatggtttgtagaacggaatatggtaataccagaggggagagttatagacctaggatgcggccgcggagggtggagctactactgtgccggacttaaaaaggtaactgaagtccgtgggtatactaagggcggtcccggccatgaggaaccagtgccaatgagcacttatgggtggaacgttgttaaattaatgagtggtaaagatgtattctaccttccacctgaaaaatgtgatacactactatgcgatatcggagaaagtagtcctagtcctaccgtggaggaaagcagaaccatacgagtattaaaaatggtggaaccatggctcaaaaataaccagttttgcattaaggtgttaaatccatacatgcctacagtaatcgagcatttagagaggctacaacgaaagcatggagggatgttggtaagaaacccactcagcagaaacagcacgcatgaaatgtattggataagtaatggaacaggcaatatagttgcttccgtaaatatggttagtagactactcttgaatcggtttaccatgactcatagaagaccaacaatagaaaaggacgtagacttaggagcaggaacaaggcatgtcaacgcagaacccgaaacccctaatatggacgtaataggggaacggataaaacgaataaaagaagaacacaactctacttggcactatgacgacgaaaatccgtataaaacatgggcctaccacggcagttatgaagtgaaagcaacaggatcagcctctagtatgatcaatggtgtagtaaaattacttacgaaaccatgggacgtagtcccaatggtaacacaaatggcaatgactgatacaacccctttcggacaacagcgagttttcaaagaaaaagttgatactagaacaccacgatcgatgccaggcacccgtagagttatgggtattacagctgaatggttatggcgaacactaggaagaaataaaaagccgcgcctatgtaccagagaagaatttactaagaaggtcaggacaaatgcagcaatgggagcagtcttcaccgaggaaaaccagtgggatagcgccaaagcagctgtagaagatgaagacttttggaaactggtagaccgcgaaagggagctccacaaacttggtaaatgtggatcatgtgtttataatatgatgggtaaaagagaaaagaaacttggcgaatttggaaaagcaaaaggatcaagagcaatttggtatatgtggttaggcgccagatatctggaatttgaagcactgggatttttgaatgaagaccattggttttccagggaaaatagttactctggcgtcgaaggtgaagggcttcacaaactgggttatattctgagagacatatcaaaaattccaggaggcgcaatgtatgcggacgataccgcagggtgggacactcgaataactgaagacgatttacacaacgaggagaaaattacacagcaaatggatccggaacaccgacaattagccaatgctatcttcaaactaacctatcagaacaaagtagtcaaggttcaaagaccaacacccactggaaccgtgatggacattattagccgcaaggaccagcgaggatcaggacaagttggcacatacggtttgaatacctttacaaatatggaggcacaattaatacggcaaatggaaggtgaaggagtgttatcgaaggcggatctggaaaatccacatcttccagagaagaaaatcacccaatggctcgaaactaagggtgtagagcgactcaaacggatggctataagcggagatgactgcgttgtgaaacccattgacgacaggttcgcgaacgcactactggcactaaacgatatggggaaagttaggaaagacatacctcagtggcaacccagtaaaggatggcatgactggcagcaagtaccattctgcagtcatcatttccatgagttaattatgaaggacggacgaaagctcgtcgttccatgtcgaccacaagatgaattaattggcagggcgagaattagccaaggagccggatggtcactgagagaaactgcctgcctcggaaaggcgtatgcacaaatgtggagcctaatgtacttccatagaagagacttgaggctagcttcaaacgctatatgctccgcggtgcctgttcattgggttcctacttcaagaacaacctggtcgatacacgcgcaccaccaatggatgacgacagaagatatgctgacagtctggaatagagtctggattgaagataacccatggatggaagataaaacacctgtaacaacctgggagaatgttccttacctcggaaaaagagaagatcaatggtgcggtagcttgattgggctcaccagtcgtgcgacgtgggcacagaatatccctacagcaatacaacaagttaggtccctaataggaaatgaagaatttttagattacatgccgagtatgaaacgatttcgtaaagaggaagaatcagaaggcgccatatggtga

SEQ ID NO: 23384 - RNA, 9873 nt, synthetic construct
  misc_feature 1..9873: note = derived and/or modified CDS sequence (opt6) from DENV-3__KF955451__SS-prME
  source 1..9873: mol_type = other RNA
acaagtctatgtttgatgatgatactaccagcagcattggcttttcatctaacatcaagggatggtgaacctcgtatgatagtgggcaaaaatgaaagaggtaaaagccttctttttaaaacagcttcaggtattaatatgtgcacgttaatagcaatggacttaggtgaaatgtgtgatgacacagtaacttacaaatgtcctcatataactgaggtggaaccggaagatattgattgttggtgtaatttaacttcgacctgggtcacgtatggaacatgcaatcaagcaggagaacacagacgagataaaaggagcgtcgcacttgcgcctcatgtcggtatgggactcgacactagaacacaaacatggatgtctgcagaaggagcttggcgacaagtggaaaaagtagaaacatgggcattaaggcaccctgggtttacaatcctggcacttttccttgcacattatataggaacatccttgacgcaaaaagtggtaatcttcatattattgatgctcgttactccatctatgacgatgaggtgtgtcggagtaggaaacagagatttcgtagaaggactttcaggagcaacatgggttgatgtagtgttagagcatgggggctgtgtcacaacgatggccaaaaataaaccaacgctcgatattgaattgcagaaaactgaagctactcaactggcaacattgagaaaattatgcattgaaggaaaaataacaaatattactacagactctaggtgccccacacaaggcgaagctgtcttgcctgaagaacaagatcaaaactatgtatgcaaacatacgtacgttgatcgcggatggggcaatggttgcgggctatttggtaaaggctcattagtcacatgcgcaaaatttcaatgtttagaacccatagaaggtaaagtcgtccaatacgagaatctaaaatacacagttataattacagtccatacgggggatcaacatcaagttggaaatgaaacccaaggagtaactgccgaaatcacaccacaagccagcacaaccgaggctattctgccggaatacgggactctgggacttgaatgctctcctcgaactggtttagactttaatgaaatgattctattaacgatgaagaataaggcttggatggtccatagacaatggtttttcgacttacctttaccttggacaagcggtgctacgacagaaaccccaacttggaatagaaaagaactactcgtgactttcaaaaatgctcacgctaagaaacaggaggttgtagtactaggatcacaggagggagcgatgcatacagccctaacaggagcaaccgaaatacagaatagcgggggcacatcgatttttgcaggtcacttgaagtgtaggctgaaaatggacaaattagaactaaaaggaatgtcctatgctatgtgtactaacacttttgtactcaaaaaggaagtcagtgaaacccagcacggaaccatacttataaaggttgagtataaaggagaagacgttccctgtaaaattccgttttccaccgaagacggacaaggtaaagcacacaatgggaggttaattacggccaatcccgtagtaacgaaaaaggaggagcctgtgaatatcgaagcagaaccccctttcggagaatcaaatatagtaatcggagtaggagacaacgcacttaaaatcaactggtataagaaaggctcctctattggaaagatgtttgaagccactgctagaggagcgagacggatggcgattttaggcgacactgcatgggattttgggtctgttggtggtgtactaaatagtctaggaaagatggttcaccaaatatttggaagtgcatatacagcattattttcaggggtgtcatgggtaatgaagattggaattggcgtcttattaacatggattggactaaattccaaaaacacaagtatgtctttttcttgcattgccattggtataataactttgtacctaggcgtcgttgtccaggccgatatgggttgtgtaataaactggaagggaaaagaattgaaatgtggtagtggcatattcgttacaaatgaagttcatacttggacagaacaatataaatttcaagcggactcacctaaacgcttagctacagcgatagccggtgcatgggaaaatggagtatgtggaatacggagtaccactagaatggaaaatctactgtggaagcagattgcaaacgaactaaactatatactttgggaaaataatataaagttaacagtagtcgttggtgatattataggagtactcgagcagggaaaaaggactctaacaccgcaaccgatggaactaaaatattcatggaaaacatggggtaaagctaagatagttaccgcagaaacccaaaactcatcattcataatcgatggccctaatactcctgagtgcccaagcgcatccagagcttggaatgtatgggaagttgaagactatggattcggagtattcactactaatatatggctgaaacttagggaggtctatactcagttatgtgatcataggttaatgtcagctgcggttaaagatgaacgagccgttcatgctgatatgggctactggattgaatcccagaaaaacggatcatggaagctagaaaaggcatcattaatcgaagtcaagacatgtacatggccgaaaagccacacactttggagcaacggtgttttagagtccgatatgataatccctaaaagtttggcaggacctatatcccagcacaactacagaccaggttaccatacacagaccgccggaccgtggcacctaggtaaattagaactagattttaactattgtgagggaacaaccgtcgtaattacagaaaattgtggaacaagaggtccgagtctcagaacaacaactgtatctgggaaactgatccatgaatggtgttgtagatcatgcacattaccgccgctaaggtacatgggagaagatggctgctggtatggaatggaaataaggcctatcagcgagaaagaagaaaatatggtgaaatcactcgtatcagccggaagtggagaagtagataatttcacaatgggcgtgctatgtttagctatactatttgaggaggtcatgagaggtaaattcggaaagaaacacatgatcgctggagtatttttcacatttgttttgcttttaagtggacaaataacgtggagagacatggcacacacattaataatgattggaagcaatgcatctgataggatgggtatgggagtgacctatttagcactaatagcaacattcaaaatacaaccttttctcgctttaggattctttcttaggaaactaacatcaagagaaaatttgctactgggagtgggcttagcaatggcaacaaccttacagctaccagaagatgtcgaacagatggccaacggcattgctttaggtcttatggcactaaaactaataacacaattcgaaacgtatcagctttggacagctctgatcagtctaacctgttctaatacgatttttacattaacagtagcgtggcgcacagcgactcttatactggctggcgtaagtttgttgcccgtatgccaatcgtcgtcgatgagaaagactgactggctcccaatgactgtagctgctatgggcgtacctcctctacccctgtttatttttagcctaaaagacacattgaaaaggagaagctggccgcttaacgaaggtgtgatggctgtaggcctagtatctattctggcgagttcgttactaagaaatgacgtcccgatggcgggacctctagtagcaggaggtcttctaatagcctgttacgtcataacaggaacgtcagcagacctgaccgtagaaaaagccgccgacgttacctgggaggaagaagcagaacaaaccggtgtttctcataacttgatgatcaccgtcgacgatgatgggacaatgagaataaaagacgatgaaacggaaaatatattaactgtactattaaaaaccgccttactaatagtgtccggaatttttccttactctataccagccaccctcctagtgtggcatacctggcaaaaacaaacacaaaggtcaggggtattatgggacgtgccatccccgccagaaacgcaaaaggcagaactagaagagggtgtttatcggatcaaacaacaaggaatatttggaaaaacacaggttggcgtgggagtgcaaaaagaaggagttttccacactatgtggcacgttaccagaggggcggtcctcacatataatggtaagagactcgaacctaattgggctagcgtgaagaaagatttaatatcctacggcggagggtggcgcctcaacgctcaatggcaaaaaggtgaagaggttcaggtaatagcagtcgaacctggcaagaatcccaaaaatttccaaaccatgcccggtaccttccagactacaactggtgaaattggtgcaatagcccttgattttaaaccagggacctcaggttcaccaataatcaatagagagggaaaagttgtcggattgtatgggaatggagtagtcaccaaaaatgggggatatgtgtccggtatagctcaaaccaacgcagaaccagatggaccaacccctgaactagaagaagaaatgttcaagaaacgcaatttaacgataatggatttacatcctggatctggcaaaaccagaaagtaccttcccgctatagtcagagaagcaataaaacgtcgattgcgaacactaattctagcgcccacgagggtagtggccgcggagatggaagaggcactaaaaggtttgcccattaggtaccaaaccacagcaactaaatcagaacacacaggaagagaaatagtagatttgatgtgccatgcaacgtttactatgagattactgagccctgttcgagtgcctaattacaatcttataataatggatgaagcacactttacggacccggcttccattgctgccagaggatacattagcacaagggtgggcatgggagaggctgcagcgatctttatgactgcaacgccaccgggaacggcagacgcttttccgcagtctaacgcgccaattcaggatgaggaacgcgacatacctgaaagatcttggaactctggcaacgaatggataaccgattttgccggtaaaacagtgtggtttgtccccagtatcaaggctggtaacgatatagccaactgtctacgcaagaacggaaagaaagtaattcagttatccaggaaaacctttgacaccgaataccagaaaacaaaacttaacgactgggattttgtagttacaacggatataagtgaaatgggagcaaactttaaagctgaccgagtaatagacccacgtaggtgcctaaagccagtaatactaacggatgggccagagcgagtaatattagccggccctatgccagttactgcggcatctgcggctcaaagacgaggacgagttggaagaaatccccaaaaggaaaatgaccagtacatatttactggacagcctttaaataatgatgaagatcacgcgcattggacagaagcgaagatgttactagacaacatcaatacccctgaagggatcatacctgcactattcgaaccagaacgcgagaaaagcgctgctatcgatggtgaatatcgtttaaaaggagagagtcgaaaaacttttgttgaacttatgaggcggggagacttgcctgtctggcttgcccataaagtggcttcagaaggtatcaaatacacagacagaaaatggtgcttcgatggccaacgaaacaatcaaatcttggaggaaaatatggacgttgaaatatggacaaaagaaggcgaaaagaagaaactccgtccacggtggctggatgcacgtacctatagcgatccacttgcactcaaagagtttaaggattttgcagcaggcagaaagtcgatagcgttggatctagtgacagagataggacgcgtaccaacacacctagctcatagaactagaagcgctctagacaacttagtgatgcttcacaccagcgagcatggcggaaaggcttacagacacgcggtagaagagttgcctgagacaatggagactcttctattactaggcttaatgatattacttaccgggggcgccatgttattcctaattagtggcaaagggattggtaagacatcgattggactgatatgcgttatagcctcatcaggaatgctatggatggccgaaattccactccagtggatagcaagtgctatagttctcgagttctttatgatggtattattgatacccgaaccggaaaagcaaagaactcctcaagacaatcaattagcctacgttgtaataggaatcttgacccttgccgccattatagctgcaaatgaaatgggattacttgaaacgacgaaaagagacttagggatgtcaaaggaaccgggggtagttagtccgacttcttaccttgatgtagatttacacccggcaagcgcatggaccctctatgcagtagcaactacggtgattacccctatgctcaggcatacaatagaaaatagcacagctaatgtttcactagcagcaattgcaaaccaagcagtagttctaatgggtcttgataaaggctggccaatatccaaaatggacttaggagtcccactattggctttaggttgctattcacaggtcaatccactcacactaaccgccgcagtgctattactaatcactcactatgcgataataggccctggtcttcaagcaaaagcaactagggaagcacagaaacgaacagctgctggaatcatgaaaaatccaacagtagacggaatcatgaccatcgatctggatccggtcatatacgacagtaaatttgaaaaacagttaggtcaggtgatgctcctagttctgtgtgctgtacagctattacttatgagaacatcttgggctttatgtgaagcactaacgctggcaacgggaccaattacaacactttgggagggaagccctggtaaattttggaatacaacaatcgcggtatctatggctaacatctttagaggctcatacttggcaggcgccggacttgcttttagcattatgaaaagcgtaggtacaggtaaaagaggaactgggtcacagggagaaacactcggtgaaaaatggaagaggaaattaaatcaactatcaagaaaagaatttgacctatacaagaaaagcggaattaccgaagtggacagaacggaagcaaaagaaggactaaaacggggtgaaataacccaccatgccgtatcaagagggagcgctaaacttcaatggtttgtagagagaaatatggttataccagaagggcgagtgatagatctaggttgtggtaggggaggctggtcttattactgtgctggattgaagaaagtcacggaagtaagaggttacacaaaagggggcccgggacacgaagaaccggtacctatgagcacttacggctggaacatagtaaaactgatgtctgggaaagatgtcttttatttgccaccagaaaaatgtgacacactgttatgtgatataggcgagagctcaccatcaccaaccgtagaagaatcaagaactataagagtgctaaaaatggttgaaccatggctcaagaacaatcaattctgcatcaaagtgcttaacccatatatgccaaccgtaatagaacatctcgaaaggctacaacgcaagcatggaggaatgcttgtcagaaatccactatcgcgaaattctactcatgaaatgtactggatcagcaatggcaccgggaacatagttgcgagcgttaacatggtttcccggctgctactaaacaggttcacaatgactcacagaagaccaacgattgaaaaggacgtagatttgggggcgggaacaagacacgttaatgctgaaccggagacgcccaacatggatgttataggggagcgtataaaaagaataaaagaagaacacaattcaacatggcattatgacgatgagaatccttacaaaacatgggcatatcatgggtcttacgaagttaaagcaacaggaagtgcatctagtatgattaatggtgtggttaaactgttgacaaagccgtgggacgtagttccaatggtaacacagatggcaatgactgatactacccctttcggacaacaacgagtttttaaagagaaggtggacacccggactcctcgccctatgccagggacacgcagggtgatgggaataactgcagaatggttatggcgaacgctaggacgaaataaaaagcctcgactctgtacaagagaggagtttaccaagaaagttaggaccaacgccgcaatgggagctgtttttacagaggagaatcaatgggacagcgctaaagcagcagtcgaagacgaagacttctggaaacttgtagatcgagaacgtgaattacataagctaggcaagtgcggctcttgcgtatataatatgatggggaaaagagaaaagaagttaggcgaatttggcaaagccaaaggttctagggctatatggtacatgtggttgggagcaagatatcttgaatttgaagcattggggtttttgaatgaagatcactggtttagtagggaaaattcatatagtggtgtagaaggcgagggccttcacaaattaggatacatattaagggatatttctaaaatccccggtggagcaatgtatgcggacgatacagcaggctgggatacaaggataacagaagatgacctgcataatgaggagaaaataacgcaacaaatggatccggagcataggcaattggctaatgccatatttaaacttacttaccagaataaagtggtgaaagtgcaaaggcccactccgaccggaaccgttatggatataataagtcgtaaagaccaacgaggatcaggacaggtaggaacgtacgggttaaatacctttactaacatggaagcgcaattaatacgacaaatggagggtgagggagttttgagcaaggcagaccttgaaaatccccatctcagtgagaagaaaattactcaatggttagaaactaagggtgtcgagagactcaaaaggatggctataagcggagacgactgtgtggtaaaaccaatagatgatagattcgcaaacgccctgttagccttaaacgatatgggtaaggtccgcaaagacataccccaatggcaaccatcaaaaggatggcacgactggcaacaagtcccattttgctcccatcattttcatgaattgatcatgaaagatgggagaaagttagtagtgccatgtcgaccacaagacgaactaattggcagggcaagaatatctcaaggagcaggatggtccctcagagagactgcatgtcttggaaaggcttatgcgcaaatgtggtcacttatgtattttcatagacgagacttaagattagcttctaatgctatttgttctgcggttcctgtacactgggtaccgactagcagaacaacatggagcatacatgctcatcatcaatggatgactacagaagatatgttaacggtgtggaacagagtatggatcgaagacaatccttggatggaagataaaacacctgtcacgacctgggaaaatgtaccatatttgggaaagcgtgaagaccagtggtgtggttcgttaatcggattaacaagtcgtgctacatgggcacaaaacattccaactgccattcaacaggtacgcagtcttataggcaacgaagagttcctagactacatgccatcaatgaaaagatttcgaaaggaagaagaatcagaaggggcaatttggtaa

SEQ ID NO: 23385 - RNA, 9873 nt, synthetic construct
  misc_feature 1..9873: note = derived and/or modified CDS sequence (opt6) from DENV-3__KF955453__SS-prME
  source 1..9873: mol_type = other RNA
acatcactatgcttaatgatgatactaccggcaacgctggcatttcatctcacaagtagagacggagagcctcgcatgatagtgggcaagaacgaacggggaaaatcacttctcttcaagacagcatcaggtataaatatgtgtacgctaattgcaatggatttaggagaaatgtgcgacgatacagttacctacaagtgtccacatatcactgaagtagagccagaagatatagattgctggtgcaacctcacttcgacttgggtaacatacggaacttgcaaccaagcaggagaacacagacgcgacaagaggagtgtagccctagccccccacgtgggaatgggcttagatacacgaacacaaacatggatgagtgctgaaggtgcatggagacaagtcgaaaaagtcgaaacgtgggccctacgacatccgggatttaccattctggcattatttcttgcacattacatcggtacttctttgacccaaaaggtagtaatttttattttgttgatgttggttacaccgtccatgactatgagatgcgtaggagtcggaaatcgcgactttgtagagggattatcaggcgccacttgggtcgatgttgtacttgaacatggcggatgcgtcacgacgatggccaaaaataaaccgactctggacatagaactgcagaaaacagaggctacccaactagcaaccctacgtaaactctgcatagaaggtaaaataacgaacattacaacagattcaagatgtccaacgcaaggggaggcagtattaccagaagaacaagaccaaaattatgtatgtaaacatacctatgtagatcgtggttggggcaacggatgcggtttattcggaaaaggatctcttgttacttgcgcgaagtttcaatgcttagagccgatagaaggcaaagtagttcagtatgaaaacctgaaatataccgttattatcacagtgcacaccggtgatcaacatcaggtaggcaatgaaacccaaggcgtaacagcagaaataactcctcaggcatcgaccacggaggcgactttaccagaatacggaactctaggattagaatgtagtccgcgtaccggacttgacttcaatgaaatgatcctgttgaccatgaaaaacaaggcgtggatggtacaccgtcagtggtttttcgatttacccctaccttggaccagcggcgcaactacagaaaccccaacatggaatagaaaagaattgttggtaaccttcaagaacgcgcacgccaaaaaacaagaggtagtcgttttagggtcccaagagggcgcgatgcatacggccttgacaggagcaactgaaatacaaaacagcggggggacgtctatatttgccggccacctaaaatgcagactgaaaatggacaaattagaattaaaaggtatgtcatatgcgatgtgcacaaatacctttgtgttaaagaaagaagtctccgaaacacaacacggaacaatactcataaaagtagaatacaaaggagaagacgtgccgtgtaaaattccttttagcaccgaagatggtcaaggaaaagctcataatggaagattaataacggccaaccctgttgtcactaagaaagaagagcctgtcaatatagaggcagaaccaccatttggagagagtaatatagttataggcataggcgataatgccctaaaaatcaattggtataaaaaaggttcttcaatcggaaaaatgtttgaagcgactgcacgaggagcacgtcgtatggcaatcctcggtgatacagcctgggattttggttccgtgggaggtgtgttgaatagtttaggcaaaatggtccaccaaatctttggatcagcatacactgcactgtttagcggtgtgagctgggtaatgaaaataggtatcggagttttactaacatggataggacttaacagcaaaaatacaagtatgtcctttagctgcatcgcgatcggaataattacgctttacttaggagctgtagtacaagccgacatgggctgcgtgataaattggaagggaaaagaacttaaatgtggtagcggtatttttgtaacaaacgaggtccatacttggacagaacaatataaatttcaagcagacagccctaagagactagcaaccgcaatagccggagcttgggaaaatggagtctgtggcatacgttctactacacgaatggaaaatctactatggaaacaaatcgcaaacgaactgaattacattctttgggagaataatataaagttaaccgttgtcgtaggagatataatcggggtgttggaacaggggaaaagaacactgactccacaaccaatggaactaaagtacagctggaagacatggggaaaagccaagatagtaactgcagaaacgcaaaattcgtcatttatcattgatggaccaaatacgcctgaatgtccatctgcatctcgggcatggaatgtatgggaggtagaagattatgggtttggagtttttactaccaacatatggcttaagctaagagaggtttacacccaactctgtgaccacaggttaatgtcagcagcggttaaggacgagcgggcggttcacgcagatatgggttactggatagagtctcaaaaaaatggctcctggaaacttgaaaaagccagcctcatagaggtaaaaacgtgtacctggccaaagtcacatactttgtggtctaatggggtattagaatcagacatgataataccaaaaagtttagctggtcccattagtcaacacaattatagaccgggctatcatacgcagacagcaggcccttggcacttaggaaaactagaattagacttcaattactgtgaaggaacaacagtcgtgattaccgagaactgtggtactagaggtccttctctacgtacgaccacagtctctggaaagttgatccacgaatggtgttgtcgatcgtgtacacttccacctttgagatatatgggcgaagacggttgttggtatggtatggaaattcggcccatctccgaaaaagaagaaaatatggtaaaaagtctggtgtctgcgggcagcggcgaagtggataattttaccatgggtgttttatgtctagcaatactatttgaggaagtaatgaggggaaaatttggaaaaaaacatatgatcgctggggttttttttacgtttgttttgctattgtccggtcagataacttggagagatatggctcacacactcattatgattgggagtaatgcgtcagacagaatggggatgggagtaacatatctggcgcttatagctacatttaagatccaaccctttctagcactaggattttttctcagaaaactgacatcgcgagaaaatcttttactaggagtgggattagcgatggcgacaacgttacaactccccgaagatatcgaacagatggccaacggtatcgcacttggactaatggcattaaaattgatcacccagtttgaaacatatcaattatggacagcattgatatccttaacgtgttcaaatacgatctttacattgaccgtagcatggagaacagccactctaatactagcaggggtatcactccttccagtctgtcaaagttcctccatgcgcaaaacagattggctacccatgaccgttgctgctatgggggttcctcccctaccattgttcattttcaatctaaaagacaccttgaaacgaaggtcatggccgttgaacgaaggagttatggctgttggattagtctcgattctcgcgtcaagccttttgagaaatgatgtgcctatggcgggtcccttggttgcaggcgggcttctaatagcatgttatgtaattactggaacgtcagctgacttaacagtagagaaggcggcagatgttacatgggaagaagaggctgaacaaacaggtgtcagccataaccttatgatcaccgtagatgatgatggtaccatgagaataaaagatgatgagactgaaaatatccttacagttttacttaaaactgcgttgttaattgttagtggcatattcccttactcgatacctgctacattgttagtgtggcatacatggcagaaacaaactcagagaagtggggtactatgggatgtaccatccccacccgaaacacaaaaagcagaacttgaagaaggagtatatcgaataaaacaacaaggcatctttggaaaaacacaagtcggagtcggggttcaaaaggaaggtgttttccatacgatgtggcatgtaactcgtggagcggtacttacatataacggaaagagactagaacctaactgggcttcagttaaaaaagatctaatctcgtatgggggcggatggagactaagtgctcagtggcagaaaggagaggaagtacaagtaatagctgtcgagcctggaaaaaatccaaaaaactttcagactatgcccggtacatttcagactacgacaggtgaaatcggtgccatagcgcttgattttaagccaggaacatccggtagtcctattattaacagagagggcaaaatagttggtctgtacgggaatggcgtagtaacgaaaaacggtggttatgtatcaggaattgcgcaaacaaacgctgaacctgatggtccgaccccagaattggaggaagaaatgtttaaaaaaagaaatctaacaattatggacctgcacccaggatctggcaaaacaagaaaatacctaccagctatcgtacgagaagcaattaaacgaagattaagaacgcttattcttgcgccgacaagagtcgtcgcagcggaaatggaagaagcattaaagggcttacccatcagatatcaaacaacagcaacaaagtcagagcacacaggtagggaaatagtagacctgatgtgccatgcaacctttacaatgaggttgctaagtccggtacgagttcccaattataatttaataatcatggatgaagctcattttacagaccccgcttccatcgccgctcgagggtatatatctacgagagtgggaatgggagaagcagcagctatttttatgacggcaactccgccaggcacagccgacgcttttccgcaatctaatgcacctatacaagatgaagaaagagatatcccagagagatcatggaactctggaaacgaatggataacagattttgctggtaaaaccgtctggtttgtcccttcgattaaagcgggaaatgatattgccaactgccttaggaagaatggaaaaaaggtgattcaactttctagaaaaactttcgatacggagtatcagaaaacaaagctaaatgattgggatttcgtagtaacaacagatattagcgaaatgggagcaaattttaaagccgatagagtaatagaccctcgtagatgcctaaaaccagttatattgacagatggccctgaaagggtaatattggctggaccaatgcctgttacagccgcttcagcagcgcagcgacgcggacgagtcggtaggaatcctcaaaaggaaaatgatcaatatatatttacaggacaaccgttgaataatgatgaagaccatgctcactggaccgaagccaagatgcttttggataacatcaatacaccggagggcataatacctgcgctatttgaaccagaacgagaaaaaagcgcagcgattgatggagagtacaggctaaaaggggagagccgaaaaacattcgttgagttaatgagaaggggagatcttccagtttggctagctcataaggtcgccagcgaagggataaaatacacggaccgaaaatggtgctttgacggccagaggaacaaccaaattttagaagaaaatatggatgtagaaatctggacaaaggaaggagaaaaaaaaaagctgagacctagatggcttgacgcacggacctactcggacccattagcattaaaggaattcaaagatttcgccgctgggcgtaaatctattgctttagaccttgttactgaaataggtagagtacctactcacttagcacacagaacaagaaatgcactagataatctcgtaatgctgcatacgagtgaacatggtggaaaagcgtatagacatgcagttgaagaacttccggaaacgatggaaactctgttgctattaggactgatgatatcgttgactgggggagccatgctattcttaatcagtgggaaaggaattggcaaaacgtccataggtctaatttgtgtcatagccagctccggtatgttatggatggcagaaattccattacagtggatcgcatcagctatagtattagaatttttcatgatggttttactcattcctgaaccagaaaaacaacgtactccccaagataatcaactagcctatgtggtaattggcatactgacactagcagcgataatagcagcgaacgagatgggactattagaaacaacaaagagggacttgggaatgagtaaagaaccgggagtagttagtccgacttcgtatctagacgtcgatttacaccctgcttctgcatggacattatatgcggtagcaactacggttattacacctatgttgaggcacacaattgagaactcaaccgctaacgtcagtttggctgctatcgccaaccaagctgtagttcttatggggctcgataaaggttggcctataagcaagatggacttaggagtacctctacttgcactgggttgttacagtcaggttaacccattaactttgacggcagcagtattacttttaatcacacattatgccataataggtccgggcttacaagctaaagccacaagggaggcacaaaaacggacagctgctggaatcatgaaaaatcccacagtagatggtataatgacaattgaccttgacccagttatatatgactccaaatttgaaaaacagttaggtcaggtcatgttactagtattatgtgcggttcagttattacttatgcgcacaagctgggctttatgcgaagcattgaccttagccacagggccgataactacactatgggagggctcacccgggaaattctggaatacaacaatagccgtctctatggccaatatctttaggggatcatatctcgcaggagccggattagcattctctatcatgaaatcggttggcacgggcaaacgaggaacaggtagtcaaggagagaccttaggtgaaaaatggaaaaaaaaattaaatcaactttcccgtaaagagtttgacttatacaaaaaaagtggaataacagaagtagatcgaaccgaagccaaggaaggtttaaaacgtggcgaaatcacccatcatgcggtatcccgtggatcagccaaattacaatggtttgtagaaaggaatatggtaataccagaaggcagagtgatagatttgggatgtggtagaggaggatggtcgtactactgcgccgggttaaaaaaagtaacggaagtaagaggatataccaaaggcggacccggtcatgaagaacctgtgccaatgagcacatatggttggaacatagttaaattaatgagcgggaaagatgtgttctacctgcccccagaaaagtgcgatacattactctgtgatataggagaatcatctccctctccaaccgtagaagagtcacgaacaataagagtattaaaaatggtagaaccgtggttaaaaaacaatcaattttgtattaaagtattaaatccatacatgcctacagttattgaacatttagaacgcctccaaagaaaacatggtggaatgttggtcaggaatccactttctagaaattctacacatgagatgtactggatatcaaacggaacgggcaatatcgtggcgagtgtaaatatggtttctcggctattactaaatagattcacgatgacacaccgtcgtccgactattgaaaaagatgttgatttaggagcagggacaaggcacgtaaacgcagaaccggaaacccctaatatggatgtaataggggaacgtataaaaagaataaaagaagaacataatagtacttggcactacgatgatgagaacccatataaaacttgggcctaccacggctcatacgaagttaaagcaactggatctgcctctagtatgataaacggagtggtcaaactgctcactaaaccctgggatgtcgtcccaatggtaacgcaaatggccatgacggatacaacaccatttggacaacaacgagtattcaaagaaaaagtcgacacaaggaccccccgaagcatgcccggaacaagaagagtaatggggattacagcagaatggctttggagaacactaggtagaaataaaaagcctagactatgtactcgtgaagaatttactaagaaggttcgtacgaatgctgccatgggagcagtatttactgaagagaaccaatgggactccgcgaaagcagccgtagaagacgaagatttttggaagcttgttgaccgcgaacgtgaactgcacaaactaggtaaatgtggaagctgcgtctacaatatgatgggaaagcgtgaaaaaaaactaggtgaattcggaaaagcaaaaggcagccgtgcgatttggtatatgtggttgggagctcgatacttagaatttgaagcattagggttcctaaacgaagaccattggttctcgagagaaaactcatactcaggggtggaaggtgagggattacacaaactaggatacatcctaagagacatttccaaaataccaggtggtgctatgtatgctgacgatacggcaggatgggacacacgaataacggaagacgatttgcacaacgaagaaaaaataacacaacaaatggatccagaacaccgacagcttgcaaacgccatatttaaactaacctatcaaaataaagtagtaaaagtacaacgtcctactccaacaggtacagtcatggacataatttcaaggaaagatcaacgcgggagcggccaggtaggtacttacggtttaaataccttcacaaatatggaagcccagttgataagacaaatggaaggagaaggcgtcttgtccaaagcggacttagaaaatcctcatctaccggagaagaaaataacgcaatggttagaaactaaaggtgtagagcgattaaaaagaatggcgatttcaggagatgactgtgtcgtaaagcctatcgacgatcgttttgccaatgccttactggcactaaacgacatggggaaagttcgcaaggatataccacaatggcaaccctctaagggatggcacgattggcagcaggtgcctttttgtagtcatcacttccatgagttaattatgaaagatgggagaaaattggttgtaccatgccgtccgcaagacgaactaatcggacgggcgcgcatatcacagggtgctggatggagtttacgtgagacagcttgtttgggcaaagcatacgctcaaatgtggtcattaatgtactttcatagaagagaccttcgactagctagtaatgcaatttgctcagcagtacccgtacactgggtcccaaccagcaggacaacttggtcgattcatgcacatcatcaatggatgacaacagaagatatgctcacagtatggaatcgcgtatggatcgaggataacccatggatggaagacaagacgcctgtaactacgtgggaaaacgttccttatcttgggaaaagagaagatcagtggtgcgggagtttaatcggattgacatcgagagcaacatgggcacaaaatattcccacagctatacaacaggttagatctttgatcgggaatgaggagtttttagattatatgccatcaatgaagcgatttcgaaaagaggaggaatcagaaggtgcaatctggtaa

SEQ ID NO: 23386 - RNA, 9873 nt, synthetic construct
  misc_feature 1..9873: note = derived and/or modified CDS sequence (opt6) from DENV-3__FJ373304__SS-prME
  source 1..9873: mol_type = other RNA
acatctttatgtttaatgatgatacttccagcggccttagcatttcacctcacgtcgagagatggggaacccaggatgatagtggggaaaaatgaaagaggaaaatcactactattcaaaacggcctcaggaataaatatgtgtacactaatagcaatggatctgggagaaatgtgtgacgacacagttacatataaatgcccccacataacggaagtagaacctgaagatatagactgctggtgcaatttaacttcaacgtgggtaacctatggcacgtgcaaccaagctggagaacatagaagagacaaaaggagcgtggcattggctccacacgtaggtatgggtttagacaccagaacccaaacctggatgagcgcagaaggcgcctggagacaagtggaaaaagtagaaacatgggccttacgacacccgggatttaccattctagcgctatttttagcacactacattggaacatctttaacgcaaaaagtagtaattttcattttgctcatgttagttaccccatcaatgactatgagatgcgtaggagttggaaatagggattttgttgagggtctaagtggagcaacctgggtggatgtagtgctagagcatggaggatgcgttaccacgatggccaaaaataaacccaccctggatattgagcttcagaaaaccgaggcaacgcaattagctacattgcgcaaactatgtatcgaaggcaaaatcacgaatattaccacagacagccgatgccccacacaaggagaagcagttctaccggaggaacaagatcaaaactatgtttgtaaacatacttatgttgacagaggctgggggaacggttgtggcctctttggaaaaggcagtctggtaacttgcgcaaaattccaatgcctagaacccatcgaaggaaaagtcgtacaatatgaaaatttaaaatataccgttataatcacagttcatacaggtgaccaacatcaagtgggtaacgagacccaaggtgttacggctgagatcacaccacaggcttcaacaacagaagcaatactgccagagtatggtaccctggggctagaatgcagtccacgaacgggactcgattttaatgaaatgatactattaactatgaaaaataaagcatggatggtgcatcgtcaatggttctttgacttaccattgccatggacgagcggcgcaacgacagagacccctacttggaacagaaaagaacttctggtcacgttcaaaaatgcccacgcgaagaaacaagaagttgtcgtccttggctcgcaagagggcgcaatgcacacagcactgaccggagccactgaaatccaaaatagcggtggtacatcaatttttgctggacatctgaaatgcagattaaaaatggataaactggaattaaaagggatgtcatatgcgatgtgtacaaacacatttgttttgaagaaagaagtaagtgaaactcaacatgggactatcttaataaaagtagagtacaaaggtgaagacgtgccgtgtaaaataccgttttcaacagaagacggccaaggcaaagcgcacaacggaagactgataacagcgaacccagtagtaaccaagaaagaagaacccgtgaatatcgaagcagaaccaccattcggagaatctaacattgtgatcggtatcggcgataacgcactaaaaattaattggtataagaaagggtcttcaatcggaaaaatgtttgaagcaactgctcggggtgccaggagaatggctattcttggagatactgcatgggactttggcagtgtaggcggagttctaaacagtctcggaaaagtagtgcaccaaattttcggctcagcatataccgccttgttttcgggagtgtcctgggttatgaaaataggcataggagtccttttaacatggattggactcaatagcaaaaatactagcatgtcttttagctgtatcgccattggaattataaccttatatctgggagcagtcgttcaagccgatatgggctgcgtaattaattggaaagggaaagagctaaaatgtggcagtggtatattcgttacaaacgaggtacacacatggactgaacaatataaatttcaagcagattcacccaaaaggttagctacagcaatagcgggcgcgtgggagaatggggtatgcggtataagaagtacaacgcgaatggaaaacctattatggaaacaaatagccaatgagcttaattacatactttgggaaaacaacattaaactcacggttgttgtaggcgacaccatcggtgttctagaacaaggtaaaagaacgcttacaccacaacccatggaacttaaatatagctggaagacctggggaaaagccaaaatcgtcacggcagaaacacaaaactcttcttttataatagacggaccaaatacacccgagtgtccttctgcatcaagagcatggaatgtctgggaggtagaagattacggctttggggtattcaccacaaacatctggttaaaattaagggaagtatatacacaattatgtgatcatcgacttatgagcgcggcagtgaaggacgaacgagcagtacacgcagatatgggatattggattgaaagtcagaaaaatggaagctggaaactagaaaaagcaagcctcatagaagttaaaacatgtacatggccaaagagtcatacgttgtggagtaacggagtactagaaagcgatatgataatccccaaatcattagcaggacccatctcacaacacaattatagacctggctatcatacacaaaccgcaggaccatggcaccttgggaaactagaactcgatttcaattattgcgaaggaacaacagttgtgattacagaaaactgcggcactcgaggcccgtcactaaggaccacgactgtaagtgggaaactcatacatgaatggtgctgtcgtagttgtacattaccacctttacgatacatgggcgaagatgggtgttggtatggaatggaaatacgtcctatttctgaaaaagaagaaaatatggttaaaagtttagtaagcgcgggatccggggaagtggataactttacgatgggagtcttatgccttgcaattttatttgaggaggtgatgcgtggaaaattcggtaagaaacatatgatagcaggggtattctttacatttgtcttgttacttagcggacaaataacatggagggacatggcacatacgctaataatgatcggcagcaatgcgtcagatagaatgggaatgggggtaacatatttagctctgatcgcaacatttaagattcaaccatttcttgctctagggtttttccttcgtaaactaacaagtcgcgagaatctgttgttaggagtaggacttgcaatggcaaccactttgcagctaccagaagatattgaacaaatggccaatggaattgcgcttggcttaatggctttaaaactcataactcaattcgagacatatcagttatggacagcattgattagcttaacgtgttctaacactatattcacgttaaccgtcgcatggaggacagcgacattaattttagctggagtttctcttttacccgtctgtcaaagttcaagtatgcggaaaacggactggctacccatgacagtcgctgcgatgggggtcccacctttacctctctttatattttcgttaaaagatacacttaaaagacggtcttggccactaaacgaaggtgtgatggcagtaggtctagtcagcatcttagcgagtagtctattacgaaatgatgttccgatggccggccccttagtagcagggggattactaattgcatgttatgtaataacaggaacatccgcagatttaacagttgaaaaagcggcagatgttacttgggaagaggaagctgagcaaacgggagtctctcataatctaatgataacagttgacgacgatggaacaatgaggataaaagacgacgaaacagaaaacattctaacagtactactaaaaacagcactgttaattgtcagtgggatatttccatatagcataccagctaccctcctagtttggcatacttggcaaaaacaaacacaaagaagtggtgttttatgggacgtaccatcaccgccagaaactcaaaaagcagaactagaagaaggagtatataggatcaaacaacaaggaatattcggaaaaacacaagtaggggtcggagtgcaaaaagaaggagtattccatacaatgtggcatgtaacaagaggagcagttcttacatataatggtaagagattagagccaaactgggcaagtgtcaagaaagacctcatatcctatgggggcggatggagattgtcggcacaatggcaaaaaggagaagaggtacaggtaattgcagtagaaccgggaaagaaccccaaaaattttcaaactatgcctggcacatttcaaacaacgacgggcgaaattggtgcaattgcactagactttaaaccaggtacctcaggatctcctatcataaatagggaaggcaaggtagtaggtctgtatgggaacggggtagttactaagaacggtggttatgtttccgggatagcacagacgaacgcggaacccgatggcccaacaccagaactagaagaagagatgttcaagaaaaggaatcttactataatggatctccatcctggatctggtaaaacacgtaagtaccttcctgcaattgtcagagaggcgattaagcgaagattaagaacacttatattagctccaacaagggtagtagccgcagagatggaggaagccctgaaggggctaccaataagataccaaacaacggcaacgaaatcagaacatacaggtagagaaatcgtagatttaatgtgccacgcgaccttcacaatgagattactaagccccgttagggtccctaattacaatctaattataatggatgaagctcattttacagacccagcttcaatagcggcgcgaggatacataagcacaagagtagggatgggtgaagccgctgcaatatttatgaccgcgacaccaccaggaaccgcggacgcgttcccccaaagcaatgccccaatccaggacgaggaacgagatatacccgagagatcatggaactcaggaaacgaatggataacagattttgcaggtaaaacagtctggtttgtaccgagtatcaaagcaggaaatgatatagctaactgcttgcgcaaaaatggtaagaaagtaatacaactgtctagaaaaacatttgacacagagtaccaaaagactaagttaaacgattgggacttcgtcgtaactactgatatatcggaaatgggggcaaactttaaagcagaccgtgtaattgaccctagacggtgcttgaagccggttattttaacggacggtccagagcgtgtgattctggccggtcctatgccggtaactgccgccagcgctgctcaacgaagaggtcgggtggggaggaatcctcagaaagaaaatgatcagtatattttcaccgggcaacccttgaacaatgatgaagatcacgcgcattggacagaggcaaaaatgctgttagacaacataaacacaccagagggcatcattcctgccttatttgagccggagagagagaaatcagccgcaatagatggcgaatatcgtttgaaaggcgaatctagaaagactttcgtagaattgatgcgacgaggtgatctaccagtctggttagcacataaggtggccagtgagggcataaagtatacagatagaaaatggtgttttgatggtcagagaaataaccaaatattagaggaaaacatggatgtcgaaatatggactaaagaaggggagaagaagaaactgcgcccacgatggttggatgctcgtacctacagcgatcctttagcattaaaggagttcaaagattttgcagcaggccgaaaatccatagcactagatcttgtgacagagataggtagagtaccaacacacctagcccacagaacaaggaatgcattagataatttagtaatgttgcatacgagtgagcacggaggaaaggcttatcgtcatgcagtagaagaattaccggagacaatggaaacactattattgctaggtctaatgatcttactaacgggcggagcgatgctctttttaatcagcggaaaggggattggcaaaacatctataggtttaatctgtgtaatagcttcttcaggaatgttatggatggcggaaataccactacaatggatcgcgtctgcaattatcctagagttctttatgatggtattgctcataccagaaccggaaaagcaaagaacaccacaagacaaccagctagcatatgttgtaataggaatactgacattggcagcaataatagcagcaaatgaaatggggctacttgaaactacaaaaagggatttgggaatgagtaaagaacctggtgtagtaagcccaaccagttatctcgatgtagacttacatccagcctcggcatggacactttacgcagtagccactacggtcatcacgccgatgttaagacatacaatagaaaattcaacggcgaatgttagtctagcagcaattgcaaaccaagctgtggtcttaatgggcttagataaaggttggcctatatccaaaatggacttaggagttccgttgttagcactagggtgttattctcaagttaatccattaaccttgactgcagccgttctattactcattacccactacgctataattggccccggacttcaagcgaaagcaactcgggaagctcaaaaacgaactgcagctggaataatgaaaaacccgaccgtcgacgggataatgaccatagatctcgatccggtaatatatgactcaaaatttgaaaaacaattagggcaagtaatgctcttggtattatgtgcggtacaactgcttctaatgagaacgtcgtgggccctgtgcgaagctctaacactagcaacgggaccaataacaacactatgggaaggctcgccaggaaagttttggaatacaacaatagcagtgtcgatggcaaacatattcagaggtagctatttggccggcgcgggacttgcattcagcatcatgaaatcagtaggaaccggaaaaagaggcaccggatctcaaggcgagacattaggcgagaaatggaagaagaaattgaaccaattaagcagaaaagagttcgatctatacaagaaatcagggataaccgaagtcgatcgaaccgaggcaaaagagggactcaaaagaggggaaataactcatcacgctgtatctcgtggaagcgctaaactacaatggtttgtagaaaggaatatggtcataccagaaggacgggttatagacttaggatgcggcagaggcggatggagttactattgtgcaggtctaaagaaagttaccgaggttagaggatatactaaagggggtccaggacacgaggagccggtaccaatgagcacgtacggatggaacatagttaaactaatgagtggaaaagacgttttctacctgcccccagaaaaatgtgacacactcttgtgtgatataggagagtcatcaccgtcgcccaccgttgaggaatctaggacaataagagtattgaaaatggtggagccctggcttaagaacaaccagttctgcataaaagtgctaaatccatatatgccgactgtcattgaacatctcgagagacttcagcgcaagcacggcggcatgctcgttcgaaatcccctttctagaaacagtacacatgagatgtactggattagtaacggaacagggaatatagttgcgagtgttaacatggtttcgaggctactgttaaatcggttcactatgacacataggagacccacaattgagaaagatgtggatttaggagcaggaaccagacatgtaaatgctgaaccggaaactccaaatatggatgtcatcggagaacgcattaaacgaataaaagaagaacataattctacttggcactacgatgacgagaacccatataagacatgggcctaccacggtagctacgaggttaaggctacagggtcggcatctagtatgataaacggagtcgttaaactattaacgaaaccctgggacgtagtaccaatggtaacacagatggctatgaccgatacaacaccattcggacaacaacgtgtttttaaagagaaggtagatactcgaacaccaagaagcatgcccggaacacgaagagtaatgggcataacagctgaatggttatggaggacgctaggaagaaataaaaagccaagattatgcactcgggaagagttcactaagaaggttagaactaacgcagccatgggagcggtattcacagaagaaaatcagtgggactcagcaaaagccgctgtagaagatgaggatttttggaaactcgttgatagagaacgcgaattacataaacttggaaagtgcggaagctgtgtttacaacatgatggggaagagagagaagaaattaggtgaatttggcaaggccaaaggtagtcgcgcaatatggtatatgtggctaggtgcaaggtatcttgagttcgaggcactgggtttcttaaatgaggatcattggttcagtagagagaactcgtactcaggagtcgaaggtgaaggacttcataaattgggttacatacttcgagatataagtaaaataccaggaggagcaatgtatgcagacgatactgccggatgggacaccaggattaccgaagatgatttacacaacgaggagaaaattacgcaacaaatggatcccgaacatagacaattggcgaatgctatattcaaacttacctatcagaataaagtagtaaaagttcaacgccctacaccaaccggcactgtaatggatatcatcagcagaaaagatcaacgcggctccggacaggtcggcacttatggcctaaatacgttcacgaacatggaagcacaattgatcagacaaatggaaggagaaggtgtcttatcaaaagcagacctagaaaaccctcatctaccggagaagaaaataacgcaatggcttgagactaagggagttgaaaggctcaaacggatggctattagtggtgacgactgcgtcgtgaagcctattgacgacagatttgctaatgccttacttgcactaaatgatatgggaaaggtacgtaaagacataccacagtggcaaccttccaagggatggcacgactggcaacaagtgcctttctgctcacatcatttccatgagttaataatgaaggatggcagaaagctagtagtaccgtgtaggcctcaagatgaactgataggcagagctcggataagccaaggcgccggatggagcctccgagaaacagcttgtctaggcaaagcatatgctcaaatgtggagcttaatgtactttcacagaagagatttgaggctcgcaagtaatgcaatttgctcagcggtacctgttcactgggttccaacgtcgcgtaccacatggtcgatccatgcacatcaccagtggatgaccactgaagacatgttgacagtatggaaccgagtatggatcgaagacaatccttggatggaggacaaaacaccagtaactacttgggaaaacgtaccctatttgggaaaaagagaagaccaatggtgtggcagcttgatcggattaacatcaagagctacatgggcacaaaatatacccacggctatacaacaggtccgaagtttaataggaaatgaggaatttttagactatatgccatccatgaaaagatttcgtaaagaagaggagagtgaaggagctatatggtag

SEQ ID NO: 23387 - RNA, 9873 nt, synthetic construct
  misc_feature 1..9873: note = derived and/or modified CDS sequence (opt6) from DENV-3__EU854291__SS-prME
  source 1..9873: mol_type = other RNA
acctcactatgtctgatgatgatattaccagcggctttagcattccatctcacttcgagggacggcgaaccacgaatgatagtgggcaaaaatgaacgtggaaaatctcttctgttcaaaacagcatcaggaataaatatgtgcactcttattgcaatggaccttggagaaatgtgcgacgataccataacgtacaaatgtcctcatattacagaagttgaacctgaagatatcgattgttggtgtaacttgacatccacatgggtgacatacggaacatgcaaccaagcaggagaacaccgtagagacaaaagatccgtagctctcgcacctcatgttggaatgggtctcgatactagaacacaaacttggatgtcagctgaaggggcttggagacaagttgaaaaagtagaaacatgggctttacgacatcccggctttacaatattagcattattccttgctcattacatcggaacgtctttgactcaaaaagtagttatatttattttgctcatgctcgttacaccatccatgactatgagatgcgttggtgtgggaaaccgcgactttgtagaaggtttgagcggagctacttgggtagatgtggtgctagaacatggtggatgcgttacaaccatggccaaaaacaaaccaacactagacatagaactacagaaaacagaagcaactcaactagctacactaagaaaattatgcatagaaggtaaaatcacaaatatcacgacagacagtagatgccctactcaaggcgaagcggtattacccgaagaacaagatcaaaactatgtctgcaaacacacgtacgtagatcgaggatgggggaatgggtgcggcctgttcggaaaaggatcattagtaacctgtgcaaaattccaatgcttggaaccaattgaaggcaaagtagttcaatacgaaaatctaaaatatacagtaatcattacagttcacaccggtgatcaacaccaggtcggtaatgaaactcagggcgtaactgccgaaataactccacaagcaagtactacagaagccatactaccggaatacggaacactaggactagaatgtagtccacgcacaggcctagactttaatgaaatgatattattaacaatgaaaaacaaagcgtggatggtgcatcgacagtggtttttcgacttaccactaccatggacctcgggtgccactacggaaactccaacatggaatcgtaaagaactgttagtaacgttcaaaaacgcgcatgcaaagaaacaagaagtagtcgttttagggtcccaggaaggtgcaatgcatactgcattgacgggggcaaccgaaatacaaaattctggcggaacttcaatatttgccggccatttaaaatgtagattgaaaatggataaattagaactgaaaggcatgtcctatgcaatgtgcaccaatacgtttgtactcaagaaagaagtttcagaaacccaacatggtaccatcctcattaaagtcgaatataaaggagaagatgtcccttgcaaaatcccattttcaacagaggacggacaaggaaaagctcacaatggacgtttgataactgccaatccagtggtaacgaagaaagaagaacctgttaacattgaagctgaaccaccttttggggaaagtaatatagtaataggtataggagacaatgccttgaaaataaattggtataagaaagggtcatcgataggaaaaatgttcgaagctaccgctcggggagcaagaagaatggctatattgggcgacacagcatgggactttgggtctgtaggaggtgtattaaactccctagggaaaatggtacatcaaatctttgggagcgcatatacggccctcttcagtggggtctcctgggtaatgaaaataggaataggagtactactcacttggattggcctaaatagtaaaaataccagtatgtcatttagttgtatcgcgatcggaatcatcaccctatatttaggagccgtagtacaagcagacatgggatgcgtaataaattggaaaggaaaagagttaaaatgtggatcaggcatattcgttacaaacgaggtacacacttggaccgagcaatataaatttcaagcagatagtcctaaacgattagcaaccgcgatagcaggggcttgggaaaacggggtatgcggaataaggtcaactacgagaatggaaaacttactgtggaaacagatagctaacgaattaaattatattttatgggaaaataacattaagttgacagttgttgttggtgatactattggagtattggaacaaggcaagcggactttgacaccacaaccaatggaacttaagtacagttggaaaacgtgggggaaagcaaaaatagttaccgcagaaacacaaaacagctcatttattatcgacgggcccaatacaccagaatgcccctccgcgagcagagcatggaacgtttgggaggtcgaagactatggctttggggtttttacaacaaacatctggctaaaactaagggaagtatatacccagctatgtgatcataggctaatgtcagccgcagtaaaggatgagcgcgcagtacacgcagatatgggctactggattgagtcacagaagaatggatcctggaaactagagaaggcatccttaatagaagtgaaaacttgtacatggccgaaatcacataccttatggtcaaatggagtcctagagagcgatatgataattccaaaaagccttgctgggccaatatctcaacataactatagacctggatatcacacccaaacagcagggccatggcatttgggtaagttagaactagactttaactactgtgaagggaccaccgttgtaataactgagaattgtggaacaagagggcccagcttaagaactacaacagtaagcggaaaactaatccacgaatggtgctgccgctcttgtacacttcccccactacgatacatgggggaagatggctgctggtacggcatggaaattagaccagtaagtgaaaaagaggaaaatatggttaaaagcctggtatcggcaggatctggagaggtagataacttcacaatgggagtactctgcttagccattctattcgaggaagtcatgcgcggaaaatttgggaaaaagcacatgattgcaggcgtgttctttactttcgtattattactaagcggccaaataacatggagggacatggcccatactctaattatgataggaagtaacgcgagcgacaggatgggtatgggtgttacatatcttgcattaattgcaacatttaaaatacaaccgttccttgcactgggatttttcttacgtaaactaacttctagagaaaatcttctattaggggtaggactcgccatggcaaccactctccagttaccggaagatatcgagcaaatggctaatggcatagcactcggtttaatggcattaaaactaataacccaattcgaaacataccaactatggacggccttaatatcattaacttgttctaacactatatttacgttaacagtggcctggagaacggcgacactgattttagccggtgtaagcctgttacctgtgtgccaatcgtccagcatgagaaaaactgactggctacctatgactgtcgcagccatgggagtacctccacttccactcttcatattttcacttaaggacacactcaaacgtagatcctggccattaaatgagggtgtaatggcagtgggtcttgtaagcatcttagcaagttccttactacgaaatgacgtaccaatggccgggccgcttgttgcaggaggccttctaattgcttgttacgtaataaccggcacctctgcagatctaactgtagaaaaagctgctgacgtaacatgggaagaggaggcagaacaaactggagtgtcccataatcttatgataacagtagacgatgatgggacgatgcgaataaaggatgatgaaacggaaaatatactaactgttttgctgaaaactgctctattgatcgtctcggggatcttcccatattcaataccagcaacgttgctagtctggcatacatggcaaaaacaaacccaaagatctggagtattatgggacgtacccagcccacctgaaacgcagaaagccgaactagaggaaggagtatatcgcatcaaacagcaaggaatatttggaaaaactcaggttggtgttggggtccaaaaagagggcgtgtttcacaccatgtggcatgtaacaagaggtgcagtgttgacctataacgggaaaagattagaacctaattgggctagtgttaagaaagacctaatctcatacgggggaggttggcgcttaagcgctcaatggcagaagggagaagaagtccaagtaatagcagtagaaccaggtaagaatcctaagaatttccagaccatgcctggcacattccaaactacaacgggtgaaataggagcaatcgcattagattttaaacccggtacgtcaggctcgcctataattaaccgcgaggggaaagttgtcggtttgtacggaaatggagttgtaaccaaaaatgggggatacgtaagcggaattgctcaaactaatgcagaaccagatggaccgacacctgagttggaagaagaaatgtttaagaaaaggaatttgacaatcatggatctacatccaggatctggaaaaacccgaaaatatctaccagccattgtacgcgaagctataaaaaggcggcttcgtaccttgatactcgcacctacacgagttgtagcggcagaaatggaagaagctctgaaaggcttaccaattagataccaaacaacggccactaaaagcgaacacactggacgagaaatagtcgacctaatgtgccacgcaacatttactatgagattgctatcaccagttcgagtcccgaattacaacctcataatcatggacgaagcacattttactgatccagcgtctatagcggcaagaggatatataagtacgagagtcggtatgggagaagccgcagcaatatttatgaccgctactccaccagggaccgccgacgccttcccacagtcaaacgcacctatccaagatgaagaacgagatataccagaacgatcgtggaatagtggcaacgaatggataactgatttcgcaggcaagacggtgtggtttgttccaagtataaaggctggtaatgacattgcaaattgtttgaggaaaaacggaaagaaagtgatacaattgtcgagaaaaacattcgatacagaatatcaaaagactaaactcaacgattgggacttcgtagtcacaactgacataagcgaaatgggagcaaatttcaaggccgacagggttatagacccaagacgttgcctgaaacctgtcatattaaccgacggatctgaaagagtaatattagccggccctatgcccgttacagcagcttctgctgctcaacgaagaggtcgagtgggtagaaatccccaaaaggagaacgaccaatacatattcacaggacaacctctgaacaacgatgaagaccatgcacactggacagaagcaaagatgctcctagataatattaacacaccagaagggattattcctgctttatttgaaccagaaagagagaaatctgcagccatagatggtgaatacagacttaagggggagtctcgtaagacgttcgttgaacttatgagacgaggggatcttcctgtttggctagcccataaagtagctagcgagggaataaaatatactgatagaaagtggtgttttgacggtcaaagaaataatcaaatactcgaagaaaacatggacgtggaaatctggacaaaggaaggagagaagaagaaactccgtccgaggtggctagatgcacgtacgtatagcgatccactagcccttaaagaatttaaggattttgccgctggaagaaaaagcatagcactagacttggtaactgaaatcggaagagttccaacacacttagcacataggacacggaatgcactagacaatctagtaatgcttcacacgtctgaacatggcggaaaagcatatagacatgctgttgaagaactgccggaaaccatggaaacattgctcttattgggattgatgattttacttacagggggagcaatgttattcttaatatccgggaaaggtatagggaagacgtccatcggcttgatatgcgtgattgcaagcagtggcatgctctggatggcagaaattcccttacagtggattgcaagtgctatagtattggagttctttatgatggtattattaattcctgaacctgagaagcaaagaactccgcaagacaatcagttagcatatgttgttattggaatattaactcttgctgcaacaattgctgctaatgaaatgggactattagaaactactaagagagatcttggtatgagtaaagaacctggcgtggtaagccccacatcatatctcgatgtcgatctgcatccagcatccgcttggacactatacgcagttgcgaccacagtaataactcccatgttgcggcatactatcgaaaactcgaccgcaaatgtaagtctcgccgcaattgctaatcaagcagtcgtactaatgggactagataaggggtggccgataagtaaaatggacctaggcgttccactattggccttaggatgttacagccaagtaaatccactaacactaacggctgcagtgctacttcttataactcattacgctataataggaccagggttgcaagcgaaagcgacacgggaggcacaaaaacgaacagcggcgggaatcatgaaaaaccctaccgtcgatggaataatgactatagaccttgacccagtaatatacgacagtaaatttgaaaagcagttgggacaagtaatgcttttagtactatgcgcagtacaactgctattaatgagaacatcatgggcattatgtgaagcattgacacttgcaactggtcctattactacactatgggaagggtctccaggaaagttttggaataccactatagcagtatccatggcgaatatatttagaggatcatatctcgctggggcagggctggcgttttccattatgaagtccgttggaacaggcaaacgcggaaccggaagtcaaggtgaaacactgggtgaaaagtggaagaagaaactcaaccagctatcccggaaagagttcgacttatacaagaagtcgggaatcacagaagtagatcgtacagaagcaaaagaaggcttgaaacgcggagaaattactcatcacgctgtcagtaggggatccgccaaactacagtggttcgtagaaaggaatatggttatacctgaagggcgagtcatcgacttgggttgtgggcgaggtggatggtcctactattgcgcggggcttaagaaagtcacggaagttaggggctatactaaaggaggacctggtcacgaggagcccgttccaatgtctacttatggctggaacatagtaaagttaatgagtggaaaagatgtcttctatttaccgcctgaaaaatgcgacacactcctctgcgacatcggtgaatcgtcaccaagtccaacagtagaagaatctagaactatccgagtcttaaagatggtggaaccttggctcaaaaataatcaattctgtataaaagttctaaatccatacatgcccaccgtaatagaacacctagaaagactgcagcgaaaacatggaggtatgttggtgaggaacccactttcaagaaatagtactcacgagatgtattggatctctaatggaaccggaaatatagtagcctcggtgaacatggtatcaagattactactcaatcgtttcacaatgactcaccgtcggccaaccattgaaaaagatgtggatttaggggcaggcacgagacatgtcaacgccgaacccgaaaccccaaatatggatgtaataggagaaagaataaaacggataaaagaagaacacaactctacatggcactatgatgatgagaatccgtacaagacatgggcctatcacggaagctatgaagtaaaagccactgggagtgcatcgtcgatgattaatggtgtagtaaaactattaacaaagccatgggacgtcgtgccaatggttactcaaatggcaatgacggacacaacaccttttgggcaacagcgtgtttttaaagagaaagtggatactcgaactcctcgcccgatgccaggtactaggagagtaatgggaatcacagcagaatggttatggaggacattaggtcgaaataagaagccacggctctgcactcgtgaagaatttactaagaaagtcaggactaatgcagcaatgggtgcggtctttacagaagaaaaccaatgggattcggcaaaagcagccgtggaggatgaagacttctggaaactcgtagacagagaaagagaattacataaactcggtaagtgtggaagctgtgtgtataatatgatgggaaagcgcgagaagaaacttggggagttcggtaaggccaaaggatctcgagcaatctggtacatgtggcttggcgcaagatatctcgaatttgaggccctgggatttcttaacgaagaccactggttcagtcgagaaaactcttactctggtgtcgaaggagaaggcttacacaaattaggttatatactccgtgacataagtaaaatcccaggaggtgcaatgtacgcagatgatacggccggttgggatacacgcattactgaagatgacctacataacgaagagaaaattacccagcaaatggatcctgaacatagacaacttgcaaacgcgatatttaaacttacataccaaaacaaagtagtaaaagtccaaagacccacaccaactggcactgtaatggacataatttcaagaaaggatcaaagagggtcgggtcaagtagggacctatggtctaaatacatttactaacatggaagcgcagctgatccgtcagatggagggggaaggtgtattaagcaaggcagatttagagaatcctcatttacctgagaagaaaataacccagtggttagaaacaaaaggagtagaacgtttgaaaagaatggcaatctccggggatgactgtgtagttaaaccgattgacgatagatttgcgaatgcattacttgcgttgaacgatatgggcaaagtcagaaaagatataccacaatggcaaccttccaaagggtggcacgattggcaacaggtgccgttttgtagccaccatttccacgaactaataatgaaggacggaaggaagctagtcgttccctgtagaccacaggacgagttaataggacgtgcaagaatatcccagggagcagggtggtcattgagggaaacggcgtgcctggggaaggcatacgcacaaatgtggtcattaatgtatttccataggcgtgacctacggttagcatctaatgcgatttgtagcgctgttcctgtgcattgggttccaactagccggacaacttggtccatacatgctcaccaccaatggatgactacagaagacatgcttactgtatggaatcgtgtctggattgaagataatccgtggatggaggataaaacaccggttaccacgtgggaaaatgtaccctacttgggtaaacgtgaggatcaatggtgtggttcattaattggtctgactagcagagcgacatgggcacaaaatattcccaccgcgattcaacaagtaagaagtttaataggtaatgaagagttcctagattacatgccaagcatgaaaaggtttagaaaagaggaagaatcagaaggagctatttggtga

SEQ ID NO: 23388 - RNA, 9873 nt, synthetic construct
  misc_feature 1..9873: note = derived and/or modified CDS sequence (opt6) from DENV-3__KF955454__SS-prME
  source 1..9873: mol_type = other RNA
accagcttatgtttaatgatgattctaccagctgcattggcatttcacttgacaagccgcgatggcgaacctcgtatgatagtcgggaaaaatgaacgtggaaagagcttattatttaaaactgcctcaggaataaatatgtgcacattgatagcaatggatcttggtgaaatgtgtgacgacacggtcacttacaaatgcccacacatcacagaagtcgaaccagaagacatagactgttggtgcaacttaacttctacctgggttacgtacggaacatgcaaccaagccggagaacatcgacgagacaaacggtccgtagccctcgctcctcatgttggtatgggacttgatacacgaacccaaacgtggatgagtgctgaaggagcatggagacaagttgagaaagttgaaacatgggcgctacgacatccagggtttacaatcttagctctattcctagcccattatataggaacctcgcttacacaaaaagttgtaatctttattttattgatgttggtaaccccaagcatgaccatgagatgtgtaggagttggaaatagagatttcgtagaaggattaagcggagcaacatgggttgatgtagtactagaacacgggggatgtgtaactaccatggctaaaaataaaccaactttagacattgaattacagaaaacggaagccacccaattagcgaccctaaggaaattatgtatcgaaggaaaaattaccaacataacaacggactcaagatgtcccacgcaaggagaagcagtgcttccggaagaacaagaccaaaattatgtctgtaaacatacttatgtggaccgtggctggggaaatggctgtggactatttggtaaagggtcgctggtaacgtgcgcgaaatttcaatgtctagaaccaatagaaggaaaagtggtacaatatgaaaatttgaaatatacagtaatcataacagtacatacaggtgatcaacaccaagtgggtaatgaaacacaaggagtaaccgctgaaataactccacaggcgagcacgactgaagcaatactaccggaatacggtaccttggggctagagtgttcaccgagaactggcttagactttaatgaaatgattttgctaactatgaaaaacaaagcctggatggtgcaccgacaatggttctttgacttaccactcccttggaccagtggcgctacaacggaaacacctacatggaaccgaaaagaactcttagtaacctttaaaaatgcacacgccaagaaacaagaagtcgtagtactcggatctcaggagggggctatgcatactgccttaactggagccacggaaattcaaaactctggtggtacttcgatcttcgccggacatttaaaatgtcgattaaaaatggataaattggaactaaaaggaatgtcgtatgctatgtgcacgaatacattcgtactcaagaaagaagtttcggaaacccagcacgggactatattaataaaagtagagtacaaaggtgaagacgtgccatgcaaaataccgtttagtaccgaagatggtcagggaaaagcccataatggaagactaataactgcgaatccagtcgtaactaagaaagaagaacctgtaaatatcgaagctgaacctccatttggtgaaagtaatattgtaataggaattggcgataatgccttaaaaatcaattggtataagaaagggagtagcataggtaaaatgttcgaagctactgcaagaggagcccggagaatggcaatactaggagatacagcatgggactttggaagcgtgggcggagttctgaactcattaggcaaaatggttcatcaaatcttcggatcagcttatacagcattgttctcgggagttagctgggtgatgaaaatcggaattggtgtattgctaacttggataggattaaattctaaaaatacgagtatgagctttagctgcattgctattgggattataaccctttacctaggagcggtagtccaagctgacatgggatgcgttatcaactggaaaggaaaagaactaaaatgtggatcgggtatctttgtaacgaacgaagttcatacctggacggaacaatacaaatttcaagcggattctccgaaacgattagccacagcaattgcaggagcatgggaaaacggagtttgtggcattagatccacaactcgaatggaaaatttgttatggaaacaaatagctaatgaacttaattacatattgtgggaaaataacatcaaattgacagtggtcgttggtgatattattggagtattggaacaaggtaaacgaacattaacgccccaaccaatggaattaaaatactcatggaaaacgtggggcaaagccaaaatagtgacggccgaaacacaaaattcgagtttcataatcgacggtccgaatacgcccgaatgcccctctgcctcaagagcttggaacgtatgggaagtagaagactacggcttcggagtgtttactactaatatttggctaaaactaagggaggtttacactcagctctgtgatcataggcttatgagcgcggccgtaaaagacgagcgcgctgttcacgcagacatgggatattggatagaaagccagaaaaatgggagttggaaattagaaaaagccagcttaatagaagtaaagacatgcacctggccgaaatcacacaccctatggtcaaatggagttcttgaaggagacatgataatcccaaagtcactagctggccctattagtcagcacaactaccgccccggttaccacacgcaaactgctggtccctggcacctaggaaaattagaattggacttcaattactgtgaaggtaccacggtagtaataacagaaaactgtggaacacgaggaccctccttaagaactacgacagtatccggcaagttaatacacgaatggtgctgtcgatcttgcactctaccaccattgagatatatgggagaggacggatgttggtacggcatggagattaggccaatatccgagaaagaagaaaatatggtaaagtccctcgtttctgcgggttcaggcgaagtcgacaatttcacaatgggcgtgctttgcttagcaatcctatttgaagaagtaatgagaggaaagtttgggaagaaacatatgattgccggagtctttttcactttcgtacttcttttgtcaggtcaaataacgtggcgtgacatggcccacacactaataatgatcggtagtaatgcgtctgatagaatgggaatgggagtaacatacctagcacttatcgccacttttaaaatccaaccgtttctagcgctcggattctttcttaggaaactaacctcacgagagaatctactcctaggagtaggactcgctatggctaccaccttgcaattacctgaagatattgaacaaatggcaaacggcatcgcattaggtttaatggcgctaaaactgatcacgcagttcgaaacataccaactttggacagccttaattagcttgacatgctctaatactatatttaccttaacggtcgcttggcgaaccgcaaccctcatacttgcaggagtttccttgttaccagtatgtcaatcttcgagcatgcgcaagacagactggttaccaatgacggtagccgctatgggagttccaccgttaccactctttattttctcactcaaagatacacttaaaaggaggagctggccgcttaacgaaggcgtcatggcagttggattagtctcaatccttgctagttcactgctaaggaatgacgtaccaatggcaggaccacttgtggccggagggcttttaatagcatgttacgttatcaccgggacaagcgctgacctgacggtagagaaggctgcagacgtgacgtgggaagaagaggcagaacagacaggtgtatcacacaatttaatgataacagttgatgatgatggtactatgcgaataaaagacgatgaaaccgaaaatattttaacagtactactaaaaactgctttactaatcgtgtcgggaatattcccgtactcaattccagcaactttgcttgtgtggcacacatggcaaaaacagacacaaaggtcaggcgttctatgggatgttccctccccacccgaaactcagaaagcagagcttgaggaaggagtatataggatcaaacagcaaggcatttttggaaaaacacaagtaggggtaggagttcaaaaggaaggggtatttcacacaatgtggcatgtcacgagaggagcggtgttgacttacaatggaaagagattggaaccgaattgggcgagcgtgaaaaaggatcttatatcatatggaggtggttggcgattatcggctcaatggcaaaaaggagaggaagtacaagttatagcagtagaaccaggtaaaaatcccaaaaattttcagacaatgccgggtacttttcagaccaccacgggtgaaatcggggccattgccctagattttaaaccaggaacaagtggatcaccaatcattaatcgggaaggcaaggtcgttggcctatacgggaacggagtggttacaaagaacggcggatatgtaagtggaatcgcccaaaccaatgccgaacccgatggtcctacacccgaattggaagaggaaatgtttaagaaaagaaatttaacgattatggatctccacccgggtagcggtaagacacgcaaatatctaccagcaatcgttcgagaagctatcaaacgacgactacgaacattaatacttgcacccaccagagtagtggcggctgaaatggaagaagcactaaaagggttacccatccgatatcaaacaactgcaacaaaatcagaacataccggtagagaaattgttgacttaatgtgtcacgctactttcacaatgcgtttactgagcccagttagggtaccaaactataatctaattattatggacgaagctcatttcacagatcctgcgtctatagctgcaagaggttacatatccacacgagttggaatgggagaagccgctgccatattcatgacagccacacctcccggtactgcagacgcttttccgcaatcaaatgcaccgattcaggacgaagaacgagatataccagaacggtcttggaacagtggtaatgagtggatcactgattttgctggaaaaacagtgtggtttgtaccaagtattaaagcaggaaatgatatagcaaattgtctaaggaaaaatggcaaaaaggtaatccaactaagtaggaaaacttttgataccgagtaccagaaaaccaaattgaacgattgggattttgtggtaacaaccgacatatccgagatgggggctaacttcaaggccgatagagtaattgaccctcgaagatgccttaaaccagtgatattaactgacggccccgaacgtgtcattctagcagggccaatgccagtgaccgcggcaagcgctgcacaaaggcggggtcgggttggtcgaaaccctcaaaaagaaaatgatcaatatatatttacaggtcagccactaaacaacgacgaagatcacgcacactggacggaagcaaaaatgttgctagataatattaacactcctgaaggcattataccggcgctctttgaaccagagagggaaaagagcgctgcgatagatggcgagtatcgcctgaaaggagaatcccgcaagacattcttagagttaatgagaagaggagatttacctgtttggctggcttataaagttgcaagcgaaggaattaaatacaccgatcgaaaatggtgcttcgatgggcagagaaataaccagattttagaagagaacatggacgtcgagatatggactaaagaaggagagaagaagaaattaagaccccggtggcttgacgccagaacatatagtgacccattagctttaaaagaatttaaagactttgctgcaggcaggaaatcaatcgcacttgatttagttactgagattgggcgcgtaccaacgcatttagctcatagaacaagaaatgcactcgataaccttgtcatgctacacacgtcagaacatggaggaaaagcataccgccacgcagtggaagaactacctgaaaccatggagactcttctcctactcggattaatgatattattaaccggaggagcgatgctttttctaatctcaggaaaaggcataggtaaaacaagtataggtctaatatgcgtaattgcatcatccggcatgctatggatggctgaaattcccttgcaatggattgcatcggcaatagttcttgagttctttatgatggtcttattaattccagaaccagaaaaacagcggacaccacaggacaaccagttagcctatgtggttataggaatattgaccctagcagctataatcgctgcaaacgaaatgggactattggaaacaacaaagcgagatcttggaatgtcaaaagagccaggtgttgtctctccaacaagttatcttgatgtagacttacatcccgcctctgcttggacactctatgcggtcgcaactaccgtcattacaccaatgctccgtcacactatagaaaatagcacggcgaacgtatcattagcggcaattgcgaaccaggctgtcgttctgatgggcttggataaaggctggcccattagtaagatggatttaggcgtgccactgttggcactagggtgctactcacaagtaaatccacttaccttaacggcagcagtactcctattgattacgcactatgcaataataggacccggtcttcaagcgaaagccaccagagaagctcagaaaaggactgcagcggggattatgaaaaacccaactgtagacggaatcatgacgattgatcttgaccctgtaatatacgacagcaaatttgaaaaacaactaggacaagtgatgctattagtattgtgtgcagtacaattgctactaatgcgtacttcttgggccttatgtgaggctctaacacttgcaactggtcctattacgacactatgggaaggaagccccggaaaattttggaatacaactattgcggtttctatggccaacattttcagggggagctacctagcgggagcaggcttagcatttagcatcatgaaaagtgttggaacaggaaaaagaggaactggtagccaaggggagacattaggtgaaaagtggaagaagaaattaaaccaactttccagaaaagaatttgacctatataagaaatccggaataaccgaggtcgacagggcagaagctaaagaagggttgaaaagaggcgaaatcacgcatcatgcggtgagcagagggtccgcgaaacttcaatggtttgtggaaagaaacatggtcatccctgaagggagagtcatcgacttaggttgtggacgagggggatggtcttattattgtgcaggtttaaagaaagtaactgaagttagaggatacactaaaggaggcccggggcacgaagaaccggtaccaatgtcaacgtacggatggaatattgtaaaattaatgtcaggcaaagatgtattttatttgccgccggagaaatgtgatactttactatgcgacataggcgaatcaagtccatctccaaccgttgaagagagcagaactattcgtgtactaaaaatggtagaaccttggctcaaaaataaccaattttgcattaaagtgctaaatccctacatgccaacagtgattgaacacttagaacgattgcagagaaaacatggtggcatgttagtaagaaatccattatcacggaacagtacacacgaaatgtactggatctcaaacggaacgggtaatatagtagcctcagttaatatggtctcgaggctattattgaacaggtttacaatgacgcaccgaagaccaactatagaaaaagacgtcgacttaggtgctggtacgagacacgtaaatgctgaacccgaaaccccaaacatggacgttataggagaacgaatcaaaaggatcaaagaagaacacaacagtacatggcactatgacgatgagaatccatacaaaacatgggcgtatcatggttcatacgaagtaaaagcaacaggaagtgcatctagtatgatcaatggagtggtaaagttactaacaaaaccttgggatgtcgtcccaatggtcactcagatggctatgactgacaccaccccattcgggcaacaacgggtgttcaaagaaaaagtagatacacgtactccgcgatcaatgccagggacacgaagagtaatgggaataactgcagagtggttgtggcgtacacttgggcgaaataagaaacctagactatgcacccgagaagagttcactaagaaagtgcgtacaaatgcggcaatgggagctgtttttactgaagaaaaccagtgggacagtgcgaaagctgcagtcgaagatgaggatttttggaaacttgtggatagagagcgggaattacataaactaggtaagtgcggatcatgcgtatacaacatgatgggaaagagagagaagaaactcggggaatttgggaaagccaaaggcagccgagcaatatggtacatgtggctgggagctaggtacctcgaatttgaagccttaggattccttaacgaagaccattggttttctcgcgaaaacagttattcgggggtagaaggagaaggcctacataaactaggatatatcttacgggatatttctaaaataccaggtggtgccatgtatgcagatgacacagccggctgggatactagaataactgaagatgacttacacaacgaagagaaaattacacaacaaatggaccctgaacatagacaacttgccaacgctatattcaagttaacatatcaaaataaagtagtaaaagtacaaaggccaacacctactggtacagtgatggatataatctctaggaaagatcaaagaggaagcggacaagtgggcacatacggtctaaacacgtttacaaatatggaagcacaactcatacgccaaatggaaggagaaggcgtattaagtaaagctgacttagaaaatccgcatccgcccgagaagaaaattacgcagtggctagaaactaaaggggtggaaagattgaaacgcatggctatatcaggcgacgactgtgtagtaaaacccatcgacgacaggtttgctaacgccttattagcattaaatgatatggggaaagttagaaaagatattcctcaatggcagccgtccaaaggttggcatgactggcaacaggtacccttctgcagtcatcattttcacgaattaataatgaaggacgggagaaagctagtagtgccatgtcgtccacaagatgagttgatcggtagagcacgaattagccagggagcaggctggtcattgagagaaaccgcatgcttaggtaaggcttatgcacagatgtggtccctcatgtatttccacagaagagatctgcggctcgcatccaacgcaatttgctcagccgtaccagtccattgggtaccaactagcagaacaacgtggagtatacatgctcaccatcagtggatgaccacagaagatatgctgacagtttggaatcgggtatggatagaagataacccatggatggaggataaaaccccggtaacaacctgggagaacgttccataccttggaaagagagaagatcaatggtgtgggagcttaataggactcacaagtcgagcaacgtgggcccagaatattccgactgctatccaacaagtccgttcacttataggaaacgaagaatttttggattatatgcctagtatgaaacggtttcgaaaggaagaagaatctgaaggagcaatatggtaa

SEQ ID NO: 23389 - RNA, 9873 nt, synthetic construct
  misc_feature 1..9873: note = derived and/or modified CDS sequence (opt6) from DENV-3__EU854292__SS-prME
  source 1..9873: mol_type = other RNA
acgtctctatgcttaatgatgatccttcccgctgctttggcattccatttaactagcagagacggggaacccagaatgatagtgggcaaaaatgaaagaggaaaatcgctattatttaaaaccgcgagtggaatcaatatgtgcactttaatagcaatggacctgggagaaatgtgtgacgataccgtaacttacaaatgcccacatatcaccgaagtcgaaccagaagatattgactgttggtgcaacttaacgtccacctgggtaacttatggtacttgcaaccaagcaggagaacatagaagggacaaaagaagtgttgcattagctcctcacgtaggtatgggattagacacccgcacacaaacatggatgtctgcagaaggagcctggagacaagtcgaaaaagtagaaacatgggccttgcgtcatccaggatttacaatactagcgctatttttggcgcactacataggaacatcgctgacacaaaaagtagtcatttttatattattaatgcttgtaacaccatctatgacaatgcgctgtgttggaataggtaatcgggattttgtcgaaggattatcaggtgccacttgggtagatgtcgttctagagcatggaggttgtgttacaactatggctaaaaacaaaccaacactagacatcgagctacagaaaaccgaagcaacccaattagccacactgagaaaattgtgcattgaaggaaaaatcaccaacattacgaccgatagtaggtgtcccacacaaggagaagctgccctacctgaagaacaagaccaaaactatgtgtgtaaacacacgtatgtcgatagaggatggggtaatggttgtggattattcgggaaaggaagccttgttacctgtgcaaaattccagtgtctagaacccatagaaggaaaagtggtacaacacgaaaacttgaaatatactgttattataactgttcatactggagatcaacatcaggtgggaaatgagacacaaggggtgaccgcggaaataacgcctcaagctagcacgacagaagccattcttcctgaatatggcactttaggcctagaatgtagcccacggactggtctggatttcaatgaaatgatccttttaacaatgaaaaataaagcctggatggtacatagacagtggttctttgacttacctctcccttggacaagcggtgcaactacagaaactccaacgtggaatagaaaagagttattagtcacgttcaaaaacgcacatgctaagaaacaagaagtagtcgtgctaggttcgcaagaaggtgctatgcatacagctttaacgggagcaaccgaaattcaaaacagtggaggcacatccatatttgcaggtcatttgaagtgtcggctaaaaatggacaaactagagttaaaaggtatgagttacgccatgtgcacgaacacatttgtgctcaagaaagaagtttctgagacccaacatggaactatcctgataaaagtagaatacaaaggggaagatgccccatgtaaaataccgttcagcacagaagatggtcaaggaaaagcacataatggtcgtttaatcacagccaatccagtcgtaactaagaaagaagaaccagtaaacattgaagctgaaccaccgttcggagagtccaacattgttataggaataggagacaatgcactgaaaataaattggtacaaaaagggatccagcataggaaaaatgtttgaagcaacagcacgtggggccagacgtatggcaatactaggtgacactgcttgggattttggttcggtcgggggtgttttaaattcactaggaaaaatggtacatcaaattttcggaagcgcatataccgctttattctccggagtcagttgggttatgaaaataggcattggggtactcctgacttggatcggactaaactctaaaaataccagtatgtcgttttcatgcattgcaatcggaatcattaccctatatctaggcgcagttgttcaagctgacatggggtgcgtaataaattggaagggtaaagagctaaaatgtggctcaggcatatttgttactaacgaagtgcacacatggacagaacagtacaagtttcaggcagacagtccaaaacgtctagcaacggcaatagcaggagcttgggagaacggtgtctgtggtattcgcagcacaactaggatggaaaacctgttatggaaacaaatcgccaacgaattaaactatatactgtgggagaacaatataaaattaacggtagtcgttggagatatcattggcgtcctagaacagggaaaaagaacattaacgccacaacccatggaactaaaatattcatggaagacgtggggtaaagctaaaatagtaacggccgaaacacaaaattcatcgttcataatagacggtcctaatactccagaatgcccatctgcagcgagagcatggaatgtatgggaagtcgaggattatggatttggggtgttcacaactaacatatggctaaaattacgagaagtgtatacacaactgtgcgaccatcgactcatgtcggcagctgtaaaagacgagcgtgccgtacacgctgatatggggtactggatagaaagccagaaaaatggcagttggaaactggaaaaggcttcactgattgaagttaaaacttgtacttggcctaaaagtcatacgctttggagcaatggagtactagaatcagatatgataataccaaaaagtctcgccggacctatatcgcagcataatcatcgccccggctaccacacacaaactgcaggaccatggcatctaggtaaacttgaactagatttcaattactgtgaaggcactacagttgttattactgaaaattgcggcaccagagggccgagtttacggacaacaacagtatcaggaaaactgatccatgaatggtgctgtagaagttgcactctgccaccactacggtatatgggagaagacggatgttggtacggaatggaaattagaccgattagtgagaaagaggagaacatggtaaaatccctcgtctcggccgggagcgggaaggtagataattttactatgggtgtcttgtgtttagcgattttgttcgaggaagttatgcgaggaaaattcggcaagaaacatatgattgcaggcgtctttttcacattcgttctccttctaagcggacaaataacatggagagacatggcacacaccttgattatgatagggtcaaatgcatcagaccgcatgggcatgggagttacttatctagcacttattgcaacatttaaaattcaacctttcctagcgttgggattcttcttaagaaaactaaccagcagggaaaacttattactaggtgttggtctagccatggccactactcttcaactcccagaagatattgaacaaatggccaatggtattgccctaggacttatggcgttaaaactaattacacaatttgaaacttatcaattgtggacagcgcttatcagcctcacatgcagcaacaccatcttcacattaacagtagcttggcgaacagcaacattaatattagcaggagttagcttgctgccagtctgtcaatcatcaagcatgcgaaaaaccgattggctaccaatggctgtagcagccatgggtgtaccaccgcttccattgtttattttctgcttaaaagatacgcttaaaagacgttcatggcctctcaatgaaggtgtcatggcggtcggcctagtatctattttagcttcttccctactgcgtaatgatgtccccatggcaggaccattagtggctggagggctattaatcgcatgctacgttatcactggtacaagtgcagacttaacagttgaaaaagccgcagatattacatgggaagaagaagcagaacaaactggtgtaagtcataatttaatgattactgttgatgacgacggtaccatgcgaataaaagacgatgaaacagaaaatatcttaacagtactattaaaaaccgccctgttaatcgtatccggaatattcccttattcaataccagcaacattattagtatggcatacctggcagaagcaaactcaaagaagtggagtactatgggatgttccctcacccccagaaacacaaaaagcggaattagaggagggtgtctataggataaaacagcaagggatatttggcaaaactcaggtaggagtaggagtacaaaaagaaggtgttttccatacaatgtggcatgtcactagaggtgcagtgctaacatacaacgggaaaaggctagagcccaattgggcaagcgtgaagaaagacttaatatcatatggcggaggttggcggctgagtgcacaatggcaaaagggcgaagaagtacaagtcattgcggtggaacctggcaaaaatccaaagaacttccaaactatgcctggtaccttccaaacaacaacaggtgaaatcggtgctatcgccttggattttaagcctggcacatccggatcaccaattataaatagagaggggaaagttgtcggactctacggtaatggagtagtaactaaaaatggtggttacgtttcgggaatagcacaaacaaatgcagaacctgatggacctacaccagagctagaagaagagatgtttaagaaaagaaatcttacaataatggatctacacccaggaagtggaaaaacacgtaagtatttaccggccatcgtacgtgaagcaattaagagacgtttgcgaacactaatattagctccaaccagggtcgttgctgctgaaatggaagaagcattaaaagggttacctatcagatatcaaaccacagccactaagagtgaacatacgggaagagagatcgtggacctaatgtgtcacgcgacatttacgatgaggcttctttcaccggttagggtacccaattacaatctaataataatggacgaagcacattttacagaccctgcctcaatagctgcaagggggtatatctccactcgagtcggaatgggtgaagctgcggccatatttatgactgcaacgcctccaggtactgccgatgcctttccccaatcaaatgcaccaatccaggatgaagaaagggacataccggaacgtagttggaactcgggaaatgagtggataaccgattttgccgggaaaaccgtatggtttgtcccgagcataaaagccggaaatgatatagccaactgtcttcgtaagaatggcaagaaagttatccagctaagccgtaaaacatttgacacggaatatcagaaaacgaaacttaatgattgggacttcgtagtgaccacggacatctctgaaatgggagctaatttcaaggcagacagagttattgatcctagaagatgcctcaaacccgttattctaacggacggacccgaaagagtcatcttagctgggccaatgcccgtgacagctgctagtgccgcccagaggagagggcgcgttggtagaaatccacataaagaaaatgatcagtatatattcactggccaacctttgaacaacgatgaagaccatgcccattggacagaagctaagatgctacttgacaacattaatacacccgaagggataataccagcactttttgaaccagaaagagagaaatccgcggcaatagatggagaataccgattaaaaggagaatcgagaaaaactttcgtagaactgatgcggcgaggtgatttaccagtttggttggctcataaagtcgctagtgagggaatcaaatataccgatcgtaagtggtgctttgacggacaaagaaacaaccagatattagaggaaaatatggacgtagaaatctggactaaggaaggtgagaaaaagaaattacgacctcgctggctagatgcacggacatatagtgacccattggccttaaaggaatttaaggatttcgctgcaggacgaaaatcaatagcactcgatcttgttaccgaaatcggacgtgtaccatcacacttagctcataggacgagaaacgcattagataacctcgtaatgcttcatacaagtgaacatggagggcgagcttatagacatgccgtagaggaactacccgaaactatggaaaccctcctattgctaggtctaatgattctgctcactggtggcgcgatgttgttcctaatatcaggtaagggaatcggcaaaacctctatcggattgatctgtgtcattgcaagcagtggaatgctatggatggccgaaatcccactacaatggatagctagcgcgatcgtattagagtttttcatgatggtactacttataccagaaccagagaaacaaagaacaccgcaagataatcaactggcctatgttgtaattgggatattaactctcgcggctataatcgccgctaacgaaatgggactgttggaaacaactaaaagagatttaggtatgagcaaagagccgggagtagtatcacccacaagttacttggacgtcgatttacatccagctagtgcatggactctatacgctgttgcaactacggtaataactccgatgttaagacatacgattgaaaacagcaccgcaaatgtgagtctagctgccatagcaaaccaagcggttgttttaatgggactggataaggggtggccaatctcaaaaatggatctgggcgttcctttattagccctagggtgctattcacaggtgaatcctttaacattaactgcagctgtattactattgatcacacactatgcaatcattggcccaggattacaagctaaagcgacacgtgaagcgcagaagagaacggcggcgggcataatgaaaaatcccacggtagacggtataatgaccatagacctggatcctgtgatatatgattctaaattcgaaaaacaacttggacaggtcatgctgctagtgttatgtgcggttcagctattactaatgcgtacttcttgggccctttgtgaagcactgacattagcaactggtccaattacaacactttgggaaggctcccccggaaaattttggaacaccactatagcagtgtcaatggctaacatttttagaggaagttatctcgcaggagcgggactcgccttctcaataatgaaatctgtaggcacgggtaaacgggggacaggatctcaaggagaaaccctaggtgaaaaatggaaaaagaaattgaaccaacttagccgaaaagaatttgatctgtataagaaatcaggtattacagaagtcgatcgaactgaagccaaagagggactcaaaagaggagaaatcactcatcacgctgtaagcagaggcagtgcgaaattacaatggtttgtcgaaaggaacatggtaatcccagaaggacgtgtaatcgatttgggatgcggcagagggggctggagttactactgcgctggcttgaagaaagtcactgaagtcagaggatacacaaaagggggaccaggtcacgaagaaccggtccccatgagtacatatggatggaacattgtcaaactgatgtccggaaaagatgtattttacttgccacctgaaaaatgtgacaccctcctttgcgatataggggaatcatccccatcacctacggtcgaagaatcgaggaccattagagttttgaagatggtagaaccgtggttgaaaaataatcaattctgcattaaggtactaaatccttatatgcctacagtgattgagcaccttgagaggttacaacgaaaacatgggggtatgttagtcagaaatccactcagtaggaactcaacgcacgaaatgtactggataagcaacggcacaggtaacatagttgcgtctgtcaatatggtatctaggttactactaaatagatttactatgacacatagacgcccaactatcgaaaaggacgtagacctcggcgcgggaactcgacacgtcaacgccgaacctgaaaccccgaatatggatgtaataggtgaaagaataaaacggatcaaggaagaacacaattcaacatggcactatgatgacgagaatccttataaaacttgggcatatcacggatcctatgaagttaaagcaactggatccgctagtagtatgattaacggagtagtgaaactgttaacaaaaccttgggatgttgtacctatggtcactcaaatggctatgactgacacgacgccctttggtcaacagcgagtgtttaaagaaaaggttgatacaagaacacctagatcaatgcccggcacaagacgcgttatgggtatcacagcagaatggctctggcgaacactcggtaggaataagaaaccacgattatgcacaagagaggagtttacaaagaaggtccgtacgaacgctgcaatgggagcggttttcacggaagaaaaccaatgggattctgccaaagctgccgtagaggacgaagacttctggaaacttgtagaccgagagagggaactacataaattaggaaaatgtggtagctgtgtatacaacatgatgggcaaaagagagaagaaacttggggagttcggaaaagctaaaggttcacgagcgatttggtatatgtggctaggtgcgagatacctggagttcgaggctctggggttcttaaatgaagaccactggttcagtagagaaaactcttattcgggcgttgaaggcgaaggccttcataaattgggatatatattaagagacatcagcaagatacctggcggagctatgtatgcagatgacaccgccggctgggatactcgtatcacagaggatgacttacataacgaagagaaaataacacaacaaatggatcccgaacatagacaactagcaaatgcgattttcaagttaacctatcaaaataaagtggtaaaagtccaacgacctaccccaaccggaacagtcatggacataatttccagaaaagaccaaaggggatcaggacaagttggaacatatggtctaaacactttcacaaacatggaagcacaattaataagacagatggagggagaaggtgttttgagcaaagctgatctggaaaatccgcacttaccagagaagaaaatcacacaatggctcgaaacgaagggcgtagagagattaaaaaggatggcaatttcaggtgacgattgtgtggtaaagcctatagatgatagatttgctaatgccttattagctctaaacgatatgggaaaagtgagaaaagacataccacaatggcaaccatcaaaaggttggcatgactggcaacaagtaccattttgcagtcatcacttccatgaattaatcatgaaagacggcaggaagctagtcgtcccctgtagacctcaggatgagctgataggtagagctcgaatatcacaaggagcaggctggagtctaaaagaaactgcatgcttaggtaaggcctatgcacaaatgtggagtctaatgtatttccatcgtcgagacctccgattagcttcaaacgcaatctgttcagccgttccagtccattgggtacctacttcaagaacgacctggtcgatacacgcccatcatcaatggatgacaacggaggatatgctaaccgtatggaacagagtatggatagaagataatccttggatggaagataaaaccccggtaactacctgggagaacgtgccatatttaggaaaaagagaagaccagtggtgcggttcactaattggactaacatcaagagcaacatgggctcaaaatattcctacagccattcaacaggtacgttccttaattggtaacgaagagtttctcgactatatgccgtcaatgaaacgttttagaaaagaggaagagtctgaaggtgcaatatggtaa

SEQ ID NO: 23390 - RNA, 9873 nt, synthetic construct
  misc_feature 1..9873: note = derived and/or modified CDS sequence (opt6) from DENV-3__FJ639746__SS-prME
  source 1..9873: mol_type = other RNA
actagcctctgtttaatgatgatattgcctgcagcattagccttccatttaacatctagagatggagaaccgcgtatgatagttggcaaaaatgaacgaggtaaatccctactatttaaaacggcgagcggaataaacatgtgcacactaattgcgatggatttaggcgaaatgtgtgatgacaccgttacgtacaaatgccctcatataactgaagtcgaacctgaagacattgactgctggtgtaatctgaccagtacttgggtaacttatggaacttgcaatcaagcgggtgaacataggagggacaaacggtcagttgccctcgcaccacatgtgggtatggggttagacacgagaacacaaacctggatgtcggcagaaggcgcgtggagacaggtagagaaagtcgagacttgggcactacgtcacccgggattcactatattggctctgttcttagctcactatatcgggacttcattgacacagaaagtagttatattcatccttctcatgctagtcactccatcaatgactatgaggtgcgtcggagtcggaaatcgcgactttgtggaaggcttatctggagcaacatgggtagacgttgtactggagcatggaggctgtgtaacaacaatggccaaaaataaacctactttagatatcgagcttcagaaaacagaagccacccaacttgccacactgagaaaattatgtatcgaaggcaaaataacaaatataacaactgactcaagatgtccgacacaaggggaggcagtccttccagaagaacaagatcaaaactatgtctgcaaacatacatatgtagatcgaggatggggaaatggctgtggattattcgggaaagggagcttagtgacatgcgcaaaatttcagtgcttggagccaattgaaggaaaagtagtccaatacgaaaacttaaaatatactgttataataacagttcacacgggcgatcaacaccaagtaggcaacgagacacaaggagtgaccgctgaaataacaccacaagcatcaacaacagaagccatacttccagaatatggaaccttgggactagagtgcagtccaagaacaggtctagacttcaatgagatgattcttctcacaatgaaaaacaaagcctggatggtacaccgacaatggttcttcgaccttcccttaccctggacgagtggagcaacaacagagacgcctacttggaatcgcaaagagctacttgtaacatttaaaaatgcacatgccaagaaacaagaagtcgtggtattaggttcacaggagggcgcaatgcatactgcgttaaccggagctactgaaatacaaaatagtggcggaacgtcaattttcgctggacacctgaaatgcagattgaaaatggataaattagaattaaaaggaatgtcatatgccatgtgtacgaataccttcgtcttaaagaaagaagtatctgaaactcaacatggtacaatacttataaaagtcgagtataaaggggaggatgtcccgtgcaaaatacccttctcgacagaagatggacaaggaaaagcacataatggcagattaataaccgctaaccctgtagtgaccaagaaagaggaacctgtcaatattgaagcggagcctccgtttggtgaatccaacatagtaataggtatcggagataatgccctgaaaataaattggtacaagaaaggttcgtctataggaaaaatgtttgaggcgaccgcccgaggggccagaagaatggcgatattgggggatactgcatgggattttggaagcgtaggcggggttttgaatagcttaggaaaaatggtacatcaaatctttggatccgcttacactgcactttttagtggagtaagctgggtaatgaaaatagggatcggagtgctactgacatggataggcctaaatagcaaaaatacgtctatgtcattctcatgtatcgcaattggaataataactttgtatcttggagcggtagtacaagcggacatgggatgtgtaattaactggaaaggaaaagaattgaaatgtgggagtggcatatttgttactaacgaagtacacacatggaccgaacaatataaattccaagcggatagtccaaaaagactcgcaacagcaatagcaggggcgtgggaaaatggtgtctgcgggatacgtagcacaacccggatggaaaatttgctttggaaacagattgcgaacgaactgaactatatactatgggaaaataacataaaattgacagtagtagtcggagacattataggagtgttagaacaaggaaaacggacgctaacgccacaacccatggagctaaaatattcatggaagacatggggtaaagctaagattgtaaccgcagagactcagaatagttcatttataattgacggaccaaatacgccagaatgtccatctgcaagtagggcatggaatgtgtgggaggtcgaagattacgggttcggggtattcactaccaatatatggttaaagctgagagaagtttatacacaactatgtgatcacaggcttatgtcagcagcagtaaaagatgaaagagccgtacacgccgatatgggatattggattgagtctcaaaagaacggctcatggaaacttgaaaaagcatccttaatagaagtaaaaacatgtacttggcctaaaagccacacattatggtctaacggtgtacttgagtcggatatgataataccaaaatccctagctggacctatatcgcaacacaattatagacccggatatcacacacagaccgctggtccgtggcatttaggcaagctagagcttgactttaactactgtgaagggaccactgtagtgataacagaaaattgcggaactcgaggaccctctttacgtacaacaactgttagtggcaaactcatccatgaatggtgctgtagaagttgtacgttgccgcctttaagatacatgggggaagatgggtgctggtatggtatggagattcgcccaatatcagaaaaagaagaaaacatggtaaaaagccttgtctctgcaggatcaggtgaagtagacaattttaccatgggcgttttgtgtcttgcaatcttatttgaagaagtaatgagaggtaaattcgggaagaaacatatgatagctggtgtattctttacttttgtattgttactgtctgggcaaatcacatggagggatatggctcatactctcatcatgataggcagcaacgcctccgatagaatgggcatgggagttacttatctcgcgcttatagcaacattcaaaattcaaccgttcctagctttagggtttttccttaggaaactcacgtcaagggagaacttgctgttaggagttggactcgctatggctacgactctacaattaccggaggatatagagcagatggccaacggaatcgcgttaggacttatggcactaaaactaattacacagttcgaaacatatcaactctggacagcattaattagtctaacttgtagcaacacaatctttactttaacggttgcctggcgaactgcaaccctaattttagctggtgtatctcttttacctgtctgtcaatcatcatcaatgcgtaaaacagactggctacctatgactgtagcggcaatgggtgtcccaccgctcccgctgtttatatttagcttgaaggatacacttaaaagacgctcctggcccttaaacgaaggggttatggccgtagggttagtctcaatcctcgcatcctcgcttcttcggaatgatgtcccgatggctggacctcttgtggcaggaggtttattgattgcttgttatgttataacgggtaccagtgcagatcttactgtagagaaagccgcagacgttacatgggaggaggaagcagaacagaccggagtatctcataatcttatgattaccgttgacgatgacggaaccatgcgaatcaaagacgatgaaacagaaaatatccttacagtattattaaaaactgcgttattaattgtgagtggcatattcccatacagcattccagctaccctattagtctggcacacatggcaaaaacaaacacagaggtcaggcgtgctgtgggacgttcctagtcctcctgaaacacaaaaagcagaattagaagagggggtgtatagaatcaaacagcagggaatttttggaaagacacaagttggcgtgggagtccagaaggaaggtgtatttcacacaatgtggcatgtaacaaggggtgctgtcctaacgtataacggtaaaaggttagaacctaattgggcgtcagtaaagaaagacctaatatcctatggaggagggtggaggctttcggcacaatggcaaaaaggtgaagaagtacaagttatagcagtagagccaggtaaaaatcccaaaaatttccaaactatgcctggcacatttcaaactacaacgggagaaataggagcaatagccctggactttaagcccgggacttcaggatcacctataatcaatagggaaggcaaagtcgttggactatacggaaacggtgtggtaaccaaaaatggtggttacgtgtcaggaatcgctcaaactaatgccgaaccagacgggcctactccagagttagaagaagaaatgtttaagaaaaggaatctcactatcatggatttacatccgggcagtggtaaaactagaaagtatctacctgcaatcgtgcgcgaggccataaagcgtagattacgaaccctaatactcgctccgacgcgggtagtcgctgcagaaatggaggaagcattgaagggtttacccatccgataccaaacgacggcgacgaaaagtgagcacactggtagagagatagtagatctcatgtgtcacgctacattcaccatgcgattactaagtcccgttagagttcctaactacaatttgataataatggacgaggctcattttacagacccagcatcaattgcagcacgaggatacattagtacaagagtagggatgggtgaagctgctgcgatatttatgacagctacaccacctggcactgcggacgcctttccacagagtaacgcaccgatacaagacgaggagagggatatcccagagcgaagttggaactctgggaacgaatggataacagacttcgcgggaaagacggtgtggtttgtaccaagtataaaagcgggaaacgacatcgctaactgcttgcgtaagaacggtaagaaagttattcagctgagcaggaaaacattcgacaccgaataccagaagaccaaacttaacgactgggattttgtagtaaccaccgatatatcggaaatgggggcaaacttcaaggccgatcgtgttatagaccctagaagatgcctaaaaccagtaatactaacagatggtccggaaagagttatattagcaggtcccatgcctgtgacagctgcatcagcagcacaaaggcgcggcagggttggaagaaacccccaaaaagaaaatgaccagtatatcttcaccggccagcctctcaacaatgacgaagaccacgcccattggacggaagcaaagatgctcctcgataatataaataccccagaaggaataattcctgcattatttgaacctgagagggaaaaatccgcagcaatagacggcgaatatagactgaaaggtgaaagtagaaaaacttttgtagagctcatgagacgaggcgatctccctgtatggctagcccacaaagttgccagcgagggtataaagtacactgatcgaaaatggtgttttgacggacaaaggaataaccaaatattagaagagaacatggatgtggagatatggaccaaagagggagaaaagaagaaattaagacctaggtggttggacgcgcgcacatattcagatccgttggcattaaaagagttcaaagactttgctgcaggtagaaagtctattgccctcgatttagttactgagattggtagggttccgagtcatttagctcacagaacaagaaacgcattagataatctggtaatgttacatactagcgaacacgggggcaaggcttaccgacacgccgtagaggagttacctgagactatggaaacattgctattactcggtctaatgatcctattgaccggaggagctatgttatttcttattagcggaaaaggaataggcaaaacaagcataggattaatttgtgtaatcgcgagttcaggtatgctatggatggctgaaataccccttcagtggatagcctccgcaattgtactcgagtttttcatgatggtattactgatccccgaacctgagaaacaaaggacccctcaagacaatcaattagcatacgtagttattgggatactgaccctcgcagcgattattgcagcaaatgagatgggattgttagaaacaactaagagggatcttggaatgagtaaggagccaggtgtggtaagtccgacatcatacctcgatgtggaccttcacccggcatcagcgtggacattgtacgctgtagctaccacagtgataaccccgatgctcaggcatacaattgaaaactcaactgccaacgtgagtctggcagctatcgcaaatcaagcagtagttctgatgggtttggacaaaggttggcccatcagtaaaatggatttaggcgtcccgctcctggctctaggctgctatagtcaggtaaacccactgactttaacagcagctgttcttctccttatcacacactatgcgattataggacctggtctacaggccaaggctactcgagaagcacaaaagagaacagcagcaggaatcatgaaaaatccgaccgtagacggaatcatgactattgatttagatcccgttatatacgatagtaaattcgagaaacaactgggacaagtaatgttattagtcctatgtgcagtgcaactattactaatgagaacttcctgggcactctgtgaagcactgacactagccacgggaccaataaccacgttatgggagggatcaccgggtaaattttggaacaccacaatcgcggtcagtatggccaacatatttagaggttcatatctagccggagcgggcttagctttttctataatgaaatctgtggggactggaaaaagaggtaccggaagtcaaggcgaaacactgggtgagaaatggaagaagaaactaaaccaattatccagaaaggaatttgacctttacaagaaatccgggattacagaagttgatcgtaccgaagcgaaagaagggctcaaaagaggtgagataacgcaccacgcagtgagcagaggaagtgcaaaactacagtggtttgtcgaacgaaatatggtaatacctgaaggacgtgttattgatttaggatgtggacgaggcggatggtcatattactgtgctggactaaagaaagttaccgaagttagaggctacacgaaaggaggacctggccatgaagaaccagtcccaatgtccacatatggatggaacatcgttaaattaatgagcggaaaggatgtattttacttacctcccgaaaagtgtgatactttactttgcgatataggtgaaagctcaccatcgccaacggtagaagaaagtcggaccatacgagttcttaaaatggtggaaccatggcttaaaaataatcaattctgtataaaagtactaaacccgtatatgccgacagtggtcgaacatctggaacggctccaaaggaaacacggtggaatgctagtaagaaacccgctctcacgtaatagtacgcatgagatgtattggatatcgaacggcacaggaaatatagtagcgtcagtaaatatggtttcccgattattattaaacaggttcactatgacacacaggcgaccaactattgaaaaggatgtagaccttggagcaggcacacgccatgtaaacgcggaacccgaaacaccaaatatggatgttataggagagcgaatcaagagaattaaggaagaacacaattccacctggcattatgacgatgaaaatccatacaaaacgtgggcatatcatggaagctacgaggtcaaagcaacaggcagtgcaagtagcatgataaatggcgtggttaagttacttacaaaaccttgggacgttgttcctatggtaacccaaatggcgatgactgacaccacccccttcggtcaacaaagagttttcaaagaaaaggtcgacactagaacaccccgatcaatgccggggactaggagagtaatgggtataacggctgaatggctatggagaacattaggcagaaacaagaaaccacgactgtgtacaagagaggagtttaccaagaaagtgcggactaacgctgcaatgggtgcagttttcacagaagaaaaccaatgggattctgcgaaagcagctgttgaagatgaagatttctggaagttagtagatagagaacgcgagttgcataaattaggcaaatgtggaagttgtgtttataatatgatgggaaagagggagaagaaattaggggaatttggtaaggcaaaagggtccagagcaatttggtacatgtggttgggcgcaagatacctagaatttgaagcgctaggatttctaaacgaagaccactggtttagccgtgaaaatagttacagcggagtagaaggcgaaggtctacacaaactgggatatatactacgcgatatcagtaagatacctggtggagcgatgtatgcagatgacacggcgggctgggacactcgtattacagaagatgatctgcataacgaagagaaaataacacaacagatggacccggagcacagacaattagcaaacgccatattcaaactgacttatcaaaacaaagtagtgaaagtgcaacgacctacacctactggaacagtgatggatataatcagccgaaaggatcagagaggaagtggacaggtgggtacgtatggattaaacacttttacgaatatggaggcgcaactaataaggcagatggaaggagaaggtgtattgtcaaaagccgatttagaaaacccccgactaccagagaagaaaattacacaatggttagaaactaaaggcgtagagcgactaaaaagaatggcaatatcaggcgatgactgtgtggtgaaaccaatagacgacagattcgcaaatgctctcctcgcacttaacgacatgggtaaagtaaggaaagacataccgcaatggcaaccgtccaaaggctggcatgattggcaacaagtgccgttctgcagccatcattttcacgagttaattatgaaggacgggagaaagctagtagtaccatgtagacctcaagacgaattaattgggagagcaagaataagccagggtgccggctggagccttagagaaacagcttgtctaggcaaagcatatgcacagatgtggtccttgatgtactttcaccggcgtgacttaagactggcgagcaatgctatctgttcggcagtacctgtacactgggtgcccacatcaaggacaacttggtctatacacgctcaccaccaatggatgactacggaggatatgttaactgtatggaatcgagtatggattgaagacaatccttggatggaagataaaactccaattacaacgtgggaaaatgtaccttatctaggaaaacgcgaagaccagtggtgcggaagtttaatcggtctgacaagtagagccacctgggcccagaatattccaacagcaatccaacaagtaaggtcattaataggaaatgaagagttccttgattacatgccatctatgaaacgatttaggaaagaagaggaatccgagggggccatctggtaa

SEQ ID NO: 23391 - RNA, 9873 nt, synthetic construct
  misc_feature 1..9873: note = derived and/or modified CDS sequence (opt6) from DENV-3__FJ639750__SS-prME
  source 1..9873: mol_type = other RNA
acaagtctttgtttaatgatgatcttaccagcggcactggcgtttcatttaacttcacgggatggagaaccgagaatgatcgtaggcaaaaacgaaaggggaaaatcgctgttgttcaaaacagccagtggtatcaacatgtgcacccttatagctatggacttaggtgaaatgtgtgacgatactgtgacttacaaatgtccgcacataacggaagttgaaccagaagatatagattgttggtgtaatctgacctctacatgggtaacatatggaacgtgcaaccaagcaggagaacataggagagataaacgatctgtagctcttgctccacacgtcggaatgggattggacacccgaacgcaaacctggatgagtgcggaaggcgcatggagacaagtagaaaaagttgaaacgtgggcgttaagacatcctggatttacaattttggcgctatttcttgcacactatatagggacctctttgacacaaaaagttgtaatatttattcttctgatgctcgtaacaccctcaatgacaatgaggtgtgtaggagtaggcaacagggacttcgtggaaggactgagcggagccacatgggtcgatgtagtcctcgaacatggaggttgcgtaaccacgatggcgaaaaacaaacctacattggatatagaacttcagaaaactgaagcaacacaactagctaccttaagaaaattgtgcattgagggaaaaataaccaatattacaactgatagtaggtgtcccacacaaggtgaggccgtacttccagaagaacaagatcaaaactatgtctgcaaacatacatatgttgatcgggggtggggaaatggctgcggattatttggaaaaggtagcttagttacttgtgcgaaattccaatgcttagagcctattgaaggaaaagtggtgcaatacgaaaatctcaaatatacggtgattatcaccgtgcacaccggcgatcaacaccaagtgggtaacgaaacgcaaggtgtcactgctgagataaccccacaagctagtactacggaagccattttacctgagtacgggaccttgggattggagtgctccccgcgaactggactcgactttaacgaaatgattctgttaactatgaaaaataaagcgtggatggttcatcgtcagtggttcttcgacttgccattgccctggacgtcaggggctactacagaaacgcctacatggaataggaaagaactactcgtgaccttcaaaaacgcacacgctaagaaacaggaagttgttgtattgggctcacaagagggcgcaatgcatacagctctaacaggcgcaaccgagatccaaaattccgggggaacttcaatatttgccggtcatcttaaatgtcgattaaaaatggataaattagaactaaagggaatgagctatgctatgtgcactaacacctttgttctaaagaaagaagtatcagaaacacaacatggaaccatactaattaaggtagaatataaaggagaagatgtgccatgcaaaataccattctcaactgaggatggacagggaaaagctcacaacggaaggttgataaccgcaaatcctgtggttacgaagaaggaagaaccggtaaatatagaagccgaacctccatttggagagtccaacatcgtcatcggaataggcgacaacgcccttaaaatcaactggtacaagaaaggctcaagcataggaaagatgtttgaagcaacagctcgaggtgctagaagaatggccatactcggcgatactgcctgggattttggaagtgtcgggggagtgctaaattccctcggaaaaatggttcatcagatattcggaagtgcttatacagctttgtttagcggagtttcttgggtaatgaaaatcggaatcggggtccttctaacctggatcggactaaatagcaagaacacaagcatgtcttttagctgcatagcaataggtattatcacactatatcttggagctgtagtccaagcagatatgggttgtgtaattaactggaagggtaaagagttgaagtgtggaagcggaattttcgttacaaacgaggtacatacatggacagaacaatataaatttcaagcagatagtccaaaacgcctcgcaactgcaatcgcgggagcttgggagaatggtgtatgtgggatccgttcaacgaccaggatggaaaatctcctatggaaacaaattgctaatgagttaaattatatactctgggaaaataacataaaattgactgtagtcgtaggagacatcataggagtgttagagcaaggtaaacggactttaacccctcaaccaatggaattgaaatatagttggaaaacgtgggggaaagctaaaatcgtcactgcagaaacacaaaactcgagctttataatagatggtccaaacacgcctgaatgtccgtctgcgagcagggcgtggaacgtatgggaagtggaagattatggatttggtgtctttacaactaacatttggctaaaattgagagaagtatatactcaattgtgcgaccatcgactaatgagtgcagccgttaaggatgaaagagctgtacatgcagatatgggctactggattgaatcacagaaaaatggatcgtggaaactagaaaaagcctcgcttatagaagtaaagacatgcacctggccgaagtcacatacattatggtccaacggcgtactagaaagtgacatgataataccaaagtcactagctggtcctataagccaacacaattacagaccaggctatcacactcaaaccgccggtccctggcacctcgggaaacttgaactagattttaactattgcgaaggaaccactgttgttataaccgaaaactgtgggacccgtggaccatcactaagaaccactaccgtctcaggcaaacttatacatgagtggtgttgtaggtcatgtacacttccacccctacgttatatgggagaggacggttgttggtacggtatggaaatacgaccaataagtgagaaagaagaaaatatggtaaaatcccttgtatcagccggctcgggagaagttgataacttcactatgggggtattatgtctagcaatactattcgaggaagtgatgagaggaaaatttggcaagaaacacatgatagccggtgtattctttaccttcgttttgttacttagtgggcaaatcacttggagagatatggcacatacactcataatgattggatctaatgcctccgatagaatgggaatgggggtcacatatttagctcttatagcaacttttaagattcaaccctttttagccctgggattctttcttcggaaacttacttctagagaaaatcttttactaggagtaggtctcgctatggcaacaacactgcaattaccagaggatatcgaacaaatggcaaatggtatagcactcggcctaatggccttgaaattaatcacacagtttgaaacttatcaactatggaccgccctaatatctttaacatgttcgaatacaatttttacactaactgtagcttggagaacagctactcttattcttgcgggagtttcattattgcccgtgtgtcaatcctctagcatgagaaaaaccgattggctccccatgacggtggcagcgatgggagtcccaccattgccacttttcattttctcgctcaaagatacattaaaaaggaggagctggcctttaaatgaaggagtaatggcagtaggactcgttagcattttagcttccagcctattgcgaaacgatgtaccaatggctggtccccttgtagcaggaggcttattaattgcgtgttatgtaatcacgggtaccagcgcggatctaacagtggaaaaagctgccgatgttacttgggaagaggaggcggagcaaaccggggttagtcataacttgatgataactgtagacgacgatggaacaatgcgcatcaaggatgacgaaacagagaatatcctaacagttctgttaaaaactgctttactcatagtttctggcatatttccttattcaattccagccacattgttggtatggcatacgtggcaaaaacagactcaaagatcaggagtattatgggatgtccctagtccgccagaaacacaaaaagccgaactagaagaaggggtatatcgcataaaacagcaaggaatattcggtaagacacaagtaggggttggcgtgcaaaaagaaggagttttccacacaatgtggcatgttacaagaggtgctgtactaacatacaatggaaaaagactcgaacccaattgggctagcgtaaagaaagatttaatttcctatggtggtggctggaggctatcagctcaatggcaaaaaggagaagaggttcaagttattgctgttgaacctggcaaaaaccctaaaaactttcaaaccatgccgggcacatttcagacaacaacaggtgagataggggccatagcgttagacttcaaaccagggacaagtggcagtcccatcataaatcgggaaggtaaagtcgtagggctctatggaaatggcgtggtaactaaaaatggaggatatgttagcggtattgcacaaacaaatgccgaaccagatggaccgactccggagcttgaggaagagatgtttaagaaacgaaatttaacaataatggatttacacccggggagtggtaaaactagaaaatatttaccggcaattgttagggaagctataaaaagaaggctgaggaccttaatactagcaccaacaagggtagttgccgcagaaatggaagaagcgttaaaaggtttaccaattagatatcaaactaccgctactaagagcgaacatacaggaagggaaatagttgatttaatgtgtcatgcaacatttacgatgcgactattaagcccagttagagtaccaaactataacttaattataatggatgaagcgcactttacagacccagcctcaattgccgctagaggatatatcagcactagagtcggcatgggcgaggctgctgctatatttatgacggcgacgccacctggtaccgcagacgcgtttccacagtccaatgcgccaattcaagatgaagaacgagatatcccagaaaggtcctggaactcagggaacgaatggattacagatttcgcaggaaaaacggtctggtttgtaccaagtataaaagcaggtaatgacatagcaaactgtttaagaaagaacggaaagaaagtaatacaattatcacgaaaaactttcgatacggaatatcagaaaaccaaattaaatgactgggactttgttgttactactgatatatcggagatgggagcaaattttaaggccgaccgggtaattgacccccgaagatgtttaaagccagtaatattaactgatggacctgagcgcgttatcctagcaggaccaatgccagtaacggcagcgtctgcggcacaaaggagaggcagggtgggacgtaatccacaaaaagaaaatgaccaatatatatttacgggccaaccactgaacaatgatgaggatcacgcacactggaccgaggcaaaaatgctactagataatataaatacacctgaaggaatcataccagcactattcgaaccagaacgagagaaaagcgccgcaatcgatggtgaatatcgtttaaagggtgaatcaagaaagaccttcgtggaactaatgaggcgaggtgatctcccagtatggttagcgcataaagtagcgagcgaggggattaaatacaccgatagaaaatggtgttttgacggacagagaaacaaccaaatactcgaagaaaatatggacgtggaaatttggactaaagaaggcgagaagaagaaacttcgtcctaggtggctagatgcaaggacatactccgacccattagccttaaaggaatttaaagattttgctgctggaaggaagtcgatagcactagacttggtaacagaaatcggaagagtgccgtcgcacttggctcacagaacacggaatgcactagataacttagtaatgttgcacacaagtgaacacggagggaaggcttaccggcacgctgtcgaggaattgcccgagacgatggaaacattactactactcggattgatgattctattgacaggcggcgctatgctttttctaatctcggggaaaggcatcggaaaaacatcaataggcttgatctgcgtaattgcatcgtctgggatgctatggatggcagagatcccacttcagtggatcgctagtgcaattgtacttgagttcttcatgatggttttgctaataccagaaccagaaaaacagcgtactcctcaagataaccaacttgcatatgtcgtaataggtatattgacactagctgcgataatagcagcaaacgagatgggtttacttgaaactactaaaagagatcttggaatgtcaaaagaaccaggtgtcgtctcaccaaccagttatcttgatgtcgatctccatcctgcaagtgcgtggacgttatacgccgttgcgacaacggttataactccaatgttaagacacaccatagaaaatagcacagcgaatgtgtcgctagcggcaattgcaaatcaagcagtggttctaatgggactcgacaaaggctggcccatctctaaaatggatctaggcgtccctctcctagcacttgggtgctatagccaagtgaatcctttaacactgacagcagcagttttattattaatcacccattacgctatcatcggaccaggccttcaagccaaagcaacaagagaggcacagaaaagaacggcagcaggtattatgaaaaatcccactgtcgatggcataatgaccatagacttagatccagttatttatgattccaaattcgagaagcaattgggacaagtaatgctattagttttatgtgctgtgcagttgcttttaatgagaacaagctgggctctctgcgaagctcttaccttagcaacaggacctattaccaccctatgggaaggcagcccaggaaaattttggaatactaccatagcggtttcaatggcaaatatattccgtgggagctacctagctggcgcagggttagcatttagcataatgaagtcagtcggcaccggaaaaagaggaacaggtagtcaaggagagacgttgggtgagaaatggaagaagaaattgaatcagttaagtcgaaaggagttcgacctgtacaagaagtcaggaatcacagaagttgaccgtacagaagcaaaagaaggtctgaagcgtggagaaataacccaccacgcagtatcaagaggatctgctaagttacaatggtttgtagaacgaaatatggttattccagaaggaagagtaatagacctaggttgtgggcgaggaggttggagctattactgcgcgggattgaagaaagttacggaggttcgtggttataccaagggaggtcctgggcatgaagaaccagtacctatgtccacctacggatggaatattgttaaactgatgtcaggcaaggatgtcttttacttacctccagagaaatgcgacactttactatgtgacataggcgaatccagcccatcacctaccgtagaagaatcaagaacaattcgcgtcctgaaaatggttgaaccatggcttaaaaacaatcaattttgtatcaaagttcttaacccttacatgcctaccgtaatagagcatctcgaacggttacaaaggaagcatggaggaatgctcgtaagaaacccactaagcagaaacagtacgcatgagatgtattggatatccaacggtactggaaatatagtcgcaagtgtaaatatggtctcaaggcttttattgaatcggttcaccatgactcatagacgacctaccattgaaaaagatgtcgatttaggagcgggcactcggcacgtaaatgctgaacctgaaacacctaacatggatgtaataggagaaagaatcaaaagaataaaagaagaacataatagcacatggcattatgatgatgaaaatccatataaaacgtgggcatatcatggatcttacgaggtaaaagctacaggaagtgcaagctcgatgataaatggtgttgttaagttattaacaaagccgtgggatgtcgtccctatggtaacacaaatggcgatgacggacaccactccattcggacaacagagagtatttaaagaaaaggtagatactaggaccccacgatcaatgccaggcacgcgacgagtcatgggaatcacagccgagtggctgtggaggacattaggaagaaataaaaagccaagactgtgtacaagggaggagtttactaaaaaggttaggacaaacgcagcaatgggcgccgtatttaccgaggaaaaccaatgggactctgccaaagcagcagtggaagatgaagacttctggaaactcgttgaccgagagcgagaattacataaacttggaaaatgcggcagttgtgtatacaatatgatgggtaaacgtgagaagaaacttggggagttcggaaaggcaaagggttcaagggccatttggtacatgtggcttggggcgagatatttagaatttgaagctctaggattcttgaacgaggaccattggttttcgagggaaaactcatactcaggggtggagggagaagggctccacaaacttggctatatactccgggacatctcaaaaattcctggaggagcaatgtacgccgatgacacggcaggttgggatactcgcataactgaagatgacttacataatgaggagaaaataacgcagcaaatggatccagaacacaggcagctggccaacgcaatttttaaattaacctaccagaacaaagttgtgaaagtccaaaggcccacaccaactggaacagtaatggacataatcagtagaaaagatcaaagagggtctggccaggtaggtacctacggattaaatacctttactaatatggaagcacaattaatcagacaaatggaaggcgaaggggttctgtcgaaagcggacttagaaaatccgcatttaccggagaagaaaattacccaatggctagagacgaaaggagtcgaacgactaaaaagaatggctatcagtggtgatgattgcgtagtaaaacctattgatgaccgcttcgcaaacgctctgctagctctaaacgacatgggaaaagtaagaaaagatattccgcaatggcaaccatcaaaaggttggcatgattggcaacaggtccccttctgcagtcaccattttcacgaactaattatgaaggacggcagaaaacttgtagtcccgtgtcggccccaggacgaacttatcgggagggcaagaataagtcaaggagcgggttggtcacttcgcgagacagcctgtttaggtaaggcatatgcacaaatgtggtcattaatgtactttcataggcgtgatttaagattggcctccaatgcaatctgttcagccgtgcctgtccattgggtgccaacttcaagaacaacatggagtatacatgcccaccatcaatggatgactactgaagatatgttaactgtttggaacagggtctggatagaagataatccctggatggaagacaaaacacctgttacaacatgggaaaatgttccatatttaggtaagcgggaagatcaatggtgtggtagtttgatcggattaacaagccgagctacatgggctcaaaatatcccaactgctattcaacaagtcagaagccttattggaaacgaagagttccttgactatatgccttcaatgaaacgttttagaaaagaagaagagtctgaaggggcgatttggtaa

SEQ ID NO: 23392 - RNA, 9873 nt, synthetic construct
  misc_feature 1..9873: note = derived and/or modified CDS sequence (opt6) from DENV-3__FJ639754__SS-prME
  source 1..9873: mol_type = other RNA
acaagcctttgccttatgatgattctgcccgccgctttagcatttcatttaacctcgagagatggtgaacctcgtatgattgtagggaaaaacgaacgtggaaaatcacttttgtttaaaaccgcatcaggtatcaatatgtgtacgttaatcgctatggatttaggagaaatgtgcgatgatacagtgacgtataaatgtcctcatattaccgaagttgaaccggaagatattgattgttggtgcaatctgacctcaacctgggtcacttatggaacttgtaatcaagccggcgaacaccggagagataaaagatctgttgccctagcgccgcatgtcggtatgggtctagatacaagaacgcaaacatggatgtcagcggaaggagcatggagacaagtagaaaaagtcgaaacatgggccttaaggcaccctggttttacgatcctagcattattcctggctcactatataggaacgagtttaacacaaaaagtagttattttcatcttgttgatgctagtgacccctagcatgacaatgagatgcgtgggtgttggtaacagagattttgtagaaggtttaagtggggcaacttgggtagatgtcgttctagaacacggcggatgcgtaactacgatggcgaaaaacaaaccaactctggatatagaacttcagaaaaccgaagccacccagctagcaactttacgcaaactatgtatagaaggtaaaattactaatataactacagatagtagatgtccaactcaaggagaggcggttttaccagaggaacaagatcagaactacgtttgcaaacacacgtatgtagataggggttggggcaacggatgtggattattcggaaaagggagtttggtaacttgcgctaaattccaatgcttagaacccatagagggcaaagttgtacagtacgagaacttaaagtacaccgtaataatcacagtgcacactggcgaccaacatcaagtgggaaacgagactcaaggggtaaccgcagaaatcacgccacaagcatcaacaaccgaggcaatacttcctgaatatggtactttaggtttggaatgttcgcctagaactggtttggactttaatgaaatgatactattaacaatgaaaaataaagcctggatggtgcacagacaatggtttttcgaccttcccctcccttggacttccggagctacaacagaaacaccgacttggaaccgaaaagaattgctagtaacattcaaaaacgctcacgctaagaaacaagaggtagttgttttagggtcccaagaaggtgcgatgcatactgcactgactggggccaccgaaatccaaaattccggtggaacatccatatttgcaggacacttaaaatgtcgactcaaaatggataagttggaattaaagggtatgagctacgcaatgtgcacaaatacattcgtattaaagaaagaggttagtgaaacgcagcacggaacaattctaataaaagtcgaatacaaaggggaagatgtcccatgcaaaataccattctccacggaagatggtcaaggtaaagcacacaatgggcgtttgatcacagcaaatccagtagtcactaagaaagaggaaccagttaacattgaagcagaacccccttttggagaaagtaatatagtaataggcattggagataatgcgctaaaaatcaattggtacaagaaaggaagttctattggtaaaatgtttgaagccacggcaagaggggctcgaagaatggccatacttggagacacggcgtgggattttggctcagtaggtggggtacttaattctctgggaaaaatggtacatcaaatattcggtagtgcctatacagcattattctcaggcgtctcttgggtaatgaaaataggtataggagttttattgacttggatcggtctgaacagtaaaaacacatccatgagctttagttgcatagctataggaataatcacattatacctaggggcggtagtacaagctgatatgggttgtgtaatcaattggaaggggaaagaattaaaatgtggaagtggcatattcgtgactaacgaagtacatacttggaccgaacaatacaagttccaagcggattcacctaaacgtttagcaaccgccattgctggcgcctgggaaaatggagtgtgcggtatcagatcaaccacgcgcatggagaatctcttgtggaaacaaatagcgaatgaattgaattatattttatgggaaaataatataaaactaaccgtggttgtaggagatataataggagtgttagagcaaggcaagagaacattaacgccgcaacctatggaactaaaatacagctggaaaacgtggggtaaagctaagatcgtcacagcagagacgcaaaactcatcgttcataatagacggtcctaacacaccagagtgtccttctgccagtagggcatggaacgtctgggaagtagaagactatggttttggggtatttaccacgaatatttggttaaaacttagagaagtatatactcaactatgcgatcatcggctaatgagtgcggctgtaaaagatgaacgggccgtccacgccgatatgggatattggattgaaagccagaaaaacggctcgtggaaactggaaaaagcgagcctaatagaagtcaagacttgtacatggcccaagtcgcatacattatggagtaatggggtattagaatctgacatgataatcccaaaatcattagccggtccaatatcacaacacaactatcgaccggggtatcatacgcagactgcaggtccatggcatctaggcaagttagagctggacttcaattattgcgagggtacaacggttgttattactgagaattgtggcacccgaggaccatcgttgcgaactacaacagtttccggaaaacttatacatgagtggtgctgcagaagttgtacactacccccgcttagatacatgggggaagacggatgttggtatgggatggaaataagaccaatatctgaaaaagaggaaaatatggttaagtccttagtgagcgctggaagtggtgaagttgataatttcacaatgggggtactatgtttagcgattttatttgaagaagtaatgcgggggaaatttggtaagaagcatatgatagctggtgtattctttacattcgtactcttattatcaggtcaaattacctggcgggacatggcccatactttgattatgataggtagtaacgcaagtgaccgtatgggcatgggtgttacctacctagcactaatagccacttttaaaattcaaccatttttggctcttgggtttttcctgcgaaaattaacatccagagaaaacttattgctcggagtaggtcttgccatggctactacactacaactacctgaggacatagaacagatggcaaatgggatagcgttgggcctaatggctctcaaactcattacacaatttgagacctaccaattatggacagccttaattagcctaacctgttctaatactatcttcacactaacggttgcttggagaactgccacactaattttagcgggagtttcattattaccggtttgtcaatcgagtagtatgagaaagacagactggttaccgatgacggttgcagccatgggggtcccgcccctccccctttttatattcagtcttaaggacactttgaaaagacgaagttggccattaaatgaaggagtaatggccgtcggtcttgtaagcattcttgcctcatcccttcttagaaatgatgtaccaatggccggtccgctcgtagccgggggactcctcattgcatgctacgtcatcacaggaacaagtgccgatctcactgtcgaaaaagcagccgatgtgacatgggaagaggaagcagagcaaacaggcgtaagtcataatctaatgataacagtagacgacgatgggacaatgagaatcaaagacgatgaaactgagaacatcttaacagtattgctgaaaactgctctattaatcgttagtggtatcttcccatatagtataccggcaacactattagtttggcacacctggcaaaaacaaacgcaaagaagtggagttttatgggatgtgccttctccacccgaaactcaaaaggccgaactggaagaaggagtttacagaataaaacaacaaggaatttttggcaagactcaagtcggagtgggggttcaaaaagaaggcgtttttcatacaatgtggcatgtgacacggggtgccgtcttgacatataacggtaaaagactagagcccaattgggcttcagtcaagaaagatctgatttcatatggtggcggatggagactaagtgcccaatggcagaaaggagaagaagtccaagttatcgcagtcgaacctggaaagaatcctaaaaattttcaaacaatgccgggaacctttcaaacaactacaggagaaataggagctatcgcattggattttaaaccaggaacaagtggttcgcccattataaaccgggaaggcaaagtagttggattgtatggaaatggtgtggtcactaaaaatggtggttatgtatccggtatagcacaaacgaacgcagaaccagacggccccacaccagaactagaggaggaaatgttcaaaaagagaaatttaaccataatggacttgcatcctggcagcggtaaaacacgaaaatatcttccagccattgtacgtgaggcaataaaaagacgactgagaacactgattttagcaccgactcgagtagttgcagcagaaatggaagaggctttaaaaggtttgcccatacgatatcaaacaacagccacaaaatccgaacataccgggcgagagatcgtagacttaatgtgtcacgcaacctttactatgagattattaagcccagttagggtgccgaattacaacttaattattatggatgaggcgcacttcacagacccagcctctattgcggcaaggggatacatatcaacgcgagtgggcatgggcgaggccgccgcaatttttatgacagccaccccgcctggaactgccgatgcctttccccaatccaatgcacccatacaggatgaagaaagggatattccagaaaggtcatggaacagtggaaatgaatggataactgacttcgctggcaaaacagtttggtttgtaccaagtataaaagccggtaacgacatagcaaactgcttaaggaaaaacggaaagaaggttattcaactatcacgtaagacttttgatacagaataccagaaaacaaaattgaatgattgggattttgtagtaacaacggatatatcagaaatgggagctaacttcaaagcggaccgggtcatagacccgagaagatgcctcaagcctgtaatcctaacggatggaccagaacgtgtgatactagctggtccaatgcccgtaacagcagcatcagctgcacaaagaagaggtagggtgggacggaaccctcagaaagaaaacgaccaatacatatttactggccaacccctaaacaatgatgaagaccacgctcattggacagaagcaaaaatgctactagataacatcaataccccggaaggaatcatccctgcattatttgaaccggaaagagagaaaagtgctgcaatagatggagaatatagactaaagggggaatcgaggaaaacttttgtcgaactgatgcgaagaggggatctacccgtgtggctcgcacacaaggtggccagcgaaggtataaaatacacggatagaaaatggtgttttgacggtcaaaggaataatcagatattagaagagaacatggatgtcgaaatttggacaaaagagggtgagaagaagaaactaagacctcgctggttagacgctcgcacttattcagaccccttagccttaaaagaatttaaggattttgcggctggaagaaaaagtattgccttagatctggtcactgaaataggaagagtaccatcacatcttgcccatagaacaagaaatgcattagataacttggtaatgcttcacacttctgaacacggagggaaagcatatagacacgcagttgaagaactacctgaaacgatggaaacgctattactgttaggtttaatgattcttctaacgggtggggccatgctctttttaatctcaggcaagggaataggaaaaacgagtataggtttaatttgcgtcatagcatcatcaggtatgttatggatggcagaaattcctctacaatggatagcctcggccatagtactggaatttttcatgatggtattgcttattcctgagccagaaaaacagagaactccacaagacaaccaacttgcttatgtagtaataggaatactaactcttgccgcaataatagctgcaaatgaaatgggtttactcgagactaccaaacgggatcttggtatgtcgaaggaacctggcgtagtgtctcctacatcctatttagacgttgatttacatcccgcatcagcctggacattgtatgcagttgctacaacagtaataactccgatgttaagacatactatagaaaattctacagcaaatgtcagcttagctgcaattgcaaatcaagccgttgtacttatgggattagataaaggctggccgatctcaaagatggatttaggagtcccgctcttagcattgggctgttattctcaagtaaatccattgacgctaacagcagcggtgcttttactaataacccattatgcaataatcggcccaggtctacaagctaaggccacaagggaggcgcagaaacggacagcagccggaattatgaaaaaccccacggttgatggcattatgacaatagatctagatccagtaatctacgacagtaaatttgaaaagcaattaggtcaagtcatgctattagtattgtgcgcagttcaactactgcttatgagaacttcctgggcactttgcgaagcactgaccctagccacggggccaataaccactctttgggaaggatctcccggtaaattctggaacacaacaatcgcagtaagcatggctaatatttttagaggaaactacttggcaggagccggattagctttcagcattatgaaatcagtgggaacaggaaaaagaggcacaggtagccaaggggagactctaggagaaaaatggaaaaagaagttgaatcaattgtctcggaaggaatttgacttatataagaaaagtggtattaccgaagtagatcgtacagaggcgaaggagggtcttaaaagaggcgagataacacatcacgccgtctcaagaggatcggcaaaactacagtggttcgtagaaagaaatatggtaataccggaaggtagggttatagacctaggatgtggaagaggtggttggtcttattattgtgcaggccttaagaaagtcacggaagtccgtgggtacacaaaaggtggaccgggtcatgaggaacccgtgcctatgagcacgtatggatggaatatagtaaaactgatgtcaggtaaagacgtgttctacctgccgccagaaaaatgtgatacgctgctatgtgatattggtgaatcctcacctagtccgacagttgaagaatcaaggacaatacgtgtattgaaaatggtagaaccatggcttaaaaacaatcaattctgtataaaggttcttaatccgtatatgcctactgtcatagaacaccttgaacgactacaaagaaaacacggtgggatgttggtgagaaatccgttatctagaaattccacgcatgaaatgtactggatatctaacggaacggggaatatcgttgcgtcagtcaatatggtgagccgactactcttgaatcggttcacgatgactcaccgacggcctacgatagaaaaggatgtagatttgggagcagggactagacatgttaatgcagaaccagaaaccccaaacatggatgtcattggcgaacgcattaaaagaataaaggaagaacataactcaacctggcattatgatgatgaaaatccctataagacttgggcctatcatggctcgtatgaggttaaagccacaggatcggcatccagtatgatcaatggcgttgtcaaactactaactaaaccgtgggatgtggtcccgatggtaacgcaaatggcaatgactgatactacaccatttggtcaacagcgtgtatttaaagaaaaagtagatactagaacgcccagaagcatgccgggaacacgtcgcgtcatggggatcacggccgaatggctctggagaacgttaggaaggaacaagaaacccaggctctgcacaagagaggagttcacaaagaaagttagaacaaatgcggcaatgggtgcagtgttcacagaggaaaaccaatgggattctgcgaaagccgcagtagaagatgaagacttctggaagctagttgatcgagaacgtgaattacataagctaggaaaatgtggttcttgcgtatataacatgatgggcaaaagagagaagaaactaggcgagttcggtaaggctaaaggtagtagggctatatggtacatgtggttgggtgcaagataccttgagtttgaagcattaggatttttgaacgaggaccactggttctcacgagaaaattcatattctggggttgaaggagaaggattacataaattagggtatatcttgcgagatataagcaaaattccaggaggagcaatgtatgcagatgatacggccggatgggatactcgcatcacagaggacgatttacataatgaagagaaaataacacaacaaatggatcctgaacaccggcaacttgccaatgcgattttcaaattaacatatcagaacaaagtggtgaaagtacaaagaccaactcccacaggcacagtcatggacataattagcagaaaagatcaacgaggttcaggtcaagtggggacgtatggattaaatacatttactaacatggaggcacaactaataagacagatggaaggagagggcgtattaagcaaagcagacctagaaaacccacatctccccgagaagaaaataacacaatggctcgaaacgaagggagtagagcgcctaaaacgtatggcaatttcgggcgacgattgtgtcgtaaaacctatagatgatcggttcgcaaatgctttattggctctaaacgatatggggaaagttcgtaaggatataccccaatggcagcccagtaagggctggcacgactggcaacaagttccattttgttctcatcactttcacgagctaattatgaaagacggtagaaaactcgttgtaccgtgtaggccgcaagatgaactaataggtagagcacgaatctcgcaaggggcaggatggtcactccgcgaaacagcctgtctaggaaaggcgtatgcgcaaatgtggtcgttaatgtacttccacagaagagatttgagactggccagcaatgcgatttgttcagcagttccagtacattgggtaccaacctccagaacaacatggtcaattcacgctcaccatcaatggatgacaactgaggatatgctgaccgtttggaatagagtatggattgaagataacccctggatggaagataaaacgccagttacaacatgggagaatgttccttaccttggcaagagggaagatcaatggtgtggatccttgataggtttaacatccagagccacctgggcgcaaaatataccaaccgctatccagcaggttagatccctcattggtaacgaagagtttctagattacatgccctcgatgaaaagattcagaaaagaagaagaaagtgaaggagcaatatggtga

SEQ ID NO: 23393 - RNA, 9873 nt, synthetic construct
  misc_feature 1..9873: note = derived and/or modified CDS sequence (opt6) from DENV-3__FJ639757__SS-prME
  source 1..9873: mol_type = other RNA
acgagtttatgtcttatgatgatcctacccgcagcacttgcgtttcatctaacatcacgggatggagaacctcgaatgattgtgggtaaaaacgaaagaggaaaatcgttactattcaaaaccgcaagtggaataaatatgtgtacgttaatagctatggacttaggagaaatgtgcgatgacacagtcacttataaatgcccacacataacggaggtagaaccagaagatattgattgctggtgtaatttaacatccacatgggtaacctatggaacatgtaatcaagccggtgaacatcgtagagataaaagatcagttgcacttgcaccacacgtagggatgggcctagatacacgaacgcaaacatggatgtctgctgagggagcatggagacaagttgaaaaagtggaaacttgggcactgagacatcccgggtttactatccttgcattatttctagcacactatataggcacgtcattaacccaaaaagtggttatatttatactactaatgctagtaaccccgtcaatgactatgagatgtgtaggagttggaaaccgtgactttgttgaaggtcttagtggagcgacatgggtagacgtagtattagagcatggtggatgtgttacgaccatggctaaaaacaaaccaactttggatattgaactgcagaaaacagaagcaacacaacttgcaacactaagaaaactgtgcatcgaaggcaaaattaccaacatcacaacagattcaagatgtcctacgcaaggagaagctgtcctgcccgaagaacaagatcagaattacgtctgcaaacatacctatgtcgaccgaggttggggtaatggttgcggccttttcggaaaaggaagcctagtcacatgtgccaaatttcaatgtttagaaccaattgaagggaaagtcgtacaatacgagaacttaaaatacacggttattatcacagtgcacactggcgatcaacatcaggtaggaaatgaaactcaaggtgttaccgcagaaataactccacaagcctctacaactgaagcaatcttaccagaatatggtacattaggacttgaatgttcacctagaaccggccttgactttaacgaaatgattctactcacaatgaaaaacaaagcatggatggtacatcgacaatggtttttcgacttaccgctcccgtggacctccggcgcaacgactgaaactccgacttggaatcgtaaagaattattagtaacattcaaaaatgcacatgcgaagaaacaagaagtagtagtactgggatcacaagaaggagctatgcacaccgcattaactggagcaacggagatacaaaactcaggcggcacctctatattcgctggacatctaaaatgtagactaaaaatggacaagttggaactcaaaggaatgtcatatgcaatgtgcaccaatacgtttgtcttaaagaaagaagtttcggaaacacaacatggaacaatcttaataaaagtagaatacaagggagaggacgtaccatgtaaaatcccttttagtacagaggacggtcaaggcaaagcacataatgggcgattaataaccgcgaacccagtagtaacaaagaaagaggaaccagtgaacatagaagcagaacctccattcggcgagtctaacatcgttattggcataggagatagcgcgcttaaaataaactggtataagaaaggctcatcgatagggaaaatgttcgaagcaacagctaggggtgcacgtaggatggcaattttaggcgatacagcttgggatttcggctcagtaggcggagtactcaatagtctcgggaagatggttcaccaaatcttcggatcagcctatacagcactatttagcggtgtatcctgggtcatgaaaattggcattggagtcctccttacctggattggactaaatagtaaaaatactagcatgtcattttcgtgcatagcaataggaatcataactttatatttaggagcggtagtgcaagccgatatgggttgcgtcatcaattggaaggggaaagaactaaaatgtggatctgggatatttgtgactaatgaggtgcacacctggacagaacagtataaattccaagccgactcaccaaagcgattagctacggcaatagctggagcttgggaaaatggagtttgcggcattaggagcactacacgcatggaaaacttattatggaagcaaatcgcgaacgaattgaattacattttgtgggagaacaacataaaattaacagtagttgtcggcgatatcatcggtgtcttggaacaaggaaaacggacacttaccccacaacctatggaacttaaatatagttggaaaacatggggtaaggcaaaaattgtaactgcggaaacacaaaattcttcgtttatcatagatggcccaaatactcccgaatgtccctcagcgagcagggcatggaatgtatgggaggtcgaagattacgggtttggagtatttactactaacatctggctaaaattaagagaagtgtatacacaactatgtgaccatcggttaatgtcagcagcagtaaaggatgaaagagctgtacatgctgacatgggatactggatagagagtcagaaaaacggttcatggaaactcgaaaaagcaagtctgatcgaagttaaaacttgtacctggccgaaatcacatactctatggagcaatggagtactcgaaagtgacatgattattcctaagtctcttgcaggcccaatctcacaacataattatcggcctggataccatactcaaactgccgggccatggcatctcggtaagctggaattagatttcaactattgtgaagggactactgtagtgattactgaaaactgcggtactcgaggaccgtcactacgtacgaccaccgtctcagggaaactaatacatgaatggtgctgtagatcatgtacgttaccacctctcagatacatgggtgaagatggatgttggtacgggatggaaattaggcctatctccgagaaggaagaaaacatggtgaaatcattagtaagtgcagggtcaggagaagtcgacaatttcaccatgggggtattatgtcttgcaatattgtttgaagaggttatgagaggtaagttcgggaagaaacatatgattgctggcgtattcttcacgtttgttttactattatccggacaaataacctggagggatatggcgcatacccttataatgataggatctaacgccagcgaccgcatgggtatgggagtaacctacctagctctcatagcaactttcaaaattcaaccgtttttagctcttggcttctttttaaggaaactgacgtcacgagaaaacttattgttaggagtgggcctagctatggctacaaccctccaattgccagaagacattgaacaaatggcaaatggtatcgcactaggcttgatggctctaaaattaattacacaatttgaaacataccaactctggacagcccttatatcgttaacatgtagtaacaccatttttacgttaactgtagcgtggaggacagcaacattaattttggcaggagtgtctttattaccagtttgtcaaagctccagtatgcgaaaaacagattggcttccgatgacagtggcagcaatgggagtccctccattgccactttttatattttctcttaaagacacgttaaaacgtaggtcatggccattgaacgagggtgttatggcagtaggtttggtaagcatcttggcttctagcctactgagaaacgatgtacctatggcgggaccactggttgcaggaggactattaatagcatgttacgtgattaccgggaccagcgctgatttgaccgtagaaaaagcggcagacgtaacgtgggaagaagaagcagaacaaacaggggtaagccataatctgatgataacggtcgatgacgacgggacaatgcggataaaagatgatgaaacagaaaacatacttaccgtattattaaaaacagctttgcttatcgtgtccggaatcttcccatattcgattcccgcaacattgctggtatggcatacttggcaaaaacaaacacaacggtctggagtgctttgggacgtaccgtcacctccggagactcaaaaggccgagttggaagaaggagtgtatagaataaagcagcaaggtatttttggtaaaacccaggtgggagtcggtgttcaaaaggaaggagtatttcatacaatgtggcatgttacacggggagccgtgttaacttacaacggaaaaagattagaacctaattgggcatccgtcaagaaagacttaataagttacggaggcggctggcgactaagtgcacaatggcaaaagggcgaagaagtgcaggttattgctgtagaaccagggaagaacccaaagaactttcaaacaatgccaggtacctttcaaacaacaacaggcgagataggagcaatagcacttgactttaaaccgggtacaagtggatcacctattattaacagagaaggaaaagtggtgggtctgtacgggaacggggtggtaaccaaaaatggtgggtatgtatccggtatcgcacaaactaatgcagaacctgacgggcccacaccagagctagaagaagaaatgtttaagaaaagaaatttaacgataatggaccttcatccaggctctggaaagacaagaaaatatcttcctgctatagtgagggaagcaataaagcgtcgactacgaacattaattttagcccccaccagagtggtagctgcagaaatggaggaagcactaaaaggattacccatccgataccagacgactgcgactaaatcagagcatacaggaagagaaattgtagacctcatgtgtcatgcaacatttacgatgcgactattatctccagttcgtgtacctaattataatctaattatcatggatgaggcacactttacagatcccgcaagcatagctgctaggggttatatctcaactagagtaggaatgggagaagcagcggcgattttcatgacagctacacctcccgggacggcagacgcatttccacaatcaaacgccccaatacaagacgaagaaagagacataccagaacgttcatggaactcgggaaacgaatggatcactgacttcgcgggtaagaccgtatggtttgttccatcgataaaagccggcaacgatattgccaattgtttgaggaaaaacggtaagaaagttatacaactctcgagaaaaacgtttgacacggaatatcagaaaacaaagttaaacgattgggattttgtagtaacaactgacattagcgaaatgggagcgaattttaaggccgatcgcgtgatagatccacgtagatgtttaaaaccagtcattctgactgacggacctgagagggtcatcttagctggaccgatgccagttacggcagccagtgcagcacaacgacgcggtagggttggaaggaaccctcaaaaagaaaacgatcaatatatttttaccggccaacccctaaataatgatgaagatcatgcccactggacggaggccaaaatgctgttggacaacataaatacacctgaaggtattatccccgccttatttgaacctgaaagggaaaaatcagcagccattgatggagaatacagactaaagggagaatctcgcaaaactttcgtcgaattaatgaggagaggtgatcttcccgtgtggcttgctcacaaagtggctagcgaaggtattaaatatacagacagaaagtggtgttttgatgggcaaaggaataatcaaatactagaagagaatatggatgtggagatttggacaaaagaaggggagaagaagaaacttagaccacgatggctagacgcccgtacttattctgatcctctagctttaaaagaatttaaagattttgccgcaggtagaaaatccattgcactggatctggttactgaaataggcagagttccaacacatttagcacaccgaacacgtaacgccttagacaacctagtaatgttgcacacaagtgaacatggaggtaaagcctatcggcacgccgtagaagaactcccagagacaatggaaaccctcttattattaggtttaatgatcctactaaccggaggagcaatgttgtttctgatcagcggaaaaggtatagggaaaacttctataggactaatttgtgttatcgcctcttctggaatgttatggatggcagaaatccctcttcaatggatagctagcgctatagtgttggaatttttcatgatggtgttgcttataccagaaccagagaagcaaagaacacctcaagacaatcagctggcttatgttgttatcggtatcctaacattggcagccataatagctgcaaacgaaatgggcttattagagacaacgaaacgagacttgggaatgtcaaaagaaccaggtgtggtatcgccaacatcgtatttagatgtagatcttcatccagcatcagcgtggacactttacgcggtcgccacaactgtaattaccccgatgctaagacataccattgaaaattccaccgcgaatgtatcactagccgcgatagcaaaccaagcagtggtactgatgggtctagataagggttggcctatctcaaaaatggacttaggcgtacctcttctcgcactaggatgttactctcaagtaaaccctttaacattgacagcagccgtactcctcttaataacacactatgcaattattggccctggtttacaagctaaagctacaagggaagcgcaaaaacggacggccgccgggataatgaaaaatccaacggtcgacggcattatgactattgatctagatccagttatatacgattctaaatttgaaaagcaattgggccaagtcatgctactggtactctgtgcagtacaactactcttaatgaggacttcctgggctctctgtgaagctctaactctagccacaggtcctatcacgacattatgggaaggctcgccgggaaaattttggaatacaactatcgctgtcagtatggcaaatatttttagagggagttacctagcaggagcaggcctcgcattctcaatcatgaaatctgtaggtacgggaaaacgaggaacaggcagtcaaggagaaactttaggagaaaaatggaagaagaaactcaaccagttatctcgtaaagaatttgatctatataagaaaagtggtataacggaggttgaccgtacagaggcaaaagagggtctgaaaagaggagaaattacccaccatgctgtatcaaggggatctgcaaaacttcagtggtttgtggagcgtaatatggttataccagaaggtcgagtaatagacttaggttgtggacgtggcggatggtcgtactattgcgcaggtctaaagaaagtaaccgaagtaagaggatatactaaaggaggacctggacacgaggaacctgtaccaatgtcaacatacggatggaatatagtaaaactaatgtccggaaaagatgtgttctatttaccaccagaaaaatgcgatactttgttatgcgatataggagagtcttcaccatcgccaacagtagaagaatcaagaacaatcagggtactgaaaatggtagagccatggctcaaaaataatcagttctgcataaaagtactaaacccctatatgcctacagtaatcgaacacctagagcgactacaaagaaaacacgggggcatgttagtaaggaatcctttatctaggaatagtacgcatgaaatgtactggatttctaacggaacaggtaatatagtagcgagcgtaaacatggtgtcaagattacttttgaatagattcaccatgactcacagacgaccgactatcgagaaagacgtagatctcggagcgggtacgaggcatgtaaacgcagaacctgaaacgccgaacatggatgtaatcggcgaaagaataaaacgaataaaggaagaacacaattcaacttggcattacgatgacgaaaatccctacaaaacttgggcttaccatggtagttatgaagtgaaagcgacgggatccgctagctcaatgataaatggcgtagtcaagctgcttacaaagccatgggacgtagtcccgatggtcacacaaatggccatgacggacaccacaccctttggacagcaaagggtctttaaagaaaaagtagatacaagaaccccacgcagtatgccgggcacacgccgagttatggggataacagcggagtggttatggaggactttgggaagaaacaagaaacctcgattgtgcacacgagaagagttcacgaagaaagtccgaactaatgctgccatgggtgccgtatttaccgaagagaatcagtgggattcagcaaaagcagccgtcgaagatgaagatttttggaaactcgtagatcgggagcgagaattgcacaaattaggaaaatgtggaagctgtgtgtataatatgatgggaaaacgggaaaagaagctaggcgagttcggcaaagccaaaggatcccgtgcaatatggtatatgtggctaggagcacgttatctcgagttcgaagcactgggattcttaaatgaagaccattggttttcaagggaaaacagttatagtggtgttgaaggagaagggttacacaaattgggttacatactcagagatattagcaaaataccaggcggagcaatgtacgccgatgacaccgcgggttgggacacaaggattacagaagacgacctccacaatgaggaaaagataacgcaacagatggacccagagcacaggcaactggcaaatgcgatcttcaaactaacgtatcagaacaaagtagtcaaagtacaacggcctactccaacaggaactgttatggatattatctctcggaaagatcagaggggtagtggacaggtggggacctacggcttaaatacattcacaaacatggaggctcaattgatacgtcaaatggagggagagggcgtcttgtccaaggcagatctagaaaatccgcatctacccgagaagaaaattacgcaatggctagaaaccaaaggggtcgaaaggttaaaaagaatggcaatatctggggacgattgtgttgtaaaacctatagacgacaggtttgccaatgcattgttagctctaaacgacatgggtaaagttagaaaggacataccacagtggcaaccaagtaaaggatggcacgactggcaacaagtccccttttgcagtcatcacttccacgaactgatcatgaaggatggacgcaaactggtagtaccatgtagaccacaagacgagcttataggtcgcgcacggatatcacaaggcgcgggatggagtctaagagaaacagcatgcctaggcaaggcttacgctcaaatgtggtcattaatgtattttcaccggcgggatttgcggttggcatctaacgcaatctgctctgctgttccagtacactgggtgcctaccagtcgaaccacatggagcatacacgcgcaccatcaatggatgactactgaagatatgttaactgtatggaatagggtatggatagaagataatccttggatggaggacaaaacacctgtcacaacctgggaaaatgtcccatatctaggcaaaagagaggatcaatggtgtggatcacttataggcctaacaagtagagcaacgtgggctcagaatatacctactgcaattcagcaagtaagaagtctaataggtaatgaagaatttctagactacatgccgtccatgaaaagatttcgcaaagaagaagaatcagaaggagcaatctggtag

SEQ ID NO: 23394 - RNA, 9873 nt, synthetic construct
  misc_feature 1..9873: note = derived and/or modified CDS sequence (opt6) from DENV-3__FJ639758__SS-prME
  source 1..9873: mol_type = other RNA
acttccttgtgcctgatgatgatcctgcccgctgcacttgcctttcatctgacaagcagggacggagagccacgcatgatcgtagggaaaaatgaacgtgggaaaagtttgttattcaaaacagcatcaggaattaatatgtgtactctaattgcaatggacttaggagaaatgtgtgatgataccgtaacttacaaatgcccacacataaccgaagttgaacctgaagacattgactgctggtgtaatctaaccagtacctgggtaacctatggaacttgcaatcaagcgggtgaacatcgaagagacaaaaggagcgtagcactagcaccacatgtaggaatgggattagatacaagaacccaaacatggatgtccgcagagggagcttggaggcaagtagaaaaagtcgaaacgtgggcgttaaggcacccgggtttcacaatattggcgctatttttagcccactacattggaacaagtctaacacaaaaagtagtaattttcatactcctaatgctagtaactccaagtatgactatgcgctgtgtaggggtggggaatcgagatttcgttgaaggattatcaggggctacgtgggttgacgttgtattggaacatggaggatgcgtaacgacaatggctaaaaataaaccgacgcttgacatagaattacagaaaacagaggccactcaacttgcaacacttagaaaattatgcatagaaggtaaaataactaatattaccacagactcaagatgccctacgcaaggtgaggcagtcctgcctgaagaacaggatcaaaactatgtgtgtaaacatacatacgtggatagagggtggggtaacggatgcgggttatttggaaaaggttcattagtaacatgcgcgaaattccaatgtctggagccaatagagggaaaagtagtgcaatacgaaaaccttaagtacacggtcattataacagtacacacaggagatcaacaccaagtgggtaatgagactcaaggtgtcactgcggaaatcaccccacaggcatcaactaccgaagcgatcttaccggaatatggtacactaggactggaatgcagtcctcgcacgggactagattttaatgaaatgattctcctcacaatgaaaaacaaagcatggatggtgcaccgacagtggttcttcgatttacctttgccatggacatcgggagccactacagaaaccccaacctggaatagaaaagagttattggtaacatttaaaaatgctcacgccaagaaacaagaggtcgtagtactaggctctcaagaaggcgcaatgcatactgctttgacaggggctacagaaatacaaaattcgggaggtacatcaatctttgctggacatttaaaatgtcgtttaaaaatggataaactagagcttaaaggtatgagctacgcaatgtgcactaataccttcgtacttaagaaagaagtatcagagacgcaacatgggaccattttaattaaagtggaatacaagggggaagacgtcccttgtaaaattccgttcagtacagaagatggacaaggaaaagcacataatggtaggctaatcactgccaatccggtagtaactaagaaagaggaaccagtaaacatagaagcagaaccaccctttggagaatcaaatatagttataggaattggtgataacgcactaaaaataaactggtataagaaagggtcaagtataggaaaaatgtttgaagcgactgccaggggtgccagacggatggcaattttaggagacacggcgtgggatttcggatcagtaggtggggtattaaatagtctgggtaaaatggtacatcaaatattcggaagtgcgtacactgcactcttcagcggtgtttcctgggtaatgaaaataggtatcggagtgttgttaacttggattggccttaatagcaaaaatacaagtatgagtttttcatgtatagctatcggtattattacactttacctgggtgccgtggtacaagcggacatgggatgtgtcataaattggaaaggaaaagaactcaaatgcggatccggaatatttgtaacaaatgaagtacacacctggacagaacaatacaaattccaggcagacagtccgaagagattagccactgcaatcgctggggcttgggaaaatggagtgtgcggtataaggtcaacaacaaggatggaaaacctattatggaaacaaatcgcaaatgaacttaattatatcctctgggaaaataacataaaactaacggtggtcgtaggagacgtaataggtgtactagagcaagggaagagaacacttactccacagccgatggaacttaaatattcttggaaaacttggggaaaggccaagatagtaacggccgagacacaaaactcatcttttatcattgacggccctaatacacccgagtgcccttcggcatccagagcttggaacgtttgggaagtagaagattatgggtttggcgtattcaccacaaatatatggttaaaattgagagaggtttatactcagctatgtgatcatagattaatgagcgcggcagtgaaagatgaacgagcggtccatgccgacatggggtactggattgaaagtcagaaaaacgggtcatggaagctagaaaaagcatcactaatagaagtaaaaacatgtacgtggcctaagagtcacacattatggtcaaatggcgtacttgaatccgatatgatcatacctaaatcgcttgcgggacctatttctcagcataattatcgaccaggttatcatacacaaactgccggcccttggcaccttggtaagctagaattggatttcaactactgcgaggggacaacagtagtcattacggaaaattgtggaaccagaggtccatctctgcgcacaacaacggtgtcaggaaagctaatccatgaatggtgctgtagaagttgcacattaccacctttacgatatatgggcgaagacggatgctggtacggcatggaaatacgcccaattagtgaaaaagaagagaacatggttaaatccttagtctctgctggctcaggagaggtagacaatttcaccatgggagtgttatgcttagctatactctttgaagaggttatgagaggaaaattcggcaagaaacacatgatagcaggagtattctttacatttgtactattactcagtggtcagatcacatggcgagatatggcacatacgttaataatgatcggatctaatgcatccgacaggatgggaatgggggtcacataccttgctcttatcgctacattcaagatccaaccgttcttggccctgggtttctttttaagaaaattaacaagtagggaaaatttgctacttggagtaggcctagccatggcaacaactctacaattgcctgaagatattgagcaaatggctaatggtatagctctaggtttaatggccctcaagttaataacacaatttgagacataccaattgtggacggctctaatcagccttacttgtagtaatacaatattcacactaactgtagcttggcgaaccgctacgctgatcctagcgggcgtatcactacttccagtctgtcagtcttcatccatgcgtaaaacagactggctcccgatgacagttgctgctatgggagtaccaccactaccattattcatattttcccttaaagacacgttaaaaaggcgaagttggccactaaatgaaggagtaatggcggtaggtctcgtttctatcctggcgagtagtctattaagaaatgacgtaccaatggccggtccattagtggcaggcggtcttctaatagcatgttacgtaatcacaggtacttcagcggacctaactgtagaaaaagccgcagatgtcacatgggaagaagaggcagaacaaacaggtgtgtcacacaatttgatgataacagttgatgacgatggaacaatgagaatcaaagacgacgagacagaaaatattctaacggtgctactgaaaaccgccctattaatcgttagcgggatttttccatattcaatcccagcgaccttgctagtctggcacacgtggcaaaaacaaacacaaagatctggggtgctctgggatgtgccttcaccacccgaaacgcaaaaagctgaattagaagagggagtctatcgtattaaacaacagggcatatttggaaaaacacaagttggagtaggggttcaaaaagaaggcgtgttccacactatgtggcacgttaccagaggagctgttttaacatataatgggaaacgtttagaaccgaattgggccagtgtcaagaaagatctcattagttatggtggagggtggaggttgtctgcacaatggcaaaaaggtgaagaggtacaggtaatagcagttgaacccgggaaaaatcccaaaaatttccagacaatgcccggaacttttcagacgacaacgggtgaaattggcgccatcgctctagattttaagcccgggactagcggaagccccataattaacagggaaggaaaagtcgtcggactatatggaaacggagtagttactaaaaatggtggatatgtgagcggaatcgcacaaaccaatgcagagccggatgggcccacgccagagttagaagaagagatgtttaaaaagcgcaacttaaccataatggatctacatccagggtcagggaaaactaggaaatacctaccagcgatagtacgagaagcgattaaaagacgcctccgaaccctaatattagctccaaccagagtggtagccgccgaaatggaagaggcactaaaaggtctgccaatacgttatcagacaacagcaacgaaatcagaacacacaggaagggagatagtcgacttaatgtgtcatgccaccttcacaatgcgcttattgtccccggtaagagtgccgaattacaatctcataatcatggatgaagctcactttacagatccggcttcaatcgcggctagagggtatatctcaacaagagttgggatgggagaggctgcagccatatttatgacggccactccacccggcactgcggacgcctttcctcaaagtaacgccccaattcaagatgaagaaagagacatacccgaacggagttggaactcaggcaatgaatggatcactgatttcgcaggaaaaacagtatggtttgtaccctcaataaaggcaggaaatgatattgcgaactgcttgcgcaaaaatgggaagaaagtaatccagctatcacgtaaaacattcgatactgagtatcagaaaaccaaacttaatgattgggactttgtggtaaccacagacatcagtgaaatgggcgcgaactttaaagcagatagagtaatagacccccgcagatgcttgaaacccgtaattctgacagatggtcctgagcgggtgattcttgcagggccgatgccagtaaccgcagcatcagcagcccaacgaaggggtcgcgtggggcggaatccccagaaggagaatgatcaatatatttttactggccaaccgttgaataatgatgaagatcatgcgcactggacagaagctaaaatgcttctcgacaatataaacacacctgaaggtattatcccagcccttttcgaacctgaacgtgagaaaagcgctgctattgatggagagtatagactgaaaggtgaaagtaggaagacattcgttgaattgatgagaaggggtgatctacctgtctggttagcgcacaaagtggcctcagaaggaataaaatatacagatagaaaatggtgttttgacggccagagaaacaatcaaatactcgaggaaaatatggatgtagaaatatggacgaaggaaggagaaaagaaaaagctaagacctagatggttggatgccaggacgtactcagatcctctggcactcaaggaatttaaagattttgcagcaggaagaaaaagcatcgcgttagatttagtgactgaaattggtcgagtaccgagccacctagctcatcggacaaggaacgccttagataatttggttatgcttcacacgtcagaacacggcggaaaagcatacagacacgcagtggaggagttgcctgaaacaatggagacactgcttttattaggcttaatgatattactgactggcggtgccatgctttttcttatttcaggtaaagggattggaaaaacaagcataggtttaatttgcgttattgctagcagcggaatgttatggatggctgaaataccgctacaatggatagccagcgcaatagtactagagttctttatgatggtgttacttatccctgaacctgaaaagcaaaggacaccacaagacaaccaactagcatacgttgtaataggaatcttaaccctagccgctatcattgccgcaaacgagatggggttactggaaacaacaaaaagagatctcggtatgagtaaagaaccaggagtggtgtcgccgacatcatacctcgatgttgatctacaccccgcatcggcttggacactgtatgccgttgcgactaccgtcatcacaccaatgctacgacatactattgaaaactcaacggcaaacgtcagcttagcagcgatagcgaaccaagcagttgtattaatgggactagataaagggtggccgataagtaaaatggatttaggggtaccgttacttgcattgggttgttattcacaggtcaacccgttaaccctaactgccgcagtattacttctaattacacattacgcaatcatcggtccgggcttacaagctaaagctacgcgtgaggcacagaaacgaacggccgcagggattatgaagaacccaactgtcgacggcataatgactattgacttagaccccgtaatatacgactctaagtttgaaaaacaattagggcaagttatgctcctagttttatgtgctgttcaactactactgatgagaacatcttgggcactttgcgaggctttgacactagcaaccggacctattactactttatgggaaggatctccaggaaaattttggaacacgacaatagcggtgtccatggcaaacatatttaggggctcctatttagctggtgcaggattagcatttagtataatgaaatctgtaggtacaggaaaaaggggtacaggttcacaaggtgaaacgctaggggaaaaatggaagaagaaattgaatcaacttagtagaaaggagtttgatttatacaagaaaagtgggatcacagaggttgatcgtacagaggcaaaagagggtctaaaaagaggtgaaataacacaccacgcagtctctagaggaagtgcaaaactgcaatggtttgtagagagaaatatggtaataccggaagggagagtgatagatttagggtgtggtaggggagggtggagctattattgtgccggccttaaaaaggtaaccgaagtacgtggttatactaagggcggtccaggtcacgaggagcctgtacccatgtcgacttatggatggaatatcgtgaaattaatgagtggcaaagatgtgttttacttaccgcccgagaaatgtgatacattactatgcgatataggcgagtctagtccatcgcctacagtggaggagtctagaacgatacgcgtacttaaaatggttgagccctggttgaaaaacaatcaattctgtataaaagtgttaaatccatacatgcctacagttgtagaacatttagaacgattgcagcgaaaacatggaggaatgcttgttagaaacccactatccaggaactctacacatgaaatgtactggattagtaacggaacaggaaatatagttgcatctgttaacatggtgtctagattattattgaatagatttacgatgactcacagaagacctacaatagaaaaggacgtagacttgggcgccggaacccgccacgtgaacgcagagcctgagacccctaacatggatgtaataggcgaaaggattaaaaggattaaagaggaacataacagtacatggcactatgatgatgaaaatccttataaaacgtgggcttatcatggaagctatgaggtaaaagccacaggtagtgcaagtagcatgataaacggggtagtaaaattactgacaaaaccctgggatgtagtgccaatggtaacccagatggcaatgacagacacaaccccgttcgggcaacaaagagtatttaaagaaaaggtggatacaaggacgccacgcagtatgcctggaaccagaagagtcatgggaatcaccgctgaatggctttggcgtacattaggaaggaataagaaaccgaggctttgcaccagggaagagtttactaagaaagtccgaacaaatgcggcaatgggagccgtatttaccgaagagaatcagtgggattcagcaaaagcagcagtagaagatgaagacttttggaaacttgtagatagagagcgggaactacataaattaggccgatgtggttcatgtgtgtataacatgatgggcaaacgtgagaagaaattgggtgagtttgggaaagcaaaaggaagtagagctatatggtatatgtggctgggcgccagatacttagaatttgaagcattgggttttctaaacgaagaccattggtttagtagggaaaactcttactctggagtcgaaggcgagggacttcacaaactcggttacatcttaagagatataagtaagataccaggcggagcaatgtacgccgatgatacagcaggctgggacacgaggataaccgaggatgacttgcacaacgaagaaaagatcactcaacaaatggatccagaacatcgacaactagcaaacgctatctttaaattaacatatcaaaataaagtggtaaaagtgcaaaggcccactccaaccggaacagttatggatataatatcacgaaaagaccaacgcgggtcaggtcaagtaggaacttatggacttaatacgtttacaaatatggaggctcaattaatccgtcaaatggagggagaaggagtacttagcaaggcggatctagaaaatccaaggttgccagagaagaaaattacgcaatggttggaaacaaaaggcgtagaacgattaaaaaggatggcaatatcgggtgatgattgtgtggtgaaaccaatagatgatagatttgctaatgcgcttttggccttaaatgatatggggaaagtacgtaaagatatcccacaatggcaaccgagtaaaggatggcacgattggcaacaagtaccgttttgttcacatcattttcacgaacttattatgaaagatggtcgaaaattagtggttccatgtcgacctcaagatgagctaataggcagagctcgtatatcccaaggtgcggggtggtcattacgggaaacggcatgcttgggcaaggcctatgctcaaatgtggtctctaatgtactttcatcgtagagacctccgtcttgcaagcaatgctatatgctcagctgtaccagtccattgggttccaacctctaggacaacatggagcatacacgcacaccatcaatggatgactacggaagatatgctcaccgtatggaatcgtgtttggatagaagacaatccatggatggaagataaaacccccgtcactacatgggaaaacgtcccatacttgggaaaacgagaggatcaatggtgcggatcacttataggcttaacgtcaagagcaacttgggcccagaacattccaacagctatacaacaagtacgttcattaattgggaatgaagaatttctcgactatatgcctagtatgaaaaggtttcggaaggaagaggaaagcgaaggagcaatatggtga

SEQ ID NO: 23395 - RNA, 9873 nt, synthetic construct
  misc_feature 1..9873: note = derived and/or modified CDS sequence (opt6) from DENV-3__FJ639759__SS-prME
  source 1..9873: mol_type = other RNA
acttctctttgtttaatgatgatcttaccggcagcattagcttttcacttaacttcgagggatggagagccgcgaatgatagtcggcaaaaatgaaagagggaaatcattattgtttaaaactgcgtcgggaataaatatgtgtactttaatagctatggacttaggagaaatgtgtgacgatacagttacgtataaatgtccccacataacagaagtggaaccagaagatattgactgctggtgtaatttaacttccacttgggtgacttacggaacttgtaatcaggcgggagaacatagacgagataaaaggagtgttgccctagctccccatgtgggaatggggctagatacacgaacgcaaacatggatgagcgctgaaggggcgtggagacaggtagaaaaagtcgaaacatgggccctgcgccaccccggatttacaattttagctttgtttcttgcgcattacatcggaacttcactaacacaaaaagtcgttatatttatcctattaatgttagtgactccctccatgacaatgaggtgtgtaggggttgggaatcgtgactttgtagaaggtctctcaggagccacatgggttgatgtagtactggaacatggcgggtgtgtcacaactatggccaaaaacaaacctacacttgatatagaattacagaaaacagaagcgacacaattagcgacgttacgaaaactatgcatagaaggtaaaataacgaatattacaactgactctcgttgtcccacccaaggcgaagctgttttaccagaagaacaagaccaaaactatgtatgcaaacacacctatgttgatcggggctggggtaatggttgtgggttatttgggaaaggcagtttagttacttgcgccaaatttcaatgtttagagccaatagaagggaaagtagttcaatatgagaaccttaaatatacagtaataataacggtgcataccggagatcagcatcaagtaggaaatgaaacacaaggagtaaccgcagaaatcacaccacaggcttcaactacggaagctattttgccggaatacggaacactggggcttgaatgttcacctcgtaccggactagactttaatgaaatgatattgctgacaatgaaaaataaggcttggatggttcatagacagtggtttttcgatttacctcttccatggacctctggagctacaactgaaacccctacgtggaaccgcaaagaactattagtaacattcaaaaacgcccatgccaagaaacaagaagtggtagttctagggagtcaagaaggtgcaatgcacacggcattaactggagcaacagagatacaaaattcgggaggaacgtcaatcttcgcaggtcatctaaaatgtaggctcaaaatggataaacttgagctaaaagggatgagctacgcgatgtgtactaacactttcgttttgaagaaagaagtatctgaaactcaacacggcacaattctgatcaaagtagagtataaaggggaggacgttccgtgtaaaataccattcagcaccgaagatgggcaaggcaaagcacataatggaagattgataactgcaaatccagtggtaaccaagaaagaagaacccgtcaacatagaagcagaacccccatttggagaatcgaacattgtaataggaataggggataatgccctaaaaatcaattggtacaagaaaggaagtagcatagggaaaatgttcgaggctactgcaagaggggcgcgaagaatggctattctaggcgatacagcatgggattttggatcagtaggcggtgtacttaattcccttggaaagatggttcatcagatttttggtagcgcatacacggctctattttccggtgtatcctgggtaatgaagataggtattggggtactcttaacatggattggcctaaactctaaaaacactagcatgagtttctcatgtatcgccattggaataataacgttatacttaggagccgtagtgcaagctgacatgggctgcgtaattaattggaaagggaaagaattaaaatgtggatcaggaatattcgttacaaatgaggtgcacacctggaccgagcaatacaaattccaagcagatagtcctaaacgcttggcaacagctatcgcaggcgcttgggagaacggtgtatgcggcatacgaagtacgacaaggatggaaaacctcctttggaaacagatcgcgaatgaattaaattatattttatgggaaaacaacattaagctaaccgttgttgtaggtgatactatcggtgtgttagaacagggtaaaagaaccttaacgccacagcctatggagttaaaatacagttggaaaacttggggaaaggcaaaaatagtaaccgcagaaacacaaaactcatcatttattattgacggtccaaatactccagaatgtccatcagcgagccgagcgtggaatgtttgggaggtagaggattatggattcggggtatttaccaccaacatttggttaaagttacgggaagtatatacacaactttgtgatcatagactaatgtccgccgcagtcaaggacgagcgagctgtacacgcggatatgggatactggatagaatcacagaaaaacggaagttggaaattagaaaaagcaagtctaatagaagtgaaaacatgtacatggcctaaaagccatactctgtggtctaatggtgtacttgaaagcgatatgatcattccaaaatcactagcaggaccaatatcccaacataattatcgtccaggatatcatacacaaacagccggtccatggcatttggggaaacttgagctcgattttaattactgcgaggggaccacagtggtcataacagaaaactgcggcacgagaggaccttctctaagaacaactaccgtaagtggtaaattaatacatgagtggtgctgtcgcagttgtaccctaccaccactaagatatatgggggaggacggatgttggtatggtatggagatacgtccaatctcagaaaaagaagaaaacatggtcaagtcccttgtttcggcagggtcaggggaagtggacaactttacgatgggtgtactatgtctcgcgatactattcgaagaggtaatgcgtggaaaatttggtaaaaagcatatgatagcgggagtgttatttacttttgttcttttattatcggggcaaatcacctggagggatatggctcatactttgattatgatcggaagtaatgcttcggataggatggggatgggagtgacatacttagccctgatagcgacttttaaaatacaaccgtttctggcgcttggtttctttctaaggaaactaacatctcgcgagaatcttttactaggcgtagggctagctatggctacgaccctacaattgccagaagatatagagcaaatggcaaatgggatcgccctaggacttatggccttaaaattgataactcaatttgagacatatcaactttggactgcattgatctctttaacatgcagtaatacaatcttcacattaacagtggcatggaggacagcgacactgattttggctggtgtatctctccttccagtttgtcaaagttcaagtatgaggaaaacagattggatacccatgacagttgcagcaatgggcgtaccccctttacccctatttatattttcactcaaagatactctaaaacgtcgaagctggcctctcaatgaaggcgtaatggcagtggggctcgtttcaatactagcaagctctctgttaaggaatgatgtacctatggccgggcccctagtcgccggagggctactaatagcatgctacgtaattacaggcacctcagctgatttaaccgtggaaaaggcagcagatgttacttgggaggaggaggcagagcaaactggcgtatcccacaatttaatgatcacagtagatgacgacggcaccatgagaataaaggatgatgagactgaaaatatactaacagtactgctaaaaactgccctcttaatcgttagtggaattttcccgtatagcataccagccacactcttagtctggcatacatggcagaaacagactcagcggagtggcgtactatgggatgtcccatctccacccgaaactcaaaaagcagaactcgaagaaggggtatataggatcaaacaacaaggtatctttgggaaaacacaagtcggagtcggtgttcaaaaagaaggagtgtttcacacgatgtggcatgtcacgcgtggagctgttttaacatataatggaaaacgtttagaaccaaactgggcctccgtaaagaaagatttaatatcgtacggaggaggctggagactaagcgcacaatggcagaaaggagaagaggtacaagtcattgctgtagaaccaggcaaaaatccgaaaaatttccaaacaatgccaggtacattccaaacgaccacaggtgaaataggagcaattgcactcgacttcaaaccaggaacttcaggttctccgatcatcaatagagaaggaaaaatcgtgggtctatacggaaacggtgttgttacgaaaaacggcggttacgtgagtggtatagctcaaaccaatgcagaacctgatgggccgacaccagagctagaagaagaaatgtttaagaaacgaaatttgacaataatggatcttcatccaggcagcggcaaaacaagaaagtatctacctgctatagttagagaagcgattaaacgaagactccgcactcttattttagctcccactagagtagtagctgctgaaatggaagaggcactaaagggcctcccaataagatatcaaacgagtgcaactaagagtgaacataccggtagagaaatcgtagacctaatgtgccacgcaacctttaccatgagactactctcaccagtacgggtcccaaattataacctaataattatggacgaagcccattttactgacccagcctccattgccgcccgtggttacataagcactcgagtgggaatgggagaggccgcggccatttttatgacagcaactccaccagggactgcagatgcttttccacaaagtaatgcacctatccaagacgaagaacgtgatattccagagcgttcttggaactctggaaatgagtggatcaccgattttgcgggtaaaaccgtatggtttgtgccctcgataaaagcaggtaatgatatagctaattgtctccgcaaaaatgggaagaaagttatccaattgtctagaaaaacattcgatactgagtaccagaaaaccaaattaaatgactgggactttgtcgttacaacagacatatcggaaatgggtgctaatttcaaagctgacagggtcatagatccccgtaggtgtctcaaaccagtgatactaaccgatggacccgaaagggtaatactcgctggtcctatgccagttacagcggcaagtgcagcacaaaggagagggagggtagggagaaatccccaaaaagaaaatgaccaatacatatttacaggccaaccactaaataacgacgaagatcacgcgcattggacggaggcaaaaatgttgttagacaacataaatacgccggaaggaattattcctgccctcttcgaaccagaaagagaaaaatccgcggcgatcgatggtgaatatcgcttaaaaggtgaatcaagaaagacttttgttgaacttatgcggcgaggagacttgcctgtctggctcgctcacaaagttgcatcggagggcataaagtacacagatcgaaaatggtgttttgatggacagcgaaataatcaaatattggaagaaaacatggacgtcgaaatttggactaaagagggtgaaaagaagaaacttcgtccccgatggctagatgcaagaacttactcggatcctcttgccttgaaagagttcaaggatttcgcagcaggcaggaaaagcattgctcttgatctagttacagagattgggcgagttcctacacatcttgctcatagaacaaggaacgcacttgataacctagtcatgttgcacacttcagaacacggcggaaaagcatataggcatgctgttgaagaacttccagagacgatggaaacattgctcctattaggcctgatgatccttttaacaggcggagcaatgttgttcctaatatcaggtaagggtataggaaagacgagtatagggctaatctgtgttatagctagttccggaatgctctggatggcagaaattccgttacagtggatagctagcgcaattgtcttagagttctttatgatggtacttttgatacccgaaccagaaaaacagcgaactccacaggacaatcagctagcctatgtagttattgggattctgacgctagctgcaatcattgcggctaatgaaatgggacttctagaaacaacaaaaagagacttaggaatgtcaaaagaaccaggagtcgtttcaccgacatcataccttgatgttgatttacatccagcaagcgcatggacgctctacgcggtggcgacaaccgtgattacacccatgctcaggcataccatagaaaattccacggcaaacgttagtctagcagcaatagcgaaccaggcagttgtcctcatggggctagacaaaggatggcctatatcgaaaatggatttaggtgtaccacttctagcattggggtgttatagccaggtaaaccctctaactttaaccgctgcagtgcttttacttataacgcattatgcaataattggcccaggcttacaagctaaagcaacaagagaagctcaaaagcgaaccgcagcgggcatcatgaagaaccctacggttgacggaattatgactatagaccttgaccccgtaatttacgattccaaattcgaaaaacaattaggtcaagtaatgctacttgttctatgtgctgttcagcttttgctaatgcgaactagctgggcgttatgtgaggcacttaccctagcaactggacccattacaacactatgggagggttccccgggaaaattctggaacacaacaatagccgtttcaatggccaatatctttcgaggatcgtacctagccggtgcaggtctcgcttttagtataatgaagtccgtgggaactggcaagagaggaacagggagtcaaggggagacactaggagaaaaatggaagaagaaattgaaccagttatcgcggaaagaatttgacctttataagaaaagcggaataacggaagtagacaggaccgaagccaaggagggacttaaaaggggagaaataactcatcacgcggtcagtagaggcagcgccaaactacaatggtttgtcgagagaaatatggttattccagaagggagagttattgacctaggctgcggaaggggaggatggtcgtactactgtgctggactaaagaaagtcacagaagtccgtggttatacaaaaggaggtccgggccacgaagaaccggtcccaatgtccacttacggttggaacattgtaaaattaatgagcggtaaggatgtattttacttgccgcccgaaaaatgtgacacacttctttgtgatattggagagtcaagtcctagtccaacagtcgaagagtcacgtacgattcgagtgcttaaaatggtggaaccatggctcaaaaacaaccagttctgcataaaagttttgaatccatatatgcccaccgtaatagagcatctagaaagactgcagaggaaacatggaggaatgttagtccgtaatccgttgagccgcaatagcacacatgaaatgtattggatatcaaatggtacaggaaacatagtagcgtctgtaaacatggtcagccgactactgctaaatagattcaccatgacgcacagaagaccgaccatagagaaagacgtcgacttgggtgctgggacaagacatgtaaatgcagaacctgaaactccgaatatggacgtaataggcgaacgaataaagcgtataaaagaagaacataattcgacgtggcactatgatgatgaaaacccatataaaacatgggcttatcatggatcttatgaagtaaaggcaacgggcagcgcatcgtctatgataaacggcgttgtaaaactactaactaaaccatgggacgtggtccccatggtcacccaaatggctatgactgatactacgccattcggacaacagagggtctttaaggaaaaggttgatactcgaaccccaagatcaatgccaggaacaagacgcgtaatggggataacggctgaatggctatggagaactctaggaaggaataagaaaccacgactatgcacgagggaagaatttactaagaaagtccgcacaaatgcagctatgggggctgtattcactgaagaaaatcaatgggacagcgctaaagcagcagtagaagatgaagatttctggaaattggtagatcgggaaagagaacttcacaaattaggcaaatgtggatcttgtgtatataatatgatgggtaaaagagagaagaaactcggcgaatttggaaaagctaaagggtcaagagcgatatggtacatgtggttaggagcaagatatttggagtttgaagcattagggtttttaaatgaagatcattggtttagcagagaaaattcgtatagtggagttgagggtgaagggctccacaaattaggatatatattacgagacatttctaaaattccgggtggagcgatgtatgccgatgatacggctggttgggatactagaataacagaagatgatctacataatgaagaaaagattacacaacagatggaccccgaacatagacaactagcaaatgccattttcaagttaacataccaaaataaagttgtcaaagtgcaacgaccgactcctaccggcacagttatggatattatatctcgaaaagaccagagaggaagcgggcaagttggaacatatggattgaacacatttacgaatatggaggcgcaattaatacgccaaatggaaggagaaggagttctctcaaaagcggacttggaaaacccacacttaccagagaagaaaattacacaatggttagagacaaagggtgtggagagattaaagagaatggctataagtggagatgattgtgtagtaaagcctatagatgacaggtttgccaatgccctgttagcattaaatgatatgggaaaggtaaggaaagatattccccaatggcaacctagtaaaggatggcatgactggcaacaagtacccttctgttcacatcacttccatgagctcattatgaaagacggacgcaaattagtagtcccctgtcgaccgcaagatgaacttataggaagggcaagaataagccaaggagctggatggtctctacgagagactgcgtgtctcggaaaagcatatgcacaaatgtggtctttaatgtattttcatagacgggatctcagattagcttccaatgcaatctgtagtgcagttcctgtacactgggtccccacaagtcgaacaacttggtcgatacatgcccatcatcagtggatgactactgaagatatgctaacagtctggaacagagtctggattgaagacaatccatggatggaggataaaacaccagtaacaacatgggaaaacgtcccgtacctagggaaacgagaggatcagtggtgtggtagtctaatcggtttaacttcaagggctacgtgggcacagaacataccaacggcaatacagcaagttagatctctcattggaaacgaggaatttctcgattacatgccatccatgaaacgattccgtaaagaggaagaatcagaaggtgccatttggtaa

SEQ ID NO: 23396 - RNA, 9873 nt, synthetic construct
  misc_feature 1..9873: note = derived and/or modified CDS sequence (opt6) from DENV-3__FJ639761__SS-prME
  source 1..9873: mol_type = other RNA
accagtctgtgtctgatgatgattttaccagcagcattagcttttcatctaacgtcaagggatggagaaccacggatgatagtaggtaaaaatgaaagagggaaatccctattatttaaaacagcgtccggaatcaatatgtgtactttaatcgcaatggacttaggagagatgtgtgacgatacagttacatataaatgcccacacataacagaggttgaacctgaagatatagactgctggtgcaacctaacttcaacctgggtaacctacggcacttgcaatcaagcgggcgaacaccgtagagataaaaggagtgttgcattggctccccatgttgggatgggacttgacacaagaacacaaacatggatgtccgcagaaggagcatggcgtcaggtagaaaaagttgaaacgtgggctttgcgacacccgggtttcacaattctagctctgttcttagctcattatataggcacctctttgacacaaaaagttgtcatttttatccttttaatgctagtaacgccatctatgacaatgagatgtgtaggtgttgggaatcgcgattttgtagaaggactaagcggggcaacttgggtagacgttgtattagaacatggcggctgtgttaccactatggcgaaaaacaaaccaacgctagacattgaattacagaaaacagaggcaacgcagctagcaacacttagaaaactgtgcatagaaggaaaaataactaatataactacagacagtagatgtccaactcaaggagaagcagtactaccagaagaacaagatcaaaattatgtatgcaaacacacatacgtcgacagaggatggggaaatggatgtggtcttttcggaaaaggtagtctcgtcacgtgtgcaaaatttcaatgcttacagcccatcgagggtaaagtagtccaatatgaaaacctaaaatacacggtcataatcacagtacatacaggggaccaacatcaggtaggcaacgaaacccagggagtaacagcagaaataactccacaagctagtaccacagaagctatattaccagaatatggtaccttagggctagagtgttctcctcgaacgggtcttgactttaatgaaatgatattgctaacaatgaaaaacaaagcgtggatggtccacagacaatggtttttcgacttaccactgccctggacctcgggcgcgacgacagaaaccccaacttggaacagaaaagaactactcgttacatttaaaaacgcacatgccaagaaacaagaggtagtagtattagggtctcaagaaggggcaatgcatacagctttaactggagcaactgaaattcaaaattctggagggactagcatttttgcgggtcatttaaaatgtcgtctaaaaatggataaacttgaacttaaaggtatgtcctacgcaatgtgtactaatactttcgtactgaagaaagaagtatctgagacgcaacatggaaccatcctgataaaagtagaatataaaggggaagacgtaccgtgcaaaattcccttcagtacagaagatgggcaagggaaagcacacaacgggcgattaataacagccaatccagtagtaactaagaaagaggaacctgttaatatagaagctgagccgccttttggtgaatccaacatagtaatcgggattggcgataatgctctaaaaataaactggtataagaaaggaagttcaatcggaaaaatgttcgaagcgacagcaaggggagcacggcgcatggcgattctaggagacaccgcgtgggatttcgggtcggtgggcggggtactaaattcattaggtaaaatggttcatcagatatttggttctgcatatactgcattgtttagtggagtgagttgggtaatgaaaattggaataggtgtattactaacctggattggtcttaatagtaaaaacaccagtatgagtttttcttgcatagcaattggaattatcactctatacttaggggccgtagtccaagctgacatgggctgcgttataaattggaaaggtaaagaactaaaatgcggttctgggatattcgtgaccaacgaagtacacacttggactgaacagtacaagtttcaagcagacagtcctaagaggttagccaccgcgatagccggtgcatgggagaatggtgtttgcggcattcgtagtacaacgaggatggaaaaccttctttggaagcagattgcaaacgaattaaactacatactttgggagaacaatataaagttaacagtagtggtgggggatataattggggttctggagcaaggtaaacgaacgctgacaccacaaccgatggaactgaaatattcatggaagacgtggggaaaggccaaaatagttactgcggaaactcaaaattcttcgtttattatcgacggccctaatactcctgaatgtccgtctgcttcaagagcatggaacgtctgggaagtggaagattacggttttggagtgttcaccaccaatatatggctaaagctgagagaagtatacactcagctttgcgaccaccggctaatgagcgcagccgtgaaggacgagagggccgtacacgcagatatgggttactggattgagtcacagaaaaacggatcctggaaattagaaaaagcatcattgatagaagtcaaaacatgcacatggcctaagtcacataccttatggagcaatggagtattagaatcagacatgataatcccaaaatcacttgcgggacctatatcacaacacaattatcgtccaggataccacacgcaaaccgctggaccttggcacctaggaaaacttgagctagatttcaactattgcgagggtacgacggtagttataacggaaaattgtggtacaagagggcctagtttgcgtacaaccaccgtatcaggaaaactcatacatgaatggtgttgcaggagttgtacattgccccctttacgctatatgggtgaggatggttgctggtatggaatggaaattagaccgatcagtgaaaaggaagaaaacatggtcaagtctttagttagcgccggttctggggaagtggacaactttaccatgggtgttctatgcctcgcaatattgtttgaagaagttatgcgaggtaaattcggaaagaaacatatgattgcaggggtattctttacgtttgtactgttactatccggccagataacttggagggatatggcacacacacttataatgataggaagtaatgcaagcgatcgaatgggcatgggggtaacttatttagctctaatagccacatttaaaatacagcctttcttagccctcgggttctttttgcgcaaactcacatcccgtgagaatttactattaggcgtaggtctagcaatggcaacaacattgcagttgcctgaagacatagagcaaatggcaaatggtattgctctaggtctgatggcgcttaaactgattacccaattcgaaacctatcagctgtggaccgccttgatttctttaacttgtagcaacacaatttttacactaaccgttgcatggcgaactgctacactgatactagccggtgtttcattactaccagtatgtcaatcctcatcgatgagaaaaacagattggttgccaatgactgttgctgcaatgggggttccacccctccccctgtttatcttcagccttaaagacacgctaaaaaggcgatcttggccactaaatgaaggtgtcatggcggtaggattagtttcaatacttgcatcaagtctactaaggaatgatgtacctatggcaggacccttagttgctgggggtttattaatagcatgctatgttataacgggaacttccgcagatttaacggtcgagaaggctgcagatgtcacctgggaagaagaagccgaacaaactggcgtgagtcacaacttaatgataaccgtagatgacgatggaaccatgagaatcaaagatgatgaaactgagaacatcttaacagtactcttaaaaacggccttattgatagtgagcggtatctttccctactcaattccagcgactcttttagtatggcatacatggcaaaaacagactcaacggagcggcgtactctgggacgttccatcgccgccagaaactcaaaaagcagaactagaagaaggggtttatagaatcaaacaacagggaatattcggcaagacccaagtgggagttggagttcagaaagagggggttttccataccatgtggcacgtgactcggggtgccgtactaacatacaatggaaaaaggctagagccaaactgggcaagtgttaagaaagacttaataagttatggaggaggatggcgattgtcagcccaatggcaaaagggagaagaggtccaagttatagcagttgaaccaggcaaaaaccctaaaaatttccagacgatgcccgggacattccagaccacgacaggtgaaataggagcaatcgctttagactttaaacctgggacatcaggatcgcctattatcaaccgggaaggaaaagtagtcggtttatacggcaacggagtagtaaccaagaatgggggatacgtgtcaggcattgcacagacaaatgctgaacccgatggaccaaccccagaactcgaagaagaaatgtttaagaaacgaaacctaacgattatggatttacatccgggaagtggcaaaacccgtaaatacttaccagctatagtacgtgaggcaatcaaacgacggttgaggacattaatactggctcccacaagagtagttgcagcagagatggaggaggcactaaaaggcttgccaatcagatatcaaactaccgccaccaaaagcgaacatacaggaagagagattgtagatctaatgtgtcacgccacatttacgatgcgtttgctatcgcccgtgcgagtaccaaattacaatctcatcattatggatgaagcacatttcacagatcctgccagtatagctgcaagaggttacattagcactcgagtaggaatgggagaggcagccgccatcttcatgaccgcaactccacctggtaccgcagatgcatttccacaaagtaatgcacctatccaagacgaggagagggatattcctgaaaggtcgtggaatagtgggaacgaatggatcacagattttgcaggaaagacagtttggtttgttccatccattaaggccggtaacgatatcgcaaattgtctccgcaaaaatggtaagaaagtgatacaattgtcaagaaaaacgttcgatacagaataccagaaaaccaaactaaatgactgggattttgtagtaacaacggatataagcgagatgggagctaatttcaaagcagatagagtaattgacccaagaagatgcttgaagccagtaatcttgactgacggacccgaaagagtaatactagcgggcccaatgcctgtcactgcggcaagtgccgcgcaaagaagagggcgtgtcgggagaaacccccagaaagaaaatgaccaatatatattcacaggacaaccattaaataatgatgaagaccatgcccattggaccgaagccaagatgttattagataacattaacacgcctgagggaattatcccggctttattcgagccggaaagagaaaaatctgccgcaatagacggtgaatatagactaaaaggggagagcagaaaaacgttcgtagagttgatgagacgaggagatctacccgtttggctagcacataaagtcgccagcgaaggaattaaatatacggaccgcaagtggtgcttcgatggtcaaagaaataatcagatattagaagaaaatatggatgtcgagatatggacaaaagagggcgagaagaagaaactaagaccacgctggctggatgctagaacttactctgaccctctagccctaaaagagtttaaggacttcgccgctgggcggaaatcaatagcgctcgatttggtgacggagataggtcgggttccgactcatctagcacatagaactagaaatgcactagacaatctagtcatgctacacacaagtgaacatggcggtaaagcctatagacatgcggtagaggaactcccggaaacaatggaaacactgctattactaggattaatgatattactaaccggtggtgtaatgttatttttgataagtggtaaaggaataggcaaaacttcaatcggacttatctgcgttattgcttcatctggcatgctatggatggcagaaataccacttcagtggatagcttccgcaatagtcttagagttctttatgatggtgttgctaattccggaaccggaaaaacaaagaacgccacaagacaatcaattagcgtacgttgttattggaatcctaacgctagcggcgataatagccgctaacgaaatgggtttattagaaactactaagcgtgatctaggaatgtcaaaggaaccaggcgtggtatccccgacctcgtatttagacgttgatctgcaccccgcttcggcttggactctttacgcggtagctactacagtaattacgcctatgctccgacataccatcgaaaattccacagctaacgtgagcctagccgcaatagccaaccaggcggtagtattaatgggactagacaagggatggcctatatcaaaaatggaccttggtgtcccattattagctttgggatgttactcacaggtaaaccccttaaccttaacggcagcggtcctattactaataacacattatgcgattattggacccggtctacaagctaaagcgacgagggaagcacaaaagagaacagcggcaggaataatgaaaaaccctacggtagatgggattatgactatagatctagatcctgttatatacgacagtaagtttgaaaaacaattaggtcaagttatgctcctggtattatgtgcggtacaattgcttttgatgagaaccagctgggctctctgcgaagctctgacattagcgacagggccaattacaacattatgggaaggaagtcccggaaagttctggaatactacaatagcagtttcaatggcaaacatattccgaggatcctatctagccggtgcgggcttagcattttcaataatgaaatcggtgggtaccggcaaacggggaactggtttgcagggagaaacattaggcgaaaaatggaaaaagaaattgaatcaattgtccaggaaagaatttgacttatataagaaatcgggaataactgaagttgacagaacagaggcaaaagaaggtttgaaacgaggtgagataactcaccatgccgtatctcggggctcagcgaaattacaatggtttgtagagaggaatatggtcatcccagaaggtagggtcatagatctcggatgcgggagaggtggatggtcatactattgcgctgggctgaaaaaggtaactgaagtaagaggatacacaaagggtggaccaggtcacgaggaaccggtcccaatgtctacttacggatggaatatagtgaaacttatgtctggaaaggacgtattttatcttccaccagaaaaatgtgacaccctcctttgtgatataggtgaatctagtccatcccctaccgtggaagaaagtcgtaccattagagttcttaaaatggttgaaccatggctcaaaaataaccaattctgtataaaggtattaaatccatatatgccaacggttatagagcacttagaacggttacaacgcaaacatggcggaatgttagtaaggaatccattatcccgtaactcaactcatgagatgtactggatatctaatggaacaggcaatatagttgcaagcgttaatatggtgagtcgattactacttaatagatttacgatgacccaccgtcggcccacaatagaaaaggacgttgatcttggtgctggcacaaggcatgtgaacgcggagccagaaacacctaatatggacgtgatcggagaaagaataaagcgaattaaggaggagcacaattctacatggcactacgatgatgagaacccgtataaaacctgggcataccatggctcatacgaagtaaaagcaacaggctctgcatcaagtatgattaatggagtagtaaaattactaacgaaaccatgggatgtagttcctatggtcacacagatggcaatgaccgatacgacaccattcggtcaacaaagagtatttaaagaaaaagtcgatactagaactccaagatcaatgcctggaacaagacgggttatgggaatcacagctgagtggttgtggagaacgctaggtagaaacaagaaaccaaggttatgcacccgtgaggaatttaccaaaaaggtgcgcacgaatgctgccatgggtgctgttttcaccgaagagaaccaatgggactcagcaaaggctgccgtagaggacgaagacttttggaagctagttgatagagaaagagaattacataaattaggaaagtgcggatcatgcgtatataacatgatgggaaaaagagaaaagaaactaggcgagttcggaaaagcaaaaggtagtagagcaatatggtatatgtggttaggcgcacgatatctcgaatttgaggcccttggctttttgaacgaggatcattggttctctagagagaacagttattctggcgtcgaaggagaaggattgcacaaactcggctatattctacgggatataagcaagataccaggaggggcaatgtatgctgacgacacagccggatgggacaccagaataacagaagacgacttacataatgaagagaaaatcacacagcagatggatcctgaacaccgccaacttgccaatgccatatttaaactgacataccaaaataaagtggttaaagtccagagacctactccaacgggtacagtaatggatataataagtagaaaggatcaacgaggtagcggacaagttggaacatatggtttaaacacctttacaaacatggaagctcaacttatacgtcaaatggaaggagaaggagtactaagtaaagcagatctagaaaacccacacttacccgagaagaaaattacacaatggttagaaacaaaaggagtagaaagactcaaacgaatggcaataagtggagatgactgtgtagtaaaaccgatcgacgaccgttttgccaatgctttacttgctcttaacgatatgggtaaagtaagaaaagacattccacaatggcagcctagtaaaggttggcatgactggcagcaggttccattctgctcgcatcattttcacgaactaattatgaaagacggaagaaaacttgtagtcccatgcaggcctcaagatgagctaataggacgagccagaataagccaaggagcaggatggtcactaagagaaacagcctgtctaggaaaagcctacgcacagatgtggagtcttatgtactttcaccggagagatctcagattagcaagcaatgccatatgttccgctgtaccagtacattgggtaccaacttcacgtacaacatggtctatccacgcacatcaccaatggatgacaactgaggatatgttaactgtatggaacagggtctggatagaggataatccctggatggaagataagactcctgtaacaacatgggagaatgttccatacctgggtaagcgcgaagatcaatggtgtggatcgttgatagggttaacttctagggctacttgggcacagaacatacccacagccatacaacaagtcaggtcactaatcgggaacgaagaatttttagattacatgccatctatgaaaagatttagaaaagaagaagaaagcgaaggagcgatatggtaa

SEQ ID NO: 23397 - RNA, 9873 nt, synthetic construct
  misc_feature 1..9873: note = derived and/or modified CDS sequence (opt6) from DENV-3__FJ639762__SS-prME
  source 1..9873: mol_type = other RNA
acctccttatgtctcatgatgattttacctgcagcattagcttttcatttaacctcacgtgatggtgaaccgcgcatgatagtaggcaaaaatgaaaggggaaaaagcctacttttcaaaaccgcatctggaatcaacatgtgcacattaatagcaatggaccttggagaaatgtgtgatgatactgtaacctataaatgccctcacatcacagaagttgaaccagaagatattgattgttggtgtaatctcacttcaacatgggtaacttacggaacttgcaatcaagcaggagaacatcgaagggataaacgatcagttgcgttagctccccatgttgggatggggttagatactcgtacacaaacttggatgagtgctgaaggagcatggagacaagtagaaaaagtagaaacttgggcacttagacatcctggctttacaatccttgccctcttcctggcacactacataggtacgagtttgacccaaaaagttgtaatcttcatactcttaatgctagttacaccatctatgacgatgaggtgcgtaggcgttggcaacagagatttcgtagaagggttatccggcgctacatgggtagacgtagtacttgagcatggaggctgtgtgacaacaatggccaaaaacaaacctacactggacatcgagttacagaaaactgaagctacccaattagcaacgctaagaaaactttgtattgaaggcaaaatcacaaatatcaccacagatagtagatgtccgacacaaggcgaagcggtactcccggaagaacaagaccagaattatgtttgtaaacatacgtatgtggacagaggatggggaaacggatgtggactattcggaaaaggttcattagtaacctgtgctaaattccaatgtctagaacccatcgaaggaaaagtggtacaatatgagaatttgaaatatacagttataattacagtacataccggggatcaacaccaggtaggcaacgaaacacaaggggtaaccgcagaaataacaccccaggctagcacgactgaagcaatattaccggaatatggaacattaggactcgaatgcagcccacgaacagggctcgacttcaacgaaatgatcctactaactatgaaaaataaagcatggatggtacatcgacagtggttctttgatctgcctctcccttggacttccggagcaacaaccgaaactcccacgtggaatcgtaaagaattactggtgacatttaaaaatgcacatgccaagaaacaagaagttgtggtattagggtctcaagagggtgcgatgcacacagctctaactggggctactgaaatacagaacagcggcggaacttcgatatttgctggacacctgaaatgcagattaaaaatggataaacttgaattaaaaggtatgagttatgcaatgtgtacaaatacgtttgttctgaagaaagaagtatctgaaacacaacatggtacaatactcatcaaaatagaatataaaggtgaggacgtaccttgtaaaatcccattctctacagaggacggtcagggtaaagcacacaacgggcgattaataactgcaaacccagtagttaccaagaaagaagaacccgttaacatagaagcagaaccgcctttcggagaatccaatatagtgatcgggatcggggataatgccctaaaaataaattggtataagaaaggatcatcaataggcaaaatgtttgaagcaacggcgaggggagccagacgcatggccattttaggagatactgcatgggattttggaagcgtaggaggggtattgaacagtctaggaaaaatggtccatcaaatatttggatcagcttataccgccttattctctggagtaagctgggtaatgaaaataggaatcggggtattgttaacgtggataggactcaacagcaagaatacatctatgagtttctcttgtatagccattggaataattactctatatcttggtgcagtagtacaagcagacatgggttgcgtcatcaactggaaaggaaaagaattaaaatgtggaagtggaatctttgtaactaatgaggttcacacatggacggagcagtataaatttcaagcagactcccccaaacgtctagcgacagcaatagcaggagcgtgggaaaatggcgtttgtggtataaggagtactacgagaatggagaatctcttatggaaacaaattgctaacgaactaaattatattctatgggaaaataatattaaactaaccgttgtagtcggagatataatcggagtactagagcaaggcaaacgaacacttacgccgcaaccaatggaactcaaatactcatggaaaacttggggtaaagccaaaattgtgacagctgagacccaaaatagcagctttatcattgacgggccaaatacaccggaatgcccaagtgcgtcaagagcttggaatgtatgggaagttgaggattacggatttggggtcttcacgactaatatctggctgaaactcagggaagtgtatacacaactgtgtgaccacaggttaatgagcgccgcagtcaaggatgaaagagcagtacacgcagatatgggatactggatagaatctcagaaaaatggtagttggaaacttgaaaaagccagtttgattgaagtcaaaacctgtacttggcccaaatcacatacactatggtcaaatggggtcctagagagcgacatgataattcccaaatcacttgctgggcccataagccaacacaactacagacccgggtatcatacacaaacagctggtccatggcatctcggtaagttagaattagatttcaattactgtgaaggaacgacagtcgttattacagagaactgcggaacccgtggcccgagtctaagaacaaccaccgtctcaggtaaattgatacacgagtggtgttgcaggtcctgcactcttccgcccttgcgatacatgggggaggatggctgctggtacggtatggaaatacgaccaatttcggaaaaagaagagaatatggtgaaatcattggtatccgcaggaagtggtgaggttgacaacttcacaatgggagtattgtgtttagctatactatttgaagaggttatgcggggaaaattcggaaagaaacatatgatcgcaggaatctttttcacattcgttctattgttaagcgggcagattacgtggagagacatggcccatacccttatcatgataggtagcaacgcatcagaccggatgggaatgggggttacatatttagcgttaatagctacatttaaaatccaaccatttttggctttaggattctttttgaggaaattaaccagcagagaaaatttactcttaggcgtgggattggctatggccactactctgcaactaccggaggatatcgaacaaatggcaaacggtattgcccttggtcttatggcactaaaattgataactcaattcgaaacataccaattatggacagccctaatctctctaacatgctctaacactatattcacgttaacagtagcgtggagaacagcaacattaatactggcaggagtcagcttgctgccagtatgtcagagctcaagcatgcgaaagaccgattggctacctatgacagttgccgctatgggagtacctccgcttccattgtttatattctctttaaaagatactcttaagaggcggagttggccactgaacgaaggagtgatggcggtaggcctggtatcaatattagccagcagtttattacgtaatgatgtacctatggctggacccttagtagcgggtggtttattgatagcttgttatgtaattacaggtacaagtgcggatctaacggttgaaaaagcagcggatgttacatgggaagaggaggccgaacagacaggagtgagtcataacttgatgataactgtggacgatgacgggacaatgcgaattaaggacgatgaaacagaaaatatattaaccgtgttgcttaagactgcacttttgatcgtaagtgggatatttccttacagtataccagctacattgttagtttggcacacgtggcagaaacaaacgcaacgttcaggggtactatgggacgtaccaagtccaccagaaacgcaaaaggcagagttagaagaaggagtctatagaatcaaacaacaaggtatcttcggtaagacacaagtaggcgtaggcgtgcagaaagaaggtgtctttcacaccatgtggcacgtaacccggggtgcggtattaacttacaatggcaaaagactagaaccgaactgggcatcagtcaagaaagatttaatcagctatggtggtggttggagactaagtgcacagtggcaaaaaggagaagaagtccaggttatagcagttgaaccggggaaaaaccccaaaaactttcagacgatgccaggtaccttccaaacaacaacaggagaaattggagcaatcgccctagattttaaaccaggaacaagcggctctcctataataaacagggagggaaaaattgtcgggctttatgggaacggtgtagttactaagaatggcggttacgtatccggcatagcacaaacgaacgcggaaccagacgggcctacaccagaattagaagaagagatgttcaaaaagagaaatctaacaattatggatctacatccaggctcgggcaaaacaagaaaatacctgccagcgatcgtaagagaggcaattaaaagacgactacgcaccctaatccttgcaccaacaagggtcgtagcagccgaaatggaagaggctttgaagggactaccgattcgatatcagactacagcgacaaaatccgaacacacaggacgagaaatagtagatctgatgtgtcacgcgaccttcacgatgcgtctactcagtcctgtaagagtacccaattataatttaataataatggacgaagcccatttcacagaccccgcgtctatagcagcacgtggttacatatcaaccagggttggaatgggagaagccgcagcaatctttatgaccgcaacaccacccggcacggcagatgcgtttccgcaaagcaatgcgcctatccaagacgaagaacgagacatacccgaaagatcatggaactctgggaatgaatggatcactgattttgcaggaaaaactgtctggttcgttcctagtataaaagccggcaacgatatcgcgaactgtttgagaaagaatggcaagaaagttattcagctatcacgtaaaacatttgatactgaataccaaaagaccaagttaaatgattgggatttcgtagtaactacagacatcagtgagatgggagcgaactttaaggccgaccgagtaatagatccccgtcgatgcctaaaaccagttatactgacagacggaccagaaagagttatacttgcgggtcctatgcctgtgaccgccgcatctgccgcacaacgcaggggtagagtgggcagaaacccacagaaagaaaatgaccaatatatctttacaggacaaccattgaacaatgacgaagatcatgctcattggactgaagctaaaatgctactcgacaatataaatacaccagaaggaatcattccagcgttattcgaacccgagagagaaaagagcgcagcaatcgatggggagtacagactaaaaggagaaagtcggaagacattcgttgaacttatgagacgtggcgacttacccgtctggctcgcacacaaagtggcatctgaagggataaaatatactgacagaaaatggtgtttcgatggccagagaaacaatcaaatacttgaagaaaacatggacgtagaaatttggactaaggaaggagagaagaagaaactaagaccaaggtggctagatgcgagaacttactcagatccgttagccctgaaagaatttaaggacttcgcagcaggtcgcaaatccatagccttggacctggttacggaaattggacgagtaccaacccatcttgcacataggacaagaaatgcccttgacaatttggtaatgttacataccagcgaacacgggggaaaagcgtatcgtcatgctgtagaggaacttcctgaaacaatggaaactctactcctattgggattaatgattttattaactggaggcgctatgctgttcctaatctctggaaagggaataggaaaaacctcaatcggcctgatatgcgtaatagcaagctctggcatgttgtggatggcagaaataccgctacaatggatagctagcgcaatagtactggaatttttcatgatggttttattaattcccgagccagaaaaacaaagaacgccacaagacaaccaattggcatatgtcgtgattggaatactaacacttgccgcgataatcgcagctaacgaaatgggattattagaaactacaaaaagagacctaggcatgagtaaagaacctggagtagtatcaccaacgagttatcttgatgtagacttgcatcctgcaagcgcttggacactgtacgcagtagcaacaaccgtcataacaccaatgcttagacatacaatagaaaactcaacagcgaacgtttcgctagcggctatcgctaatcaagcagtagttctgatgggattggacaagggttggccaatttccaagatggatttaggtgtacccctattagcgcttggttgctatagtcaagtcaaccctctaactctgacagcggcggtcttactgttaatcactcattatgcgataatagggccgggcttacaagcaaaagcaacaagagaagcacagaaaaggacagccgcaggaataatgaaaaacccaactgtagatggtataatgacaatagaccttgatccagtaatatacgattcaaagtttgagaaacaactcggccaggtaatgcttttagtactatgcgcggtacagttgttgttaatgagaaccagttgggcgctttgcgaagcactaactttggcaacaggacccattaccacattatgggaaggttccccaggtaaattttggaacaccaccatcgcggtgtcaatggccaatatcttcagaggttcctatctagcaggggctggcttagcgttcagcattatgaaatcagtaggaactggaaaaagggggacaggctcccagggagaaacgctaggagaaaaatggaagaagaaactgaatcaattatcgcgtaaagagttcgacttatacaagaaatcgggtattacagaggtagatcgcactgaggcaaaagaaggtctgaaaagaggggaaataacacatcacgcagtaagtagaggatccgcaaagctgcaatggttcgttgagcgaaacatggtcatccctgaaggaagagtcatagacttaggttgtgggagaggtgggtggtcctattattgcgccgggttaaagaaagtaacagaagtgaggggatacactaaaggaggacccggccacgaggaacccgtaccaatgtcaacctatgggtggaacatcgtgaaactaatgagtgggaaagacgtcttttatttaccaccagagaaatgtgacactctgctttgtgatattggagagtcgtcaccatcacctacggtagaagaaagcagaacgataagggtcctaaaaatggtagagccttggctaaagaataaccaattttgtatcaaagtcttaaacccatatatgcccaccgttatagagcacttagaaagattacaacgaaagcatggaggcatgttagttagaaacccactatcccgaaatagcacgcatgaaatgtattggatatccaatggtacgggaaacatagtggcgagtgtcaatatggtaagcagactattactaaacagatttacgatgacacacagaaggcccaccatagaaaaagacgtagaccttggagcaggcacacggcatgtaaacgccgaaccagaaacgcctaatatggacgttatcggcgaaagaataaaaaggataaaagaggaacataatagtacttggcactatgatgatgaaaatccatacaagacctgggcatatcatgggtcttatgaagtgaaagcaactgggtcagcttcatcaatgataaatggcgtcgtaaaactcttgactaaaccatgggatgtagttccgatggtaacacagatggcaatgacagatacaacgccatttggacaacagagagtctttaaggagaaggtagatacacgaacaccaaggtcaatgccaggtacaaggagagtaatgggaattaccgctgagtggttgtggcgcacattaggccgaaacaagaaacccagattgtgtacgcgtgaagagtttacaaagaaggtgaggacgaatgcggctatgggtgctgtatttacagaagaaaatcaatgggattcagctaaagccgcagtagaagatgaagatttttggaagttagtagacagagaacgagaactacacaaactaggaaaatgtggatcgtgcgtatacaatatgatgggaaagagagaaaagaagttaggtgagttcggaaaagctaaaggcagtagggccatatggtatatgtggttaggtgcccgatacttagagtttgaggctttgggatttctcaatgaagatcactggttctctagggaaaacagctatagcggcgtcgaaggggagggtttgcacaaattaggctatatcctcagggacatcagcaaaataccaggaggggcaatgtacgctgatgataccgctggatgggatactaggatcactgaggatgatctacataacgaggaaaagattacgcaacaaatggatccagagcaccgacaattagcaaacgccatatttaagttaacgtatcaaaataaagtagttaaagtacagcgaccaactccaaccggtacggtaatggacataatatcccgaaaagaccaaagagggagcgggcaggtaggaacctacggtctgaacactttcacaaatatggaagctcagctaataagacaaatggaaggtgaaggggtactatcgaaagccgacttggaaaacccccatctaccagaaaagaaaataacacagtggctagaaaccaaaggcgtcgagcgcttaaaaagaatggccattagtggtgacgactgcgttgttaaacccatcgacgatagatttgctaacgctctattagccctgaatgatatgggaaaggttagaaaggatataccacagtggcagccttcgaaaggatggcacgattggcaacaggttccattctgtagtcatcatttccatgaacttattatgaaagatgggagaaaacttgtggtaccatgcagacctcaggacgaattgattggtagagccagaatctctcaaggggcggggtggtccttaagggaaacagcatgtttgggaaaggcttatgctcaaatgtggagcctgatgtatttccacaggagagacctaagacttgcatcaaacgccatatgctcagcggttcctgttcattgggtacctactagccgtaccacctggagtattcatgcccatcaccaatggatgacaactgaagacatgttaactgtttggaatagagtatggattgaagataatccatggatggaggataagactccagtaacaacctgggagaacgttccatatctaggtaagcgcgaagatcaatggtgtggcagcctaataggactaacgtccagagcaacttgggctcagaatattccaacggcgatacagcaagtgcgtagcttgatcgggaatgaagagttcctagactacatgccaagtatgaaaagatttagaaaggaagaggaaagcgaaggcgcaatatggtga

SEQ ID NO: 23398 - RNA, 9873 nt, synthetic construct
  misc_feature 1..9873: note = derived and/or modified CDS sequence (opt6) from DENV-3__FJ639763__SS-prME
  source 1..9873: mol_type = other RNA
acaagtttgtgtcttatgatgatcctaccggcagctttagcgtttcacctaacatcgcgcgacggagaaccccgaatgatagtgggcaaaaatgaaagaggtaaaagtctgttatttaaaaccgcatctggaatcaacatgtgcacattgatcgcaatggacttaggtgaaatgtgcgacgatacagtcacgtacaaatgccctcacatcacggaagttgaacccgaagacattgactgctggtgtaacttaacctccacatgggtcacatacggtacgtgtaaccaggcaggggaacacaggagagataaaagaagcgtagccctagctccacatgtagggatggggctagatacacgaacacaaacctggatgtcggcagaaggtgcatggagacaagtagaaaaagttgaaacatgggctttaagacatccaggatttactatcttagccctattcctagcacattacatagggacatccttgacccaaaaagcagttatatttattttacttatgttggttacgccatctatgacaatgagatgtgttggagttggtaacagagacttcgttgaaggattaagtggcgcgacatgggtagatgttgtacttgaacacggtggctgtgtgacaactatggctaaaaacaaaccgacactagacatagaactacagaaaactgaagcgacacaactggcaacactaagaaaattatgcatcgaaggcaaaataaccaacatcactactgattctcgatgtcccacacagggggaagcggtcttacccgaagaacaagatcaaaactatgtttgcaaacacacgtacgttgacagaggctggggcaatggttgcggattatttgggaaaggaagtctcgtgacatgtgccaaatttcagtgcctggaaccaatagaagggaaagttgtacaatacgaaaatttaaaatatacagtaattataacggtacatacaggcgatcaacaccaggtaggaaacgaaacacaaggagtaacagccgaaattactccacaagccagtaccactgaagccatactaccagaatacggaactttgggactagaatgtagcccgcgtacaggtcttgattttaatgaaatgatactattaacgatgaaaaataaagcgtggatggtacataggcaatggttctttgacttgccattaccttggacaagtggagcgacgactgaaactccaacatggaatcgaaaagagttgttggtaacctttaaaaacgctcacgcgaagaaacaagaagtagtggtactaggttctcaagaaggggccatgcatactgcactaactggggcaacggaaatacaaaattccggcggaacaagtatattcgccggacatttaaaatgtaggttaaaaatggataaattagaattaaaaggaatgtcttacgcaatgtgcacaaatacgtttgtactcaagaaagaagttagtgaaactcaacatggaaccattctaatcaaagttgaatataaaggtgaagacgttccatgtaaaattcccttcagtacagaggatggacaagggaaagcacataatggacgcttgattacagcaaatccagtggtcactaagaaagaagaaccagtcaacattgaagccgaaccaccctttggggagagcaatatagttataggcatcggagacaatgccctaaaaataaattggtataagaaaggcagttcaataggtaaaatgtttgaagctacggcacgaggagctagacgtatggccatactaggtgacacagcttgggacttcggatcagttggaggtgtattgaacagcttaggaaaaatggttcaccaaatatttggaagcgcttacaccgcacttttctcaggggtgtcgtgggtgatgaaaattggaataggagttttattaacgtggattggactaaattcgaaaaacaccagtatgtcattttcttgcattgcaataggcatcattacgctatacctaggcgctgtcgtacaggccgatatggggtgtgtgattaattggaaaggtaaagaattaaaatgtggatcgggaatatttgtcaccaatgaggttcacacatggacggaacaatataaattccaagcagattctccaaaaaggttggcgacggcaattgccggtgcttgggaaaatggagtatgtggcattcgctcgaccacccggatggaaaatttgctttggaaacaaatcgcaaatgaactaaactatattttatgggaaaataatatcaaacttactgtagtggttggcgatattataggcgtacttgaacaggggaagcgcacactgacccctcaaccaatggagcttaaatactcctggaaaacgtggggcaaggctaaaatagtaacagcagaaactcaaaacagctcatttataatagatggtcctaatactccagagtgtccatcagcctcgagagcttggaatgtatgggaagtagaggattatggcttcggagtgttcaccacaaatatctggttaaaattaagggaggtctacacacaactatgtgaccatcgcttaatgtcagcggctgttaaagatgagagagcagtccatgcagatatgggctactggattgaatcccagaaaaacggaagctggaaactcgaaaaagctagtctaattgaggtaaagacatgtacatggcctaaatctcacaccttatggagcaatggtgtccttgagtcagacatgattatacccaagtcactggcaggacccataagccaacataattatcgacccggataccatactcaaaccgctggcccttggcatctcggcaagctggaattggattttaattattgcgaaggaaccacagtcgttattacagaaaactgtgggacaagaggacctagcctacgcactacgacagtaagcgggaaactaatacatgaatggtgttgtagatcttgtactttgcccccactacgttatatgggggaggacgggtgttggtacggtatggaaattcgtccaatttcggaaaaggaagaaaatatggtgaagtcgttagtatctgccggttcaggggaagtagacaatttcacgatgggggtactgtgtttagcgatattgttcgaagaagtaatgagaggaaagtttggcaagaaacatatgattgcaggagtattctttacgtttgtattattacttagtgggcagataacgtggcgagacatggcacacacgctgataatgataggtagtaatgccagcgatagaatgggcatgggagtaacatatttagcattaattgccacttttaaaatccaaccctttcttgccttgggcttctttcttagaaaattaacttcaagagaaaacttactgctaggagtaggattggcaatggccactacattgcaacttcccgaggacatcgaacagatggcaaatgggatagcacttggattgatggccctaaaattaataactcaatttgaaacataccaattatggacagccttaatttctttaacatgctcaaacaccatattcaccctaactgtggcctggagaacagcgacactcattttggctggtgtatcgctgttaccggtgtgccaaagttcctcaatgagaaaaacagattggttacctatgaccgttgcagcgatgggggtacctccgctacccctgttcatattcagtcttaaagacactctcaaacgaagatcctggcccttaaatgaaggtgtgatggcggttggattagtttcaatactagcaagcagtttattacgtaacgatgttccaatggctggaccacttgttgcgggcggattactaatcgcatgttacgtcattacaggaacaagtgctgatcttacggttgagaaggcagcagatgtgacctgggaagaagaggcggaacaaactggagtctcccataacttaatgattactgtagatgatgatggtacgatgcgtataaaagatgacgaaactgaaaatattctcacagtactacttaaaacagcattattaatagtctcggggatttttccatatagtataccggcaactcttttagtttggcacacatggcaaaagcagacccaacgtagcggagttctttgggacgttccttcaccaccagaaactcaaaaggccgagctagaagaaggtgtctaccgaatcaaacaacaaggcatattcggcaaaacacaggtaggtgtaggcgtccaaaaagaaggcgtatttcataccatgtggcatgtaacacgaggtgcggtccttacttataatggcaaaagactagaacctaactgggcatccgtgaagaaagatctgatttcgtacggagggggatggcgtctaagtgcacagtggcaaaaaggagaggaggtacaggtcattgccgtagaacccggtaaaaatccgaaaaacttccaaacgatgccaggtaccttccaaaccacgacaggagaaatcggtgctattgccctagatttcaagcctggcacatcggggagcccaattataaatcgtgagggtaaggtggtaggattatacgggaatggagtggttaccaaaaatggtggatatgtttcaggaattgctcaaaccaacgcagaaccggacggaccaacaccagaactagaggaagaaatgttcaaaaagagaaatttaaccataatggacttacacccaggaagcggcaaaactagaaagtaccttccagctatagtaagggaagcaataaaaagaaggttgcgtacacttatcttggctccaacaagggtagttgcagcggaaatggaagaggcccttaagggactacccataaggtatcagaccactgcaacaaaatcagaacatacgggacgcgaaatcgtagatctaatgtgtcacgccacgttcaccatgcgactgctctcgcccgtccgcgtaccaaattacaacctaattattatggatgaagcccactttactgacccagcaagtattgcagcaaggggttacataagtacaagggtgggaatgggagaagcagcagcaatattcatgactgcaaccccacccggtacggccgatgcatttccacagagcaacgcccccattcaagacgaagagagagatatacctgaaagatcatggaactcaggaaatgagtggataacagattttgcaggcaagacagtatggtttgtaccaagtattaaagcaggtaatgatattgctaactgcctgcgcaaaaatggtaaaaaggtgatacaattgtcacgaaaaacctttgatacggagtatcagaaaacaaaattaaatgactgggattttgtggttacaaccgatataagcgaaatgggagcaaattttaaggccgatagagtaatcgatccgaggcgatgtttgaaaccagttatactgaccgatggaccagaacgggtcatattagcaggaccaatgccagtaacagccgcgagtgcagcacaaaggagaggacgcgtgggtcggaacccgcagaaagaaaacgatcagtatatctttactggccaaccccttaataatgatgaagaccatgctcattggactgaagcgaaaatgttgttagataatatcaatacaccagaaggaataatacccgcattatttgaacctgaacgtgagaaaagcgctgccattgacggtgaatatagactaaagggagaatctcgtaaaacgttcgtagaattaatgcgccgcggagatttgcctgtttggctggcacacaaagtagctagtgaagggattaagtatacggataggaaatggtgtttcgacggccaacgaaataatcagatattagaagaaaatatggacgtggagatatggacgaaagagggcgagaagaagaaacttagacctaggtggctcgatgcaagaacatattctgaccctcttgcactaaaggagtttaaggactttgctgccggaagaaagtcaatagccctagacttagtaaccgagatcggaagagtaccctctcatctggcacacagaacccgtaatgcacttgacaatttggtcatgctacatacaagtgaacatggaggtaaagcataccgacacgcagttgaagaactacccgaaacaatggagaccctgcttctactaggattaatgatcttattaacagggggcgctatgttatttttgatcagcgggaaaggcatagggaagacaagtataggtcttatatgtgtcatagcctcatcaggaatgttatggatggctgaaattcctctgcaatggattgcatcagccatagtactagagttctttatgatggtactgctcataccagaacccgaaaaacagaggacccctcaagataatcagctcgcatacgtggttattggtatattgacactggcggcaataatagcggctaacgaaatgggtttgctcgaaactacaaagagggatcttggcatgtcgaaagaacctggggttgtgtcacctacatcgtatttagatgtagatctccacccggcaagtgcatggacgttatacgctgtagcaacgactgttattactccaatgctcagacacacaatagaaaattctactgcgaatgtatctctagcagcgattgctaaccaagcggttgtgttgatgggacttgataaaggttggcccatctcgaagatggacttaggagtacccctcctagcgctaggttgttacagccaggtaaacccgttgacacttactgcagccgtgctactattaatcacacactacgccataataggacctgggttacaggctaaagctacacgagaagcgcaaaaacggactgctgcaggaataatgaaaaatcctacagtagatggtataatgacaatagatttggacccagttatttatgacagcaagtttgaaaaacaattgggtcaagtcatgcttttggtactatgcgcagtacaactattattaatgaggacatcgtgggccttatgtgaagccttaaccttggctacaggacccataaccaccctgtgggagggtagcccagggaagttttggaatacgacaattgctgtgtcaatggctaatatatttcgcggatcatacttagcgggagccggattagcgttttccattatgaaatcggtcggaactggaaagcgcggtacaggatcacaaggtgagacattaggtgagaagtggaaaaagaagttaaaccaactaagtcgtaaggagttcgacttatacaagaaaagcggaattactgaagttgatagaacagaagcaaaagaaggattaaaaagaggagaaattactcaccatgctgtaagtaggggatccgcgaaactacaatggtttgtggagaggaatatggttataccagagggtagagttatagacttaggttgcggaagaggaggatggtcatattactgtgctggccttaagaaagttacagaggttagaggatataccaagggcgggcccggacatgaagaaccagtcccaatgagtacttatggatggaatatagttaaactaatgagtggaaaagatgttttctaccttcccccagaaaaatgcgacacgttgttatgtgatatcggagaatcatcaccatcgccaactgtagaagaaagccggacgattcgagttcttaaaatggtcgaaccttggcttaaaaataatcaattctgcattaaagtactaaacccatatatgccgactgtaattgagcatttggaaagactccaacgaaaacatggaggtatgttagtgcgaaatccattaagcaggaatagtacacatgaaatgtattggattagtaacggcacaggcaatatagtagccagcgtaaatatggttagtagactgctcctgaatcgatttacaatgacacacagaagaccgacaattgagaaagacgtagaccttggagcaggaaccagacacgtcaatgctgaaccggaaacaccaaatatggacgttataggtgagcgaatcaagagaataaaagaggaacataactcaacatggcactacgacgatgagaatccgtataaaacttgggcttatcacgggagttacgaggtaaaggccacaggatccgcgagttcgatgattaatggcgtagtcaagctcctaacaaaaccgtgggatgttgtacctatggtaactcaaatggctatgacagatactactcccttcggacaacaacgagtttttaaagaaaaagtggatactcgaacgccaaggtctatgccgggaacaaggagagtaatgggcataacggccgaatggctatggagaactctcggaagaaataagaaaccgcgtttgtgcacgagggaagaatttacgaagaaagtacgtacaaacgctgctatgggcgctgtattcacggaagaaaatcaatgggatagtgcgaaagcagcagttgaagatgaggacttctggaagttagtagatagggaaagagaattgcataagctagggaaatgtggatcgtgcgtgtataacatgatgggtaagagagagaagaaattaggtgaatttgggaaagctaaaggaagcagagccatatggtatatgtggctgggggcaagatacctagaatttgaggctctggggtttcttaacgaagaccactggtttagcagagaaaattcatattctggggttgaaggagagggactccataaactgggctacatacttcgcgatataagcaaaattccgggaggagcaatgtatgcagacgacacagcaggatgggatacacgaataactgaagatgatctgcataacgaagagaaaataacacaacaaatggacccagaacaccgacagctagcaaatgcaatattcaaactaacttaccaaaataaagtcgttaaagtacaaagacctactccaaccggcaccgttatggacatcatatctagaaaagaccagcgtggatcaggacaagtaggtacatatggactgaacacgttcactaatatggaagcacaattaataagacaaatggaaggagaaggagtcctgtctaaggccgacttggaaaaccctcatttaccagagaagaaaattacgcaatggttagaaacgaatggcgtagagagattaaaacgaatggccattagtggcgatgattgtgtagttaaacccatagatgatagatttgccaatgcactccttgcacttaacgatatggggaaagtccgaaaagacattccgcaatggcagccgtcgaaaggatggcatgactggcaacaagtaccattttgtagtcatcattttcatgaattaataatgaaagacggtagaaaactcgttgtcccgtgtaggcctcaagacgaattaattgggcgggctaggatcagtcagggagccggatggtcgttacgagaaaccgcgtgcctaggaaaggcttatgctcaaatgtggtcacttatgtattttcacagacgggatctgcgtctagcgtccaacgctatatgtagtgcagttcccgttcactgggtacctaccagcagaacaacttggtcaattcatgcacatcatcaatggatgactacagaagatatgttgacggtttggaatcgtgtatggatagaagataatccgtggatggaagataagacaccagttactacgtgggaaaacgttccgtacctaggcaaacgcgaagaccaatggtgtggctcgcttattggactcacatcgcgtgcgacatgggcccagaatataccaacagctatacaacaagtacgaagccttataggtaatgaagaatttttagactatatgccatcaatgaagcgttttagaaaagaagaagaaagcgagggtgccatctggtaa

SEQ ID NO: 23399 - RNA, 9873 nt, synthetic construct
  misc_feature 1..9873: note = derived and/or modified CDS sequence (opt6) from DENV-3__FJ639765__SS-prME
  source 1..9873: mol_type = other RNA
acaagtctatgcttaatgatgattcttcctgctgctttagcttttcatctcacctctcgagatggtgaaccacgaatgatcgtaggtaaaaacgaaagaggcaaatctctcctattcaaaactgctagtggtattaatatgtgtacgttgatcgcaatggatttaggagagatgtgtgatgacacggtaacgtacaaatgtcctcatataaccgaagtcgaaccagaagacattgattgttggtgtaacttgacttcgacctgggttacttatgggacatgcaatcaagcaggagaacaccggcgtgataaacggagtgtagcacttgcaccacatgtgggtatgggattagacactagaacacaaacttggatgagtgcggaaggtgcgtggcgacaagtagaaaaagtagaaacctgggcgctaagacatcccggattcactatactggcgctattcttagctcactatataggtacatcattaacccaaaaagttgtaatattcatactactcatgcttgttacccccagtatgacgatgaggtgtgttggagtcgggaatcgtgactttgtagagggactttcaggcgcaacgtgggtagatgtcgtacttgagcatggcggatgcgtgacgacgatggccaaaaataaacctactctcgatatagaactacagaaaacggaggctacccaattagctactctaagaaaattatgtatagagggaaaaataactaatattaccaccgacagtagatgtccaactcaaggcgaagcagtactcccggaagaacaagaccagaactatgtttgcaaacatacctatgtagatcgtggctggggaaatggatgtggtttatttggcaaaggatcgcttgtcacgtgtgccaaattccaatgtctagagcccatagagggtaaagtagttcaatatgaaaatttgaaatacacagtaataataaccgtacacaccggggaccaacaccaagttggaaacgagacacagggagtcaccgctgaaatcacaccacaagcgagtaccaccgaagcaattctgccggagtacggcacacttggcctggaatgcagtccacgaaccggtctagattttaacgaaatgattctactaacgatgaaaaataaagcctggatggttcacagacaatggttctttgacctccccctaccctggacttcaggagcaacaacagaaacaccaacttggaaccgaaaagagctccttgtaacgtttaaaaatgctcatgccaagaaacaagaagttgtagtcctaggcagccaagagggtgcgatgcatacagcactaaccggcgcaacagagattcaaaatagcggaggaacaagtatattcgctggtcatttaaaatgtcgcttgaaaatggataaacttgaactaaaaggcatgagttatgcaatgtgtaccaatacctttgtacttaagaaagaggtaagtgaaacacagcatggaacaatactaattaaagtcgaatataaaggagaagacgttccatgtaaaattccattttccacagaagacggacaagggaaagctcataatggacgactgatcactgcaaatccggtagttactaaaaaggaagaaccggttaatatcgaagctgaacctccttttggggagtctaacatcgtaataggaattggggataacgctcttaaaataaattggtacaaaaagggaagctcaataggaaagatgttcgaggctaccgctcgaggagcacgtagaatggcaattcttggagatacggcttgggattttggatcagttggaggtgtactaaattctctgggcaaaatggtacaccaaatttttggatctgcttataccgcattgttttcaggagtatcatgggtcatgaaaataggaatcggagtgcttctgacgtggattgggcttaacagcaaaaatacgagtatgtcgttctcatgtatcgcgattggtataatcacactttatttgggcgccgtagtacaagcggatatgggatgcgtcattaattggaaaggcaaggaactaaaatgcgggtcaggaatatttgtaacaaatgaagtgcatacttggactgaacaatataaatttcaagcagattccccaaagcgactagcaactgccatagctggcgcatgggagaatggcgtttgtggcatccgatcaacaaccagaatggagaacctcttgtggaagcagatagcaaatgaacttaattacattttgtgggaaaataatataaaactgacagtcgttgtcggggacataattggagtgctcgaacaaggaaaacgcacacttactccacagccgatggaactaaagtacagttggaaaacctgggggaaagctaaaatagttacggcagagacccaaaacagtagtttcataatcgatggaccgaacacgccggaatgtccgtcagcaagcagagcatggaatgtatgggaagtagaagattacggctttggtgtctttaccacaaatatttggctaaaactcagggaagtgtatacccaattatgcgatcatagactaatgtcagcagcagttaaggatgaacgtgccgtgcacgcagacatgggttactggatagaatcacaaaagaatggaagctggaagctagagaaagctagtttaatagaagtaaagacatgtacgtggccgaaaagtcatacgttatggtctaatggagtattagagtccgacatgattattccaaagagcctagctggcccgataagtcaacacaactaccgacctggttatcacactcaaactgcaggaccatggcacctcggtaagctagaactagacttcaactattgcgaaggcaccacagttgtcataacggaaaactgtggcacaagagggccaagcctacgaactaccacagtatcaggcaaacttattcatgaatggtgttgtcgtagttgtacattacctcctctaagatatatgggagaagatggttgctggtacggaatggagatacgaccgatatcagaaaaggaagagaatatggtgaaaagcctggtatccgcaggatcgggagaagtagataacttcacaatgggtgtattatgtctggcaatcctatttgaagaagtaatgagaggtaaatttggaaagaaacatatgatagcgggtgtattctttactttcgttttactactaagtgggcaaattacttggagagatatggctcacacacttataatgatcggaagcaacgcttctgatcgtatgggcatgggagtgacttatctggccctcattgcaacttttaaaattcaaccattcttagccttaggatttttcttaagaaaattaacaagtcgtgagaatttgctactgggcgtgggtttggctatggcgacgaccttacaacttccagaagacatcgagcagatggctaacggaatcgcacttggactgatggcactgaaactcattacacaattcgaaacttaccaactttggacggccttaatatctttaacgtgttcaaatacgattttcactttaacggtagcgtggcgcacggctaccctaatactagctggagtttcccttttacctgtgtgtcaaagctctagtatgagaaaaactgactggctaccaatgaccgtggcagcgatgggggttccacccctgccgctatttatatttagtctaaaggataccttaaagcggagaagctggccactgaatgagggcgtaatggcggttggcctagtctcaatattagcctctagccttttaagaaatgacgtccctatggcgggtccactggtagcgggtggattgcttattgcttgttatgttatcacaggtacaagtgctgatctaacggtcgaaaaggctgctgatgttacttgggaagaagaggcagaacaaacgggtgtctctcataatctgatgataacggtagatgatgatggaacaatgaggataaaagatgatgaaactgaaaatattcttacagtacttctaaagacggcattactaatcgtaagtggaatatttccatacagtatcccagcaacgctattagtttggcatacttggcaaaaacagacccagagaagtggagttctatgggatgtgccatcacctccagaaacacagaaagccgaattagaagaaggcgtatatagaatcaaacaacagggcatctttggtaaaacacaggttggtgtaggagttcaaaaagaaggagtatttcatactatgtggcacgtcactagaggagccgtactaacttacaacggaaagcggttagaaccaaactgggctagtgttaaaaaggacctcatttcatacggaggtgggtggcgtctatctgcacaatggcaaaaaggggaagaagttcaagtcatagcagtagaacctggtaagaatccgaaaaacttccaaactatgccaggaacatttcagactacgactggggaaatcggagcgatagcgctcgatttcaagccagggactagcggctccccaattataaatagagaaggtaaagttgtcggattgtatgggaacggagttgtcacgaaaaatggcggatatgtttcaggaattgcccagaccaacgcagaacctgatggtccaactccagaactagaagaagagatgttcaaaaagagaaatctaactataatggatttgcatccagggtcaggcaagacccggaagtacttaccggcaatagtaagagaagcgatcaaaagaagattaagaactcttatcttagcgcccacaagggtggttgcagccgaaatggaagaggcccttaaaggcctgccaataaggtatcaaactactgctacaaagtcagaacatacggggcgagaaatagttgacctcatgtgtcacgccacatttactatgagactattatccccggtaagagtccccaattataatttaataataatggatgaagcacattttacggatcctgcatcaatagctgcaagaggttatatatcaactcgtgtcggaatgggagaggctgcggcaatatttatgactgcaacccctccaggtaccgccgatgcctttcctcagtccaatgctccaatacaagatgaagaaagggacatcccagaacgatcatggaacagcggaaacgaatggatcactgacttcgcaggtaaaactgtgtggtttgttccaagtatcaaggcaggaaacgatattgcaaattgcctgcgcaaaaatgggaagaaggtaattcaacttagtagaaaaacattcgacacagaatatcagaagaccaagttgaacgattgggattttgttgtcacaacagatataagtgaaatgggcgcaaacttcaaggctgatcgagtaatcgatcccagacgatgtctaaaacccgtaatattgactgatggtccagaaagggtaatactagccggtcccatgccggtaacggcagcctctgctgctcaacgacgaggccgtgtgggacgaaacccccaaaaagaaaacgaccagtatatctttacaggacaacccttaaacaatgatgaagatcacgcacattggacagaagctaaaatgctgctggataacataaacacgccagaaggaatcattccggctctttttgaacccgagagagaaaagagtgcagctatcgacggtgaataccgcttgaaaggtgaatctcgtaaaacattcgttgaactaatgaggcgaggtgacttacccgtctggctagcacacaaggtagcatccgaaggcatcaaatatactgatcgaaaatggtgtttcgatggacaaagaaataaccaaattcttgaggaaaacatggacgtagaaatttggaccaaagagggagagaagaagaaattacggccaaggtggctggatgcccgcacttactcagatcctttagcattaaaagaatttaaagactttgcagcggggaggaaaagtatagcattagatttagtaacagagattggacgagttcccacacacctagctcataggacaaggaatgcactagataatctcgtaatgctacacacctcagaacacggtggaaaagcatatagacacgctgttgaagaattgccagagacgatggaaacattactcctattgggtttgatgattttattgactggaggagccatgctgtttctcataagtggaaaagggatcggaaaaacatccataggattaatctgtgttattgcttcaagtggaatgctatggatggcagaaataccattgcaatggatcgccagcgccattatcctagagttctttatgatggtattactcatacccgaaccagaaaaacaacggactccacaagacaaccagctcgcatacgttgttattggaatccttacactcgcagctataatcgcagcaaatgaaatgggattactagagactacgaagagagatttaggcatgagtaaagaaccaggagtagtatcacctacatcatatttagatgtcgatttgcatccagcctcagcatggacattgtacgcagtagctacgacagtaataactccaatgctaagacacacaatagaaaattccacagctaatgtgtcattagctgccatagcaaaccaagcggttgtcctaatgggactggataaaggttggccaatatcaaaaatggacctaggtgtgccactattggctctgggttgctattcacaagtaaatcctctaacactaacagccgcagtccttttactaataactcattacgctatcataggacctggattacaagcaaaagctactcgagaagcacaaaaacgcacagcagcaggtataatgaaaaacccaacagtggatgggataatgactatagacttagatcctgttatatatgacagtaagtttgaaaagcaactaggtcaggtaatgctcctagtcctatgtgctgtccaactcttgttaatgcgaacatcttgggcactatgcgaggcgctaacgttagcgaccggaccaattactacattgtgggagggatcacccggaaaattttggaatacaactattgccgtttctatggcaaacatctttcggggtagttatttagcaggagcaggtctcgcgttctcaataatgaaatccgtgggtactggaaaacgtgggaccggtagtcaaggagaaacattaggagaaaaatggaagaagaaattaaatcaattaagccgaaaagagttcgatttatataagaaatcaggtataactgaagtcgatagaacagaggcaaaagagggactaaaaaggggtgaaattacgcatcatgccgtgtccagaggctccgcaaaactacaatggtttgtggaacgtaacatggtaatacctgagggcagagtaatagatctcgggtgcggtcgagggggttggtcgtactattgcgctggacttaagaaagttactgaagtacgtggctatacaaaaggagggcccggacatgaggaaccagttccgatgtcaacatatggatggaatatcgttaagctaatgagcggaaaagatgtattttacctacctccagaaaaatgtgatactttactctgtgacatcggcgaatcctcaccctcacctactgtggaggagtctcgaaccattcgagtgctaaagatggtcgaaccatggctgaaaaataaccaattctgtataaaggtgctgaatccttatatgcctaccgtcatagaacatttagagcgcctccaaagaaaacatggtggaatgctagtcagaaatccattgtcccgaaatagcacacatgaaatgtattggatttcaaatggaactggaaacatagtagcttcagttaacatggtaagccgcctcttattaaataggtttactatgactcataggaggccaaccatagagaaagacgtcgatttaggagcaggaactcgtcacgtgaacgcagaacccgaaacccctaatatggacgtaattggagaaagaataaaaaggatcaaagaagaacacaattcaacctggcattatgacgatgaaaatccctataagacatgggcataccacgggtcatacgaagtgaaagcaacaggatcggcgagttcaatgataaacggcgtagttaaactattgaccaaaccgtgggatgtagtgcctatggtcacccaaatggcgatgactgatactacacctttcggtcaacaacgagtatttaaagaaaaggtcgatacccgaactccgcgctctatgccgggcacaagaagggtaatgggtattactgcagagtggttatggagaacgctaggtagaaacaagaaaccaagattatgtacaagagaagagtttactaagaaagtcagaacgaacgcggcgatgggcgcggtgttcaccgaggaaaatcaatgggatagtgctaaagccgctgtcgaagatgaagatttttggaaattagtagatagagagcgagagttacacaagctcggtaagtgcggaagctgtgtttataatatgatgggtaaaagagagaagaaactaggtgagtttggtaaagctaaaggaagtagagccatatggtacatgtggcttggagcccgatatttggaatttgaagcgctcggcttcctaaacgaggatcattggtttagtcgagagaacagttacagtggagtagaaggagagggactgcataaattaggatacatattgagagatatatccaaaatcccagggggcgcgatgtatgcggacgatacggcagggtgggatactagaataactgaagacgatcttcataacgaagagaaaatcacgcagcagatggatccggagcacagacaactggcgaatgcgatttttaaacttacatatcaaaacaaagttgttaaagtccaacgaccaacaccaacaggaacagtaatggatataatatccagaaaagaccaacggggatcaggacaagttggaacatacgggctaaacactttcactaacatggaagcacaactaatccggcagatggaaggtgaaggcgtactaagcaaagctgatcttgaaaatccccacctcccggagaagaagataacccaatggctggaaacaaaaggtgtggagcgattaaaaagaatggctataagcggagatgattgtgttgtaaaaccaatagatgataggtttgcaaacgcacttctcgccttaaatgatatgggcaaagtaaggaaggatataccacaatggcagccttcaaaaggctggcatgattggcaacaagttcccttctgcagtcatcattttcacgaactcataatgaaagacggaagaaaattagtggtaccgtgtcgaccccaagacgaattaataggtcgagctagaatatcacaaggcgcgggatggagcctacgcgagaccgcctgtttaggtaaagcctatgcacagatgtggagtttaatgtactttcaccgacgggatcttagattagcgtcaaatgctatatgcagtgctgtccctgttcattgggtccccacatcacggacaacgtggtcaatacatgctcatcatcaatggatgacaacagaagacatgctcaccgtttggaatagagtatggatagaggacaacccatggatggaagataagacaccagtaacaacgtgggaaaatgtcccatatctaggaaagagagaagatcagtggtgtggatctttaattgggctgacatcaagagccacgtgggcacagaacatacctaccgcaattcagcaggtacgaagtcttataggaaatgaagaatttttggactatatgccttcgatgaaaagattcagaaaagaagaagagtcagaaggggcgatatggtag

SEQ ID NO: 23400 - RNA, 9873 nt, synthetic construct
  misc_feature 1..9873: note = derived and/or modified CDS sequence (opt6) from DENV-3__FJ639766__SS-prME
  source 1..9873: mol_type = other RNA
acctctctttgccttatgatgatcctccctgcagctttagctttccacttaacaagccgagacggagaaccaagaatgattgttgggaaaaacgaaagagggaaaagccttttatttaaaacagcatcagggattaacatgtgtacgcttatagcaatggacttaggggaaatgtgtgatgacacggttacttataaatgtccacatatcacggaggtggaacctgaagacatagactgctggtgcaatttaacatctacgtgggttacatatgggacctgtaatcaagcaggggaacaccggcgtgataaacgatctgtggcattagcaccacacgtcggaatggggttggacacgagaactcaaacatggatgagcgcagaaggggcttggagacaagtagagaaagttgagacatgggctttgagacatcctggattcacaattcttgcgctatttttagctcactatataggaacatcattaacacaaaaagtagtaatattcatacttttaatgctcgttacaccgtcaatgaccatgcgatgcgtaggggttggaaatcgtgactttgtcgaagggcttagcggagcaacctgggtggatgtcgtcttggagcacggaggatgtgtaacaacaatggccaaaaacaaaccaactctagacatagagcttcagaaaacagaagccacacaacttgcaaccctcaggaaactatgtatagagggaaaaattacaaacataacgactgattcccggtgccccactcaaggggaggcggtcttgccagaagaacaagaccagaattatgtatgtaaacacacatatgtagaccgagggtggggaaatggctgtggattatttggcaaaggaagtttagtaacctgcgctaaatttcagtgtttagaacctattgagggcaaagttgtgcaatatgaaaatttaaaatatactgtaataataactgtccatacaggagaccaacatcaggttggtaatgaaacgcaaggggtgacagcagaaataacgcctcaagcatctacaacggaagcaattctaccggaatatgggacattaggtttagagtgcagccctaggacaggcctcgattttaatgaaatgatactgctgacaatgaaaaataaagcatggatggtccaccgtcaatggttcttcgatttaccattaccgtggacgagtggagcaacaactgaaacaccgacttggaaccgtaaagaactgctagtgacgttcaaaaacgcccatgcgaagaaacaagaagtagtcgttttgggtagtcaagaaggggctatgcacaccgcactcactggagcaactgaaatccaaaattccggcggaacttcaatttttgcgggtcatttaaagtgtagattaaaaatggataagttagagcttaaaggtatgtcttatgcgatgtgtaccaatacttttgtattaaagaaagaagtctctgagacgcaacatggcactatactaattaaagtagaatacaaaggtgaggacgtcccatgtaagattccattcagtacggaagatgggcaaggaaaggcacataatggtagactaataactgcaaatccagtagttacaaagaaggaagaaccagtaaatatagaagcggaacctccctttggagaatctaatatagttattggcataggagacaatgcattaaaaattaattggtacaaaaagggctcctcaataggcaagatgtttgaggcgaccgcaagaggcgcaagacgaatggcaattttaggtgatacagcgtgggactttggatcagtagggggagtattaaatagcttaggaaagatggtacatcaaatatttggttcagcgtatactgcattattttcaggagtctcatgggtcatgaagattggcatcggagtactacttacttggattggactaaatagtaaaaacactagcatgagtttttcctgtattgccataggtataattactctgtacctaggagcagtagtccaagcggatatggggtgtgtgataaattggaaaggtaaggaattaaaatgcggtagcggtatttttgtgacaaacgaagtccatacgtggacagagcaatataaatttcaagcagatagcccaaaaaggctcgcgaccgcgatagctggagcctgggaaaatggagtctgtgggattcgaagtaccacaagaatggagaatcttttgtggaaacaaattgccaatgaattaaattatattttatgggaaaataatataaaactaacagtggtagtcggagatattataggagtgttggagcagggaaagagaactctgactccacaaccgatggaattaaagtattcttggaaaacgtggggaaaagcgaaaatagttactgctgagacacagaactcctctttcataatagacggaccaaacacacccgaatgtccgtccgctagcagggcttggaatgtgtgggaagttgaggactatggttttggtgttttcacaactaacatatggttgaagctgagagaggtttatacacaattatgtgatcacagactaatgtctgcggcggtaaaggatgaaagagcagtacatgccgacatgggatactggattgaatctcagaaaaatggaagttggaagttggaaaaagccagcttgatagaggtaaaaacctgtacgtggccgaaatcccacacgctttggagtaatggcgtgttggagtccgatatgataataccaaaatcattggcgggaccgatatcacaacataattacagacctggataccatactcaaacagcagggccatggcacctcggcaagttggagctggacttcaattactgtgaaggcacaacagttgtaattactgaaaactgtggaactcgcgggccttcattgcgaacaacgactgtttcagggaaattgatacatgagtggtgttgcagatcctgcacgttacccccactaagatatatgggagaggacggatgttggtatggcatggagataagaccgattagcgaaaaagaagagaacatggtaaaatcccttgtctccgctggatcaggagaagtggacaattttacaatgggagtactatgtttagctattctgtttgaagaagtaatgcgaggcaaatttggcaagaaacatatgattgctggtgtctttttcacattcgtcctgctactaagcggacaaatcacatggcgagacatggcacataccttaataatgattggcagcaacgcaagtgatcgtatgggaatgggagtcacttacctcgcattgatagctacatttaaaatacaaccatttttggcgctcggattctttctgaggaaactaacatcgagagaaaatttactattaggagtgggtttggcaatggcaacaaccctgcaactaccagaagatatcgaacaaatggcaaacggaatagcattgggactgatggctctaaagctaattacgcaatttgaaacgtatcaattgtggacagctttaataagcctgacatgttcaaatacgatctttacattgacagtggcgtggagaacagcgacattgatcctagctggtgtcagtctgctgccagtttgtcaaagttcgagtatgagaaaaacggattggctaccaatgacagtcgcagccatgggtgttccaccactaccgctgtttatatttaatctaaaggatacattaaaacgtcgatcttggcccttaaatgaaggtgtgatggctgttggtctagtcagcatcctagcgagtagtcttctgagaaacgatgtccctatggcaggtccattagttgcaggaggtcttctaattgcttgctatgttattactggaacctcagcagatcttacggtcgaaaaagctgcggatgtaacctgggaggaagaagcagaacaaactggagtttcccataacttaatgataacggttgacgatgacggtacgatgagaataaaagatgacgagactgaaaatatactaacagtgttattaaaaactgctctcttaattgtctcaggaatatttccttatagcataccggcaacgttattggtatggcatacttggcaaaagcaaactcaaagaagtggcgtcctatgggatgtaccttccccgccagaaacacaaaaggctgaactagaggagggtgtataccgaataaaacaacaaggcatatttggcaaaacgcaggttggagtaggagttcaaaaagaaggggtctttcataccatgtggcacgtgacgaggggagcggtactaacatataatggcaaaaggctagaaccaaattgggcaagcgttaagaaagacttgatatcttacgggggaggatggaggctgtctgcccaatggcaaaaaggagaagaagtacaggttatcgcggtagagccaggcaaaaaccctaagaattttcaaactatgccaggaacgtttcaaacaaccacaggagaaattggggctatcgcccttgatttcaaaccgggtacttcgggttcaccaatcataaacagagaaggtaaagtagtgggtctatatggaaacggagtagtaaccaaaaatgggggctatgtgagtggaatagcacagaccaatgcggaaccagacggcccaacgccagaattggaagaggaaatgtttaagaaaagaaatctaacaataatggacttgcacccgggaagtggtaaaacgcgtaaatacctacctgctatagttcgagaagcaattaagagaagactgagaactctaatccttgctcccactagagtagtagctgccgaaatggaggaagccttgaaaggtttgccaataagatatcaaactacagcaacaaagtcggaacacactggacgagagatagtagatctaatgtgccacgcgacattcacgatgagattactctcacctgtaagagtgccaaactataacctgataataatggacgaagcacatttcactgacccagcatccatagcagcaagaggatatatcagtactagggtaggtatgggagaagcagccgcaatctttatgacggcgacaccaccaggtacagctgatgcatttccgcaaagtaacgcgccaattcaggatgaggagagggatattcctgaaagatcctggaatagtggaaatgaatggataactgactttgcaggaaagacggtatggttcgtaccaagtatcaaagcaggtaacgatatagcgaattgtttacgtaagaacggcaagaaagttattcagctaagccgtaagacgtttgatactgaataccagaaaacaaagctaaatgattgggatttcgtcgtgacaacagacattagcgaaatgggagcgaattttaaagcagatagagtaatagatcctagacgctgtttaaaacctgtaatattaacagacggtccagaaagagtgatcttagcgggacctatgcctgttacggctgcatcggcggcccaaagaagaggaagagtgggtcgtaatccacaaaaagaaaatgaccaatatatatttacgggacaaccgctaaataatgatgaggatcacgctcattggacggaagcaaagatgttactggataatattaatacaccagaggggataataccggcattattcgaaccggaaagagagaaaagtgcggccatagatggtgaatacaggttaaaaggagaatctcgcaaaacgtttgtagaattgatgagaagaggagatctgcccgtgtggttggcacataaagtagcgtctgagggaattaaatatacagatcggaaatggtgtttcgatgggcaaagaaataaccaaatattagaagaaaatatggatgtagagatctggactaaagagggggaaaagaaaaagctcagaccaagatggttagacgcacgtacttactcagatcctctagccttgaaagaatttaaggattttgctgccggaagaaaaagcatagcacttgatttagttaccgaaattggtcgggtacctacacacttagcccataggactagaaacgctcttgataatctggttatgttacacacgagtgaacacggcggaaaggcttatcgacacgcggtagaagaactaccggaaacaatggaaacgctcctattacttggtctaatgattttgttaacagggggagctatgttattcctgatcagtggaaaagggataggcaagacttccatcgggttaatatgcgtaatcgcaagttctggaatgttgtggatggcagaaataccgctacagtggattgcatcggctatagttcttgaatttttcatgatggtactactaataccagaacctgagaaacaaaggacaccacaagacaatcagctagcttacgtggtcatagggatactgacattagcagctattattgcagctaatgagatggggttactggaaacaaccaaaagagatctcggaatgtccaaagaaccaggggtagtttcaccaacatcgtacttggatgttgatttacatcctgcttctgcatggactctatatgcggtagccacaacagtcataacaccaatgcttagacatactatagagaacagtacagcaaatgtgtcattagcagcaatagccaaccaggctgtagtcctgatgggactagacaaggggtggcctattagcaaaatggatctaggggtgcccctgctagccctgggatgttatagtcaggtaaatccactcacgctcaccgctgctgtcttattactgatcacacactatgctattatcggaccagggcttcaagcaaaggcaactagggaggcgcagaaaagaactgccgcaggcattatgaaaaaccctaccgttgatggcattatgacaatcgacttagatcctgtaatttatgattcgaaatttgaaaaacagttaggtcaagttatgctgctagttctatgcgctgttcaactactgctcatgagaacttcctgggcattatgcgaagcactaacacttgccacaggtccaattaccaccttgtgggaaggatcaccgggtaaattttggaatacaaccatagccgtaagtatggcaaatatcttccgtggttcatacttagcaggagcaggattagccttttcaataatgaaaagcgttggtactgggaaaagaggaaccggaagtcaaggagagaccttaggagaaaagtggaagaagaaattaaaccaattaagtcgaaaagagtttgatctgtataagaaatctggaataacagaggtagatagaacagaggcgaaagaaggcttaaagagaggagagattactcaccacgcagtctctcggggatctgcaaagttacaatggttcgttgaaaggaacatggtaattcctgaaggaagagtaattgatcttggatgtggaaggggtggctggtcgtattactgcgccggtttaaagaaagttactgaagtaagggggtataccaaaggagggccagggcacgaagaaccagtaccgatgtcaacatacggatggaatatcgtgaaactgatgagtggcaaagatgtattttacttgccaccggaaaaatgcgatacgttgctttgcgacataggtgaaagttcacccagtcctacggttgaagaaagtagaacaatccgggtcctgaaaatggtagagccatggttaaagaacaaccagttctgtattaaagtattgaacccctatatgcctaccgtcatagaacatttagaaaggttgcaaaggaaacatggcggaatgttggtaagaaacccactaagcagaaattcgactcatgaaatgtattggatttcaaatggtacagggaacatcgtggcatcggtaaatatggtttctcgtctcttattaaatagatttacgatgactcacaggagaccaacgatagagaaagatgtagatttaggtgcaggtacaagacatgttaacgcagaaccggagacacccaatatggatgttataggtgagaggatcaagcgaataaaagaagaacacaactcaacatggcattatgatgatgaaaacccttataaaacttgggcatatcacggatcttacgaagtaaaggccacaggctcagcctcatctatgattaatggggtggtaaaactcctaactaaaccatgggatgttgttccaatggtaacgcaaatggcaatgacggatacgacgccttttggtcaacagagagtatttaaggagaaagtagatactagaactccaagaagcatgccaggcacgcgaagagtcatgggaataactgcagaatggttatggcgtacattgggaagaaacaagaagccccggctatgtacacgtgaagagttcaccaagaaagtaagaactaatgccgccatgggggcagtcttcactgaggagaatcaatgggattctgctaaagcagcagtggaagatgaagacttttggaaattagtagacagggaaagagaattacataagctcggcaaatgcggttcgtgcgtttataacatgatgggtaaaagagaaaagaaactcggtgagttcggaaaagcgaaaggatcaagagctatttggtacatgtggttgggagcaagatacctagaatttgaagcactgggctttttaaatgaagatcactggttctctagagaaaattcgtattcaggcgtcgagggagaaggactacataagctagggtatatcttaagggatattagtaaaatacccgggggagcaatgtatgccgatgacacggcaggctgggatacacgaataacagaggatgatttacacaatgaagagaaaatcacacagcagatggacccggagcacagacaactagctaatgctatatttaaattaacataccagaataaggtagtaaaagtacaaaggccaactccaacgggtacggttatggacataatatcaaggaaagatcaaagaggatcaggtcaagtaggtacatacggtctgaacacattcacaaatatggaagcacaactgatccgtcaaatggagggggagggtgttttaagtaaagcggacttagaaaacccgcacttacccgagaagaaaatcacacaatggctagaaactaaaggagtagagcgacttaaacgaatggccataagcggtgatgactgcgtggttaaacctattgacgatcgatttgctaacgcactactcgcacttaatgacatggggaaagtacgaaaagacataccccagtggcagccctctaaagggtggcatgactggcaacaggtaccattctgctcacaccactttcatgaactaattatgaaagacggtcgaaaattagtggtaccctgtaggccacaagacgaattaataggtcgtgcacgaatatcacaaggggcagggtggtcacttagagaaaccgcctgtctaggaaaagcgtatgcccaaatgtggtcattgatgtactttcaccggcgcgacttaagactagcttccaacgcaatatgttctgcagtacccgtgcattgggtacccaccagtaggactacctggtctattcatgcgcaccatcaatggatgacaacagaggatatgttaactgtgtggaatcgcgtatggatagaggataacccttggatggaagacaagacaccagtgacaacgtgggagaatgttccatacttaggtaaaagagaagatcaatggtgtggaagtctaatcggacttacttctagggcaacatgggcccaaaatatccctactgcaattcaacaagtgcgatcactaattggaaatgaagaatttctagattatatgccgtccatgaaaagattccggaaggaagaggaatcagagggtgccatatggtaa

SEQ ID NO: 23401 - RNA, 9873 nt, synthetic construct
  misc_feature 1..9873: note = derived and/or modified CDS sequence (opt6) from DENV-3__FJ639767__SS-prME
  source 1..9873: mol_type = other RNA
acatccttatgtttgatgatgattttgccagcagcactagcttttcacctaacctccagagacggtgaaccaagaatgatagtcggtaaaaacgagagaggaaaatcattacttttcaaaactgcgtctggtataaacatgtgtacacttatagctatggatttaggagagatgtgtgacgatacagttacctacaaatgtcctcacataacagaagtcgagccggaggatatagattgctggtgtaaccttacatcaacatgggtaacctatggaacttgtaaccaagccggtgaacaccggcgggataaaagatctgtcgcacttgcaccacatgtaggaatgggattggatacacgcacccaaacatggatgagcgcagaaggggcatggcgccaagttgaaaaagtggaaacatgggcactaaggcatcctggattcacaatattggctttattcctagcacattatataggaacgtccctaacacaaaaagttgtgatcttcatcttattaatgttagtaacaccttcaatgacgatgagatgtgtaggtgttgggaaccgcgatttcgtagagggactgtcaggagcaacatgggttgacgtggtcctagaacacggaggctgtgtaaccacgatggccaaaaataaaccaactctagatatcgagttacagaaaacggaagcaacacagttagcaactttacgaaaactgtgtatagagggaaaaataactaatataactacagactctagatgcccaacgcaaggtgaagcagtactacccgaagaacaagaccaaaactatgtctgcaaacatacatatgtggatcggggatggggaaatggttgtggtctattcgggaaaggttccctagtcacctgtgcaaaatttcaatgtttggaaccgatagaaggaaaagttgtccaatatgaaaatctaaaatacactgtaataataacggtgcacactggagatcaacaccaggtaggcaatgaaacacaaggtgtaacagcagaaattacgcctcaagcatcgacaaccgaagcgattttaccagagtatggaaccttgggactggagtgttcacctcgaacgggcttggattttaatgaaatgatactactcacaatgaaaaacaaggcttggatggtacatcgtcaatggtttttcgacttaccattaccttggacaagtggagcaaccacagaaacaccaacctggaatcgcaaagaactgctagtaacctttaaaaatgctcatgcgaagaaacaagaggtggtagtgcttgggtcgcaggaaggggcaatgcacactgctttgactggtgctacagaaattcaaaattcaggcggcacatcaatatttgctggtcacctaaaatgtcgtctaaaaatggataaactagaattaaaaggtatgtcatacgcaatgtgcacgaatacatttgttctaaagaaagaagtatcagagacacagcacggaacgattctaatcaaagtagaatacaaaggagaagatgttccgtgtaagattcccttttcaacggaagacgggcaaggaaaagcccataacggaagattaataacagctaacccggtagttactaaaaaggaagaaccggtaaacatcgaagcagaacctccatttggcgaatcgaatatagttatagggataggagacaatgcgttaaaaataaactggtataagaaaggatcctcaatcggaaaaatgttcgaagctaccgcaagaggcgcacgtagaatggctattctcggagacacagcatgggacttcggaagtgtgggcggagtattaaactcccttgggaaaatggttcatcaaatttttggcagtgcttatacagcactattttcaggcgtcagctgggttatgaagattggcataggtgttctcctaacctggataggcctcaacagtaagaacacaagcatgagcttctcatgtatagcaatagggatcattactctatacttaggagctgttgttcaagcggacatgggatgcgtcattaactggaaaggcaaagaactcaaatgcggtagtggaatatttgtaacaaacgaagtgcacacatggaccgaacagtataaatttcaggcggattccccgaaaagactagccacggcaatagccggtgcttgggaaaatggggtttgtgggatcagaagtacgacaagaatggaaaaccttctgtggaagcagattgcaaacgagctaaactacatattatgggaaaacaatattaaattgaccgtggtcgtaggtgatatcataggcgttctcgaacaaggcaaaagaacgttaacaccacagcctatggaattaaaatattcgtggaagacatggggtaaagctaaaatcgtcacagctgaaacccaaaactctagcttcataatagacgggccaaatactccagagtgccctagtgcttcaagggcctggaatgtctgggaagtagaagattacggatttggagtattcacaaccaatatctggttaaagctcagagaggtttatacacaactatgtgaccatagactaatgtcagcagccgtaaaagacgaaagagcagtacacgcagacatgggatattggatagaaagccagaaaaacggatcttggaaactagaaaaggcctcactaatcgaagtgaaaacgtgtacttggccgaaaagtcacactctatggtccaatggtgttttagaatcagatatgattataccaaagagcctcgcaggaccaataagccagcataactataggccaggttatcatacccaaacagcaggaccttggcacttaggaaaactagagttagatttcaattattgtgaaggtacaactgtggtgatcactgaaaattgtggcacgcgtggcccgagcctacgtactacgacagtaagtggcaaactcatacacgaatggtgttgccgctcctgtacacttcctcccttacgatacatgggtgaggatggttgttggtacggtatggagataaggccaatatcagaaaaagaagaaaatatggtaaaatcgttagtttctgcagggagcggcgaggtcgataacttcacaatgggagtgttatgcttagcaatattatttgaggaagtaatgcgaggtaaatttggcaagaaacatatgatcgcaggcgtgttctttacattcgtccttttactctcgggtcaaataacctggagggatatggcacacacactgataatgatcggtagtaatgcaagtgacaggatgggaatgggcgtaacatacctcgcgctaatagcaactttcaagattcagccgttcttggcactgggattctttttacgtaagctaacatcgagggagaatttacttttaggcgtgggtttagctatggcgacaacgctccagctccctgaagatatagaacaaatggcgaacggaattgcactcggcttaatggccctgaaattaatcacacagtttgaaacataccaattatggacagcacttatcagcttgacgtgtagtaacacaatattcacattgacagtagcatggcgaacagccactttaatcctagcaggggtatcactgctaccggtatgtcaatcatcttcaatgagaaagacggactggctaccaatgactgttgcagcaatgggagttccacccctacctttattcatcttctctctgaaagatacactaaagaggagatcttggcctttaaacgaaggagttatggcggtaggccttgtctcaatactggcgtctagcttattgcggaatgacgtacccatggccggtcccctagtcgcgggaggactactaatcgcatgctatgtcataaccggtacgtctgcagacctcacagtagagaaagcagcagatgtaacatgggaggaagaagcagaacaaacaggtgtgtcccacaatctaatgattacagtcgatgatgatggaacaatgcgaatcaaggacgatgagacagaaaacatactgaccgtcctcctcaagactgcactccttatagtatccggtatttttccgtactcgatacccgcaacgcttctggtttggcatacctggcaaaagcagactcagagatctggtgtactgtgggatgttcctagtccgcctgaaacgcaaaaggcagaacttgaggaaggggtttacagaatcaaacaacaaggtattttcggaaaaactcaagttggggtgggtgtacagaaagaaggagtatttcacactatgtggcatgtgacaagaggagctgttcttacctacaacgggaaaaggttagaaccaaactgggcatctgttaaaaaggatttaatttcatatggaggaggctggaggttaagtgcacaatggcagaagggggaagaagttcaagtcatagctgtagagcctggcaaaaaccccaaaaacttccagactatgcctgggactttccaaaccaccaccggagaaattggtgcaatagccctggatttcaaacctggtacgtcaggctcacccataattaacagggaaggaaaggtagtaggactctatgggaatggtgtagtgactaaaaacggtggatacgtctcaggaatagcacaaacaaacgccgaacccgatggtccaactcctgaactggaagaagagatgttcaagaagagaaacctgactatcatggatctacatcctggtagtggtaaaactagaaaatacttgccggcaattgttcgcgaagctataaaaaggcgattaaggaccctgattttggcgcccactagggtcgtagcagcagaaatggaagaagccttaaagggtttaccaatcagataccaaactaccgctacaaaatctgaacacaccgggagagaaatagttgatttgatgtgtcacgctacgtttacaatgaggttgctgtcaccggtgagagtaccgaattacaacctaatcatcatggatgaagcacacttcacagacccggcatccatagccgcaaggggttatataagtacacgggtagggatgggggaagctgcggctatatttatgactgcaaccccacctggaaccgctgatgcctttccacaaagtaatgcgcccattcaagatgaagaacgggatatcccggaaagatcgtggaactccggcaatgaatggataaccgactttgcagggaaaacagtttggttcgtcccaagcataaaggcaggtaacgacattgctaactgtctcaggaaaaacgggaagaaagtcatacaactaagtcgcaaaacgttcgataccgaatatcagaaaactaaactaaatgattgggattttgttgttacaacagatatatcagaaatgggtgctaactttaaagccgacagagtaatagacccacgacgctgccttaagcccgtcatcctaacagacgggccagaaagagtaatattagcaggacccatgccagtaacggcagctagtgccgcacaaagaaggggtagggtcggaagaaacccccagaaggaaaacgaccagtatatattcacaggtcagccattaaataacgatgaagatcacgctcattggaccgaggcgaaaatgctattagataacattaacaccccagaaggaataatccccgccttattcgaacctgaaagagaaaaatccgcagcaatagacggggagtatagattaaaaggtgagagccgtaagaccttcgtagaactgatgaggagaggtgatctgccagtatggcttgctcataaagttgcctcagaaggaattaaatatacagatagaaaatggtgcttcgatggacagcgaaataatcaaattctagaagaaaacatggatgtggaaatttggaccaaagagggagaaaagaagaaattacgaccacgatggctagacgcgagaacttattcggatccacttgccttgaaagaatttaaagattttgcagcagggagaaaatcaattgcgttggatctagttacggaaattggacgtgtcccatcacatctagcgcacaggacgaggaatgctcttgacaacttagtaatgttacacacgtctgagcacggaggaaaagcatatagacatgccgtagaagagttaccagaaactatggaaactctattgttactagggctgatgatattgttgactggaggggcaatgttattccttatttctggaaaaggaataggtaagacaagtataggtttaatctgcgtaatcgcaagtagtggcatgctttggatggcagaaataccattacaatggatagccagtgcaatagtgcttgaatttttcatgatggttttacttataccagaacccgagaaacaacgaaccccacaagacaatcagctggcgtacgttgtaataggcatcctaacgctagcagcaattatcgcagctaatgaaatgggccttctcgaaactacaaaaagagacttaggaatgtcgaaagaacctggagtagtaagtcccatttcatatctagatgttgatctacatccagcatcagcatggaccttatatgcagtggccacaacggtaatcacgccaatgttacgacatacaatagaaaattcaaccgctaatgtcagccttgctgcaatcgctaaccaagccgtagtcttaatggggttagataaaggctggccgatttcaaaaatggatttaggtgtcccgttactagcgttaggatgctattcacaagtcaatccattaacactcacagcagcagtacttctcttaattactcactatgcgataatcggacctggccttcaagctaaagcaacccgagaagctcaaaaacgtactgccgcaggaattatgaaaaaccccactgttgacgggataatgactatagacctcgatccagtaatctatgactcgaaatttgaaaaacagctaggacaggttatgttgttagtgctttgtgcagtacaactgctattgatgagaacaagctgggcattatgcgaagccttgacgttggcgactggtccaatcaccacactttgggaaggaagtccagggaaattttggaacacaaccatagcggtaagcatggcgaatatatttcgtggtagttacttagccggtgcaggattagctttctcaattatgaaatcagttggaactggtaaaaggggtactggaagccaaggagaaacacttggagaaaaatggaagaagaaactaaatcaactatcacgaaaggagtttgacctctataagaaaagtggcataaccgaagtagaccgtacagaagcaaaagaaggactgaaaagaggggagataacacatcatgccgtcagtcgaggctctgcaaaacttcaatggtttgttgagcggaacatggtaatccctgagggtagagttatcgatttaggatgtgggagaggcggatggtcatattactgtgcagggttaaagaaggttacggaggttcgaggatatactaaagggggtcctggacatgaagaaccagtgccaatgtcaacttacggatggaacatagttaaacttatgtcaggcaaagatgttttctaccttcccccagaaaaatgcgatacattactctgcgatatcggcgaaagttcaccatcaccaaccgtagaagaatccagaaccataagagtcctaaaaatggttgaaccttggctcaaaaacaaccaattttgcattaaagtgctcaatccctacatgcctacagttattgagcatctagaacgactccaaagaaaacacggtgggatgctggtaaggaaccccttaagtagaaacagtacacatgagatgtactggatctcaaacggaacggggaatatagtagcatcagtgaacatggtaagtagattattactaaaccgatttaccatgacacacagaagacccactattgaaaaggatgtcgatttaggagctgggactcgacatgtaaacgcagaaccagaaacaccgaacatggacgttataggagaacgaataaagaggatcaaagaagaacacaactctacctggcactacgacgatgaaaatccttataaaacatgggcgtatcatggttcgtatgaagtaaaggctacaggatccgcatcatctatgatcaatggtgtagttaaacttcttacaaaaccatgggacgttgtaccaatggtcactcaaatggcaatgaccgatactactccctttggacagcagcgggtatttaaagagaaagtagacactagaaccccgaggagcatgcctggaacccgcagagttatgggaataactgccgaatggttatggcgaacacttggcagaaacaagaaaccacggctgtgtacaagagaagaatttacgaagaaagttaggaccaacgccgcaatgggtgcagtattcacggaggaaaatcaatgggatagtgcaaaagctgccgtagaagatgaagatttctggaaattagttgacagagaacgagaattgcacaaacttggaaaatgtgggagttgcgtttacaatatgatgggaaagagagaaaagaaattaggggaatttgggaaggcaaaaggttctagagcaatatggtacatgtggttgggcgcgcgatatttggagtttgaagcattaggttttctaaatgaagaccattggtttagtagagaaaacagttactccggtgtcgaaggtgaagggttacataaacttggatacatactacgagatatttcaaagattccaggcggggccatgtacgctgatgatacggcaggttgggacacacgcattacagaagacgaccttcataacgaagagaaaattactcaacaaatggaccctgaacatagacagctggccaatgccatttttaaacttacttaccaaaataaagtagttaaggtacaaagacctacgccaaccggaacggtaatggatattataagccgaaaagaccaaagaggttcaggacaagtcggaacatatggtcttaatacatttactaatatggaagcacaattaatacgacaaatggaaggcgaaggggttctttcaaaagcagatcttgaaaaccctcacttacctgagaaaaagattactcaatggctcgagacgaagggcgtagagcgactaaagcggatggcgatctctggagacgactgtgtcgtaaagccgatcgacgatcgttttgcaaatgcattattggccctaaatgatatggggaaggtaaggaaggatattccgcaatggcagccttcaaagggatggcatgactggcaacaagtgcccttctgctctcatcattttcatgaattgataatgaaggatggccgaaaactggtagttccatgtcgacctcaagatgagcttattggacgagcccgcatatctcaaggcgcggggtggagtcttcgtgaaaccgcatgtctaggcaaggcctatgcacaaatgtggtcattaatgtattttcaccgaagagatcttcggttggcatccaacgcaatctgttccgcagtacccgtacactgggtaccaaccagcaggactacatggagtatccacgctcatcaccaatggatgactacagaagacatgctgaccgtttggaacagagtatggatagaggacaacccctggatggaagacaaaacgccagtaacgacgtgggagaatgtaccttatctcggcaaacgagaagatcaatggtgcggaagtcttataggtctgacatcaagggctacgtgggctcagaatataccaacagctatacagcaagttcgctcactaataggtaatgaagagttcctagactacatgccatccatgaaacgattccgtaaggaagaagaatcagaaggagcaatatggtga

SEQ ID NO: 23402 - RNA, 9873 nt, synthetic construct
  misc_feature 1..9873: note = derived and/or modified CDS sequence (opt6) from DENV-3__FJ639768__SS-prME
  source 1..9873: mol_type = other RNA
acatcactgtgcctaatgatgatattaccagcagctctggcattccacttaacatcccgagatggtgaacctagaatgattgttggcaaaaatgaacggggtaaatcattactctttaaaacagcaagcggaattaatatgtgtactctaatcgcaatggatttaggtgaaatgtgtgacgatacggtaacctataaatgtcctcatataacggaagttgaacctgaagatatagattgttggtgtaacttaactagcacgtgggtcacatatggaacatgcaaccaagccggtgaacataggagggacaaacgatctgtagcattggcaccccacgtaggaatgggcctggatactagaacacaaacatggatgtcggctgagggagcatggcgtcaagtcgaaaaagtagagacctgggcattgagacaccctgggttcacaatacttgcactattcctggcacattatatcggcacctcactaacacaaaaagttgttatctttatacttttgatgcttgtaactcccagtatgaccatgagatgcgtaggtgtgggaaaccgtgattttgttgaaggtctttcgggtgcaacctgggttgatgtagtactagaacacggaggatgcgtcacgacaatggctaaaaataaaccgacgctggatatagaattacagaaaacagaagcaacacaattagctacacttaggaaattgtgtattgaaggaaaaataactaatataacgaccgactccagatgtccaacacaaggagaagcagtgcttcccgaagaacaagaccaaaattacgtttgtaaacacacctatgttgatagagggtggggaaatggatgtggactttttggaaaaggttctctagtcacttgcgcaaaattccaatgccttgaaccaatcgaaggaaaagtagtgcaatatgaaaacttgaaatatactgtcatcataaccgttcatactggagaccaacatcaagttgggaacgaaacacaaggagtcactgctgagataacgccccaggcttcaaccacagaagctattttgccagaatatggaacattgggcctcgaatgttcaccaagaaccggacttgactttaatgagatgattttattaactatgaaaaataaagcgtggatggtccatagacaatggttctttgatttgcctttaccatggacgtctggcgcaacaactgaaacacctacgtggaatagaaaagaattgcttgtcacatttaaaaacgcccatgccaagaaacaagaagtcgttgttcttgggtctcaagagggtgcaatgcatactgcattgacaggcgcaacggagatccaaaactcgggaggaacatcaatatttgcgggacatttgaaatgtcgtctgaaaatggacaaattagagttaaaaggtatgtcatacgcaatgtgcactaatactttcgtcttaaagaaagaagtgagtgagacgcaacacggtactatcttgataaaagtcgaatacaaaggagaggacgtgccgtgcaaaatcccattcagtacagaagacgggcagggaaaagctcacaatggacggctcataacagcgaaccccgtcgtcaccaagaaagaggagccagtgaatatagaggctgaacccccatttggcgaatctaatatagttattgggattggtgataatgctttaaaaataaattggtacaagaaaggatcatcgattgggaaaatgtttgaagcaactgcacgaggagcacgtaggatggcaatacttggtgatactgcatgggatttcggttctgtaggtggtgtcttaaattctttaggtaaaatggttcatcaaatattcgggagtgcctataccgccttattcagtggtgtttcctgggtgatgaaaatcggaataggagttcttttaacatggattggactaaatagtaaaaatacttctatgtcgttttcttgcatagcgataggtatcataacgctgtacctaggagctgtggtacaagccgatatgggatgtgtaattaattggaaaggaaaagaattaaaatgtggctcaggcatatttgttacaaacgaggtccacacctggacagaacaatacaaattccaagctgactctccaaaaaggttagcaacagcaattgccggtgcatgggaaaatggggtatgcggaataagatccactacccgtatggaaaatctgttatggaaacaaatagctaacgaactcaattatattctctgggaaaacaacattaaactaaccgtagttgtcggggatattatcggcgtacttgaacagggcaaaagaacactaactccacaaccaatggaacttaaatactcatggaaaacctggggtaaagctaaaatagtaactgccgagacacaaaactcctctttcattatcgatggtccaaatacaccagagtgtccaagcgcatcaagagcttggaatgtttgggaagttgaagattatggatttggtgtatttaccacgaacatctggctcaaattaagggaggtttatacgcagttatgtgaccaccgtctaatgtcagcagctgtgaaagatgaacgggcagtacatgctgatatgggatactggattgagtcccagaaaaacggatcctggaaactagagaaggcttcactcattgaggtcaaaacatgtacgtggccaaaaagccatacattatggagcaacggtgttcttgaatctgatatgataataccaaaaagtcttgcaggccccataagccagcataattatcgcccaggataccatacacagacagcaggaccatggcacctgggcaaactagaactggactttaactactgtgaaggaactaccgtagttataaccgaaaattgcggtacaagagggccaagtctaagaacaacaacagtctccggaaaactaatacatgaatggtgttgtcgatcatgcacattaccacctctaagatatatgggtgaggatggttgttggtacggtatggaaatcaggccaatttctgaaaaagaggaaaacatggttaaatcgttagtaagtgcgggttcgggtgaagtagacaacttcacaatgggagtattatgtttggcgatcctatttgaagaagtaatgagaggtaaattcggtaaaaagcatatgatagcaggagtcttctttacttttgtcctccttctgagcggacaaataacttggagagacatggcacataccttgatcatgattggatcaaacgctagtgatcgtatgggcatgggagtaacgtacttagcgcttatagctacattcaaaattcaaccctttcttgcgttggggtttttcctccgtaaactaacatcaagagaaaacttactgcttggtgttggtcttgcaatggcaacaaccttacaattacccgaagatatagaacagatggcaaatggcatagccttaggattaatggccctgaaattaataacacaatttgaaacatatcagttatggaccgccctcatatcgctaacatgcagcaatacaatctttactttgactgttgcttggagaacggcaacgttgatcttagctggggtctctcttttaccagtatgccaatcatcatcaatgcgaaaaacagattggttaccgatgacagtagccgcaatgggggtaccgccactacctttatttatattttcattaaaagatacactgaagcgccgctcctggcctttaaatgaaggtgtaatggcggttggtctcgttagcatcttggcaagtagtttactgagaaatgacgtgccgatggctggtcctctggtagctggtggcttactaatcgcatgttatgttataacaggtacctccgcagatctcacagttgaaaaagcagccgatgttacctgggaagaagaggcggaacaaacaggtgtttcccataacttaatgataacagtcgacgacgatgggaccatgcgaataaaggacgatgagacagaaaatattctaactgtactgctaaaaacagcattgttaattgtttctggaatcttcccttatagcatacctgcgacactacttgtgtggcacacgtggcaaaaacaaacacaacggagtggagtattatgggacgtaccaagtcccccagaaacacaaaaagctgaactggaggagggcgtgtacagaataaagcaacaaggcatcttcggaaagactcaagttggcgtaggagtccaaaaggaaggagtctttcatacgatgtggcatgttacccgaggcgctgtattgacatacaatgggaaacgactcgaacccaattgggccagtgtcaagaaagatcttatcagttatggcgggggatggcgattaaatgcgcaatggcaaaaaggtgaagaagtgcaagtcattgcagtagaaccgggtaagaatccaaagaatttccaaactatgccagggacatttcaaactacaactggcgagataggcgcaattgcattggactttaaaccgggtacatcaggatcaccaattataaatagagaaggcaaagtagtgggactctacggtaatggagtagtcactaaaaatggaggatatgtatcgggaatagcacaaacaaatgcagagccagatggccccacacccgaattagaagaagaaatgtttaagaaacgtaatttgacaatcatggacttacaccctggatcaggcaaaactcggaaataccttcctgcaatagtacgagaggcaataaagcgaagattaagaactttgatactagccccaacgcgagtagtagccgctgaaatggaagaagctcttaagggacttcctatacgttaccaaacaactgcgacaaaaagcgaacatacaggtagagagatagtggatcttatgtgccatgcgacatttacaatgagattactttcgcccgtaagggtgccaaattacaatctaataattatggatgaggcccatttcacagaccccgcgtccatagctgctagaggctacatatcaactcgtgtgggtatgggagaggccgctgcaatcttcatgaccgcaactccgccggggacagctgacgcgtttccacaaagcaatgctccgatacaggacgaggagagagatataccggagcgtagctggaactcaggcaatgagtggataaccgattttgccggcaaaacggtttggtttgttccgagcatcaaagcgggcaatgacatagcaaactgcttgaggaaaaatggaaagaaagttatacagctctctagaaaaactttcgacactgaatatcagaaaacaaaattgaatgactgggactttgtggtaacgacggatataagtgaaatgggcgctaattttaaggctgacagagtaatagatcctcgacgatgtctaaaaccagtaatattgacagatgggcctgaaagagtaatactagcaggtcctatccctgttacagcggcaagcgccgcgcagagacgcggccgcgtaggtcggaacccacaaaaagagaatgaccagtatatctttacaggacaacctctaaataacgatgaagatcatgcgcattggacagaagcgaaaatgcttctagataatattaacacacctgaagggataatacccgctttattcgaacctgagagggaaaaatcagcggctatcgacggcgaataccgtctcaaaggtgaaagtcgtaaaaccttcgttgaactaatgagaagaggtgaccttcctgtttggctagcacataaagtcgcatccgaaggtataaaatatactgacagaaagtggtgtttcgatggtcagaggaacaatcaaatattagaagagaatatggacgttgaaatatggactaaagaaggtgagaagaagaaattgaggccaagatggctagacgctcgaacctattctgacccgttggctctgaaggaatttaaagactttgcagcaggtcgtaaaagtatagctctagacctggttacggaaataggacgcgtacctagccacttagcacatcggacaagaaacgccttagataacttggttatgcttcacacttcggaacatggcggaaaggcttacagacatgcggttgaagaattaccggaaaccatggaaacgttattgctattgggattaatgattctattaaccgggggagcaatgctatttctcatttcagggaaaggcattggtaaaaccagtattggccttatatgcgttattgcctcaagcggtatgttgtggatggcagaaatacctcttcaatggatcgcttcggcaatcgtgttagagttctttatgatggtcctgttgataccagaaccggaaaaacaaagaactccccaagataatcaactagcatatgtagtaataggcatcctcacactcgctgccataatagcagcaaatgaaatgggtttgctagaaacaacaaaaagagacctcggtatgtcaaaagaaccgggagtagtttcccctacaagctatctagatgtggacttacaccccgccagcgcttggacattatacgcagtagcaacgaccgtcattactccaatgcttagacacactatcgaaaattcgaccgcaaacgtgagtttagcagctatagcaaatcaagctgtagtattaatgggtttagataaaggttggccaatctctaaaatggatctaggcgtgcctttattagcactcggatgctattcacaggtgaatcctttgacacttacagcagcagtcttgttacttataacacactacgcaataattgggccaggcctgcaagctaaagccacgcgggaagcacagaagagaactgctgctggtataatgaaaaatcccactgtcgacggcataatgaccattgacttagacccggtcatatacgattcaaaattcgaaaaacagctaggtcaagtaatgcttcttgttctttgcgccgtacaacttttgctgatgcggacatcttgggccctgtgcgaggcacttactttagcaacaggtccgattacaactttatgggaaggatcgccgggaaagttttggaatactacaattgcggtctcaatggcaaatatatttcgggggtcttacattgccggtgcaggactggctttctcaatcatgaagtctgtcggaacaggaaagcggggtacgggatcccagggagagactctgggagaaaaatggaagaagaaacttaatcaattatcaagaaaagagttcgatctctataagaaatccggcataactgaggtagatcgtaccgaagcaaaagaggggttaaagaggggagaaattacacatcatgctgtcagccgtgggtcagccaaactgcagtggtttgttgaaagaaatatggtgatccctgaagggagagtgatagatctaggatgcggaagagggggttggtcttattactgcgcaggtctaaagaaagtgacagaggtacgaggatatacaaaaggagggccaggtcatgaagaacccgtccccatgtcaacctacggatggaacatcgtaaaactgatgagtggaaaagatgtattttacttgccaccagaaaaatgtgatacactattatgtgacataggcgagtcgagcccttcacctacagtagaagaatctcgtacaataagagtcctcaaaatggtggaaccttggttgaaaaataaccaattctgcataaaagtactaaacccttatatgccgaccgtgatcgaacatttagaaaggttacaaaggaaacacggtggtatgttagtgcgcaatccgctcagcaggaactctacacatgaaatgtactggatatcaaatggtacgggcaatattgttgcaagtgtaaacatggtaagtagactgttactcaatagatttacgatgacacatagacgacctacgatagagaaagacgtagacctcggagctgggaccagacacgtaaacgctgagccagagacccctaatatggatgtaattggtgaaagaattaaaagaataaaagaggaacataattctacatggcattatgatgatgaaaatccgtataaaacatgggcataccacggctcatatgaggttaaagcaacggggagtgcctctagtatgataaatggcgtagtgaaactactaacaaagccgtgggatgtagtgccaatggtaacacaaatggcaatgaccgacacgaccccattcggacaacaaagagtcttcaaagaaaaggtagacacgagaaccccaaggtccatgccaggaactaggcgtgttatggggataacggctgaatggctttggagaacccttggaagaaataagaaaccgaggttatgcactagagaggagttcactaagaaagttcggacaaatgctgcaatgggggccgtatttacggaggaaaaccagtgggactcagcaaaagccgcagtagaagatgaagatttttggaagctagtagatagagaacgggagttacacaaactagggaaatgcggatcgtgtgtctacaatatgatgggaaaaagagagaagaaacttggagagttcggaaaagccaaaggttcccgggcgatatggtatatgtggttaggtgcaaggtatttagagtttgaagctctaggatttttgaacgaggaccattggttctcacgtgaaaattcttacagtggggtagagggcgaagggcttcataaactaggatatatactgcgtgacataagcaagatacccggcggagctatgtatgctgatgatacggctggatgggatactcgaatcactgaagacgacctacacaatgaggagaaaattacgcaacaaatggacccagaacacagacaactggccaatgcaatcttcaaattaacttatcaaaacaaagttgttaaagtccaaagacccacaccgacgggtacagttatggatataatttcaagaaaagatcagagaggtagtggacaagttggaacatacggactgaacacattcactaacatggaagcacaactaatcaggcaaatggaaggagaaggcgtgctatctaaagcggacttagagaatccacatctgccagaaaagaaaattacgcaatggcttgaaacgaaaggagtagaaaggttaaaaagaatggcaatcagtggtgacgactgtgtcgtaaaacctattgatgatagatttgccaacgcactacttgcccttaacgatatgggaaaagtcaggaaagatataccgcagtggcagcctagtaaaggttggcatgattggcaacaggtacccttttgtagtcatcattttcatgaactaataatgaaagatggcagaaaactggtcgtcccttgtcggccccaggatgaacttattggccgagctcgaatttcacaaggggctggttggtcactaagggaaacagcctgtctgggaaaagcctatgcccaaatgtggtcgcttatgtatttccatagacgcgacctgagattagcgagcaatgccatatgctctgctgtccccgtacattgggtacctacaagccgaacaacatggagtatacatgcacaccatcaatggatgacaaccgaagacatgttaacagtgtggaatcgggtttggattgaagataatccgtggatggaagataaaactccagtcactacatgggaaaatgtgccctatttaggtaaaagagaagatcaatggtgcggaagtcttataggattaacgagtcgggcgacttgggcacaaaatatacccacggctatacaacaagtacgctcgctcatagggaacgaggagttcttagattacatgcctagcatgaaaagatttagaaaggaagaggaaagtgaaggcgcaatatggtaa

SEQ ID NO: 23403 - RNA, 9873 nt, synthetic construct
  misc_feature 1..9873: note = derived and/or modified CDS sequence (opt6) from DENV-3__FJ639769__SS-prME
  source 1..9873: mol_type = other RNA
acgtcgttgtgtctgatgatgatactacctgctgctttagctttccatctaacaagtagagatggagaaccacgaatgattgtaggcaaaaatgaaaggggaaaaagccttcttttcaaaacagcaagtggtataaatatgtgcactctgatagcgatggatctaggagagatgtgcgacgatacagtgacatataaatgcccccatataaccgaagtcgaacctgaggatatcgactgctggtgcaatctaacaagtacctgggtaacgtatgggacatgtaaccaagccggtgaacatcgaagagataaaagatccgtcgcgctagcgccacatgttgggatgggactagatacgaggacgcaaacatggatgtcagcagaaggagcatggaggcaagttgaaaaagtcgaaacatgggcattacgacacccaggatttactatcctcgcattgtttcttgcacattatatcggaacttcactgactcaaaaagtggtgatctttatattgttaatgctggtgaccccatccatgacaatgagatgcgtcggtgtaggaaatcgagacttcgttgaaggattatccggagcaacatgggtagatgtggtgttagaacacggaggatgcgtgacaactatggccaaaaataaaccaacactagacatagaattacagaaaacggaggctacacagttggctactcttaggaaattatgcatagaaggaaaaattactaacataactacggatagtcgttgtccaacacagggagaagcggtactccctgaagaacaagaccaaaactacgtatgtaaacatacatatgtagatagaggctggggtaatggctgcggattgtttggaaaaggtagtctcgtgacttgtgcaaaattccaatgtctcgaaccaatcgaaggcaaagtagtgcaatatgaaaatttaaaatatactgttattattaccgtacatacaggcgaccaacatcaggtaggcaatgagacgcaaggtgtgacagctgaaataacaccccaggcaagcacgacagaagcaatattacccgaatacggtacattaggtcttgaatgcagccctagaacaggtcttgattttaatgaaatgatacttcttacaatgaaaaataaggcttggatggttcatcgccagtggttctttgatttacctttaccctggacgagtggggctacaacggaaacaccgacttggaacaggaaagaactcttggtcacatttaaaaacgctcatgcaaagaaacaggaggtagttgttctggggagtcaagaaggggctatgcatacagcgttaacaggagcaaccgaaatacaaaactccggcgggacctcgatatttgcaggacatttaaaatgccgattaaaaatggacaaactagaacttaaaggtatgtcatacgcaatgtgcacaaatacttttgtgctcaagaaagaagtaagtgaaactcaacacggaaccattctaataaaagtagagtataaaggtgaggacgtgccgtgtaaaataccgtttagcacagaagacggccaaggaaaagcgcataatgggcgacttataacagcgaatcctgtagtaactaagaaagaggaaccggtcaacatagaggctgaaccaccattcggagaatccaatatagtaataggcataggagacaatgcactaaagataaactggtataagaagggcagtagtataggaaagatgtttgaagccactgcaagaggagctcgcagaatggctatattgggagatacagcatgggattttggttcagtaggcggagtcttaaactcactcggaaaaatggtacatcaaattttcggtagtgcatacacagccttattcagcggcgtcagctgggtaatgaagattggaataggagtgttacttacatggataggcctaaacagtaagaatacatcgatgagcttctcatgtatagcaatcggaataataacattgtacttgggggcagttgttcaagcggacatgggatgcgtaataaactggaaaggaaaagaattgaaatgcggtagcggaatttttgtcacgaatgaagttcatacgtggacagaacagtataaattccaggctgacagtcctaaaaggttagcgaccgctatcgcaggagcctgggaaaacggagtatgcgggatacgatcgacaacacgaatggaaaatttactctggaaacaaatagctaatgaattaaattacatactgtgggaaaataacattaaactcacggtagtagtcggtgatataattggtgtcttagaacaaggaaagcgaacattgacaccgcaaccaatggagttaaaatactcatggaaaacttggggcaaggctaagatcgttacagcagaaactcaaaatagctcttttattatagatggaccaaacactccagagtgcccaagcgcatccagagcttggaacgtatgggaagttgaagactatggctttggggtgtttacaacaaatatttggttaaaattacgagaagtgtatacccaattgtgcgatcaccgattgatgagcgcagcagttaaagatgagagggctgtacacgctgatatgggttactggatagaaagccagaaaaacggatcatggaaattggaaaaggcatcgttaattgaggttaagacatgtacctggccgaaatcgcacacactctggagtaatggtgtgctggaaagcgatatgattatcccaaaatccttagcaggcccgataagccagcacaattatcgccccggataccacacacagaccgctggtccatggcatcttggtaaattagaactcgattttaactattgcgaaggcaccacagtagtaattaccgaaaactgtggtaccagaggacctagtttgcgtacgacgaccgtaagcggtaagctcatacatgagtggtgttgcagatcgtgtacattaccaccactaagatacatgggcgaagacggttgctggtatgggatggagatacgccctataagtgagaaagaagaaaatatggtaaaatccctagtatctgcaggtagcggcgaagtcgacaactttacaatgggagtactttgcttggcgatactatttgaagaagttatgcgggggaaatttggcaagaagcatatgatagctggagtgttctttacgttcgtattgctactctccggtcaaattacgtggagagacatggcgcatacacttatcatgatcggatccaacgcatccgatagaatgggtatgggtgtaacatatttagcattgattgcaacgtttaaaatacaaccctttttagcgctcggattctttttaagaaaacttacatcccgagaaaatttattattaggagtcggtctagctatggcaaccactttgcaactgccagaagatattgaacaaatggcgaatggaattgcactaggactaatggcacttaaattaataacacaattcgaaacttatcagttatggactgcgctaattagtttaacgtgtagcaataccatcttcacactcacggtagcctggcgcacagctacactaatactggctggcgtttcactactacccgtatgtcaaagttcatctatgagaaaaacggattggctgcccatgacagtagctgctatgggcgtacccccacttcccctcttcatatttagtctaaaagatactctgaaaagaagaagctggccattgaatgaaggtgttatggccgtcgggcttgtatcaatattagcatcctccttactccggaatgatgtccctatggccgggccattagtggccggtggactacttatcgcatgctatgtcataacagggaccagtgccgatctgacagttgaaaaagctgcagacgtaacttgggaggaagaagcggagcaaacaggggtatcacacaatttaatgataacggtagatgatgacggcacaatgcgaatcaaagacgatgaaaccgaaaatatcttgaccgtgttactaaaaacagcacttttaatagtgagcggcatttttccgtattctattcctgcaacactacttgtatggcacacatggcagaaacaaacgcaacgaagtggtgtgctctgggatgttccatcaccccctgaaactcagaaagctgaactagaagaaggtgtctaccgcataaaacaacaaggcatcttcggaaaaacacaggttggagtgggtgtacaaaaagaaggagtatttcatacaatgtggcatgtaacgcgaggggcagtactcacttacaatggtaaaagactagagccgaattgggcatcagtcaagaaggatctcatttcgtacggtggtggttggagattatcggcacaatggcaaaagggagaagaggtacaagtcatagcggtggaacctgggaaaaatcccaagaacttccaaactatgcctgggaccttccaaaccaccaccggtgaaataggtgcaatcgccttagatttcaagccgggaacgtcaggctcacctataataaatagagaagggaaggtagtgggcttgtatggtaatggagttgtgactaaaaatggcgggtacgtcagtggtattgcccaaacaaacgcggaacctgacggaccaacaccagaattggaagaagaaatgtttaagaagaggaatttaacaattatggatttacaccccgggtcagggaaaacgcgaaaatatttacctgcaatagttcgggaagccattaaacgaaggttaagaactctgattttggctcctacacgagtggtagctgctgaaatggaggaggccctaaagggattgcctatacgatatcagaccacagcaacaaaaagtgaacacacgggtagggaaatcgtggatttaatgtgtcatgcaacatttacgatgagattacttagccccgtcagggtaccaaactacaaccttattataatggatgaagctcactttacggatccagcatcaatagcagctagagggtatataagtaccagagtagggatgggagaagcagctgccatttttatgacggccacaccacctgggaccgccgatgcttttccacaatctaacgcacctattcaagacgaggaacgcgatataccagaacggagttggaactccggaaacgaatggattactgatttcgcaggaaaaacagtatggtttgtcccaagcattaaagcaggaaacgatatagcaaattgtttacgaaagaatggcaagaaagtaatacaactcagtagaaagacatttgatacagaatatcagaaaacgaaactaaacgactgggacttcgtggtaacgaccgacatttctgaaatgggagccaatttcaaggcagatagggttattgatccccgaagatgccttaagcccgtgattctaacagacggacccgaaagggtaattctagctggacccatgccagtaacagcagctagtgctgcgcaacgacgtggtagggtaggccgtaatccgcaaaaggaaaatgaccaatatatttttacaggacaacctttaaataatgatgaagatcacgcgcattggacagaagcaaagatgttgctcgacaatattaatacacccgaaggaataataccagcactctttgaaccagagagagaaaaatctgcagctatagatggggagtacaggttaaaaggagaatcccgaaaaaccttcgttgaattaatgcgacgaggagatttaccggtctggctcgctcacaaagttgcctccgaaggaatcaaatatacggaccgaaaatggtgttttgatgggcaacggaataaccaaatcttagaagaaaacatggatgttgaaatttggactaaagaaggagagaagaagaaactaaggcctaggtggctagatgctcggacctattcggacccgttagcgctaaaagaatttaaagactttgcggccggaaggaaatcgatcgctcttgacttggtaacggagataggccgagtcccaactcatctagctcaccgaactcgaaatgcacttgacaatcttgttatgttacatacatctgagcacggtggaaaggcatatagacacgcagtggaggaactacctgagacaatggaaacattgcttttattaggactaatgattctcttaactggtggagctatgctttttctaatatcgggtaaaggaataggaaaaacaagtataggattaatctgtgtgatcgcgtcatccggtatgctttggatggcagaaatccctttgcagtggatagcttcagctatcgttcttgaatttttcatgatggttcttctcatcccggaaccagagaaacagagaactccacaagacaaccaactggcttacgttgtcataggcattctgactttagctgcgattattgcggcaaatgaaatgggtttactagaaacaacaaaaagggatttaggaatgtctaaagagccgggagtcgtctctcccacgtcttacttagacgtggatttgcatcctgcatcagcctggacactttatgcagtggcgaccactgtaataacaccaatgctacgtcatacaatagagaatagtaccgcaaatgtatcgttagctgcaattgcaaaccaagcagttgtattgatggggttagacaaaggatggcctatttccaaaatggatctaggagtacctctacttgcattaggatgttattcgcaagtaaatccactaacgctaactgctgcagtattattgctaataacgcactatgcaatcatcgggcccggtcttcaagcgaaggcgactcgagaagcacaaaaacgcaccgcagctggaataatgaaaaacccaacagtggatggcataatgacgatagacctcgaccctgtaatttatgatagtaaatttgaaaaacaacttggtcaagtcatgctcctagtattatgcgtggtacaattactactaatgagaacaagttgggcactttgtgaagcacttacgctagccaccgggcctattacgacgctatgggaaggatctccgggcaagttctggaatactacaatagccgtaagcatggcaaatatattcagaggttcatacctagcaggagctggactagcatttagtatcatgaagagtgtaggaacaggcaaacggggtaccggttctcaaggtgagacgctaggcgagaagtggaaaaagaaactaaaccaactatcacgtaaagaatttgatctatacaagaaatctgggataacggaagtagaccggacagaagcgaaggagggactgaaacgtggggaaataactcatcatgctgtctcacgtggttccgccaaacttcaatggtttgtggagagaaacatggtaattcccgaagggagggttatagaccttggttgtggccgtggaggatggagttattattgcgctggattaaagaaagtaaccgaagtccgaggctatactaaaggtgggcccggacatgaggaacccgttcctatgtctacatatggatggaacattgtgaaactaatgagcgggaaagacgtattctacttaccacccgaaaaatgcgacacgttactttgtgatataggagaatcatctccttctccaacagtagaggaaagtagaacaataagagtgcttaaaatggtcgagccgtggctcaaaaataatcaattctgtattaaagtactaaatccctacatgcccactgtgatagagcatttagagagactacaacgtaaacatggcggaatgcttgtacgaaaccccctgtcacgaaattctacccatgaaatgtactggataagtaacggaactggtaatatagttgcgtctgtaaacatggttagtcgtctcctcctgaatagatttaccatgacacatcgtagacctacgattgaaaaagacgtagaccttggcgcggggactagacatgtcaacgccgagcctgaaacgcccaacatggacgtaataggtgaaaggataaaacggataaaggaagaacataatagcacttggcattacgatgacgaaaatccatataagacttgggcatatcatggtagctatgaggtaaaggcaacagggtcggcaagctcaatgattaatggagtggtaaaactcttgactaaaccatgggatgtagttccaatggtgactcaaatggccatgacagacactacgcccttcggacaacagagggtattcaaagaaaaagttgacacgcgaacacctagatccatgcccgggactagaagggtaatggggattacagcggaatggctttggagaactttgggacgaaacaagaaaccgagactatgtacacgagaggaatttaccaagaaagtaagaacgaatgcagcgatgggtgccgtatttacggaagaaaaccagtgggattcagctaaagcagccgtcgaagatgaggacttttggaaattagtagatcgtgaaagagaattacataaactaggcaaatgtggttcctgtgtatataacatgatgggtaagcgcgagaagaaattgggagaatttggaaaagcaaaaggatcaagagccatttggtacatgtggctaggagcgaggtatctcgagttcgaagctctcggattcctaaatgaggaccactggttttctagagaaaacagctatagtggcgtggaaggagaaggactgcataagctaggatacatactcagagatatctcgaaaattccgggaggcgccatgtatgcagatgatacagctggatgggacacaaggataactgaagacgatctacataatgaagagaaaatcactcaacaaatggatccggagcatcgtcaattagctaatgcaatattcaaattaacatatcaaaacaaggtagtgaaggtgcaacgtcccacacccacaggaacagttatggacatcatatctagaaaggaccagagaggaagcggccaagtaggcacgtacggcctcaatacttttacaaatatggaagcccaactaatcagacaaatggaaggagaaggtgtattgtctaaagcagatttggaaaatccacatctgccggagaagaaaattacacaatggctagaaacaaaaggagtcgagcgtctaaaacgcatggcaataagtggagatgactgtgtcgtgaagccgatagatgaccgattcgcaaatgcgctcctcgcgctcaacgacatgggaaaagtccgaaaagatataccacaatggcaaccatcaaagggatggcatgattggcagcaggttcccttttgtagccatcatttccacgagcttataatgaaagacggtcgaaaattagtagtgccctgcagacctcaagatgagctcatcggccgagctcgaatttcacaaggcgccggatggagtctgagagaaacagcatgcttgggaaaggcttacgctcaaatgtggtctttgatgtactttcataggcgtgatcttagactagcatctaatgcaatctgctcggccgttccagtacattgggtgccaactagcagaaccacatggtctatccacgcccatcatcaatggatgacgaccgaagatatgctcaccgtgtggaaccgagtatggatcgaggataacccctggatggaggacaaaacaccagttacgacctgggagaacgttccctatttaggtaaacgcgaggaccagtggtgcggatcgctcataggtctaactagcagggcaacctgggcacaaaacatccctaccgcaatacagcaggtacgaagcctgattggtaacgaagaatttttagactacatgccgtcgatgaagaggttccggaaggaagaggagtccgaaggagcaatctggtaa

SEQ ID NO: 23404 - RNA, 9873 nt, synthetic construct
  misc_feature 1..9873: note = derived and/or modified CDS sequence (opt6) from DENV-3__FJ882577__SS-prME
  source 1..9873: mol_type = other RNA
acaagcctttgtttaatgatgatattgcccgcagcattggctttccacctaacatcacgagatggagaaccacgcatgatcgttggcaaaaacgagagaggtaaatctctgctattcaaaacagcaagtggtattaatatgtgtaccctaattgcgatggacttaggagaaatgtgtgatgatactgtgacttataaatgcccgcacataacagaagttgaacccgaagatattgactgttggtgcaatttaacatctacgtgggttacctatggaacatgtaatcaagcaggagaacacagaagagacaaacgttcggttgcactagcgccacatgtaggaatgggattagatacacggacccaaacttggatgtcagcagaaggagcatggcgtcaagtagagaaagtagaaacatgggcgctacgccacccgggtttcactatactagctctattcctcgcacactatataggtacaagtttgacgcaaaaagttgttatattcatattattaatgttggtaactcctagcatgacaatgagatgtgtcggagtaggcaatagagacttcgtcgaagggttaagcggtgccacatgggttgacgtggtacttgaacacggcggctgcgtaactacaatggccaaaaataaacctaccttagatatagagttacagaaaaccgaagccactcaattagcaacgttgaggaaactctgcatagaagggaaaattacgaatattacgacagacagtagatgtcccactcaaggagaagctgttcttcctgaagaacaagatcaaaattatgtttgtaaacacacatacgttgatcgaggatggggtaatggatgcggactatttggaaaaggatcgttagtcacatgtgcaaaattccaatgtcttgaaccgatagaagggaaagtagtacaatacgaaaatctcaaatacacagttatcataaccgtgcatacaggtgatcaacatcaagtcggaaatgaaacgcaaggagtgacagccgaaatcaccccacaagcatctacaacagaagcaattctgcctgaatacggtacactaggattagagtgttctcccaggacaggactggattttaacgaaatgattctattgactatgaaaaataaagcatggatggtacacagacaatggttcttcgaccttccgttaccgtggacatcaggtgcaactacagagacacccacctggaatagaaaagaattgcttgttacgtttaaaaacgcccatgcgaaaaagcaagaagtagtagtacttggatctcaggagggggcaatgcacacagcactgacaggcgcaacggaaatccaaaactccggcggaacaagtattttcgcaggacatctaaagtgtcggttaaaaatggataaactagaactaaaaggaatgtcatatgcgatgtgtacaaatacatttgttctgaagaaagaagtaagtgaaacacagcacggaactattttgattaaagtcgaatataaaggagaagacgtgccctgtaaaatacctttttccacggaagacggccaaggaaaagctcacaatggtcgactaataacggcaaaccccgtggtcactaagaaagaagaaccggtaaatatcgaggccgaacccccattcggtgaatctaatatagttattggtattggagataatgccctaaagatcaactggtataagaaaggttcatctattggtaaaatgtttgaagcaacggccaggggcgctcgtagaatggcaatacttggagacactgcttgggatttcggcagcgtaggaggagtattaaattcgttaggcaaaatggttcatcagatcttcggtagcgcatacactgcacttttctcgggagtaagctgggtaatgaagatcggaataggcgttctattaacatggataggtctaaacagcaaaaatacttcaatgtccttttcatgtatagctataggaataatcaccctatatctcggcgcagtagtacaagcagacatgggctgcgttataaattggaaggggaaagaacttaaatgtggttctggtatttttgtgactaatgaggtacatacttggacggaacagtataagttccaggcagattcgccgaagagactagccacagcaattgctggagcatgggagaatggagtatgtggaattaggagcaccactagaatggagaatctattgtggaagcaaatagctaacgaactaaactacatactttgggaaaataatataaagctaactgttgtagtcggggacatcataggagttcttgaacaaggaaaacggacgttgactccacagcctatggaactgaaatatagttggaaaacatggggtaaagcaaaaatagtgacagcagaaacacaaaacagttcatttattatagatggtcctaacaccccggagtgtccgtcggctagtagagcctggaacgtgtgggaggtcgaagattacggttttggggtatttacaacgaacatctggcttaaattacgtgaggtctacacccaactatgtgatcataggctcatgtcagctgcggtaaaagatgagcgcgccgtacatgccgacatgggctactggatagaatcacagaaaaatgggtcttggaaacttgaaaaagcatccttaattgaagtaaaaacatgtacttggccaaaaagtcacacactttggtcaaacggtgtacttgaatcggacatgataattccaaaatctcttgccggcccaatatcacagcataactatcgccctggttatcacactcaaacggcgggtccatggcacctgggtaaattagaacttgacttcaattattgcgagggcacaacagtagtcattactgaaaattgcggaacaagaggaccgtcattaagaactaccactgtcagtggtaaactaatccatgagtggtgttgtagatcctgcacgttaccgcccctaagatacatgggagaagatggatgttggtacggcatggaaataagaccaataagtgagaaggaggaaaatatggtgaaatctttagttagcgctggttcaggagaagtagacaactttacgatgggagtcctatgcttggctatcctctttgaagaagtgatgaggggtaaatttggaaagaaacacatgatagcagggatattctttactttcgttcttctactatctggccaaataacttggagagatatggcacataccttaataatgataggatctaatgcttccgacagaatgggaatgggcgttacctaccttgctctcattgctacttttaagatacaaccattccttgcacttggattctttctcagaaaattgacctccagggagaatttgttgttgggtgttggcctggctatggcaactacgctgcaactacctgaagatatagaacaaatggcaaacggcatcgcgcttgggcttatggcactaaagctgatcactcaattcgaaacttaccaactctggacggccttaatcagcttgacctgcagcaatacaattttcacactaactgtagcttggagaaccgccactcttattctagccggtgtaagccttctacccgtttgtcaaagcagctctatgaggaaaacggattggctgccgatgactgtagcggcaatgggagtgccgccacttcccttattcatcttttcattaaaagatacacttaaacgaagatcatggccattaaacgaaggagtaatggcggttgggctagtctcgatattagcgagttccttactacgaaatgacgtgccaatggctgggccgttagtagcaggcggtttacttattgcctgctatgtgataacgggcacttcagcggatctaacagttgaaaaggcggcggacgtgacatgggaagaagaggccgagcaaacaggcgtctcacataatttaatgattactgtagacgatgacgggacgatgaggataaaagatgacgaaaccgaaaatatattgacagtcttattaaaaacagcccttttaattgtatctggtatatttccgtatagcataccagccaccctattagtgtggcatacatggcaaaaacaaacacagaggtcaggcgtcttatgggatgttccaagtccacctgagactcagaaagcggaactggaagaaggcgtataccgaattaaacaacagggtatattcgggaaaacacaagttggtgtgggagtgcaaaaagaaggagtctttcacacgatgtggcatgtgacacgtggagcggtcttgacgtataatggtaaaagactagagccgaattgggcgtcagtcaagaaagacctaattagttacggaggcggatggcgtttaagcgcccagtggcaaaaaggtgaagaagttcaagtaattgccgttgaacccggcaagaaccccaaaaacttccaaacaatgcctgggacttttcaaactactacaggagaaataggagctatagcgctagactttaaacctggcacatcaggcagccctataatcaatagagaaggaaaaatagtaggcttatacggtaacggtgtagtgactaaaaatggaggctatgtaagtggaatagcccagacaaacgcagaaccggatggccccactccagagctagaagaagagatgtttaagaagagaaatctcacaataatggacctccaccctggctcgggtaagacaagaaaatatcttcctgcgatcgtaagagaagccattaaacgaagactacgaacattgatcctcgctccaaccagagttgtcgcagcagaaatggaggaagcacttaaaggtttaccaattaggtatcaaactacagcaacgaaaagcgaacatacaggcagggaaattgttgatttaatgtgccacgctacttttaccatgaggttactaagcccagtgagggtcccaaattacaatttaataataatggacgaagcgcactttacagatcctgcctcaatagccgctagaggatatatttccactcgagttggaatgggtgaagcagctgctatcttcatgacagccacgccacccggaacagccgatgcatttccacagtcaaatgcccccattcaggacgaagaaagggatatcccagaacgttcctggaactcgggcaatgaatggattacagattttgccggaaaaaccgtttggtttgtaccgtcaataaaggcaggtaatgatatagcgaattgccttaggaaaaatggcaagaaagtaatacagctttcacgaaagacttttgacacagaatatcagaaaacaaaacttaatgactgggacttcgttgtaactacagacataagtgaaatgggcgcaaattttaaggctgatagagtaatagatccaagacgatgtttaaagccggttatattaacagatggaccagagcgagtaatattagcaggtccaatgcccgtaacagctgcaagcgctgctcagcgacgaggtcgagttggacgtaatcctcaaaaagaaaatgatcaatatatattcacaggtcaacctctgaataacgacgaagaccatgcccactggactgaagcaaaaatgttactagacaatattaatacacctgaggggataattcctgcactatttgagccagaacgagagaaatcagcggccattgacggtgaatacagattgaaaggcgagtccagaaaaacatttgtggaattgatgagaaggggtgaccttccagtttggttggcgcataaggttgcaagtgaaggaataaagtacacagacagaaaatggtgttttgacggacagcgaaataatcaaatactggaagaaaatatggatgttgaaatatggacaaaggaaggagaaaagaaaaagttgagacccaggtggcttgacgcaagaacctacagtgatccacttgcattaaaggaatttaaggatttcgcagccgggagaaaaagcatagcattggatctagtaaccgaaattggacgtgtacctacgcatttggctcaccggacaagaaatgctcttgataacttagtaatgctgcatacatccgaacatgggggcaaggcgtacagacacgcggtagaagaactccctgaaaccatggagacattattattgctgggtctcatgatattactaacgggcggagcgatgttatttttgatttctggtaaaggaattgggaaaacatcaataggcctcatctgcgtgatagcgagtagtggaatgctatggatggctgaaatcccactacaatggatagcttcggctatagtattagagtttttcatgatggttcttcttatcccagaacccgaaaagcaaagaacaccccaggacaaccagttagcatacgtagttattggtattctaacgctggcagcaattatcgcagcaaacgaaatgggactactcgagactactaagagagatttgggaatgagtaaagaaccaggagtcgtttcgccaacctcgtacttggatgttgaccttcacccagcatcagcctggactttatacgccgtagccacgactgtaataacaccgatgctaaggcatactatagaaaacagcactgcaaatgtcagcctggcagcaatcgcaaatcaagctgttgtattaatgggtcttgacaaaggctggccgataagtaaaatggatctaggtgtacctttactcgcactgggatgctattcccaagtaaatcccttaacactaaccgcagcagtgttactcttaatcactcattacgccattataggacctggacttcaagcaaaggccacaagagaagctcaaaaacgtactgcagcaggtattatgaaaaatccaaccgtcgacggtataatgacaattgatttagatcccgttatttatgacagcaaatttgagaaacaattgggacaagtcatgttattagtactatgtgcagtgcaattactattgatgaggacttcatgggcattatgtgaagctctaacattggccacaggaccaatcactaccttgtgggagggatccccaggaaaattctggaatactacaatagcggttagcatggctaatatcttccgcggctcatatttagctggcgcgggcctagctttcagtattatgaaatcggttggtacaggaaaaagagggactggaagtcaaggtgaaactttgggagaaaaatggaaaaagaaactaaaccaactgagtcggaaagagtttgacctatacaagaaatcaggaatcacagaggtggatcgaacagaagcaaaagaaggattgaaaagaggagagataacacatcacgcagttagtagaggaagtgctaaacttcaatggtttgttgagcggaatatggttatacccgagggtagggtgattgatctggggtgtggaagaggcggttggtcatattactgtgctggactaaagaaagtgaccgaagtgagaggctacacaaaaggtggtcccggtcatgaagaacctgttcctatgtctacttatggatggaacattgtaaaattaatgagcggtaaagatgtattttacttaccaccagagaaatgcgataccttattatgtgacataggcgaatcatcaccttcaccaacagtcgaagaatctagaacaatccgtgtcttaaagatggtcgaaccgtggctcaaaaataatcaattttgtataaaggtattgaatccatacatgccaactgtaatagagcatctcgaaagacttcagagaaagcacggcggtatgttggtgagaaatccattgtctcgcaacagcacacatgaaatgtattggataagtaacggtactgggaacatagtcgcatcagtgaatatggtatcaaggctactgttgaaccgcttcactatgacacaccgtcgaccgactatagaaaaagatgttgatctaggcgcggggacacgacatgtaaatgctgaaccagaaacccctaatatggatgttatcggcgaaaggataaaaagaataaaagaggaacataacagtacttggcactatgatgatgaaaatccttacaaaacatgggcatatcacggaagttacgaagtgaaagccacgggaagtgcgagttcaatgataaatggcgtggtcaaattattgacgaagccttgggacgtagttcctatggtaacccaaatggcaatgactgacacaactccttttgggcaacaacgagttttcaaagaaaaagtagatactcgtacacctcgcagcatgccagggactagaagagttatgggtattacagcagaatggctatggaggacactcggaagaaataagaaaccaaggttatgtacgagagaagaatttactaagaaagtaagaactaatgccgcaatgggtgccgtctttaccgaagaaaaccaatgggattcggcgaaggcagcagtggaagatgaggatttctggaaacttgtagaccgtgaaagagagctacataaattgggaaagtgtggatcttgcgtttataacatgatgggcaaacgtgagaagaaattaggtgagtttggtaaagccaagggatcacgggccatatggtatatgtggctaggcgctcgttacctcgaatttgaagcgttaggctttttaaacgaagatcattggtttagtagagaaaattcatattcaggagtagagggagaaggtcttcataagctggggtatattcttagggacataagtaaaataccaggtggcgcgatgtatgcagatgacactgctggatgggacaccagaattacagaggatgatctacataacgaggagaaaataacacaacaaatggatccagaacaccggcagttagccaatgcgatatttaaacttacatatcagaacaaagtggttaaagttcaacgaccaacccctacaggtacagttatggatatcatcagccgaaaagatcaaagagggtcaggacaagttggaacatatgggttaaatacattcactaatatggaagctcaattaataagacaaatggaaggcgagggcgtgttatcaaaggctgatctagaaaatcctcatctacctgagaagaaaataactcagtggctagagacgaaaggcgtggaaagattaaaacgtatggccattagtggggacgattgcgtagtaaaaccaatagacgatcgattcgcgaatgccttgttagcattaaacgatatggggaaggtgcggaaggatatcccacagtggcaaccttcgaaagggtggcacgattggcaacaagtgccattttgttcccatcactttcatgaactcatcatgaaagatggtcgcaagctagtagtgccctgtcgccctcaagacgaactaataggtagagcaagaatcagccaaggcgctggttggtcactccgtgaaacagcttgtttaggcaaggcatacgcacaaatgtggtcactaatgtactttcaccgccgcgatcttcgattagcgtcaaacgccatatgctcggcagtacctgtacactgggtacccacatctagaaccacatggagcatacatgcacatcatcaatggatgaccactgaagatatgcttaccgtatggaatcgagtgtggattgaagacaacccttggatggaagataagacgccggttaccacatgggaaaatgtcccttatctaggcaaacgggaagatcaatggtgcggttcgctaattggcttaacttccagagcgacgtgggctcagaatattccaactgccatccaacaagtacggtctctaattggtaacgaagagttcttagattacatgccgtcaatgaaaaggtttcgtaaggaagaagaaagtgagggtgctatatggtaa

SEQ ID NO: 23405 - RNA, 9873 nt, synthetic construct
  misc_feature 1..9873: note = derived and/or modified CDS sequence (opt6) from DENV-3__FJ850096__SS-prME
  source 1..9873: mol_type = other RNA
acgagtctatgtctgatgatgattctgccagcagctcttgcctttcatctaacttctagagatggagaaccaagaatgatcgtagggaaaaatgaaagaggcaaatctttattattcaaaacagctagtggcataaacatgtgtacgcttatagccatggatttaggggaaatgtgtgacgatacagtaacctacaaatgtcctcatattacagaagtcgaacctgaagacattgattgttggtgcaacctgacttcgacttgggtcacgtacggaacttgtaatcaggccggtgaacaccgtcgagacaaaagatccgtggcattagccccgcatgttggcatgggacttgatactcgaactcaaacttggatgagtgcggaaggcgcatggagacaagtagaaaaagtagaaacgtgggccttaagacaccctggctttacaatattggcattattcttggctcattatataggtacaagtctaacgcaaaaagttgtaattttcatcctattgatgctagttacgccctcaatgacaatgaggtgcgttggtgtgggtaatagagattttgtcgaaggactatcaggagccacatgggttgatgtggtacttgagcacggcggatgtgtaacaactatggcgaaaaacaaaccaacgttagatatagaactacagaaaactgaagcaacacaactagcgacactaagaaaattgtgtattgaggggaaaataacaaacatcacgactgattctagatgcccgacgcaaggagaagccgtattgccagaggaacaagaccaaaactacgtatgcaagcacacatatgtagataggggctggggaaatggctgtggcctttttggtaaaggatcgctagttacatgtgccaaatttcaatgcctggaaccaatcgaaggtaaggttgtacaatatgaaaatttaaaatacactgtaattataactgttcatacgggggaccagcatcaggtaggcaacgagacacaaggtgtaacagccgaaattacgccgcaagccagtactactgaggcaattctacccgaatacgggacacttggccttgaatgctctccaagaacaggactggatttcaatgagatgatacttctaaccatgaaaaataaggcctggatggttcatcgacaatggttctttgacctgccacttccatggacctcaggagcgacaacggaaacacccacttggaaccgcaaagaactattagtaacattcaaaaacgcccatgccaagaaacaagaagttgtagtattaggtagtcaagagggagcaatgcacactgcattgactggtgcaaccgagatacaaaatagcgggggcacatctatctttgcaggacacttaaaatgtagactaaagatggacaaattagagttgaaaggtatgagttacgcgatgtgtacaaatacctttgtactaaagaaagaggtatcagagacacaacatgggacgattctaataaaggttgaatacaagggggaggatgtcccatgtaagatacctttttcgacagaagatggtcaaggaaaagctcacaacggtaggctaatcactgcgaatcccgtagtgacgaagaaagaagaaccagtaaacatagaggcagaaccgccgtttggcgaatctaatatagttatagggattggagataatgccctaaaaataaattggtacaagaaagggtcatcaattggaaagatgtttgaggcaactgcgcgaggcgcaaggagaatggcaattttaggcgatacggcttgggactttggatcagttggaggtgtactaaattcattgggcaagatggtacaccagatattcggaagtgcttacacagctctgtttagcggtgttagctgggtcatgaagattggtataggtctactgttgacgtggattggactaaattctaaaaacacgagtatgagcttttcatgtattgcgataggtataataacattgtatcttggtgcagttgtgcaagctgatatgggatgtgtaattaattggaaaggaaaagaactaaagtgtggatctggaattttcgtaactaatgaagttcacacttggaccgaacagtataaatttcaagcggattcacctaaacgacttgccacagcaattgccggcgcatgggaaaatggcgtatgtggcattcggtcaacaacgcgcatggaaaatttactgtggaaacaaatagcaaacgaattaaattacatactatgggaaaacaacatcaaattgactgtagtagttggtgatataattggagtcctggaacaaggcaagagaacgttaacaccacaacctatggaattaaaatattcatggaaaacttgggggaaagcaaaaatagtcacggcggaaacacaaaatagcagttttatcatcgatggtccaaacaccccggagtgtcccagcgcatccagagcatggaacgtatgggaagtggaggattacggctttggagttttcacaacaaatatatggttgaaactgagagaagtatatactcaattatgtgatcacaggttaatgagtgcggccgtaaaggatgaacgcgcagtacatgcagacatggggtattggatagaaagtcagaaaaatggttcatggaaacttgaaaaagcgtcattgatagaggtaaagacctgtacctggcccaaatcgcacacattatggagcaatggtgtattagagagtgacatgataataccaaaatcgttggcaggaccgatctcacagcataactataggcccggataccatacacaaacagccggcccgtggcacttgggtaaattagaattagatttcaattactgcgaaggtacgacggtagtaattacggaaaactgcggaacaagaggcccaagtttgcggactacaacggtatctggtaaacttatacacgaatggtgctgtcgaagttgtacattaccgccattacgctatatgggcgaagatggctgttggtacggtatggaaattagaccgataagtgagaaagaggagaacatggtaaaatcgctggtttcagcgggtagcggagaagttgataacttcacaatgggagtattatgcttagcaattttatttgaagaggtgatgcggggtaagtttggtaaaaagcacatgatagccggggtattctttacatttgttttattactatctggacaaataacatggagagacatggcccacacattgatcatgataggatccaacgcttcagatcgaatggggatgggcgtaacctatctcgcattaatagctacgttcaaaatacaacccttccttgcgttagggttctttttgagaaaacttacttcaagggaaaacctactactaggtgtaggactagcaatggctacaacactgcaacttccagaagatatagaacaaatggcaaatggtatagctctaggccttatggcgttgaaactcatcacacaatttgaaacatatcaactatggacagcattgatatctttaacttgctccaacactatcttcacgttaacagtagcatggaggactgctaccttaatactagctggcgtcagtctcctaccagtctgtcagtcatcatctatgaggaaaacggactggctacctatgactgtggctgccatgggagttcctccgctacctttgtttatattcagtttgaaagatactctgaaaagaagaagttggccgttaaatgaaggagtgatggcggtgggattagtttcaatcctcgcatcgtccttattacggaatgacgtgcctatggcaggtccattagttgcgggcggtttattgatagcttgttatgtcataacaggaacgagtgcagaccttaccgtggaaaaggcggcggacgttacatgggaagaagaagctgagcagacaggagtaagccacaaccttatgatcacagttgatgatgatggtacaatgaggataaaagatgatgaaacagaaaacattctaacagtacttttaaaaacggcactactgatagtatcagggatattcccttattcaatacctgcgacattattagtatggcacacctggcaaaagcaaacgcaaaggagtggagtgttgtgggatgtcccgagtccgcctgaaactcaaaaggcagagttagaagaaggagtatatagaatcaaacaacaaggaatttttgggaagacacaggtaggcgttggcgtacaaaaagaaggagtcttccacacaatgtggcatgtaactcgcggtgctgttttaacttacaacggtaaacgtttagaacctaattgggcaagtgtcaagaaagatcttattagttacggaggtggttggcgcttgagtgctcaatggcaaaaaggagaagaggttcaggtgatagcagtcgaaccaggaaagaatccgaaaaattttcaaacaatgccagggacatttcagactacaacaggcgaaatcggagctatagcattagactttaaacctggtacatcaggatctccaataattaacagagagggcaaagtggtgggtctttatggcaatggcgttgtaactaaaaacggaggatacgtgagcggtatcgcgcaaactaacgctgaaccagatgggcccacaccggaactagaagaagagatgttcaagaaacgtaacttaaccattatggatttgcatccagggagcggtaaaacacgaaagtatctcccagcaatagtaagagaagcaataaagcgaaggttacgcacacttattttggcgcccacgcgagtggtagcagcagaaatggaggaagctctaaaaggattaccaatcagatatcaaactactgcaacaaagtcggaacatacgggcagagaaattgtggatttaatgtgccatgcgacattcacaatgcgcttattgtcaccagtacgagttccaaactacaatttaataataatggatgaagcccactttactgatccggcatcgattgccgcgaggggctatataagcacaagagtaggcatgggagaagcagccgcaatttttatgacggcaacgccaccaggaactgctgacgcatttccccaatcaaatgctcctattcaggatgaagaacgggatattccagagagatcctggaactcaggaaacgaatggatcaccgattttacaggcaaaacagtatggttcgtaccaagcattaaggcaggtaatgatatcgccaattgcctaaggaaaaatggtaaaaaggtgatccaattatcacgaaaaacgtttgataccgaatatcagaaaaccaaacttaatgactgggatttcgtagtaactactgacatttcggaaatgggcgctaatttcaaggctgaccgagttatagaccccagacgatgtctgaagccagtaattttgacagacgggccagaaagagttattttagcgggccctatgcccgtcaccgcggccagtgcagcacagagacgtggacgtgttggaaggaatcctcaaaaagagaacgatcaatacatattcaccggtcagccactaaataacgatgaagatcatgcacactggactgaggcgaagatgttactcgataatattaatactccggaaggaataattcccgcattattcgagccagaaagagagaagtcagcagccatcgacggagagtatcgtctaaagggcgaatcacgtaaaacgtttgtagaactgatgcgtcgaggtgatcttcccgtttggctcgcacataaagtagctagcgaaggtatcaaatacacagatcgcaaatggtgctttgatggacaaaggaacaaccaaatattggaggaaaatatggatgtggagatttggactaaagaaggggagaaaaagaaactacgtccgcgatggttagatgcacgaacatatagcgacccccttgctctaaaagaatttaaagactttgcagcgggaagaaaatccatcgctctggaccttgtaaccgaaataggtagagttccaagccacttggcgcataggacgcgtaatgcacttgataacttagtaatgcttcatacaagcgaacatggcggtaaagcctaccgccatgcagtagaagaattaccagaaaccatggaaacgctacttctattggggctaatgattctattaaccggcggagcaatgctgttcctgataagtggaaaaggaataggaaaaacatctatagggttaatatgcgtaattgctagtagtggaatgctatggatggcggaaatcccactccagtggatagcatcagccatagtactggaatttttcatgatggtgttactgattcctgaaccagaaaaacaacggacaccacaggacaatcaattagcatacgtagtgatcggcatattaaccttggcagcgattatagcagctaacgagatgggactactcgaaactactaaaagggacctaggaatgagtaaagagcctggagttgtttcgccaacatcatacttggatgtagacttacaccctgcatccgcttggacattgtatgccgtagccactacagtaataacacccatgctaagacacaccatagaaaatagcacggcaaatgtaagtttagcagccatagcaaatcaggcagtagtgctcatgggtcttgacaaaggatggcccatatccaaaatggatttgggtgttccattattggctctcgggtgttattcacaagtcaaccccttgaccctcaccgctgctgtgttgctgcttatcacacactacgcgataattggaccgggactccaggcaaaagccactcgcgaagcgcaaaagagaactgctgcaggaataatgaaaaacccaacagtggatgggataatgacaattgacttagatccagttatttatgacagtaaatttgaaaaacaactcgggcaagtaatgctcttggtattatgcgcagttcaactacttttaatgagaacatcatgggcattatgcgaggcgttaacacttgctacgggaccaataacaactctatgggaaggatcaccaggtaaattttggaatactacgatagctgtctcgatggcgaatatatttagggggtcttatttagccggtgctggactagctttcagcattatgaagtctgtgggtaccggaaaacgaggaactggatctcaaggagaaactctaggtgagaaatggaagaagaaattaaatcagctcagtcgaaaagagttcgacctatataagaaaagtgggatcacagaagttgacaggaccgaggcaaaagaaggccttaaaagaggggagataactcatcatgcagttagtaggggaagcgcaaagctacaatggttcgttgaaaggaatatggttataccagagggacgagtaatagatcttgggtgtgggagaggcggatggagctattattgcgctggccttaaaaaggtcactgaagtaagaggatacacgaagggaggcccaggccacgaagaaccagtacctatgtcaacttatggctggaatatagtaaaacttatgtccggaaaagacgtattttaccttccaccagaaaaatgcgataccctactatgcgatataggagagtcatctccatcacccacagttgaagaatcacgcactatacgcgtactaaaaatggtcgaaccttggttgaaaaacaatcaattttgcattaaggtgttaaacccttatatgccgactgttatagaacatcttgaaaggttacaaaggaaacacggagggatgctagtaagaaacccgctgagccggaacagcacacatgaaatgtattggatatccaacgggactggcaatatagtcgcgtctgtgaacatggtatcaagactattattgaatagatttaccatgactcatcgaagaccaactattgagaaagatgtagacctaggagctggaactaggcacgtaaacgctgaaccagaaacaccaaatatggatgttattggggaaagaattaaaagaattaaagaagaacacaactcaacgtggcactatgatgatgaaaatccttacaaaacatgggcatatcatgggagctacgaagttaaagctacgggaagtgcttcatctatgatcaatggagtagtcaaactcctaacaaaaccatgggatgtcgtcccaatggtaacgcaaatggcaatgactgacaccactcctttcggccagcaaagggtatttaaagaaaaagttgacacccgaaccccacgtagtatgcctggaacacgaagagtgatgggaataactgctgaatggttgtggcgaacattaggccggaacaaaaagccgcggctctgtacacgagaggagttcactaagaaagtacgtactaatgctgctatgggcgccgtctttactgaggagaatcagtgggactcagcaaaagcggcggtcgaagatgaagatttctggaaattagtagatcgagaacgcgagttacacaaattagggaaatgcggctcttgcgtttacaatatgatgggaaaacgcgagaagaaattaggggaatttggaaaagctaaaggaagcagagctatctggtatatgtggttaggagcaagatacctagaatttgaggctctcggctttttaaacgaagatcactggttttcaagagaaaacagttatagcggagttgagggtgaagggctgcataaattagggtatattttgcgtgatatatcgaagattcccgggggagcaatgtatgcagatgatacagcggggtgggacacgagaataaccgaagatgatttgcataatgaggagaaaataacccagcaaatggatccagaacaccggcaacttgcgaatgctatatttaaactcacataccagaataaagtagtaaaagtacaacgaccgacaccaacgggtactgtgatggacattatctcaaggaaagatcagcgtggatctggacaagtgggcacctacggattaaacacattcactaacatggaggcccaactaatcagacaaatggagggcgaaggtgtattatccaaagctgatttagaaaatcctcatttacccgaaaagaaaattacacaatggctagaaactaaaggcgttgaaaggttaaaacgaatggccatctccggagacgattgtgtcgtaaaaccgattgatgatcgtttcgccaatgcgctgttggcattaaatgacatgggcaaagttcgaaaagacataccacaatggcagccatcaaaaggatggcacgactggcaacaagttcccttttgttcacatcatttccacgagctaataatgaaagacggacgtaaactggtagttccctgcagaccccaagacgagttaatagggagagctcgtatatcgcaaggggcaggttggtctcttagagaaacagcatgcctaggtaaagcatacgcacaaatgtggagcctaatgtactttcatagaagagatctacgtctagcatcaaatgcaatctgtagtgcggttcccgtacattgggtcccaacgtcgcgtactacgtggtcgatacatgctcatcaccaatggatgacaaccgaagatatgcttacagtatggaacagagtatggatagaagataatccgtggatggaagataagacacctgtaactacatgggaaaacgtaccatatcttggtaaacgagaagatcaatggtgtggctctttaattgggctaacatcgagagcaacatgggctcagaatataccaactgctatccaacaagtacgaagtcttattggaaatgaagaatttcttgattatatgccttcgatgaaacggtttaggaaagaagaggaatcggagggagccatctggtaa

SEQ ID NO: 23406 - RNA, 9873 nt, synthetic construct
  misc_feature 1..9873: note = derived and/or modified CDS sequence (opt6) from DENV-3__FJ882578__SS-prME
  source 1..9873: mol_type = other RNA
acctcactatgcctaatgatgatattaccagcagctctcgctttccatctaacgagtagagacggagaaccgaggatgatagttggtaaaaatgaaagaggaaaatcgctactttttaaaacagcatctgggataaacatgtgcacactaatagcaatggatctgggagaaatgtgtgacgacactgtaacatataaatgtccccatattacagaagttgaaccagaagatattgactgttggtgtaacttaacaagtacttgggtcacgtatgggacatgtaaccaagcgggagaacatcgaagagataaaaggagtgttgctctagcgccgcatgttggaatggggttggacacaagaactcaaacttggatgtccgctgaaggcgcatggagacaagtagagaaagtagaaacatgggcactgagacacccgggttttactattttagcactctttttagcacattatataggtacaagcctcacgcagaaagtagtaattttcattctcttaatgttagtgacaccgtccatgactatgaggtgcgtcggcgtgggcaatagggatttcgtagagggattgtccggggcaacctgggtggatgtagtcttagaacatggaggatgtgtaacaaccatggccaaaaacaaaccaacattagatatagaattacagaaaaccgaagcaacacagttagctactctacgaaaactttgtatcgaaggaaagataacaaatatcacaacagactctaggtgccctacgcagggagaagcagtactaccagaagaacaagaccaaaactatgtttgcaagcatacgtatgtagataggggatggggcaatggatgcggattatttggcaaaggctcgttggtcacatgcgctaaatttcaatgcctagaacccattgagggtaaggttgttcaatacgaaaatttaaaatacaccgtcattatcactgtccacacaggagatcaacaccaagtaggcaatgaaacacaaggagtaacagcggaaattacaccccaggcatcaacaaccgaagcaattctgccagaatatggcacgctagggctagagtgctcgccaagaacaggtttggatttcaatgagatgatattattaacaatgaagaacaaggcttggatggtccacaggcagtggttctttgacttgccattaccttggacttctggtgcaacaaccgaaacgccaacctggaataggaaagaattacttgttacttttaaaaatgcacatgcaaagaaacaagaagtagtagtacttggctcacaagaaggagctatgcatactgcactaaccggtgcaacagaaatccagaatagcggtggaacatctatattcgctggtcaccttaaatgtagactcaaaatggacaaacttgaactaaaggggatgtcgtatgccatgtgcacaaatacttttgtattgaaaaaggaagtgtctgaaacacagcacggcacgattctaataaaggtagaatacaaaggagaagatgtcccatgtaaaattccattcagcacagaggatggacaaggaaaagcacataacggacgtttaattactgcgaaccctgtcgtgactaagaaagaggaaccggttaatatagaagctgaaccaccctttggcgaaagcaatattgttataggaatcggagacaacgccttaaagattaactggtataagaaaggtagttcgattggcaaaatgtttgaagcaacggcaagaggtgctcgaagaatggcaatcctgggggatacggcttgggattttggatccgtcggcggagttctaaatagtcttggaaagatggtccatcaaatatttgggtcagcatacaccgcactgttttcaggagtttcgtgggttatgaaaattggaattggagtactgctaacctggatcgggttaaattctaaaaacacaagtatgtcattttcttgtatagctattggaataataaccttatatctaggggcagtagtgcaagcggatatggggtgtgtaataaactggaaaggaaaagaactaaagtgcggatcggggatctttgtcacaaatgaagtacatacttggacggagcaatataaatttcaggccgattcaccaaagcgactagcaaccgccatagcaggcgcatgggaaaacggggtatgtggcattagatctactaccaggatggaaaatttattatggaaacagatagcaaacgagctaaactacatcctttgggaaaataatatcaagctgacagtcgtagttggggacactatcggagtactagagcaaggaaaaaggatcctcacacctcaaccaatggagttaaagtactcgtggaaaacttggggaaaagctaaaatcgtaacggccgaaacacaaaattcttcatttattattgacgggcctaatacacctgaatgtccatccgccagtcgagcctggaacgtatgggaggtcgaagactacggatttggcgtatttaccacaaatatatggttgaaactaagggaggtatacactcaattatgcgatcatagactcatgtcggcagctgtaaaagacgaacgagccgtacacgcagacatgggatactggatagaatcacaaaagaacggatcttggaaacttgaaaaagcatcactgatcgaagtaaaaacatgtacatggccaaaaagtcatacattatggtcaaacggagtgctcgaatcagacatgatcatcccgaaatctttagcgggtccaatctctcagcacaattacagacctggatatcacactcaaactgccggaccatggcatttagggaaactagaacttgactttaactattgcgaaggcactactgtagtgataaccgagaattgcggcacaagaggacctagtttgagaacaacaacagttagtggaaaacttatacatgaatggtgctgcagatcttgtactttacctcctttaagatatatgggggaagatggatgctggtatggtatggagatacgacccatttccgagaaggaagagaacatggtaaagtctctagtgtcagctggaagtggagaagtagataacttcacaatgggcgtgttatgtctggccatactttttgaggaagttatgcgcggaaaattcggaaagaaacatatgatagcaggagtatttttcacatttgttttgctactcagtgggcaaataacatggcgagacatggcacatactctcatcatgataggtagtaatgcgagcgaccgaatgggaatgggtgtgacatatctggcacttattgcaacatttaaaatacaaccctttctagcattaggattctttctcagaaaattaacctctcgagaaaatctcttactaggggtcggtctagcgatggcaactacactacagttaccagaagatatagaacaaatggcgaacggaatcgcactaggtttaatggcactaaaattaatcacgcaattcgaaacatatcagctatggactgccttaatctctctaacttgctcaaacaccatatttacccttacagtagcatggaggacagccacactaatcttggcaggagtttcacttttgccggtgtgtcaatcatcgagtatgcgtaaaaccgactggcttccaatgacagttgcagctatgggggtcccacccttaccgctttttatcttctcattaaaagacactctgaaacgccgaagttggccattgaatgagggggtaatggcagtgggattggtttcaatactagcaagtagtttattacgtaatgacgtgccaatggctggaccactggtagcgggtggtttgctaatagcctgttatgtcataacagggaccagcgcagatctaacagtagaaaaagcagcagatgttacatgggaagaagaagcggaacaaaccggagttagtcacaatctaatgatcacagtcgatgatgacggaaccatgcgtattaaagatgatgaaactgagaatatattgacggtgctattaaagacggctttattaatcgtaagtgggatatttccctactccatacctgccacgttgctcgtttggcatacttggcagaaacaaacccaaaggtccggggtcttgtgggatgtaccatctccacctgaaactcagaaagcagagttagaagaaggtgtttatagaattaagcaacaaggaatatttggaaagacacaagttggtgtcggcgtgcagaaggaaggcgtttttcacaccatgtggcatgttacacgaggggctgtactaacatacaatggtaaacgattagaacctaactgggcatcagttaaaaaggatcttataagttacggaggcggctggcgtttaagcgcgcaatggcaaaaaggggaagaagtacaagtaattgccgttgagccaggcaaaaaccctaaaaacttccaaaccatgcccggtacatttcagacaacaacgggcgaaataggtgctattgccttagatttcaaaccaggcacttctggttcaccgatcataaatagggaaggtaaagttgtaggcctgtacgggaacggtgtagtcactaaaaatggtggctatgtatcaggaattgcacaaacaaatgcagaaccagacggacccacccctgaacttgaagaggaaatgttcaagaaaagaaatcttacaataatggacctgcatccagggagtggaaaaacccggaaatatttacctgctatcgtcagggaggcaattaagaggagattaagaacgttgatcctcgctcccacacgcgtagtggctgcagaaatggaggaagcattaaaaggcttacctattaggtatcaaacaacggccaccaagtcagaacacacaggaagagaaatagtagatctaatgtgccatgctacttttacaatgaggcttctatccccagttagggtacccaattacaacttaattatcatggatgaagcacattttaccgatcctgcaagtattgctgcacggggatacataagcacccgcgtaggaatgggcgaagccgctgcaattttcatgactgccaccccaccaggaacggctgacgcatttccgcaaagcaatgcaccaatacaggatgaagagagggacatcccagaaaggtcttggaacagtggaaacgaatggatcacggattttgccggtaagaccgtatggtttgttccatctataaaggcaggaaacgacatagccaactgtttaaggaaaaacggcaagaaagtaatacaattatctagaaaaacatttgatacggaataccagaaaactaaactaaatgactgggattttgtagttacaacagatatctccgaaatgggagcaaattttaaggcagatcgtgttattgacccaagaagatgtttaaaaccggtgatattgaccgatggtccagaacgagttatcctagccgggcctatgccagtgacggccgccagtgcagcacaaagaagaggacgtgtcggaagaaatccgcaaaaagaaaacgaccaatacatatttacaggacaacccttaaataacgacgaagatcatgcacactggacagaggcaaaaatgctcctcgataacataaacactcccgaaggaatcattccagctctttttgaaccagaaagggagaaatctgccgctattgatggtgaataccgtctcaaaggtgaatcccgcaagaccttcgtcgaattaatgcgtagaggtgatcttccagtatggcttgcacataaagtagcctcagaggggataaaatatacagatcggaaatggtgctttgacgggcagaggaacaatcagattttagaggagaatatggatgtcgaaatatggacaaaagagggtgagaaaaagaaacttagaccccgatggctagacgctcgaacatattccgaccctttagctcttaaagagttcaaagacttcgctgcgggtagaaagtcaatcgcactggatctcgtaactgaaataggtagggtaccaactcatttagcacataggacaagaaatgcactggataatttagtaatgctacatacctctgagcacgggggcaaggcttataggcatgcggtcgaggaactgccagaaactatggaaacattactgctattaggtctaatgatattactaactgggggcgcgatgttatttttaatttcaggaaaaggtattggaaagaccagtatcggtctaatatgcgttattgctagctctggtatgctatggatggcagaaattccccttcaatggattgcaagcgctatagtactagagtttttcatgatggtcctacttatcccagaacccgagaaacaaaggactccacaagacaatcaactggcatatgtagtaataggcatactcacacttgctgcaataatcgccgcaaatgagatgggtttactcgaaacgactaaaagagatttaggaatgagtaaagaaccgggagtagtaagccctacatcgtatcttgatgtggatcttcatcccgcttcagcttggactctatatgcggtagcaactaccgttataacgccgatgcttagacacacaatagaaaattctaccgccaatgtgtcactagcagcaattgcaaatcaagcagtggtattgatgggactagataaaggatggccgatctccaaaatggatttgggtgtcccgctcttagctttgggttgttacagccaagttaacccgctcacattaacagctgcagtattgctgcttattactcactatgcgatcattggacctggtttacaagccaaggcaacaagagaagctcagaaaaggacggctgccggaatcatgaaaaatcctacagtagatggtatcatgacaatagatctagatccagtaatatatgattcgaagtttgagaaacaattgggtcaagtaatgctactcgtcctgtgtgcagtccaattactactaatgaggaccagttgggcgttatgcgaggctttaaccctagccaccggcccaattacaacattatgggagggatcccctggaaagttctggaacacaactatagcagttagcatggcgaacatttttaggggatcgtatctggccggtgcagggctcgcattctcgatcatgaagtcagtaggaactggcaaaagaggcacgggttcgcaaggggaaacactcggagaaaagtggaaaaagaaactaaaccaactatcaagaaaggagtttgatctatataaaaagtctggaataaccgaagtcgatcgtactgaggcaaaagagggtctaaaaagaggagaaataacgcatcatgcggtttcacgcggttcggctaaactgcaatggtttgttgaaagaaacatggttattccagagggacgcgttatcgacctgggatgcggtcgtgggggctggagctattactgcgcaggacttaagaaagtaacagaagttcgcgggtacaccaaaggaggcccaggacatgaagaaccggtaccgatgagcacttacggttggaatattgtaaaacttatgtctggaaaagacgtattttacttaccaccggagaaatgcgacacgttactctgtgatattggggaatctagtccttcaccaactgtggaagaatctagaacgataagggtgttaaaaatggtagaaccttggctaaagaataaccaattttgcattaaagttctaaacccttacatgccgactgttattgagcatttagagcgtcttcaacggaagcacggtggtatgctagtccgaaatccattatcaagaaactctactcatgaaatgtattggatttctaacggaacgggtaacatagtagcttccgtcaacatggtatcaagactattgttaaataggttcacaatgacacatcgacggccaacaatagaaaaggacgttgacctaggagctggcacaagacatgtaaacgccgaaccagagacgcctaacatggacgtcataggggaaagaattaaacgtataaaagaagaacataacagcacatggcactacgacgatgaaaatccatataaaacgtgggcctatcatgggtcttacgaggtaaaagccactggatcagcttcatcaatgataaatggggtcgtaaaattattaactaaaccatgggatgtagttccaatggttacgcagatggctatgaccgatacaaccccatttggacaacaaagggtcttcaaggagaaagtagataccagaaccccacgatctatgccaggcacaagaagagtaatgggtattactgcagaatggctatggaggacgttaggtagaaataaaaagcctagattatgtacacgtgaggaatttaccaagaaagtgcgaactaatgccgcaatgggtgcagtttttacggaagagaatcagtgggactctgctaaagccgctgtggaagacgaggatttttggaagttagttgacagagaaagagaattacacaaattgggaaagtgtggctcatgcgtatacaatatgatgggcaaacgggagaagaaattgggggagttcggcaaagcaaaagggagccgggccatatggtacatgtggcttggtgcccgttacttggagttcgaggccctaggtttcttgaatgaagatcactggttttcacgagaaaattcttatagcggtgtagagggtgaagggctccacaaattaggctacatactcagagacatatcgaaaatcccagggggcgcgatgtacgcagatgacaccgcagggtgggacacccgtatcacggaagatgatctacataatgaagagaaaatcacgcagcagatggatccagaacatcgtcagctcgcaaatgcaatattcaaattaacatatcaaaataaagtagtaaaagtccaacggccaaccccaaccgggactgtgatggatattatatctagaaaagaccaaagaggatcgggtcaagttggaacatatggattgaacacttttacgaacatggaagcccaactaataagacaaatggagggagagggtgtcctgtcaaaagcagatttagaaaatccgcacttgcctgagaagaaaattacacaatggttagaaacaaaaggagttgagagacttaagagaatggcaatatcaggcgatgactgcgtagtaaaacccatagacgacagatttgcaaatgcactactggcgcttaacgatatgggaaaagtaagaaaagatataccacaatggcaaccgagcaaaggatggcacgattggcaacaagtacccttttgttcacaccacttccacgaactaataatgaaggacggtaggaagctagtggtaccttgtcggcctcaagatgaactaattgggcgggctaggatatcgcagggagctgggtggtcgcttcgtgaaaccgcttgtcttgggaaagcatatgctcaaatgtggtccctgatgtacttccatagacgtgatctacgattagcatccaacgcaatctgtagtgcagttccggttcattgggttcccacatcaaggaccacttggagcatacatgcacatcatcagtggatgacaacagaagacatgcttaccgtgtggaaccgagtttggatagaagataacccctggatggaagataagacccccgtcactacctgggaaaatgtaccataccttggaaaaagggaagatcaatggtgtggaagcctaattggcttaacatccagagcaacttgggcacagaatatcccaacagcaatacaacaagtgaggtctctaatcggcaatgaagaatttttagactacatgccctctatgaagcgattcagaaaagaggaagaatcagagggagctatatggtaa

SEQ ID NO: 23407 - RNA, 9873 nt, synthetic construct
  misc_feature 1..9873: note = derived and/or modified CDS sequence (opt6) from DENV-3__FJ639770__SS-prME
  source 1..9873: mol_type = other RNA
acaagtttatgtctgatgatgatacttcctgcagcactagcattccatttaactagccgtgatggagaacctagaatgatagtcggtaaaaacgaacgggggaaatcactgctatttaaaacagcttctggaatcaatatgtgcacactaatagcaatggacctaggagaaatgtgcgatgatactgttacttacaaatgcccgcatataacggaagtagaaccagaagacattgattgctggtgtaatttgacttcaacatgggtgacttatggaacttgcaaccaagcaggagaacacagaagagacaaaagatccgttgccttagcgccacatgtaggtatgggattagatacaagaacacaaacatggatgtcagccgaaggtgcgtggaggcaagttgaaaaagtagaaacatgggcacttaggcatcccggtttcactattctagccctatttctcgcgcattatattggtacgtcactcacacaaaaagtggttatctttatactcctaatgctagtaacacccagtatgacaatgagatgcgtgggggtaggtaatcgtgattttgtggaagggctttctggagctacttgggtggatgtagtattagagcacggaggttgcgtgacaacaatggccaaaaataaaccgactctcgatatagaattacagaaaaccgaggctacacaactagcaacactgcgtaaattgtgtattgaaggaaaaattacgaatattacaactgatagtcgatgtccgacacaaggcgaagcagtattgccagaagaacaagatcaaaactatgtctgtaaacatacttatgttgatagaggatgggggaacggatgtggtttgtttggcaaaggaagtctggttacttgtgcaaaatttcaatgtctagagccaatagagggaaaagttgtccaatatgaaaatttgaaatatacagtcataataactgtacatactggggaccaacaccaagtagggaatgaaacacaaggagtaacagctgaaataactccccaagctagcacaacagaagctatactgccagaatatggcactctggggctcgaatgttctccaagaacaggcctagactttaatgaaatgattttgttaacaatgaaaaataaagcatggatggtacatcgtcaatggttctttgacttacctttaccatggaccagtggagcgacgactgaaactccaacttggaatagaaaagagttactggtaacctttaaaaatgcgcacgccaagaaacaggaagtagtcgtattgggatctcaggagggcgcgatgcataccgctttgactggggcaacggaaatacaaaactccggtggaactagcatcttcgcaggccacctcaaatgtcgactaaaaatggacaaattggaattgaaaggtatgagttacgctatgtgcacaaacacttttgttttaaagaaagaagttagcgaaacacaacatggtacaatcttaattaaagtagaatataaaggcgaagacgtgccatgtaaaattccattctcaacggaggatggtcaaggtaaagctcataatgggcgtctgataacagccaatccagtagtgactaagaaagaagaaccagtcaacatcgaagctgaaccaccctttggagaatcaaatatcgttatcggtattggggataatgctctgaaaattaactggtacaagaaaggatcctccatagggaaaatgttcgaagcaacggctagaggcgcgcgaaggatggcaatattaggagataccgcatgggactttggttctgtgggtggggtattaaactcgcttggtaaaatggtccaccaaatattcggttctgcgtatacggccctatttagcggcgtatcgtgggttatgaaaataggtataggcgtacttctaacatggatcggtttaaacagcaaaaacactagcatgagcttcagttgcattgccattggcataataacattgtatctcggcgcagtggtacaagcagatatggggtgtgtaatcaactggaaaggtaaagaattaaaatgtggttcaggaatttttgtaacaaatgaagtacacacatggaccgaacaatacaaattccaagccgattcacccaaaagactcgcaacagcgattgcaggagcctgggagaatggagtgtgtggaatacggtcaactacaaggatggaaaatctactttggaaacagatagccaatgaactaaattatatattatgggagaacaacatcaaattaacagttgttgtaggagacgtgattggagtacttgaacaaggtaaacgaactctaacactacaacccatggagttaaaatactcatggaagacgtggggtaaagcaaaaattgtaacagctgaaacacaaaattcatcctttataattgatggaccaaatacgccagagtgcccatcagcgtcaagggcttggaacgtatgggaagtggaagattacggattcggggtatttacaacgaacatatggttaaaattgagagaagtctatactcagctatgtgatcaccggttaatgagtgccgctgttaaagatgagagagcggtgcatgccgatatgggatactggatagaaagccagaaaaatggatcgtggaaattagaaaaagcgagcctaatagaagtgaaaacatgtacgtggccgaaaagccacaccctttggagtaatggtgttctagagtcggacatgattatcccaaaatccctagccggtccaatttcacagcacaactaccggccggggtatcatacacagacagccggtccatggcacttaggtaaattagagctggattttaactattgtgaaggaaccactgttgtaatcactgaaaattgcggaacacgtggaccaagtctacgtacaaccacagtttcaggaaaactgatacacgagtggtgttgtcgaagctgtacccttcctcctcttaggtatatgggggaagacgggtgttggtacggtatggaaattagaccaatttccgagaaggaagaaaatatggttaaatctttggtatcggcaggttcaggagaagtagataattttacaatgggtgttttatgcttagcaatattatttgaagaagtaatgagagggaagttcgggaagaaacacatgatcgccggagtcttcttcacctttgtactacttctcagcggacagataacctggagggatatggctcatactctgattatgatcggaagtaatgcatcggatcgcatgggtatgggggtgacctatctcgcccttatagcaactttcaaaatacaacctttcctagcattaggattctttcttaggaaacttacatcaagagaaaatctactacttggggtgggattagctatggcgacaaccctacaattacccgaagatatagaacagatggcaaatggtatagcgctcggcttaatggccctaaaattaataacacagtttgaaacgtatcaactctggacagccctaataagcctcacctgtagcaacacaatattcacacttacagttgcttggagaacggcgacgctgatacttgcgggcgtttccctattgccagtttgccaatctagttcaatgagaaaaacggactggctacccatgactgtagctgctatgggagtgcctcccctcccactattcatattttcgctaaaagatacacttaaacgacgttcttggcctttaaatgagggtgtaatggccgttgggcttgtcagcatactagctagttctttgcttagaaacgacgtaccaatggccgggcccttagtggcgggagggttactaatagcatgctacgtaataacaggaacttctgccgacttgacggttgaaaaagctgctgatgtaacatgggaagaagaagcagagcagacgggggtatcacataatctaatgattacagtagatgacgatggcaccatgcgaataaaagatgacgagacggaaaatatattaactgtcttgctaaaaacggctttgcttatagttagtggtatatttccatattctattcctgctacgttactggtttggcatacgtggcaaaaacaaactcaacgcagcggggttctttgggacgtaccctcgccaccagaaacgcagaaagctgagctcgaggaaggagtgtatcgcataaaacagcaagggatattcgggaaaacccaagttggtgtgggtgtacaaaaggaaggtgtatttcatacgatgtggcatgttacgaggggcgctgtacttacgtataatgggaaacggcttgaaccgaattgggcgagcgtaaagaaagatttaattagctacggcggtggatggcgactgtctgcacaatggcagaaaggagaagaagttcaagtaatcgcagtagaacccggtaaaaacccaaagaattttcaaaccatgcccggaacttttcaaactaccacaggagaaatcggggcaattgcattagattttaaaccgggaacctcgggaagccctatcataaatagagagggaaaagtagtgggattgtatggaaacggagttgtaaccaaaaacggaggttacgtgtcgggaattgcgcagacgaatgcagagccagacggtcctacaccagaattagaagaagaaatgtttaagaaaagaaatttaacaattatggatttacacccagggagtggaaaaactagaaaatatttgccggcaatagtccgtgaagccattaaaagaaggttaaggactcttatacttgctcctacgagggtagtcgcggcagagatggaggaagcactaaaagggctaccaatacgataccagacgacagcaacgaaaagtgagcataccgggcgagagatagtcgatttaatgtgccatgcaacgtttaccatgcgactgctttcacccgtgagagtaccgaattataacctaattattatggatgaagcccacttcacagaccctgcatcaatcgcagcaagaggttacatatctactagagtcggaatgggagaagccgctgctatttttatgacagctactcccccaggtactgccgatgcgtttcctcaaagcaatgcacctatacaagacgaagaaagagacatacctgaaaggagttggaacagtggtaatgaatggattacagacttcgcaggaaagacagtatggttcgtgcccagcattaaagcagggaatgacattgccaattgtttgaggaaaaacggtaagaaagttatacaactatctcgtaaaacattcgatacagaatatcagaaaactaaattaaatgattgggattttgtagtgaccacagatatcagtgaaatgggagcaaactttaaagcagatagagtaatagatcctagaagatgcttgaaaccggtcatcctgactgatggaccagaacgagtaattcttgcagggccaatgccggtaacagccgcgtcagctgcacaacgacgagggagagtaggcagaaacccccaaaaagaaaacgatcagtacattttcacagggcagccgcttaataacgacgaagatcatgcacactggacagaggcaaaaatgctattagataacataaataccccagaaggaataatacctgctttgttcgaaccagaaagggaaaaatcagctgctatagatggagaatatcgccttaaaggcgaatcaagaaaaacatttgtggaattaatgcggcgcggagacttaccagtatggttagcacataaagtcgcttccgagggaataaagtatacagatagaaaatggtgcttcgacggacaacgtaataatcaaatcctagaggagaatatggatgtggagatttggacaaaagagggcgaaaagaagaaactaagaccacgttggttagatgcaagaacatattccgacccactggcactaaaggagttcaaagatttcgcagcaggtagaaagagtatagcactagatctagttacagagatcggaagagtgccttctcatttagcacacagaacacgaaatgcccttgacaatctggttatgctccacaccagcgaacatggagggaaagcataccggcatgccgttgaagaactgccggaaaccatggaaacccttttactcttaggactgatgattctcctaacgggaggggctatgctatttttaatttcagggaaaggtataggaaaaactagcataggtctgatttgtgttatagcgtcaagtggcatgttatggatggccgagatacccttacagtggatagcaagtgctatagttttagagttctttatgatggtactactcatacctgaacctgaaaaacaaaggacgccgcaggataaccagttagcgtacgtagttatagggatcttgactttggcagccataatagcggcgaatgaaatgggtttattagaaactacaaagcgggatttaggcatgtcaaaggaacccggagtagtatcccctacatcctacttggacgtcgacctacatccggcatcagcctggactttatacgcagtagctactaccgttattactcctatgctaaggcatactatagaaaattcgacagcgaacgtatcactagccgctattgcgaatcaggccgttgtactaatggggctggataaaggctggccgatttcaaaaatggatttaggagtgccactgttagcgttagggtgctatagtcaagtaaaccccctaacactaacagcagcggtactgctactcataacacattatgctattataggacctggactacaagcgaaagcaacaagagaagcacaaaagaggaccgctgctggaattatgaaaaatccaacagtggatggcattatgactattgacctcgaccctgttatctacgactccaaattcgaaaaacaattaggtcaagtaatgttactggtcctgtgtgcagtacaactactcttaatgcgaacatcttgggcactttgcgaggcgcttacattagcaacaggacctataacaacattatgggagggatcacctgggaaattctggaatacaacaatcgctgttagtatggccaatatttttcgcgggtcataccttgcaggcgcaggtctagctttctcaattatgaaaagtgtcggtacagggaaaaggggaacaggatcacaaggcgaaacattgggcgagaaatggaagaagaaattaaatcaattgtcaagaaaagaatttgatttgtataagaaatcgggaattacggaagtagatagaacggaagctaaagagggacttaaaaggggagagattacgcaccatgctgtgagcagaggtagtgctaaattacaatggttcgtggaaagaaacatggtaattccggaggggcgggtaatcgatctcggatgtggaagaggtggatggtcttattattgtgcagggttaaagaaagtcacagaggtacgtggttatacaaaaggaggacctggccacgaagaacccgttccgatgagtacttacggctggaacattgtaaaattaatgtctggtaaagacgtattttatctcccgccggagaagtgcgacacgctactttgtgatattggagaatctagcccttcgccaactgtagaagagtcgagaaccattcgagtactaaaaatggtagagccctggctgaagaacaaccaattctgcataaaagtgttaaacccctatatgccgaccgtagtagaacatctagagaggttgcaaagaaaacatggaggaatgctagttagaaacccactaagccgtaatagcacacatgaaatgtactggataagtaatggcacaggtaatattgtggcgtcagtaaatatggttagccgtctgttgctaaatcggttcacaatgacacacaggagacctaccattgagaaggatgttgacttaggcgcaggtactcgtcatgtaaatgctgaaccagaaacgcctaatatggatgtcattggagagagaataaagaggattaaagaagaacataactcaacctggcattatgatgacgaaaacccttacaaaacctgggcgtatcatggaagctacgaagtgaaagcaaccggttctgcgtcgtcaatgataaatggggtagttaaattattgacaaaaccatgggacgtggtaccaatggtcacacaaatggctatgacggatacaaccccattcggacagcaaagagtattcaaagaaaaagttgatacacggacaccaaggtcaatgcccggaactcgacgcgttatgggaataacagcggaatggctgtggagaactcttggtcgaaacaagaaacccagactatgtactcgagaagagtttaccaagaaagtcagaacaaatgcggcgatgggtgctgtcttcacagaggaaaatcaatgggatagcgcgaaagccgccgtcgaagatgaagatttttggaagctagttgatagagagcgcgagctacataaattaggaaaatgcgggagttgtgtatacaacatgatgggaaaacgagagaagaaactaggagagttcggaaaagctaaaggtagtcgtgcaatatggtatatgtggctaggagcaagatatctagaatttgaggctttagggttcctaaatgaagatcactggtttagtagggaaaacagttactcaggagtagagggtgaaggtcttcacaaattgggctatatattgagagatatctcaaagatccctggcggagcaatgtacgcagacgatactgccggttgggacacccgtataactgaagacgatctacataacgaagaaaagatcacgcaacaaatggaccccgaacatcgacaattggccaacgctattttcaaactaacctatcaaaataaagtcgtaaaagtacagagacccaccccaacaggtacagtcatggacataataagccgtaaagaccaaagaggatcaggacaggtcggcacatacgggctaaatacatttacaaatatggaggcccagttaattcgtcagatggaaggtgagggagtactatcaaaagctgacttagaaaaccccaggcttccagagaagaaaatcactcaatggttagaaacgaaaggcgttgaaaggttaaaaagaatggccatttcgggtgatgactgtgttgtaaaacccatagacgatagattcgcgaatgctctgttagcacttaatgacatgggaaaagtgagaaaggatatccctcagtggcaaccatcgaagggatggcacgattggcaacaggttcctttttgttcgcatcattttcacgaactcataatgaaggacggtaggaagctagtagtaccctgcaggccacaagacgaacttattggcagagcacgcatttcgcaaggggcggggtggtcactacgtgagacagcatgcttaggtaaggcttacgcccaaatgtggagtttaatgtatttccatagaagagatttaaggctcgctagcaatgcaatatgttccgccgtacctgtgcattgggtacctacgtccaggacaacttggtcaatacatgcccatcatcaatggatgacaacagaagatatgcttaccgtatggaatagagtatggatagaagacaacccttggatggaggataaaactccagtgacaacatgggagaacgttccctaccttggaaaacgagaggaccaatggtgtggatctcttatcggtttaacgtcaagggcaacatgggcacagaatataccaacagctatacaacaagttagatcactaatcgggaacgaagagttcctcgactacatgccttcaatgaaaagatttagaaaagaagaagaaagtgaaggcgcaatatggtga

SEQ ID NO: 23408 - RNA, 9873 nt, synthetic construct
  misc_feature 1..9873: note = derived and/or modified CDS sequence (opt6) from DENV-3__FJ639771__SS-prME
  source 1..9873: mol_type = other RNA
acaagcctatgcctaatgatgatattacctgcagcactagcatttcatttaacttcacgtgacggagaaccacgtatgatcgttggcaaaaatgaaaggggaaaatcccttctatttaaaacagcctcaggaattaacatgtgtacacttatagcaatggatctaggtgaaatgtgtgatgatactgtaacttacaaatgtccccatatcacagaagttgaaccggaagatatagattgctggtgcaatcttacctcaacttgggtaacatatggtacgtgcaaccaagctggtgaacatagaagagataaaaggagtgtcgctttggcgccacacgtcgggatgggacttgacactagaactcagacatggatgtccgccgaaggagcttggagacaagttgaaaaagtggaaacatgggcattaagacacccaggctttacaatactcgcacttttcctagcacattatataggaacatctttaacgcagaaagtagtgatatttattctattaatgttggttacacctagcatgacaatgagatgtgtaggtgtcggaaatcgcgattttgtagaagggctttctggtgccacctgggtagacgttgtacttgagcacggaggatgtgtcacaactatggccaaaaacaaaccaactctggatatcgaactgcagaaaactgaagccacacaacttgcaacactaaggaaactttgtatcgaaggaaaaataaccaacattacaactgattcgaggtgtccaacacaaggggaagccgttcttcctgaagaacaagatcaaaactacgtatgcaaacacacgtatgtagataggggatggggtaacggatgtggattatttgggaaagggagcttagtaacttgcgcgaaatttcaatgtctggaaccgattgaaggaaaagtagttcaatacgagaatctaaagtacaccgtgataattacagttcacacaggtgaccaacatcaagtgggcaacgaaacacaaggggtaactgctgaaatcaccccacaagctagtacaactgaagcgattttacccgaatatgggacactaggattagaatgctctccacgaaccggacttgactttaatgaaatgatactattgactatgaaaaacaaggcatggatggttcatagacaatggttctttgatctgcctctaccctggacgtccggtgcgacaacggaaactcccacatggaatagaaaagaattattagtaacatttaaaaatgctcatgctaagaagcaagaggtagtagttctaggttcacaagaaggtgcaatgcatactgctctaactggcgccacagagatacaaaactctggaggtacatcaatatttgctggccatctaaaatgccgactaaaaatggacaagctagaacttaaaggaatgtcttacgcaatgtgcactaatacatttgtcttgaagaaagaagtatcggaaacgcaacatggtacaatacttattaaagtggaatataagggtgaagacgttccctgcaaaatcccctttagtaccgaggatggacaagggaaagcacacaacggacgactcattactgctaaccccgtcgtaaccaagaaggaagaaccggtaaatattgaagcagaaccaccatttggggaatcgaatatagtaataggtataggcgacaatgcattaaagataaactggtacaaaaagggcagttcaataggaaaaatgtttgaagcgacggctagaggcgctcgtagaatggctatccttggggatactgcttgggatttcggcagcgttggcggagtattaaattcgttaggcaaaatggttcatcaaatattcggaagcgcctatactgccttattttcaggggtgtcctgggtgatgaagataggtataggagttctgctcacttggatcgggctaaacagcaagaatacatcgatgtcattttcatgtatcgctattgggataatcacattatatctaggtgcagtagtgcaggccgatatggggtgtgtcataaattggaaaggaaaggagctaaaatgcgggtcaggtatattcgtaaccaacgaggtacatacatggacagagcagtataagtttcaagcagacagtccaaaacgtctggcaacagctatagccggggcttgggagaacggcgtatgtggaataaggtccactaccagaatggaaaatctattgtggaaacaaattgcaaacgaactaaattatatattaagagaaaataatataaaactaactgtagttgtgggtgatgtaattggtgttctagaacaaggaaaacgaacgctaacgccgcaacctatggaattgaaatacagctggaaaacttggggaaaagctaaaatagttactgcagagactcaaaactcgagttttataattgacggaccaaacacgccagaatgcccttcagcatcgcgagcatggaatgtttgggaagttgaggactacgggttcggtgtttttacaactaacatatggctaaaattacgtgaggtatatactcaattatgcgatcatcggttaatgagtgctgcagtaaaagacgaacgcgcagtacacgcagacatgggatattggatcgagtcgcaaaagaacggttcatggaagttagaaaaggctagtctgatagaagtcaaaacctgcacatggcctaaaagccataccctttggagcaatggagttcttgaatccgacatgatcatacctaaatcgttggcaggtcctattagtcagcataactatagacctggatatcatacacaaactgcgggcccgtggcacttagggaaactcgagcttgactttaattattgcgaaggaactacagttgtaatcactgaaaattgtggtacacgggggccctctcttcgcacaactacagtctctggaaagttaatacacgagtggtgttgccggtcatgtacactacctccgctaagatatatgggagaggatggctgctggtatggaatggaaattcgtccaattagtgaaaaagaagagaatatggtgaaatctttagtttctgcaggctcaggtgaagtcgataattttaccatgggcgttttgtgtctcgcaatcttattcgaagaagtaatgcgggggaaattcggcaagaaacatatgatcgcaggagtatttttcacattcgttttattgttaagtggccagataacctggagagacatggcacataccttaatcatgataggatcaaatgcaagcgatagaatgggaatgggagttacatatttagctcttattgcaacatttaagattcaaccctttttggcactaggattctttttacggaaactgacatcacgcgaaaatttgctcctaggggtaggtttagcgatggcgacaaccttacaattgcctgaagatattgagcagatggcaaatggcatagctttaggactgatggctctcaaacttataacacagtttgagacatatcagttatggactgccctaataagcctgacgtgtagtaacacaatctttactcttacggttgcttggcgaacagcaacactaattttagcaggagtgtcactacttccagtctgtcaatcatcatcaatgagaaagacagattggctgcccatgactgtcgctgcgatgggagtcccgcctctaccgttgtttatcttctccttaaaagacaccctaaaacgtcgttcttggcccttaaacgaaggcgtaatggcagttggacttgtttcaattctcgcaagttcgcttcttcgtaacgatgttccaatggcaggaccgcttgtcgctggaggtcttttaattgcctgctatgttattactggaacctccgccgaccttacagtcgaaaaagccgctgacgtaacatgggaagaagaggcagaacagaccggggtatcacataatttaatgattacagtggatgatgacggcacaatgagaattaaagacgacgaaacagagaacatcttaactgtgcttttgaaaacagccctccttatcgtaagcggaatattcccatatagcatacctgcgaccctattagtctggcacacatggcaaaagcaaacccaacgcagcggggtcttatgggatgtgccatctccgccagaaactcaaaaagcagagctggaagaaggtgtatacagaataaagcagcaaggcatcttcggaaaaacgcaggtaggcgtaggtgtccagaaagaaggcgtgtttcataccatgtggcatgtaactcggggagccgtattaacgtacaatggaaagcgactcgagccgaactgggccagtgtaaagaaagatctaattagttatggcggtggttggcgtttatcggcacaatggcagaaaggggaagaagtacaggttatagcagtagagcctggcaaaaatcccaagaattttcaaaccatgccaggtacattccaaaccaccacgggtgaaataggcgcaatagcactcgattttaaacccggtacgagcggttcaccgattatcaacagagaaggtaaggtcgtaggactgtatgggaatggggtagtaactaaaaacggaggctatgtgagcggaattgcacaaactaatgcagagcccgatggtcctaccccggaattagaggaagaaatgtttaagaaacgtaatcttactataatggatttacatcctgggtccgggaaaaccaggaagtatttaccggcaatcgtaagagaagccattaaaagacgactgagaactctgattctggcaccgactagagtcgtagccgccgagatggaagaggcactaaaaggacttccaatacgctaccaaactactgcaacaaaatcggaacatacggggcgggaaattgtcgacctcatgtgccacgcaaccttcactatgcgactactaagtccggtccgggtgccaaactataatctaataataatggatgaagcacacttcacagacccagcctctatagcagcaagaggctacatatctacaagagtagggatgggtgaagccgctgcaatctttatgacagccacccctcctggtactgctgatgcattcccacaatccaatgcaccaattcaagatgaagaaagggacattccggaaagatcatggaatagcggaaacgagtggataacagattttgctggtaagacagtatggtttgtaccatccattaaagccggcaatgatatagccaattgcctacgtaaaaacggaaagaaagtaatacaacttagccgaaaaacatttgatacagaatatcagaaaaccaaattgaacgattgggacttcgtggttacaacagacatatctgaaatgggagcgaattttaaagcagatagggttattgacccaagaagatgtttaaaacctgtaatactcacagatggcccagaaagggtgatccttgcaggccctatgcccgtaactgctgcatcggcagctcagcgacgagggagagtcggccgaaaccctcaaaaagaaaatgatcaatatatattcacaggtcagcccctaaataatgatgaagaccacgcgcactggacagaagcaaaaatgttgctagacaatataaacactccggaagggataattcctgctctcttcgaacctgagcgcgaaaagagcgccgccatagatggagaatatagacttaaaggggaatcacgaaaaacgttcgtagaacttatgcgtcgaggagatttaccagtatggctagcacacaaagtggcaagtgagggcataaaatatacagaccgcaaatggtgctttgacggtcagagaaacaaccaaattctagaagaaaatatggatgtggaaatttggacaaaggagggtgagaagaagaaattaagaccgcgatggctcgacgctagaacgtatagtgatccattagcacttaaagaatttaaagattttgcggcaggaagaaaatcgatagctctagacctagtgactgaaattggccgagtacccagccatcttgcacatcgcacgcgaaacgcattagataaccttgttatgttgcacacaagcgagcacggtggaaaagcgtacagacatgctgtagaagagttaccggaaacaatggaaacactattgttattaggtctaatgattctattaacaggtggagcgatgttatttctaataagcggtaaaggtattggaaagacatcaattggtcttatttgtgttatagcttcgtctggtcttctatggatggcagaaataccacttcaatggatcgctagcgcgatagtactcgaatttttcatgatggttctactaatacctgaaccagagaaacagaggaccccacaggataatcaattggcatatgtagtaataggcattttaacactcgccgccattatcgccgcaaatgagatgggattgcttgaaactactaaacgagatttaggtatgagcaaagagccaggtgttgttagtcctacatcttacttggatgttgacttgcaccctgcttcggcatggacattatatgcagtagcaacaacagtaattacaccaatgctacgccatactatcgaaaacagtacagcaaatgtaagtcttgcagcaatagcaaatcaagcggtagtattgatgggattggataagggttggccaataagtaaaatggaccttggggtcccgcttttagccctaggatgttattcgcaagtgaatccgctcacccttaccgccgcggtacttttattgatcactcattatgctatcatcggtccaggcttacaggcaaaagctacaagagaggcacagaaacgaactgctgctggcattatgaaaaatccaacggtcgatggcatcatgacaattgacttagacccagtaatatacgattcaaaattcgaaaaacaactagggcaggtaatgcttctagttctttgcgcagtacaactattactaatgagaacatcctgggccctttgcgaagctcttacactggctaccgggccaataaccacactttgggaagggtctccgggaaagttttggaatacaactatagcagtgtcaatggcaaatattttcagaggtagttatttagctggtgccggtctagcattttcaattatgaagtcggtaggtacgggtaagagagggactggatcccagggagaaacactaggtgaaaaatggaagaagaaattaaaccagttaagcagaaaagagtttgatttatacaagaaaagcgggataactgaagtagaccgcacagaggctaaagaaggtttaaaacgtggagagataacgcaccatgcagtaagtcggggaagtgcaaaactccagtggtttgtagaaagaaatatggtaattccagaagggagagtaatagacttaggctgcggccgaggcggctggtcctactattgcgcaggtctcaagaaagttactgaagtgaggggttacactaaaggtggacctgggcacgaagaacccgtaccgatgagtacatatgggtggaatatagtaaagttaatgagcgggaaggatgtcttttacctcccgccagaaaaatgtgacacattattgtgcgatattggagaaagttcccctagtccaactgttgaggaaagtagaacaatacgagtgttaaaaatggtagaaccctggttaaagaataaccagttctgtataaaagtattaaacccttatatgccaacggtcgtcgagcacttagagcgattgcaaaggaagcacggaggaatgttagttagaaacccgctaagccgaaacagcacacatgagatgtactggatctctaatggaacaggaaacatcgtagcgtctgtgaacatggtcagccggctactattgaatagattcacaatgacgcatcgtcgtccgactatcgaaaaagacgtggatcttggcgcgggaaccagacatgtaaatgccgagcctgaaacccctaacatggatgtaattggcgaaaggataaaacgtataaaagaagaacataattcaacctggcactatgatgatgagaacccatacaaaacctgggcttaccacggtagctacgaagtgaaagctacgggcagcgcaagctcaatgataaacggtgttgttaaactactcaccaaaccatgggatgtagttccaatggtgacgcagatggccatgactgacacaacgccttttggacaacaacgtgtatttaaggaaaaagtagacacacgtactccaagaagcatgcctggaacgaggcgagtgatgggtattaccgcggaatggctatggagaacacttggtagaaataaaaagcctcgcttgtgcacaagggaagagttcaccaagaaagtccggacaaatgccgcgatgggagcagtatttactgaagaaaaccaatgggatagcgcaaaagctgcagtggaagatgaagacttttggaagctagtggacagggaaagagagcttcacaaactcggaaaatgtggatcatgtgtatataatatgatggggaaaagagaaaagaagctgggtgagttcggaaaagccaaaggttcacgagctatttggtatatgtggttaggtgcgaggtatctagagtttgaggcgctgggatttttaaacgaagatcattggttctctcgcgaaaattcatattctggcgtagaaggagaaggcctacacaaacttggatatatactcagagatatcagtaagatacctggaggcgcaatgtatgctgacgacactgctggctgggacacaagaattacagaagatgacttacataatgaagagaagatcacacaacagatggatcccgagcatcgccaattagcaaatgccatatttaaattaacatatcaaaacaaggttgttaaagtacaacgtcccacacctaccggaacggtcatggacatcataagtaggaaagatcaacgtggctcaggtcaagtaggaacttatggattgaacacattcacgaacatggaggcgcaactaataagacaaatggaaggggaaggagtcttaagcaaagccgacctcgaaaatccacgactaccagagaagaaaatcacgcaatggcttgaaacaaaaggagtagaaagactaaaacgaatggcgatctcgggggacgactgtgtagtcaagccgatcgatgacagattcgcaaatgctctattagcattaaatgacatgggtaaagtaagaaaagatataccacagtggcagccaagtaaaggttggcatgattggcaacaggtcccgttctgctcgcaccactttcatgaactaatcatgaaagatggaaggaaattggtagttccctgccgtccacaagatgagttaataggaagggcgagaatttcacaaggagctggctggtcactaagagaaacagcatgccttggaaaagcatatgcacaaatgtggagcctgatgtattttcatagacgtgacttgagattagcgagtaatgcaatatgtagcgcagtaccggtacattgggtgccgacatcccggacaacatggtcgatccacgcacatcatcagtggatgactacagaagatatgcttactgtttggaaccgtgtatggatagaagacaatccatggatggaagataaaacacctgttaccacatgggaaaatgttccgtatttaggcaaacgagaggaccagtggtgtggttcccttataggactcacaagtcgcgcaacttgggcacaaaatataccaaccgctattcaacaggtacggagtttaataggaaacgaagagttcctcgattatatgcctagcatgaaaagatttcgtaaggaagaagaatcagaaggagcgatatggtaa

SEQ ID NO: 23409 - RNA, 9873 nt, synthetic construct
  misc_feature 1..9873: note = derived and/or modified CDS sequence (opt6) from DENV-3__FJ639772__SS-prME
  source 1..9873: mol_type = other RNA
acttcgttatgccttatgatgattttaccggctgcacttgcttttcatttaacaagccgtgacggggaaccaagaatgatcgtcggtaaaaacgaaaggggaaaaagtctgctttttaaaacggctagcggtataaatatgtgtacattgatcgcaatggacttgggagaaatgtgtgacgacacggttacctataaatgtccacacataacggaagtagaaccggaggacatagactgttggtgtaatttaacaagcacgtgggttacatacggtacttgtaatcaagctggagaacatagacgagataaacgttcagtagctctggcacctcacgtaggaatgggattagacactagaacacaaacatggatgagcgcagaaggtgcatggagacaagtcgaaaaagtcgagacatgggcgctgcgacatcctggttttacaattttagctctgtttttggcccattacataggtacatcattgacgcaaaaagtagtaattttcatcctattaatgctagttacaccaagtatgacaatgagatgtgttggagtaggaaatcgcgattttgtcgaagggctatccggggcaacctgggttgatgtagtcctggaacatggcggatgcgttactactatggctaaaaacaaaccaacgctagatatagaactgcagaaaacagaagcgacccaattagccacactgcgaaaactgtgtatcgagggcaaaattacaaatattacgactgattccaggtgccctacacagggagaagcagtcctacccgaggagcaagatcaaaactacgtatgtaaacatacttacgttgacagaggatggggcaacggctgtggactttttggtaaggggtcattagttacctgtgctaagttccaatgtttggaaccgatcgaaggaaaggttgtacagtatgaaaatcttaagtataccgttataattaccgtacacactggagatcagcatcaagtagggaatgaaactcagggggttacagcagaaataacgccccaagcatctactactgaggcaatattaccagaatatggtacattaggactcgagtgcagtccacgaaccggattagattttaatgaaatgatcctgttgacaatgaagaacaaggcctggatggttcatagacagtggttctttgatctcccgttaccctggacttcaggagcaacaacagagaccccaacctggaatcgtaaggaacttttagtaacctttaaaaatgcccatgccaagaaacaagaagtagtcgtattaggtagccaagaaggagcaatgcatacagctctgacaggtgctacagaaatacaaaattctggaggaacaagtatattcgcgggacatttaaaatgcagactaaagatggacaagttagaacttaaaggaatgtcttatgcaatgtgtacaaatacttttgtattgaagaaagaagttagtgaaacccaacatggaacaattctcatcaaggtagaatacaaaggagaagatgcaccctgcaagattccattttctacagaagacggtcaaggaaaagctcacaacgggagactaatcacagcaaacccagtcgtaacaaagaaagaagaacctgtaaatattgaagcagaaccgccgttcggggagtcgaacattgttatagggattggagataatgccttaaaaataaattggtacaagaaaggatccagcataggtaagatgttcgaagccacagcacgaggagcgcgacgtatggctattctaggggatacagcttgggactttggttcagtcggaggggtactaaactcacttggaaagatggttcatcaaatatttggcagcgcgtacactgctttgttcagtggggtgtcatgggttatgaagatagggattggagtacttttgacctggataggtctgaactcgaagaatacatcaatgtcgttttcatgtatcgctataggaatcatcacgctttatttaggagcagttgtacaagctgacatgggatgtgtcatcaattggaaagggaaagaattaaaatgtggtagtggaattttcgtgacaaatgaagttcatacttggacagaacaatacaaattccaagcagactccccgaagaggcttgcaactgctatagcgggcgcttgggaaaatggagtatgcggcatacggtcaactacgcgtatggaaaatctgctatggaagcaaattgcaaatgagttaaattatattctttgggagaataatattaaactaacagtagtcgttggagatattattggagttttagaacagggaaaacgaaccctaacaccgcaaccaatggaacttaagtattcatggaaaacctggggtaaggcaaaaatagttacagcagaaacccaaaatagcagctttataattgatggcccaaatactccagaatgcccttccgcatctcgagcctggaacgtttgggaagtagaggactacggttttggggtgtttaccacaaatatatggttaaaattaagggaggtgtatacgcaattatgtgaccacaggctaatgtccgccgcagtaaaggacgaaagggcagtacacgctgatatgggttactggattgaatctcagaaaaatggaagttggaagttggagaaagcatctttaatcgaagtgaagacatgtacctggccgaaaagccatacgctatggtctaacggtgtactagaatctgatatgatcataccaaaaagtttagcggggcccatatcacagcataactatcggccaggataccatacacagacagcaggtccgtggcacctcggaaaactggagctagatttcaattattgcgaaggtacaaccgtagtcataactgaaaactgtggcacccgcggcccatccctacgcactacaacagtctcagggaagctcatacatgagtggtgctgtaggtcctgtacgctaccaccgttaagatatatgggagaggacggttgttggtacggtatggaaataagacctattagcgaaaaagaggaaaatatggtcaaatccctagtttccgctggaagcggggaagtagacaactttaccatgggagttctgtgtttagcaatcctttttgaagaagtgatgcgggggaaattcggcaagaaacacatgatcgccggagtattctttacatttgtacttttgttatctgggcaaattacttggcgagatatggcacatactctaataatgataggctctaatgcctcagatcggatgggaatgggagttacttaccttgctttaatagcgacattcaagatacagccatttctggcattaggcttctttcttaggaaacttaccagtagagagaatctcctacttggagtcggcctcgcgatggccacgactctgcaattgccagaggatatagaacaaatggccaacggaatagcacttgggttaatggcacttaaactaattactcaatttgaaacttatcaactatggacagcccttatatctctaacatgttcaaacactattttcacgctgacagtagcctggcgaactgctacattgattctcgccggtgtatcactccttcctgtctgtcaatcatcatcaatgcgaaaaacagattggataccgatgaccgttgcagccatgggtgtgcctccgctgccactatttatattttcattaaaagacacgctaaaaagacgatcttggccactaaatgaaggggtaatggcagtcggccttgtatcaatactagccagcagtctactaagaaatgatgtgccgatggccggaccgctcgtcgccgggggccttttaattgcctgctacgttataacaggtacgtcagcagacttaactgtagaaaaagccgcagatgtcacatgggaagaagaagcagaacaaactggggtctcgcataatcttatgataacagtagatgatgatggtacgatgcgaattaaagatgacgaaaccgaaaatattttaacggtactacttaaaacggcattacttatcgtatcagggatctttccatattcaatacctgcgacgctcttggtttggcacacttggcaaaagcaaactcaaagaagtggggtcttatgggacgtaccttcaccacctgaaacccaaaaagctgaactcgaggaaggcgtgtatcgaattaagcaacaaggaatttttggcaaaacacaagtcggagtaggagtacaaaaagagggtgtattccatacaatgtggcacgtaacccgaggtgctgtcttgacatacaacggaaaaagactagaaccaaactgggcttctgtaaagaaagatttaatctcttacggagggggttggagactctcagcacaatggcagaaaggagaagaagttcaagttattgctgttgaaccgggcaaaaatcccaaaaacttccaaactatgccaggaaccttccaaactactacaggggaaataggagcaattgccctggattttaaaccaggcacatctggcagtccaatcatcaacagggaggggaaaattgtaggattgtacggaaacggggtcgtaactaaaaatggaggatatgtttctggcattgcgcagaccaatgctgagccggacgggcctacacctgaactcgaagaagaaatgtttaagaagaggaatctgacgatcatggaccttcatccgggatcaggtaaaacacgaaagtatctaccggcaatagtacgagaagcgataaaaagacgtctgcgaactctaatcctcgctcccaccagagtcgtagcagcagaaatggaagaagccttaaaaggactaccaatccgatatcagacatctgctacaaaatccgagcacacaggaagggagatagttgatctaatgtgccatgcaacttttacaatgaggctactgagtccagtcagagtacctaattacaacttaattatcatggacgaagctcatttcacagatccagcgtcaattgcagccagaggatatatctccactagagttgggatgggagaagctgcggctatttttatgaccgcaactcctcctggcacagccgatgctttcccacaaagcaatgctccgatacaagacgaagaacgagatattccagaacgttcttggaacagtggaaatgaatggattaccgatttcgcaggaaagactgtttggttcgttccttcgatcaaagcggggaacgatatagcaaattgcttacgtaagaacgggaagaaagttattcaactgtctagaaagacgtttgatacagaatatcaaaagacgaaacttaacgattgggattttgtagtaacaacagatattagtgaaatgggtgctaacttcaaagctgatcgcgtcatagatccaaggagatgtttgaaacctgttatcttaacagacggcccagaacgagtcatcctagctgggcccatgcctgttacagctgctagcgctgcacaacggcgcggacgggtaggaagaaatcctcaaaaagaaaatgaccaatatatatttaccggacaaccgctgaataacgatgaagaccacgcccactggactgaggcaaagatgttgctagacaacataaatacccccgaggggatcataccagcgctattcgaaccagaaagagagaagtcagcagccatagatggggaatacaggttaaaaggagaatcacgtaaaacatttgttgaattgatgagacgcggtgatctaccagtatggcttgcacacaaagtagcatcagaaggaattaaatatactgataggaagtggtgtttcgacggtcagcgaaacaatcagatacttgaagaaaacatggatgtggagatctggacaaaagaaggtgagaagaaaaagttacgtccaagatggttggatgcgaggacttattcagatccattagcattgaaagagtttaaggacttcgctgctggacgtaaatcaatcgcactcgacttagtaactgagattggaagagtgccgacacatttagcgcatcgtacgagaaatgctctcgataacctagttatgcttcacacatccgaacatggcggaaaggcttatagacatgcagttgaagaacttccagaaacaatggaaactctcctactactaggcctgatgatcttattaactggtggtgcaatgttgttccttataagcggaaaaggaataggaaaaacttcaataggattaatttgcgtaatcgccagcagcggaatgctatggatggccgagattcccctacaatggattgcgagtgcaatagtcttagagttctttatgatggtgttattgatccctgagcctgaaaaacagaggactccacaagacaatcaattggcatatgttgtgataggaatattaacactagcagctattatagcagcaaacgaaatgggacttctagaaacaacaaaacgtgatttgggaatgagcaaggaacctggcgtagtgtcgcctacttcatacctggatgtagatctacatcccgccagtgcttggacactctatgcagtcgcaactacagtaataacccctatgttacgacacactatagaaaattcaacggctaatgtaagcctggcagcgatcgctaaccaagccgttgtactaatgggtttagacaagggatggccgatatccaaaatggatctgggtgtcccgttactagcccttggatgttacagtcaagtaaatccactcacactaaccgctgcagtattactattaataacacattacgcgatcataggcccaggactacaagcaaaagctacccgagaagcacaaaagagaaccgctgcaggtatcatgaaaaatccaacagtggatggaattatgactattgacttagatcctgtgatatatgatagtaaatttgaaaagcaactgggtcaggttatgctattagtactgtgcgccgtgcagttactgttaatgagaaccagttgggcgttatgcgaagcacttacattagccacaggtccaattacgactctgtgggagggaagcccagggaaattctggaacacaaccatagccgtaagtatggctaatatattcagaggttcctacttagcaggagctggactcgcctttagtatcatgaaatcagtgggaacaggaaaaagaggcacaggttcgcagggagaaacactaggagaaaagtggaagaagaagttgaatcaattatcgagaaaagagttcgatctttacaagaaatcaggaataacggaggtggatagaactgaagctaaagaaggattgaagcgcggggaaattacgcaccacgctgtgagtagaggaagtgcaaaattacaatggttcgttgaacgaaacatggtaataccagaaggtcgtgtgatagacctaggatgtggccgaggaggttggtcgtactactgcgccggtctcaagaaagtaacagaagtaaggggctacaccaagggtggtcctgggcacgaagaaccagtaccaatgtccacatatggttggaatatagtaaaattaatgagcggtaaagatgtcttttatcttcctcctgaaaagtgtgatacgcttttatgcgacataggcgaaagttccccaagccctactgtcgaagaaagtcgtacaattagagtacttaagatggtagaaccatggcttaaaaataatcagttttgcataaaagtactaaatccctacatgcccactgtcatagaacatctagagcgtcttcaacgaaaacacgggggcatgcttgttaggaaccccctgagccgtaactctacacatgaaatgtattggatatccaatggtaccggaaacattgtagccagtgtcaacatggtaagtagattactgctcaatagattcaccatgactcacagaagacccactatagaaaaagatgtcgacctaggcgcaggtactagacatgttaatgcagagccagaaacaccaaatatggacgtgataggagaaagaataaaaagaataaaagaagaacataattcaacatggcattacgatgatgaaaacccatacaagacatgggcttaccacggaagctatgaagtcaaagccactgggtcagcttcctcaatgataaatggagtggtaaaattactaacaaaaccatgggacgtagtaccaatggtaacccagatggctatgacagataccactcccttcggacaacaaagggtatttaaagaaaaagtcgacacaagaacacctagatcgatgccagggacccgacgagttatgggtatcacagcagaatggctttggcgtaccttgggtagaaacaagaagccccgactctgtacaagagaggaatttaccaagaaagtccgaaccaatgcagcaatgggagcagtctttacagaagagaaccaatgggattcagccaaggctgcggtggaagatgaagatttttggaaactcgtggacagagaacgagagctacataagctgggaaaatgtggcagctgtgtttataacatgatgggcaagagagagaagaaattaggggagtttggaaaggcaaagggaagtagagcgatttggtatatgtggctgggagcaagatatcttgagtttgaagctcttggatttctcaacgaagatcattggttttcacgtgaaaactcttactcgggagtggaaggagaaggtttacataaattaggatacatcttacgggatattagcaaaatacccggtggggcgatgtatgcagatgatacagctggctgggacactaggatcacggaggatgaccttcataatgaagagaaaatcacacaacaaatggaccccgagcatagacaactggctaacgccatttttaaattgacatatcaaaataaagtcgtcaaagtacaaagaccgacaccgacagggacagttatggacattatctcacgtaaggaccaacgaggttcaggtcaggttggaacatacggactcaacacatttacaaatatggaagcacaactaattaggcagatggaaggggaaggagtattgtccaaagccgatctagagaatccacacttacctgagaagaaaattacgcaatggctagaaacgaagggggtagaaagattaaaaaggatggctatatctggagacgattgcgtagtaaaaccaatagatgatcgatttgccaatgcgctattagctttaaatgatatggggaaggtaagaaaagatataccacaatggcaaccatctaaaggatggcacgattggcagcaagttcctttttgttcgcaccatttccacgaattaataatgaaggatgggagaaaattagtggttccatgtaggcctcaagatgaattaattggtagagctagaatttctcaaggagcaggatggagtcttcgtgaaacggcatgtcttggcaaagcatatgctcaaatgtggagtctgatgtattttcataggagagacttaagacttgccagtaatgcaatttgcagtgcggttccagtacactgggttccaacgagtagaacaacgtggagtatacatgcacatcatcaatggatgaccacagaagatatgctgactgtttggaatagggtgtggatagaagataatccttggatggaagataagacccctgttacaacatgggaaaatgttccgtacttgggcaaacgggaagatcaatggtgtggttcattaattggtctcacatctagagccacgtgggcacaaaacatacccactgcaatccaacaagtacgttcgttgattgggaatgaagaatttcttgactacatgccctccatgaaaagatttcgaaaggaagaagaaagcgaaggtgccatctggtga

SEQ ID NO: 23410 - RNA, 9873 nt, synthetic construct
  misc_feature 1..9873: note = derived and/or modified CDS sequence (opt6) from DENV-3__FJ639774__SS-prME
  source 1..9873: mol_type = other RNA
acaagtctttgcctaatgatgatattgcctgcagctttggcattccacttaacatcaagagatggggaacctcgaatgatagtaggtaaaaacgaaaggggaaagagcttactattcaaaacagcaagtggaatcaatatgtgcacactaatagctatggacttgggtgaaatgtgcgatgatactgttacctataaatgtccgcatataacagaagtagaaccagaagatattgattgctggtgtaatctgacaagtacatgggtaacatacgggacatgtaatcaagcgggagaacatcggcgagacaaacgtagtgtagctttagcgccccacgtaggcatgggactcgacaccaggacacaaacctggatgtcagcggaaggagcatggaggcaagtagaaaaagtagaaacctgggcactaaggcaccccggattcactatactggcactcttcctcgcacactacatcggaaccagcctaacccaaaaagttgtaatcttcatacttctaatgcttgtaacaccatctatgactatgagatgtgtaggagtcggtaatagagatttcgtcgaaggtctgagcggtgcaacctgggttgatgtggtactagaacatggaggatgtgtaaccacaatggccaaaaataaacctactttagatattgagttacagaaaaccgaagcaacacaactagcaactttaaggaaactctgcatagagggaaaaataaccaacatcaccactgattcacgatgtccaacacaaggagaagcagtactaccagaagaacaagaccaaaattacgtatgtaaacatacatatgtcgacagaggttgggggaacggatgcgggttgttcggaaaaggttcacttgtaacatgtgcaaaattccaatgtctggaacccattgaaggcaaagttgtccaatacgaaaaccttaaatatactgtaataataacggttcatacaggagatcaacaccaagtaggaaacgaaacacaaggagtaacagcagaaatcacaccacaagcaagcacaactgaagccatattaccagaatatggaactttagggttagaatgttcacctcgaacagggcttgacttcaacgaaatgatcctgctaactatgaaaaataaagcgtggatggtacacaggcaatggttctttgatcttccgttaccatggacatccggaacgactactgaaacccctacatggaatcggaaagagcttcttgtaacattcaaaaacgctcacgcgaagaaacaagaggtagtcgtacttggatctcaagaaggggcaatgcacaccgcattaacaggagctacagaaatccaaaattcaggaggaacaagtatcttcgctggacatctaaaatgcaggctaaaaatggataaattagaactcaaaggaatgagttatgcaatgtgcaccaacacatttgttctaaagaaagaagtcagtgaaacacaacatggaacaatacttattaaagtggaatataaaggtgaagatgttccatgcaagatacctttttccacagaggacgggcaagggaaggctcataacggtcgtctaataaccgcgaaccccgtagttacgaagaaagaggagcccgtaaacatagaggcagaaccaccatttggagagtctaatattgtaattggtataggtgacaatgccttaaagataaattggtataagaaaggaagctctatcggtaagatgtttgaagcaactgctcgtggggctagaagaatggcaatattaggagatacagcatgggattttggcagcgttggaggggtattaaactcattgggtaagatggtccatcaaatctttggctccgcgtacacggcgttatttagtggagtttcctgggtaatgaaaataggcataggcgtacttctcacctggataggcctaaacagtaaaaatacctcaatgtccttttcttgcatagccataggaataattacattatatctaggagcagtagtacaagcggacatgggatgtgttatcaattggaaaggcaaagagttaaaatgtgggtctggtatattcgttacaaacgaggtccatacatggacagaacagtataaatttcaagcagactcaccaaaacgattagctactgctatagctggggcctgggaaaacggtgtatgtggcatcagatcaacaacaaggatggaaaaccttctgtggaaacagatagctaatgaattaaactatattttgtgggaaaacaacataaaattaactgtagtagtaggagacataattggagtgttagagcagggtaagagaacgctcaccccgcaacccatggaattgaaatattcctggaaaacctggggcaaagctaagattgtaactgcggaaacacaaaattcctcgtttattatagacggtcccaacactcccgaatgccccaacgcgtccagagcatggaatgtctgggaagtagaagattatggatttggagtttttactacaaatatctggttaaaactgagggaagtgtacacccagctctgcgatcatagattgatgtctgctgcagtcaaagatgaacgggctgtacacgcagacatgggatactggattgaatctcagaaaaacggatcttggaaattggagaaagcaagcctaattgaggtaaaaacgtgcacttggccaaaatcacatactttgtggtcaaatggagttttggaatccgatatgattataccgaagagtctagcgggtccaatatctcagcataattatcggccaggataccacacacaaacagctggaccttggcatctagggaaactcgaattagactttaattattgtgaagggaccacagtcgtcataacagagaactgtgggacgagaggtccctcactacgtaccactacagtatcaggaaagttaattcacgagtggtgctgtcgttcctgtacgttaccaccgcttaggtatatgggggaagatggatgctggtacgggatggaaatcaggcccatttcagaaaaggaggagaatatggttaagtccctagtatccgctggtagcggagaagtagacaactttacgatgggcgtcctgtgtctcgcaatcctgttcgaggaggtaatgcgcggaaagttcgggaagaaacatatgattgcaggagtattctttacattcgtactcttgctgtccggccaaataacctggagagatatggcgcatacccttataatgattggatcaaatgcaagcgacagaatgggcatgggcgttacttatttagcattgattgcaactttcaaaattcagccgtttctagctcttggattctttctgcgtaagctaacaagccgagaaaatttgttattaggagtaggcttagctatggccaccaccctacaactacccgaagatattgagcaaatggctaatggaatagcacttggattaatggcgttaaaattaattacgcaatttgagacctatcaattatggaccgctctaatcagcttaacatgtagtaatacaatattcacactaaccgtagcgtggagaactgctactctgatattagctggagtttccttattgccagtatgtcagtcctcatcaatgcgaaaaactgattggctaccaatgaccgttgctgctatgggagtacctcctctaccgctatttatttttagcctcaaagacacactgaaaaggaggtcgtggccattaaatgaaggcgtaatggctgttggattagtttcgatcctagcatcgtcactcttacgaaatgatgtacccatggctggacctctggtagcaggaggattattaattgcgtgctatgtcatcacaggtacgtctgcagatttgaccgtagaaaaggcagcagatgtaacatgggaagaggaagctgaacaaacgggggtaagtcacaatttaatgattaccgtggatgacgatgggacgatgagaatcaaagacgacgagactgaaaacatattaacggtacttttaaaaaccgccttgttgatagtctcaggtatatttccttatagtatacctgcaacattacttgtgtggcacacttggcagaagcagactcaacggagtggcgttctgtgggatgtgccgagtcccccagaaacgcaaaaagctgaacttgaagaaggcgtctatcgaatcaagcagcagggtatttttggtaaaacccaagttggcgttggagtgcagaaagagggtgtcttccatacgatgtggcacgtaaccaggggtgctgtcctgacatataacggaaaacgactagaaccaaattgggcatcggtcaagaaagatctaatatcttatggaggaggatggcggttatccgcacaatggcaaaaaggggaggaggtacaagtgatagctgtggaacctggcaaaaaccctaaaaatttccaaacaatgcccggcacgttccaaaccacaactggtgagatcggcgctatagccttagatttcaaacctggcacatctggctcacccatcattaatcgggaaggaaaagttgtagggttatacggcaacggagtcgttactaaaaatggtgggtacgtgtctggaattgcacaaactaatgctgaaccagatggtcctactcctgaacttgaagaagaaatgttcaaaaagagaaatcttacgattatggatctacatcccggaagtgggaaaacaagaaagtatttaccagctatagtacgggaagcgataaagcgccgtctccgtactctaatattggccccaacaagagtagttgcagctgaaatggaagaagcactaaaaggtcttccaatacgttatcaaacaacagctacaaaatcagagcatacaggcagagaaatcgtagacctcatgtgccacgcaacatttacaatgagacttctatcacctgtgcgtgtaccaaattacaatctaataataatggacgaagctcatttcacagacccagcaagtatagccgcgcgagggtacataagtacacgagtcggcatgggcgaagcggctgcaattttcatgaccgcgaccccacctggaacagcagacgcgttcccccaatcgaacgccccaatccaagacgaagaacgggatatacctgagcgtagttggaactcagggaatgaatggataaccgattttgcgggtaaaacagtatggtttgtgcccagcattaaggccggcaacgacatcgcaaactgtttacgcaagaatggcaagaaagtcatacaactatcacgaaaaacattcgacacggaatatcagaaaactaaattgaacgattgggatttcgtcgtaacaactgatatttcggaaatgggagcaaattttaaagccgatcgcgtcatagatccaagacgttgcctcaaaccagtaatattaacagacgggccagagagagtgatacttgccggtccaatgccagtcacagcagcctctgctgcacagaggagaggacgggtcggtcgcaacccccaaaaagaaaacgatcagtacatattcacaggacaacctctaaacaatgatgaagatcatgcacactggactgaagctaaaatgttgctagataacataaacacgcccgagggcatcatacccgccctctttgaacctgaacgagaaaagtccgctgcaatcgacggtgagtacagattaaagggtgaatctcgaaaaacatttgtagagctaatgcgtagaggagacttgccagtgtggcttgcacacaaagttgcatctgagggcatcaaatacacagataggaaatggtgctttgacggacaacgtaataaccaaatcctagaagagaacatggatgttgaaatatggacaaaagaaggggaacgtaagaaactaagaccaagatggttggatgctcgcacttattcagatcccttagcactaaaagaatttaaagatttcgctgcaggccgtaaatcaattgcattggatctagtaacagagataggtcgtgtacccactcatctggctcacagaacccgtaatgccctggacaatcttgtaatgcttcacacatctgagcatggtggaaaggcttatcgacatgccgttgaggaactcccagagacaatggaaacacttcttctgttaggactcatgattctactaaccggcggtgcgatgttgtttttaatatccggaaaaggtataggcaaaacatcaataggcctaatttgtgtaatagcaagctcaggaatgttgtggatggcagagattcctttacaatggattgcttcagctattgtcctagaatttttcatgatggtgttattaatccctgaaccggaaaaacagcgaacgccacaagataatcaactagcatacgtagttatcggaattttaacactagccgctattattgcagcaaacgagatgggtttattagagacgaccaaacgcgatctgggcatgtccaaggaacctggcgttgtaagtccgacaagctacttagacgtggacttacaccctgcttcagcatggactttgtacgcagtcgctacaacagtgataacgcctatgttaagacatactatagaaaactccacagcaaacgtatcactggcggcaatagctaatcaagcagtagttttaatgggtctagataaaggatggccgataagtaaaatggatctaggagtccccctgcttgctttaggttgttattcacaggttaaccccctgacactgactgcagctgtgttgctcttaattacacattatgccataataggtccaggcttgcaagccaaggcaacacgtgaagcacagaaaagaacagctgcgggcattatgaagaacccaaccgttgatgggataatgactatcgatttggacccagttatatacgattctaaattcgaaaaacagctaggacaagttatgctcttggtactctgcgcagtccaactattactaatgagaacaagttgggcgctatgcgaagcattaaccttagcgactggtcccataacaactttatgggagggaagcccaggaaaattctggaacactaccattgccgtgagcatggctaatatttttagaggatcatacttagccggtgcaggcttggcgttttctataatgaagtcagtaggaacgggaaaacgcgggacaggtagccaaggtgaaacactaggcgaaaaatggaagaagaaacttaaccaactttcccgaaaagagtttgatttatataagaaatcaggtatcacggaggttgatagaacagaagcaaaagagggcctgaaacgaggagagataactcatcatgcggtctcaaggggatctgcaaaacttcaatggtttgtggagcgaaatatggtaatcccagaaggaagagtgatagatctgggatgtgggcgaggaggttggagttattactgcgcgggcttaaagaaagtcacagaagtacgtggttatacaaaagggggtccaggtcatgaagaacccgtacctatgtccacatatggctggaacatagtaaaattaatgagtggtaaagatgtattctaccttccaccagagaaatgtgatactttactttgtgatatcggggagtcttctccgtcaccaacagtcgaagagtcacgcacaatacgcgtattgaaaatggtggaaccatggctcaaaaacaaccagttttgcataaaagtactaaatccttatatgcctgcagtaatagaacatctggaacggctgcaacgtaaacatggagggatgttagtaagaaatcctctaagtaggaacagcacacacgagatgtactggatctccaacggaaccggcaatatagttgccagtgtcaatatggtaagccggctcctattgaatcgcttcactatgacccaccgacgacctactatagaaaaagatgtcgatttaggagccggaacaaggcatgtgaatgctgaacccgaaactccaaacatggacgttataggcgaaagaattaaaagaatcaaagaggagcacaactcaacatggcattacgatgacgaaaacccctataagacgtgggcctatcatggctcatatgaagtaaaggcaactggatccgcgagttcaatgattaatggtgttgtgaaactccttactaagccttgggatgtagtaccaatggtcactcaaatggctatgacagacactactccgtttggtcaacaacgcgtctttaaagaaaaagtcgatactagaactccaagatccatgccaggaacacgtagagttatgggcataactgctgagtggttatggagaacactaggcagaaacaaaaagccacgactatgtaccagagaagagttcaccaagaaagtccgaactaatgccgcaatgggcgcggtatttacagaggaaaatcaatgggattccgcaaaagcggcagtggaagatgaagacttttggaagctagtagacagagagagggaactacataaactagggaaatgcggatcatgtgtatacaacatgatgggaaaaagggagaagaaactaggggagttcggaaaagctaaaggatctagggcaatttggtatatgtggctaggagcgcgatatctggagtttgaagctctaggattcttaaatgaagaccattggttttcaagagaaaactcatatagtggcgttgaaggagaaggacttcataaattaggttatatcttacgagatattagcaaaatacctggaggagccatgtatgcagatgatacagcgggatgggacacacgtatcacagaagacgacctacacaatgaagagaaaataacacaacaaatggatccagagcatagacaattagcaaacgccatatttaaattgacatatcaaaataaagtagtaaaagttcaacgacccactccaacaggcacagtaatggacattataagtcgaaaagatcaacgaggatctggtcaggtaggcacttacggattaaatacctttacaaatatggaggctcagttaataagacaaatggagggcgaaggggtacttagtaaagcggacctagaaaatccccatctaccagagaagaaaataacacagtggttggagactaagggcgtggagcgacttaagagaatggccataagtggggatgattgtgtggtcaaaccgattgacgatcgattcgctaacgcgcttttagccctgaacgacatgggaaaagttaggaaggatataccacagtggcagccaagcaagggatggcacgattggcaacaagttccgttctgcagccatcatttccatgagctaatcatgaaagacggtagaaaacttgttgtgccatgtcgaccacaagacgaactcataggtcgagcgcgcataagtcaaggagccggatggtcattacgagagaccgcttgcttaggtaaagcatacgcacaaatgtggagcttaatgtatttccatcgaagggacctaagattggcaagcaacgcaatttgcagcgcagttccggtgcattgggtacctacgtcacgcacaacttggtccatacatgcacatcatcaatggatgactacagaagacatgttaaccgtatggaacagggtgtggatagaagacaatccatggatggaagataaaacaccggtaacaacttgggaaaatgtaccctacttaggcaaacgagaagatcaatggtgtggtagccttataggactaacgagccgtgcaacttgggcccaaaatatacccacggcaatacagcaagtgagatcgctaataggtaacgaggagttccttgattacatgccctcaatgaaaagattccgtaaagaggaagaatctgaaggcgcaatctggtaa

SEQ ID NO: 23411 - RNA, 9873 nt, synthetic construct
  misc_feature 1..9873: note = derived and/or modified CDS sequence (opt6) from DENV-3__FJ639775__SS-prME
  source 1..9873: mol_type = other RNA
acgagcttgtgcctaatgatgatattgccagcagcgttggctttccaccttacatcccgagatggagaaccgcgtatgatcgtaggcaaaaacgaaagaggtaaatccctactctttaaaaccgcaagtggtataaacatgtgtactttgattgctatggatcttggtgaaatgtgcgacgatacagtaacatacaaatgtccacatataacagaagtagaaccagaagacatagattgctggtgtaacttaacttcaacttgggtcacttatggaacctgcaatcaagcgggagaacatagacgagacaaaaggtcggttgcgctagcgccacatgttggcatgggccttgatactaggacgcaaacatggatgagtgcggaaggggcatggaggcaagtagaaaaagtcgaaacgtgggcgctccgccacccagggttcacaatcttggcattatttttagcacattatataggtacctcacttacacagaaagtagtaatttttatcttacttatgttagtaacaccttctatgactatgcgatgcgtgggcgttggtaacagagatttcgtagaaggactatcaggcgctacatgggtagacgtagtattggaacatggtggatgcgtgacgacaatggctaaaaacaaaccaacactagatatagaacttcagaaaacagaagccactcaattagcaaccttacgcaaattatgtatcgaaggtaaaatcaccaacattacaactgactcgcggtgtcccacccagggagaagctgtgttaccggaggagcaagaccagaattacgtctgtaaacatacatatgttgatagaggttgggggaacggttgcggattattcggaaaaggcagtttagttacgtgcgcaaaattccagtgcttggaacctatcgagggcaaagttgtacaatacgagaatctaaaatatacggtcattatcacagttcatacaggagatcagcatcaggtaggcaatgaaacccagggtgtgactgctgaaataacaccccaagcaagtaccacggaagccatactcccagaatatggtactttgggattagaatgtagtccccgcacagggctggattttaatgagatgattttactaacaatgaaaaacaaagcctggatggttcatagacaatggttctttgatttgccccttccttggacatcgggtgctacaacagaaacgccgacatggaatcggaaagagctattagttacatttaaaaatgcacacgccaagaaacaggaggtagtagtgttaggctcacaggaaggtgctatgcacacagcccttacaggagcgacagaaatacaaaatagcgggggtacatcaattttcgccggacatttaaaatgtcgcttaaaaatggacaaattggaactaaaaggaatgtcgtacgctatgtgtactaatacatttgtattaaagaaagaagtttcagaaactcaacatggcacaatcctaatcaaagtagaatacaaaggtgaagacgtaccttgcaaaatcccttttagcacggaggatgggcagggaaaagcacacaatggtcggttaataaccgcaaatcctgtggtaacaaagaaagaagaaccggtcaatatagaagctgaaccaccttttggagaatccaacatagtaatcggaataggagataatgccctcaaaatcaactggtataagaaagggtcgagcatcggcaaaatgttcgaagcaacagcaaggggagccagaagaatggcaatactaggagataccgcatgggattttgggtccgttggcggtgtcttaaacagtctagggaaaatggttcatcaaatattcggatcggcctatactgcacttttctcaggtgtatcatgggtaatgaaaatcggaattggtgtacttcttacatggatcggtcttaatagtaaaaacacctcaatgagtttttcgtgtattgctataggtattatcacattatatttgggcgctgttgtacaggcggacatgggatgtgtaatcaactggaaaggtaaagaactaaaatgtggaagtggaatatttgtgacaaacgaagtgcacacatggacagaacagtacaaattccaagctgattcacccaaacgcctggccacagccatagctggtgcttgggaaaacggtgtatgcggaatacggagcacaactcgcatggaaaacttattatggaaacagatcgcaaatgaactcaactatatattatgggaaaacaatataaaacttactgttgtagtaggagacatcatcggtgtcttagagcaaggtaaacgaacattgactccgcaacctatggaactaaaatattcctggaagacatggggcaaggcgaaaatagtgactgcggagacacaaaattcttcttttataatagatggaccaaacactcccgaatgtccatcggcttcacgagcttggaatgtatgggaagtcgaagattacggttttggcgtcttcacaactaatatatggctcaaacttagagaagtgtatacgcagctgtgcgatcaccggctcatgagtgcagcagtgaaggatgaacgagccgtacatgcggacatggggtactggatagaatcacagaaaaacggatcatggaaactggaaaaagccagtctgatagaagtaaaaacatgtacatggccaaaaagtcatacactatggagtaacggggtccttgaaagcgacatgatcatccctaaatctttagcaggtccaatctctcaacataattaccgccccggataccatacccaaacggctggaccatggcatcttggtaaattagagcttgattttaattattgcgaaggtacgacggtagttatcactgaaaactgtgggacccgcggtcccagcttaaggacaacgactgtgagtggaaaactgattcatgaatggtgctgcaggagctgcacgctacctccactacgttacatgggagaagacggctgttggtatggaatggaaattaggccgatctcagagaaggaagaaaacatggttaagtccttagtaagtgcaggctcaggtgaagtcgacaactttacgatgggagtcttgtgcttagccatactgtttgaggaagttatgcggggaaaattcgggaagaaacacatgatcgcgggtgtattctttacatttgtactattattaagcggtcagataacatggcgagatatggctcatactttgattatgatcggcagtaatgcctcagacagaatgggtatgggggtaacttacttagcattaatcgcgacattcaagatacaaccattcttagcattaggattctttctgagaaaattaacatcgagagaaaatctcttattaggagtcggcctggccatggcgacaacattacaattgcctgaggacatagaacaaatggccaacggaatcgcactcggactcatggcactaaaactaatcactcaattcgaaacatatcaattatggaccgctttaatatctttaacctgctctaacacaatatttactctaacggttgcgtggagaacagccactctaatactagcaggagtatcattattacctgtatgtcaatcatcctcaatgaggaaaacggactggctacccatgactgtagccgcaatgggggtcccaccactaccattgttcatattctccctaaaggatacattaaaaaggagatcgtggcccttaaatgaaggcgtgatggcagtggggttagtatcgatacttgcgagctcattactaagaaacgacgtgcctatggccggacctctagtagcaggagggctcttgatagcgtgttatgttataaccggaaccagcgctgatctcactgttgaaaaggcagctgatgtaacatgggaagaagaagcagaacaaaccggagtatcacacaacttaatgataaccgtggatgatgacggaaccatgagaataaaggatgacgaaacggaaaacatattaacagttttactaaagactgcactactcatcgtttcgggaatttttccatacagtataccagctacattattggtatggcatacatggcaaaaacagacccaaagatcaggagtgctatgggatgttcctagtcctcctgaaactcaaaaagcggagttagaggaaggggtctataggattaaacagcaaggaatatttggaaagacgcaagtaggagtaggtgtacagaaagaaggtgtgtttcacacaatgtggcacgtcacacgtggtgcagttctcacatataacggaaagcgactagaacccaattgggcttctgttaagaaagatcttatatcttacgggggtggctggagactatcagcccaatggcaaaaaggggaggaagtacaagtcatagctgttgaacctggcaaaaaccccaaaaactttcaaacgatgcccgggacatttcaaacaacaacaggcgaaataggcgccatagctttagattttaaacctggaacatctgggagccctattatcaatagggaaggtaaagtagtagggctatatggaaacggcgtcgttactaaaaatggcgggtacgtatctggaatcgctcaaactaatgcagagcctgacggaccgactccggaactagaagaagagatgtttaagaaacggaatttaacgataatggacctacaccctggtagtggcaagacgagaaaataccttccggcaatcgtgcgagaagcgattaaacggagattgcgcactctaattcttgcccctacaagagtagtggctgcagagatggaagaagcacttaaaggtttacccatccgatatcaaacaacggcgacaaaatccgaacatactggacgtgaaatagtagaccttatgtgtcatgccacttttactatgcggttgctaagccctgtacgcgtacctaattataacttaatcatcatggacgaagctcactttactgatccagcctcaatagcagcccgaggatatatcagtactagagtaggcatgggcgaggcagccgcaatttttatgacagcaacacccccaggaactgcagacgcatttcctcaaagcaatgctccaatacaagacgaggaaagagatattccagaaaggagttggaatagtggaaatgaatggattactgatttcgcaggcaaaacagtctggtttgttccaagtataaaggcgggaaatgacatagctaattgcttgagaaagaatggcaagaaagtaatacaactttcaagaaagacatttgataccgaatatcagaaaactaagttaaacgattgggactttgtcgtaacaacagatatctcggagatgggtgctaattttaaggccgatagggtaatagacccacgccgctgcttgaaaccagtcatattaactgacggccctgagagagtaatattagccggacccatgccagtgacagcagctagtgcagcacaaagacgaggaagagtaggaagaaatcctcagaaggaaaacgaccaatatatctttaccggtcagcccttaaataatgatgaagaccatgctcattggacagaagcgaaaatgctattggataacataaacacaccagaaggcataatccctgcattgtttgaaccagaacgagaaaaatcagcagccatcgacggtgagtaccgattaaaaggagaaagtcgcaaaacatttgtagaattgatgagaaggggagatctacctgtttggctagcccataaagtggcatcagaaggaattaaatatacggatcgcaagtggtgtttcgatggccaacgaaacaatcaaatacttgaagaaaatatggatgtcgaaatatggacaaaagaaggggagaagaagaaactacgtccacgatggctagatgcaaggacatactcagaccctctcgcacttaaagaatttaaagattttgcagccggcaggaaatcgattgcattagacttagttacagagataggccgcgttccttcccacttagcacatagaacgagaaatgctttggacaacttggtaatgttacataccagcgagcacggaggaaaggcgtatcgacacgcagtagaagagttaccagaaactatggagacgctgttactgcttgggcttatgattttattaacaggtggagctatgctctttctaatttcgggaaaagggattggaaagacgtcgataggtttgatatgtgtgatcgcatcgagcggaatgttgtggatggctgaaattcccctacaatggattgcttcggccatagtattagaatttttcatgatggtcttactaatacccgaacctgaaaaacaacgaacgccacaagataaccagcttgcttatgtcgttataggcattctaactcttgcggctattatcgcggcgaatgaaatggggcttttggaaacaacaaagagagatttaggtatgagcaaagaaccaggggtagtatcaccaaccagttatctggatgttgacctacatccggcctctgcttggactttatacgcagttgcgacaacggtgatcactcccatgctgaggcacaccatcgaaaatagtactgcgaacgtaagtcttgcggccattgcaaaccaggccgtcgtattgatgggccttgataaaggctggcctatctcaaaaatggacctcggggtaccattgcttgcccttggttgctacagtcaagtaaatccattgacattgaccgcagctgtattattacttataacacattatgcaataattggtccaggcctccaggctaaagccacaagggaggctcagaagagaacggcagcaggaataatgaaaaaccccaccgtagacgggataatgactatagatttagatcccgtaatatatgatagtaaattcgaaaaacaattaggccaggtcatgttgctcgtattatgcgcggtacaattattgctaatgaggacatcctgggctttgtgcgaagcattaacattggcgaccggaccgatcacaactctgtgggaaggaagtcccggaaaattttggaacacaactattgccgttagtatggcaaatatctttcgaggttcatatttggcgggagccggattagcattcagcataatgaaatccgtagggacaggcaaaagaggaaccggtagtcaaggagagactctaggagaaaagtggaagaagaaactgaatcagttatctcgcaaagagtttgatctatacaaaaagtcaggaattacagaagtagatagaaccgaagcaaaagaaggccttaaacgaggagaaattacgcaccatgcagtgtcaaggggctccgcaaaattacaatggtttgtagaacgaaacatggtaattccagaaggaagggtaattgatcttggatgtggtaggggtggctggagctattattgtgcaggactgaagaaagtgacagaggtacgaggatacacgaagggaggcccaggccacgaagaacccgtcccaatgtccacatacggctggaatatagtgaaactcatgagtggtaaggacgttttctacttaccacctgaaaaatgtgatactctgttatgcgatattggagagtcgtctccatcgcccacagtcgaagaaagcagaaccataagagttctgaaaatggtagaaccttggttgaaaaataatcaattttgcataaaagtccttaatccttacatgccaaccgtaatagagcatttggaacgattgcaaagaaaacatggtggaatgctggtgcgaaatccgctatcacgaaacagcacacacgaaatgtactggataagtaacggaacgggaaacatagttgcttccgttaatatggtctcccgtctgctactaaataggtttaccatgacgcatcgacgcccaacgatagaaaaagacgtggacttaggcgcaggaacccgacacgtaaacgcagaaccggaaactcctaacatggatgtaattggagagcgtataaaaagaataaaagaggagcataattcaacctggcactacgatgacgaaaatccatacaagacatgggcataccacggcagttatgaagttaaggcaactggatcagcttcatcaatgattaacggggtagtaaagctattgacaaaaccatgggatgtcgtacccatggtaactcagatggcaatgaccgatactacaccattcggtcaacaacgcgtttttaaggaaaaagtagatacgagaacacctcgatctatgcctggtactagacgggctatgggaataaccgcggaatggctgtggcgtacgttaggaagaaataagaaaccacgtttatgcaccagagaagaatttaccaagaaagtaagaacgaatgcagccatgggggcagtttttacggaagagaatcaatgggactcagcaaaagcagcagtcgaggatgaagacttctggaagttagttgaccgagaacgtgaacttcacaagctaggaaagtgtgggtcctgcgtctacaatatgatgggcaaaagagagaagaaactaggtgagttcggtaaagctaaaggatcaagagcaatttggtatatgtggctgggagcaagatatctggaatttgaagcgctcggctttttaaatgaagatcattggttcagccgagaaaactcctactcaggagtcgagggtgagggattacataaattaggatatatcttaagagatatatccaaaattcctgggggcgcgatgtacgctgatgacacagccggatgggatacgagaattacagaagacgatctgcataacgaagagaaaataacacagcaaatggatccggaacaccgacagcttgcaaacgcaatatttaaattaacatatcaaaacaaagtagttaaagttcagagacctactccaacaggtacggtgatggatattatctctcgaaaggaccaacgtggttcagggcaagttggaacttacggacttaatacatttacaaatatggaagcacaattgatacgacaaatggaaggagaaggagtcttatcgaaagcagatttggaaaatccacacctcccagagaagaaaattactcaatggctcgagactaagggcgtagagagacttaaacggatggcaatttcaggggatgattgtgtagtaaaaccaattgacgaccgatttgctaatgcgctcttagcattgaatgatatggggaaagtacgcaaagatataccacagtggcaaccatcgaaaggttggcacgattggcaacaagtacctttttgtagtcatcatttccacgaactaatcatgaaagatggtaggaaacttgttgtaccttgcagacctcaagatgaactgatcggacgagcacgcatttcacaaggtgccggttggagtttaagagaaacggcatgtttgggaaaagcctatgcgcaaatgtggtcacttatgtatttccatcgaagggacttgcgactagccagtaacgcaatatgctcagccgtaccagtacattgggtaccgacctcgaggacaacatggagtatacacgcacaccatcaatggatgacaacagaagatatgctcactgtatggaatcgtgtatggatcgaagataatccgtggatggaagacaaaactccagtgacgacctgggaaaacgtaccatatctgggaaaaagagaagaccagtggtgtggatccttaattggattaacctcgagggcgacctgggcgcaaaacatcccaacagcaatccaacaggttcgctcactcatcggaaatgaggaatttctggactacatgccgtcaatgaaaagattcagaaaggaagaagaatccgaaggagctatatggtaa

SEQ ID NO: 23412 - RNA, 9873 nt, synthetic construct
  misc_feature 1..9873: note = derived and/or modified CDS sequence (opt6) from DENV-3__FJ639777__SS-prME
  source 1..9873: mol_type = other RNA
acctcgttatgtttaatgatgacattgcccgcagcgttagcattccatctgacctcaagagatggtgaaccacgaatgatagtaggtaaaaatgaaagagggaaatccttattgtttaaaaccgcttcggggattaacatgtgtacacttatagcaatggatttaggagaaatgtgcgacgacacagtgacctataaatgcccacacattactgaagttgaaccggaagatatagattgttggtgtaacttaacttcgacatgggtaacatatggaacatgtaatcaagcaggagaacatagacgagataaacgtagtgtagccctggcaccacatgtaggcatgggattagatacgaggacacaaacttggatgagcgctgaaggagcctggagacaagtcgaaaaggtggaaacatgggcgctacgccaccctggattcacgatcttagccctcttcctcgcacattatatagggacttctctaacgcaaaaagtagtcatttttatacttctcatgttagttactccctctatgaccatgcgttgtgttggagtaggaaatagagacttcgtggaaggcctatctggagctacgtgggtcgacgttgtcttggaacatggcggatgtgtgactactatggccaagaataaaccaactctagacatagaactacagaaaacggaagctacccaactcgcaacactgaggaaactttgtatagaaggtaaaatcactaatataacaacagattcgagatgtcccacacaaggggaagctgtccttccggaagaacaagatcaaaactatgtatgcaaacacacttacgttgaccgaggctggggaaatggctgcggattattcggcaaagggtcattagtaacttgtgccaaatttcaatgtttagaacctattgaaggtaaggtcgtgcaatatgaaaatttaaaatacaccgtaatcattaccgtccatacaggagaccaacatcaagtcggaaacgaaacacaaggagtaactgcggaaattactcctcaagcatcaacaacggaagcaatattaccagagtacgggacattaggattagaatgtagcccaagaacaggacttgactttaatgaaatgatacttttaacaatgaagaataaagcctggatggtccatcgacaatggttctttgacttacccctaccatggaccagtggggcaacaactgaaaccccaacgtggaaccggaaagaacttcttgtaacattcaaaaatgcacatgctaaaaagcaagaagtcgtcgtgctcggttctcaggaaggagcgatgcacacagctctaactggggcaacagaaatacaaaacagcggtggaacaagtattttcgcaggtcacttgaaatgccggctaaaaatggacaaacttgaactcaaaggaatgtcttatgcaatgtgcacgaacacattcgtgctaaagaaagaggtttcagaaacccaacacggtacaattttaatcaaagtggaatacaaaggggaagacgttccatgcaaaattccgtttagtaccgaagatgggcaaggtaaagcacataacggacgactcataaccgcaaatcccgtagttacaaagaaagaggaaccagtaaacatcgaagcggaacctccctttggcgaatcaaacatcgtgataggtattggtgataacgcactaaagataaactggtataaaaagggctctagcattggcaaaatgtttgaagctactgcgcgcggtgcacgtcgaatggctattctaggagatacagcttgggacttcgggagtgtaggaggtgtattaaatagcctcggaaaaatggtgcatcaaatatttgggagtgcctatactgccctattttccggtgtaagttgggtgatgaaaataggtataggtgtcctactaacttggatcggattaaattcgaaaaacacatcaatgagtttcagctgcatcgcaataggcataataaccctatatctaggtgctgtcgtccaagccgatatgggctgtgtgattaactggaagggcaaggaattaaagtgcggcagcggtatttttgtgactaacgaggttcatacctggacagagcaatacaagttccaagctgattctcccaaaagactagctacggcaatagcaggagcatgggaaaatggcgtgtgcggtattagatcaacgactcgtatggaaaatttactatggaaacaaattgcgaacgagctgaactatatcctatgggaaaataatatcaaattaaccgttgtggtaggagacatcataggtgtacttgaacaaggaaaaagaaccctaacaccccaaccaatggaattaaaatactcatggaaaacatggggcaaagcgaaaatagtggcagcagagacacagaacagtagttttattatagatggacctaatacacccgaatgcccctctgcttcgcgcgcttggaatgtctgggaagtagaagattatggttttggagtattcactacaaatatatggctaaaactgcgggaggtctatacacaattatgtgatcatcggttaatgtctgcagccgttaaggatgaacgagcagttcacgcagatatgggttattggatcgagtctcagaaaaatggatcatggaaattagagaaggcctcccttatcgaagtgaagacatgcacgtggccaaaatcgcataccctctggagcaatggcgttcttgaatcagatatgattatacccaagtcattggcaggtccaattagtcagcataattatagaccaggatatcatacacaaacagcaggaccttggcacctagggaagctagagctagacttcaactattgtgaaggcacgaccgttgttattacagaaaactgtgggacgagaggtcctagtttaagaactactacagtctcaggaaaattaatacatgaatggtgttgtcgatcctgtactctacctccgctacgatatatgggcgaagacggatgttggtatgggatggagataaggcctatatcggagaaggaagaaaacatggttaaaagcctagttagtgccggatcaggtgaggtagataatttcacgatgggggtgttgtgccttgccatattattcgaagaggttatgagaggtaagttaggtaagaaacatatgattgcgggtgtattctttacatttgtattattattatctggccaaataacatggagggatatggcacacaccttaattatgataggaagcaatgcatcagatcgcatgggcatgggggttacataccttgcactaatagcgacatttaaaatccaaccattccttgcactagggttcttcctgcgcaaattaaccagtcgagagaatttattgttgggtgttggattggctatggcaactacattacaattgcctgaggatatcgaacaaatggcaaatggaatcgctctaggcctcatggcgctgaaattgataactcaattcgagacgtatcaattgtggactgctctaattagcctgacatgttccaatacaatctttaccttaacggtggcttggaggaccgcaacattaattttggctggtgtaagtcttttaccagtttgccaaagctcaagtatgcggaaaacagattggctaccaatgacggtagcagcgatgggggttcctccattaccactatttatcttttcattgaaagatacactcaaaagaaggagttggcctttaaatgaaggtgtcatggcagtaggattagtttctatcttggctagttcgttattgagaaacgatgttccaatggcgggaccacttgtagctggcggacttttaatagcttgttatgtaataacagggacctctgctgatctcacagtagaaaaagccgccgacgtcacttgggaggaagaagccgaacaaacaggggtgagccataatttaatgatcaccgtagacgatgacgggacaatgcgaataaaagacgatgaaacagagaatatcctcacagtactgctcaaaacagcactattaattgtctcaggcatatttccatacagtatcccagccacgttgcttgtctggcatacgtggcaaaagcagacacaacgcagtggggtgctatgggacgtccccagtccaccagaaactcaaaaagcagagctcgaggaaggagtatatcgaataaagcaacagggaatatttggaaagacacaagtaggtgtaggggtacagaaagaaggagtctttcatacaatgtggcatgtgactagaggtgcggttctcacgtataatggaaaacgactagaaccaaattgggcatccgttaaaaaggatttaattagctatggcggaggatggaggctaaacgcacaatggcaaaagggagaggaagtacaagttattgcagttgaaccaggcaaaaatcccaaaaacttccaaacgatgccaggaacctttcaaacaactacgggagaaataggagcaatagcccttgactttaaacctggtacaagtggaagcccaatcataaacagggaaggaaaagtagtagggctatatggaaacggagtagttactaagaacggaggttacgtctcgggaattgcacaaacaaatgcagaacctgatggaccaactccagagttggaagaagaaatgtttaaaaagcgaaacttgacaattatggacttgcatccaggatcgggcaagactcgcaaatatttacccgcaatagtaagggaagcaatcaaaaggagattaagaacactgatattagctccaacgagggttgtagcagccgaaatggaggaagcattgaaaggattaccaatcagataccaaactacagcaacaaaaagtgaacatacaggcagagaaatagtagacttaatgtgtcacgcgacatttacaatgcgtttgctatcacctgtcagagtaccaaattataatctaataattatggacgaagcacattttacagaccctgcctcaatagccgcccgtggttatatttcaacacgtgtagggatgggtgaggcagcagcaatttttatgacggcgacgccacccggtacggcggacgcatttcctcaaagtaatgcccctattcaagatgaagaaagggatatcccagaacgatcatggaactcaggaaatgagtggatcacggacttcgcagggaaaactgtatggtttgtaccaagtataaaagcaggtaacgatattgctaattgcctaaggaaaaatggtaaaaaggtaattcagctatctagaaaaacatttgacaccgagtaccagaaaactaaattaaatgactgggatttcgtcgttacaacagatatttctgaaatgggagcaaactttaaagctgatagggttatagatccacgaagatgcttaaaacccgtcattttgactgacggtccggaacgtgtaatactggcaggaccaatcccagttacggcagcatcggcagcacaacggagaggacgggttggtagaaaccctcaaaaagaaaacgatcaatacatttttactggccaaccattaaataatgacgaagatcatgcgcattggacagaagcaaaaatgcttctagataatataaatactccggagggcatcatacctgcactatttgaacctgaacgcgagaaatctgctgctatcgacggtgaatataggctaaagggagagtcaaggaaaacatttgtagaactcatgcgtagaggtgacttacccgtatggctcgcgcataaagtcgcgagtgaaggaattaagtatacagatcgcaaatggtgttttgacggacaacgaaataaccaaatattagaagaaaacatggacgtggaaatttggacgaaggagggcgagaagaagaaattgcgtccaaggtggcttgacgcaagaacttatagcgaccccctagccctcaaagaatttaaagattttgcggctggacggaaaagcatagctctagatctcgtaaccgaaatcggtagagtaccgtctcatttggcgcacagaacacggaatgcattagataatctcgtaatgttgcatacctcagagcatggtggtaaagcgtacagacatgcagtcgaagagttacccgaaacaatggagacgctgttactattagggcttatgatattactcactggtggcgcgatgctctttttaattagtggcaaaggcataggaaagacttcaattgggttaatatgcgtaatcgcatcctccggtatgttgtggatggcggaaatcccgctacaatggattgcatctgctatcgttcttgagttctttatgatggttttactaattcctgagccagaaaaacaacgaaccccgcaagataatcaactagcttacgtagtaattggcatacttacactcgcagcgatcattgcggccaacgaaatgggactgctagaaaccacaaaacgcgacctggggatgagtaaagagcccggtgtggtctcaccaacttcatatctagatgtagatcttcatcctgcgtcggcatggactttatacgcagtcgccacaaccgtcattactccaatgctcagacacacaattgaaaattcaactgctaatgtgagtctggctgccatagcaaaccaagctgtggtattaatgggtctagataagggttggcctatatcaaaaatggatcttggcgtacccttattagcgctgggttgctacagccaagtaaacccattaacactgacggctgctgttctcttactaattactcattatgcaataattggaccgggattacaagctaaagcaacaagagaagctcaaaaacgaacagctgcagggatcatgaaaaaccccacggttgacggtattatgacaattgatttggatcctgtgatatatgattctaagtttgaaaaacaattaggtcaagttatgttattggtgctttgtgccgtacagttgttattaatgcggacatcttgggcactttgtgaagccttaacattagctacaggccctatcaccactttatgggaaggtagtcccggaaaattctggaatacaaccatcgctgttagtatggccaatatcttcaggggatcatacatagcaggagccggactagcattctcgataatgaagtctgtcggaaccggcaagagaggaacaggatcgcaaggagaaacactaggagaaaagtggaagaagaaactaaatcaactttcgagaaaagagttcgatctgtataagaagagtgggattacagaggtggatcgaactgaagccaaggaaggactaaaacgaggagaaatcactcatcatgctgtttctagaggctcagcgaaactacaatggtttgttgaacggaatatggtgacacccgagggtcgtgtaattgatcttggatgcgggagaggaggttggagttactactgcgctggcttgaagaaagttacagaagtacggggttacacgaaaggaggcccaggacatgaagaaccagttcctatgtccacctatggatggaatatcgtgaaactaatgagtggaaaagatgtcttctatttacctcctgaaaagtgtgacactttactatgtgatatcggcgagagcagtccaagtcccactgtagaagagtccaggacaatacgggtgttgaagatggtggaaccctggctgaaaaataatcaattctgcattaaagttttaaatccttatatgccgactgtaatagagcacctagagcgcctgcagcgaaaacacggtggtatgcttgttcgatcccctctatctcgaaactcaacacacgaaatgtactggattagtaatggcactggtaacatagttgcttcggtcaatatggtaagcaggctattattaaatagattcactatgacacacagacgtcccacgatagaaaaggacgttgatttaggggcaggtacgcgtcatgtgaacgccgagccagagacaccaaatatggatgtaatcggggaaagaattaaaagaataaaagaagaacataattcaacatggcattacgatgatgaaaatccttacaaaacttgggcttaccatggttcatatgaagttaaagcaacaggttctgcttcttcaatgataaacggagttgtgaaactactgacgaaaccctgggatgtggtaccgatggtaacacagatggctatgacagatactaccccttttggacagcaacgagtttttaaggaaaaagtggatacccgaaccccacggtctatgcctggtacaagacgggtgatgggtataaccgccgaatggctctggagaacattaggacgtaacaagaaacctaggctctgtactagagaagagttcaccaagaaagtaagaaccaatgcagcgatgggtgctgtctttacagaagagaatcaatgggattcagctaaagcagcagttgaagatgaagatttctggaaattagttgatagggagagggaactgcacagattaggtaaatgcgggagttgtgtttataatatgatgggaaaaagagagaagaaacttggagagttcggaaaagcaaaaggaagtcgggcgatctggtatatgtggttgggagctcggtacttggagtttgaggcgctgggttttctaaatgaagaccactggttttcaagggagaactcctatagtggagttgaaggtgaaggcttacataaattgggatatattttacgtgacatatcaaaaatacccggtggcgctatgtatgcggacgacaccgcaggatgggatacgcgtatcacagaagacgatcttcacaacgaagaaaagatcacacaacaaatggacccagaacacagacaactcgctaatgctatattcaaactgacttatcaaaataaagtggttaaagtacaaaggcccacacctactggaacggtaatggacataatatcgagaaaggaccaaagaggaagtggccaggttggcacctatggactaaatacatttaccaatatggaagctcaactcatacgtcaaatggaaggagaaggcgttctctcaaaagcagatttggaaaatccacatttaccagaaaagaaaataacacaatggttagaaacgaaaggcgtagaaagacttaaacgaatggcgataagtggtgatgactgtgtggttaaaccaatcgatgacaggtttgctaatgcgttacttgccctaaatgatatgggcaaggtgagaaaagacatacctcaatggcaaccttccaaaggttggcatgactggcaacaagtccctttctgtagtcatcatttccatgaattaattatgaaggacggtagaaaacttgttgtaccctgtcgaccacaagatgagctaatcggccgtgccaggatctcacaaggtgcgggttggtcgttaagagagaccgcttgcctcggcaaagcatacgcgcaaatgtggtcattaatgtactttcatcgaagggacttgcgcctagcatcaaacgcaatctgtagtgcagtacctgtgcattgggtacctacatctagaacaacgtggagcatccacgctcatcatcagtggatgaccactgaggatatgttaacggtttggaacagagtctggattgaagataatccctggatggaggataaaactcccgtaaccacttgggagaacgtgccttatctcggaaagagggaagatcagtggtgtggctctctcatcggtttaacgagccgtgccacatgggctcaaaatatacctacggcaatacaacaagtacgtagtctaattgggaacgaggagttcttagactatatgccatcgatgaaacgatttcgtaaagaagaagaatctgaaggagcaatatggtaa

SEQ ID NO: 23413 - RNA, 9873 nt, synthetic construct
  misc_feature 1..9873: note = derived and/or modified CDS sequence (opt6) from DENV-3__FJ639778__SS-prME
  source 1..9873: mol_type = other RNA
acgagcttatgcctaatgatgattcttcccgctgctttagcattccacttaacatcgcgagatggagaacctcgcatgatagtagggaaaaacgaacgtgggaaaagtttactcttcaaaactgcttccgggatcaacatgtgtacgttaattgcgatggacttaggagaaatgtgtgatgatactgtcacctataaatgtccccatattacggaagtagaacctgaagatatagactgttggtgcaatctaacaagtacgtgggttacttatgggacctgtaatcaagctggcgaacacaggagggataaaagaagcgttgcactagcccctcatgtcggcatgggtctagatacacgtacgcaaacctggatgtcagcagaaggtgcatggaggcaagtcgaaaaagtagaaacatgggccctacgacacccaggattcaccatcttagcgttgtttctcgcacattatattggcacttctctgacccaaaaagtggtgatatttatactactcatgctagttacaccatcaatgaccatgagatgcgtaggagtcggaaaccgagatttcgtagaaggcctaagcggagccacgtgggtagacgttgtacttgaacacggcggttgcgtcacaaccatggctaaaaacaaaccaaccctcgacatcgaactacagaaaactgaagctactcaattagcaacactcaggaaactatgtattgaaggcaggatcacgaatataacgacagacagtagatgccctacccaaggcgaagcagtattaccagaggaacaagatcaaaattatgtatgcaaacatacctatgtcgataggggatggggaaacgggtgtggacttttcgggaaaggatcgttagtaacatgtgctaaatttcagtgtctagaacctattgaaggaaaagtggtacaatacgaaaacctgaaatatactgtaataatcactgttcataccggagatcaacatcaagtgggaaatgagacacagggggtcaccgctgagataacccctcaagcctccacaactgaagcaatcctacccgagtatgggactcttgggctcgaatgttcaccccgaactggtctagactttaacgaaatgatcctattaacaatgaaaaacaaggcttggatggtacaccgacaatggtttttcgatttgccattaccatggacgagcggagctacaactgaaactccaacctggaatcgtaaagaattgttagtaacttttaaaaacgcacacgcaaagaaacaagaggttgtagttctagggagtcaagagggagctatgcacactgcgcttacgggagcgactgagattcaaaactcaggtggtacatcaatattcgccggacatctaaaatgcagattaaaaatggataaattagaactaaaagggatgtcatatgccatgtgtactaatacctttgtactaaagaaagaagtgtcggaaactcaacatggaacaatattaataaaagtagaatacaaaggagaggatgtaccttgtaaaataccattctcaacggaagatggacagggaaaagctcataatggaaggctaataacagcgaacccagtcgtgaccaagaaagaagaacctgttaatatagaggccgaaccgccttttggggaatctaatatggtcattggtattggagacaatgcactcaaaataaactggtacaagaaaggcagctcgatcggaaaaatgtttgaggctacggcgagaggtgctaggcgaatggcaatcttaggtgacacggcgtgggatttcggatccgtcggtggtgtcctgaacagtcttggtaaaatggtacatcagatctttggaagtgcgtacacggccttattctctggagtctcttgggttatgaaaattggaataggagtactattgacgtggatcggactgaacagtaaaaacacatcaatgtctttttcatgtattgcaattgggataataacattatatttaggtgcagtagtgcaagcagacatgggatgcgttataaactggaaaggcaaagaacttaaatgcggttcgggaattttcgttaccaatgaggtacacacttggacagagcagtataaatttcaagccgacagtcctaagaggttagcaacggcgatcgctggagcatgggagaatggggtttgtggtattcgatctactacacgtatggaaaacctactatggaaacaaattgctaatgagttgaattacattttgtgggagaacaatataaaactaactgtggttgtgggggacataattggagtgttggaacaaggaaaacgaacattgacgccccaaccgatggaactcaaatattcttggaaaacatgggggaaggctaaaattgtcaccgcagaaacacaaaatagttcctttataatcgacggtcctaatacaccagaatgcccatcagcatcaagagcatggaacgtgtgggaagtagaagattatggatttggtgtttttacaacaaatatatggttaaaactaagagaagtatatactcaactttgtgatcatcgactaatgtcggccgcagtcaaggatgaaagagcggttcacgctgacatgggatattggatagaaagtcagaaaaatggaagctggaaattagagaaagcaagtttaatagaagtaaagacatgtacttggccaaaaagtcacacattatggtccaatggggtgctagaatcggatatgattatcccaaagagtctagcagggccaataagtcaacataattaccggccaggctaccacactcaaactgctggaccatggcatttgggaaaacttgaattagacttcaattactgtgagggaacaacagtagtaattacagagaattgtgggacaagaggtccctcgttaagaaccacaactgtttcagggaagttaatccatgaatggtgctgtcgaagttgcactttaccacccttaagatacatgggggaagacggctgctggtacggtatggagatacgacccatatcagaaaaggaagaaaatatggtcaagtcgcttgtaagtgccggttctggcgaggtagataactttactatgggtgtcttgtgcttagccatactatttgaagaagtaatgaggggaaaattcggtaagaaacatatgatagctggagtgttcttcacgtttgtattattgttaagtggccaaattacgtggagagatatggcacatacacttattatgattggaagtaatgctagtgatagaatgggaatgggagtaacctatttagctttaatagctactttcaaaattcaaccttttcttgcactaggattctttttaaggaaactcacaagtagggaaaacttattgttaggagttggactagccatggccaccaccttacaattgccagaagatatagagcaaatggcaaatggcatagcactaggtttaatggctttgaaattaatcacgcaatttgaaacctatcaattatggacggccttaatctctttaacatgttccaacacgatcttcacccttacagtagcctggcgcaccgccacccttatactggccggggtctctctactacccgtatgccaaagcagttctatgagaaagacggattggctgccgatgaccgttgcagctatgggagttccgccattaccactctttatattttcattaaaggatactttaaaaaggagatcttggcctctgaatgaaggagtgatggctgtaggcttagttagcatattagcttcttcactactaaagaatgatgtaccaatggcagggccattagtagcgggtggtcttctaatagcatgctatgtaataacaggaacgagtgccgatctgacagtagagaaagcagcagacgtaacctgggaggaagaggcagaacaaacgggtgtaagccataacctgatgatcactgtggatgacgatggtacaatgagaataaaagatgacgaaacagagaacatattaacagtgttgctaaaaaccgccttattgattgttagcggtatattcccctacagtataccggctaccctattagtatggcatacttggcaaaaacaaacacaaagatctggcgtattgtgggatgttccaagcccaccagaaacacaaaaggcagagctagaagagggtgtatataggatcaaacaacagggcatatttggtaagacgcaggtaggtgtgggagttcagaaagagggggtctttcacacaatgtggcatgttactagaggtgcagttctcacatataatgggaaaagattagaacccaattgggcatcagtgaagaaagaccttatctcgtatggcggtgggtggcgtttatcggcccagtggcagaagggagaagaagtacaggttatagctgtggaaccgggcaaaaatcctaaaaactttcagacgatgcccggaacattccagacaaccaccggagagataggagctatagcccttgactttaaacctggtacctccgggtcacctatcataaacagagaaggcaaggtagtaggattgtacggaaatggagtagtgacgaaaaatggaggatatgtatcgggaatagcacagaccaatgcggagccggatggccctacccctgaactagaggaggaaatgtttaagaaaaggaatctgactatcatggacctgcaccccggatccggtaagacaagaaaatatctccccgctattgtcagggaagcaataaaaagaagactccgaacactgattttagcaccaacacgggtagttgctgctgaaatggaagaagctctgaagggattacccattcgataccaaactacggcaacaaagtctgagcatacaggaagagaaatagtcgatttgatgtgccacgcgacatttacaatgcgactactatctccagtcagagtccctaattacaatttaattatcatggacgaagcccattttacagaccctgcgtctatagctgcaagagggtacatctctacgcgagttgggatgggagaagcagccgccatatttatgactgccactcctcctggtacagcagatgcattccctcaaagtaatgcaccgatccaagacgaggagagagatatacctgaaagaagttggaactcaggaaacgaatggatcacggatttcgcaggaaagacagtttggtttgtgccttcgattaaggcagggaacgatattgcaaactgcttacggaaaaacggcaagaaagtaatacaattatcgagaaagacctttgatacagagtatcagaaaacgaaattaaacgattgggattttgtggttacaactgatatttcagaaatgggagcgaatttcaaagctgatcgggtaattgatcctcgtagatgcttaaaacctgttattctaacagatggtcccgaacgcgtaattctagcgggtcctatgccggtcactgccgcttcggcagcacagcggagaggtcgtgtaggacgaaaccctcaaaaagagaatgatcaatatatctttacgggacaaccactaaataacgatgaggaccatgcacattggactgaagccaagatgttattagataatattaacacacctgaaggtataattcctgcgctattcgaacctgaacgagagaaaagcgccgcgatagatggagaatatcgcctaaaaggagaatctaggaagacttttgtagaattgatgaggagaggtgacctcccggtatggctggctcacaaagtcgccagtgaaggcataaaatatacagataggaaatggtgttttgatggacaacgaaataaccaaatactagaagagaacatggatgtagaaatttggaccaaagaaggcgagaagaagaaactgcgccccaggtggctggatgcccgaacatactcggatccgctcgctttaaaggaatttaaagattttgctgcaggcagaaaatcgattgctttagatctggtgacagaaataggaagagttccgacgcatttagcccacagaacgagaaacgcattagataacctagtaatgcttcacacatcagaacatggaggaaaagcatatagacatgcggtagaagaattacctgaaacaatggaaacattactactactgggacttatgatactcttaactggcggtgccatgttatttctaatttcaggcaagggaatcggaaaaaccagcattggtttaatttgtgtaattgcatcgagcggtatgctatggatggcagaaatcccactacagtggattgcgagcgcaattgttttggagttctttatgatggtcctcctcatacccgaacctgaaaaacaaagaacgccacaagacaatcagcttgcttatgtcgttattggaatcttgactctagcagcgatcattgcagccaacgaaatgggtttactagaaactaccaaacgagacctaggaatgtcaaaagaacccggcgtggtatcacctacaagctatttagatgttgatcttcacccagcaagcgcttggaccttatatgcagtcgctacaacggtgattacaccaatgctcagacacactatcgaaaatagtactgcaaacgtctccctagctgcgatagctaatcaagcagtcgtcctaatgggacttgataagggatggcccattagtaaaatggatcttggggtgcctctcctagcgctcgggtgctactcgcaagtgaacccattaacattaacggctgcagtacttttactaataacccattatgcaataattggacccggattacaagcgaaagctacacgtgaggcacaaaaacgcactgctgcaggcatcatgaaaaatccaacagttgatggaataatgacgatagacctagatcctgttatttacgattccaaattcgagaagcagctaggacaagtcatgctattagtcctttgcgcggtgcagctactattaatgagaacaagttgggcgctgtgtgaagccttaacgttagcaactggacccataacaactctctgggaaggttcacctggaaaattttggaatacaactatagcagtatccatggccaatatattccgtgggagttacttagcaggcgcagggcttgcgtttagcattatgaaatcggtgggaacaggaaaacgtggaaccggatcacagggagaaacgttaggtgaaaaatggaagaagaaactgaatcaactatcaagaaaagaatttgacttatataagaaatctggcatcaccgaagtagacagaacagaagcgaaagaaggtctgaggagaggagaaataacacaccacgcagtaagcagaggaagtgccaaacttcaatggtttgttgaacgaaacatggttatacctgagggacgcgtaatagacctaggttgtggaagagggggatggtcctactattgcgccggactcaagaaagtaactgaagtaagaggctatactaaaggcggaccgggacatgaagaaccagttccgatgagtacttatggatggaacattgttaaattgatgtctggcaaagatgtattttacctgcccccagaaaaatgcgatacactgttatgtgacataggcgaatcttctccttcacctactgtggaagaatcaaggacaattagagtactaaaaatggtagagccttggctaaagaataatcaattttgcataaaagttttaaacccatacatgccaacggtaattgaacatcttgaacgattgcagcgaaaacatggtggaatgttagtcagaaatccactctcccgcaacagtacacatgaaatgtattggatatctaacggcactggaaatatagtagcatcagttaatatggttagccgactactattaaaccgattcacaatgacacaccgtagaccgacgatagaaaaagatgtagacctaggtgctggaactcgtcatgtcaatgcagaaccagaaactcctaatatggatgttatcggtgaacgtataaaaagaattaaagaggagcataactctacttggcactatgacgatgaaaacccttataaaacgtgggcgtaccatggatcttacgaggttaaggcaacaggatccgcatcaagtatgatcaatggagttgtaaaacttttaactaagccatgggatgtggtaccaatggttacacagatggccatgactgatacgacgccgtttgggcaacagagggtctttaaagaaaaagtagacacaagaacacctaggagcatgccaggaactaggagagtgatgggaataacagccgaatggttgtggagaaccttgggcagaaacaagaaacccagactgtgcacaagggaagaatttactaaaaaggtgagaactaacgcagcaatgggcgctgtttttactgaagaaaatcagtgggacagtgctaaagcagcagttgaagacgaggatttctggaaactggtagacagggaaagagaactacataaacttggcaaatgtggcagttgcgtgtataatatgatgggaaaacgagagaagaaacttggagagttcgggaaagcaaaagggtcaagggcaatatggtacatgtggttaggcgcacgatatttggaatttgaagccctgggtttcttaaacgaagatcactggttttctagagaaaattcctactcgggcgttgaaggagaagggttacataaattaggctacattcttagggacataagcaaaatccccggtggcgcaatgtatgcggacgatactgcaggatgggatacgagaataacagaggatgatctacataatgaagagaaaataactcaacaaatggatccagagcatagacaactggcaaacgcaatcttcaaactcacctaccaaaacaaagtagtcaaggttcagcgcccaaccccgacaggcacggtgatggatataatctcgcgaaaagatcaacggggaagcggacaggtgggaacatacgggttaaacaccttcacgaacatggaagcccaacttatacgacaaatggagggtgaaggagtcttgtctaaggcggacttggaaaatccacatttaccggagaagaaaataactcaatggctagaaaccaaaggcgtcgaacgactaaaacgaatggccatatcaggggatgattgcgtggtcaaacctatcgatgatagatttgcaaatgctttgctagcgttgaatgacatgggaaaggttagaaaggatataccacaatggcaaccctcgaaaggatggcacgattggcaacaggttccgttttgcagccatcattttcacgaacttataatgaaagatggccgcaaattagtagtgccgtgtagaccacaggatgaactgattggacgtgcgagaataagtcaaggcgccggatggagcctacgtgaaacagcctgtctaggtaaagcctatgctcaaatgtggagtcttatgtatttccatcgacgagatttacgacttgcgagtaatgcaatatgttcagccgttcctgtccactgggttccgacgtcaagaactacgtggtcaattcatgcgcatcatcaatggatgacaacagaagacatgttgactgtgtggaatagagtatggatagaggataatccatggatggaagacaagactccggttactacgtgggagaacgtaccatacttaggaaagcgggaggatcaatggtgtggtagcctaattgggttaacaagtcgtgcgacatgggcacaaaatatccctacggcaatacagcaagtaagaagtctaatcggaaacgaagaatttctagattacatgccatcgatgaaacgttttaggaaggaagaagaatccgagggtgctatctggtag

SEQ ID NO: 23414 - RNA, 9873 nt, synthetic construct
  misc_feature 1..9873: note = derived and/or modified CDS sequence (opt6) from DENV-3__FJ639779__SS-prME
  source 1..9873: mol_type = other RNA
acttctctttgtctaatgatgatattacctgcggcattggcgttccacctaacctctcgggacggagaacctcgaatgattgtgggtaaaaatgaacggggaaaaagtctactatttaaaacggctagcggtattaacatgtgcacacttatcgcaatggacctaggcgaaatgtgcgatgatacggttacatacaaatgcccacacataacggaagttgaacctgaagatatagattgttggtgcaatttaacatctacatgggtgacttatggaacttgtaaccaggcaggagaacacaggagagataaaagatctgtggcgttggctcctcacgtgggcatgggcctagacacgaggacacaaacgtggatgtctgcagaaggagcttggaggcaggtagaaaaagtagaaacatgggctttgcgacacccaggattcactatattggcattatttcttgcgcactatattgggacatcgttaacccaaaaagtcgtaatttttatattgcttatgcttgtaacaccaagtatgacgatgcgatgcgtaggtgttggaaaccgagattttgtcgaaggcttaagcggtgcaacatgggtcgacgtagtattggaacatggagggtgcgtgaccacaatggccaaaaacaaaccaacactagatatagaattgcagaaaactgaagccacgcaactagcgacgttaaggaaattgtgtattgaagggaaaatcactaacataacaacagatagtcggtgcccaacacaaggagaagctgtattacctgaagaacaggaccaaaattatgtctgtaaacatacttatgtcgatcgcgggtggggaaacggctgtggtttatttgggaaaggatcgttagtaacttgcgcaaaatttcaatgtctagaacctatcgaaggaaaagtggtccaatatgaaaatctaaaatatacggtaattataacggtacataccggtgaccaacaccaagtaggcaacgaaacgcaaggagttacagcggaaataactcctcaagcgagcacaacagaagcgatattaccggaatatgggacgttagggttagaatgttcacccagaactggacttgatttcaatgaaatgatacttttaaccatgaaaaataaagcatggatggttcatagacagtggttctttgacttgcccttaccctggaccagtggtgcaactacggaaacgccaacatggaaccgaaaagaactccttgtaacatttaaaaacgctcacgccaagaaacaagaagtggtcgtacttggtagccaagaaggcgctatgcacacggccctgacaggagcaaccgaaatccaaaactccgggggaacaagtatatttgcaggccatctgaaatgtcgacttaaaatggacaaattagaattaaagggaatgagttacgccatgtgcacaaatacattcgtcttgaagaaagaggtttccgagacccaacatggaacaatacttataaaagttgagtataaaggagaggacgttccgtgcaaaattccattctcaacagaagatgggcagcgaaaagcacacaacggaagattgattacagcaaacccagtagtcactaagaaagaggagccagtcaacatagaggccgagccaccctttggagagagcaatatagtaattggaatcggagacaatgcgttaaaaataaactggtacaagaaagggagctccattggtaaaatgtttgaagcaacagccagaggcgcgcggaggatggcaatcttaggagacaccgcatgggattttggctctgtgggaggagtattgaactctttaggcaaaatggtacaccaaattttcgggagcgcatatacggctcttttctcgggtgtttcttgggtcatgaagataggcattggtgtactcttaacatggataggactcaactctaaaaatacatccatgagttttagttgcatagccatagggataatcacactttaccttggtgcagtagtacaagccgatatgggatgcgtaatcaattggaagggtaaggaattaaagtgcggttccggaattttcgttaccaacgaagtgcatacgtggacagaacagtataaattccaagcagatagtccaaagaggctcgccacagctatagctggagcatgggaaaacggagtctgtggaattagaagtacgacgcgcatggaaaatttgctttggaaacagatcgccaacgaactcaattacatcctttgggagaataatataaaattaaccgtagtcgtcggcgacatcattggtgtattagaacaaggcaaaagaacgctaacgccacaaccaatggaactcaaatattcttggaaaacgtggggtaaagcaaaaatagttacggcggagactcaaaattcctctttcataatcgatggcccaaatacaccagaatgcccctccgcgagtcgtgcatggaacgtttgggaagttgaagactatggatttggcgtatttaccacgaatatctggttgaaacttcgagaagtatatacacagctatgcgatcatagactaatgtccgcagcagtaaaagatgaaagagccgttcatgctgatatgggttattggattgaaagtcagaaaaatgggagttggaagctagaaaaggcaagcctaatagaagtcaaaacatgtacttggcctaaatcacacacattgtggtcgaacggagtcctggaatcagacatgataataccgaagtcattggccggcccaataagtcaacataattatagacctggataccatacgcagacggcaggaccctggcacctagggaagttagaattggattttaattattgtgaaggaaccacagtggtcatcaccgagaattgtggaacacgcggaccatcactgaggacaacaacagttagcggaaagctcatacatgaatggtgttgtcgcagctgtactttgccaccattaagatacatgggggaagacgggtgttggtatggaatggaaattaggcccatatccgaaaaagaggaaaacatggtcaaaagtctcgttagtgctggtagtggcgaggtagataactttacaatgggtgtattatgtcttgccatcctattcgaagaagtgatgcgtggtaaattcggcaagaaacatatgatagctggggtattctttacttttgtactcttgctgtccggtcagataacttggagggacatggctcacacactaatcatgatagggagtaacgcaagtgaccgaatgggcatgggagtaacataccttgcacttatagcgacttttaaaattcaaccctttttagctttaggctttttcttacgaaaactaacaagtcgcgaaaatcttctattgggagtgggactggcaatggcgacaaccttacaactcccagaagatttcgaacaaatggctaatgggattgcactcggacttatggccctaaaactaataacccagttcgagacttaccaactttggacagcattaatctcgttaacctgctccaacaccatattcactctaactgtcgcatggcgaaccgcaactttgatattggccggtgttagcctactaccagtatgtcaaagttcaagtatgagaaaaaccgattggttacctatgacagttgcagcaatgggagtacctccactgcccctgtttatcttctctttaaaagatacgcttaaacgaaggagttggcccctaaacgaaggagtgatggctgttggcctagtatctattctagcatctagcctgctgagaaatgatgtaccgatggcgggacctctagtggctggtgggttactaatcgcatgttacgtaatcacagggacaagtgccgatttgacagtcgaaaaagccgccgatgtcacatgggaagaagaagccgaacaaacaggcgtatcacataacttgatgattacagtagatgatgacggaacgatgcgaattaaagacgacgaaactgaaaacatactcaccgtcttactaaaaactgcattgttaatagtttccggcatattcccatactcaattccagccacattactcgtctggcatacttggcagaagcaaacgcaacgctctggggtactatgggatgttccaagtccacctgaaacacaaaaagcggaactggaagaaggcgtatataggatcaaacaacaagggatttttggaaaaacccaggttggcgtcggggtccagaaggaaggtgtatttcacacaatgtggcatgttacaagaggagcggttttaacgtataatggtaaacggttagaacccaactgggcttcggttaagaaagatcttattagttatggtggaggatggcgattaagcgctcaatggcagaaaggagaagaagtgcaagtaatagctgtagaaccaggcaaaaaccccaaaaacttccaaacaatgccgggcacatttcaaacgacgaccggagaaataggagcaatagcacttgacttcaagccaggcacttcaggaagtccaataataaatagagaaggtaaagtcgttggactctatggtaatggtgtagtgactaaaaacgggggctacgtaagcggcatagcgcagacaaacgccgaacctgatgggcctgcacccgagttagaagaagaaatgttcaagaaacgcaacttaacaatcatggatctacatcccggaagtggaaaaacgagaaaatacttaccagctattgttcgcgaagcaataaaaaggagactacgaaccttaattttagcaccaactcgcgtggtagcagcggagatggaggaggctttgaagggattaccaataagatatcaaaccacagccactaaatcagaacatactggacgagaaatagtggatctcatgtgtcacgcaaccttcacaatgcgcctactcagcccagtgcgagtgccgaactacaatttaatcataatggatgaagcacactttactgaccctgcatccattgccgctcggggatatatttcaacacgtgtaggaatgggagaagcagcagctatatttatgacagcaacaccacccggaacagccgatgcgtttccgcaatcaaacgcgccaatacaagatgaggagcgagatatccctgagagatcatggaatagtggcaatgaatggataacggactttgctggaaaaacggtctggttcgtcccaagcattaaagctgggaatgacatagcaaattgcttgaggaaaaatggcaagaaagtcatacaattatcacgaaaaacatttgataccgagtatcaaaagacaaaactaaacgactgggacttcgttgttactacggacataagtgaaatgggagcgaactttaaagcagatcgagttatcgatccgagaagatgcctgaaaccggtaatactaacggacggacctgagagagtcattctcgcaggacccatgcctgtgacagcggcatccgccgcgcaaagaaggggacgtgtaggtagaaatccacagaaagagaacgatcaatacatcttcaccggacaaccattaaataacgatgaggaccatgcccactggacagaagctaagatgctactagataacattaacacacccgaaggaataataccagccctcttcgagcccgaaagagagaaaagtgctgctattgatggagagtacaggctaaaaggggaaagccggaaaacattcgtggagcttatgagaagaggtgacctccctgtatggctcgcgcataaagttgcgtcagagggcataaagtataccgataggaaatggtgtttcgatggtcaacggaataatcagatacttgaagaaaatatggatgtcgaaatctggaccaaagaaggagagaaaaagaaattgagaccacgttggctagacgcgagaacttacagcgatcccctagccctgaaagagttcaaagattttgcagcaggacgaaaatcaattgcgcttgacctcgtgactgaaatcggtcgagtgcctacccacctcgcgcacagaacaaggaatgcactagataatttggtgatgttacatacgtcagaacacgggggtaaagcatatcgccatgcggtggaagaattgcctgagacaatggaaaccttacttttacttggactcatgatcttgttaacaggtggagcaatgcttttccttataagcggcaaaggaataggtaaaaccagcattggcttgatatgtgttattgcgagtagcggaatgttgtggatggctgaaataccacttcaatggattgcctctgcaattgtactggagttctttatgatggttctgttgatcccagaacctgaaaaacaaagaactccgcaagataaccaactagcgtacgttgtcataggtatactaacacttgcagcgatcatcgctgccaatgaaatgggtcttctggaaactacaaagagagacctcggtatgagcaaagaacccggagtagtttctccgacaagctatctggacgtcgatcttcatccagcatccgcctggacattatatgccgtagctaccactgtaatcacccctatgctgagacatacgatcgaaaatagcacagctaacgtatcccttgcagctatcgcaaaccaagcagtagtcctcatgggattagacaaaggttggcccataagcaagatggatcttggtgtccctctcttggctcttggatgctattctcaagtcaatccgttgacattgacagctgcagttctactcctaattactcattatgcaatcattggaccaggtttacaagcgaaagctaccagagaagcacaaaagcgaactgctgccggtattatgaaaaatcctacggtagacggaataatgactatagacctagatcccgtaatctatgatagtaagtttgaaaaacagcttggtcaagtgatgcttttagtcctgtgtgcagtacagcttttattgatgcggaccagctgggccctttgcgaagcgctgacccttgcaacaggacccatcacaacactatgggaaggttctcccgggaagttttggaacactaccatcgccgtaagcatggcaaatatatttcgaggatcttatctcgcaggagcaggtctagcattctcaattatgaaatctgtaggaactggaaaacgcggtacggggtctcaaggggaaacattgggggaaaaatggaagaagaaattaaaccaactaagtagaaaggagttcgacctgtacaagaaatcaggtataacggaggtagaccgaacagaggctaaagaaggtcttaaaagaggcgaaattactcaccacgcggttagtcgaggtagtgccaagctacaatggtttgtagaaagaaacatggttattccagaagggagagttatagacttaggttgcggtagaggtggatggagttattattgcgctggtcttaagaaagtaacggaagttagaggatatacaaaagggggtcccggacatgaagaacctgtcccaatgtcgacgtacggatggaatattgtaaaacttatgagtggaaaagacgtattttatttaccaccggaaaaatgtgatacattgctgtgcgatattggagaaagcagccccagtccaaccgtagaagaatctagaaccattcgagtattaaaaatggtggagccttggcttaaaaacaaccaattttgcataaaagtacttaacccttatatgcccaccgtaatcgaacaccttgaaaggctgcaaagaaaacatggaggaatgttagtccgaaatcctctatctcgaaatagcacccatgagatgtactggatatcaaacggaacaggcaacattgttgcaagtgtaaatatggtatcacgactattactgaatagatttacaatgacccatagacgcccaacaattgaaaaagacgtagacctaggtgcaggcaccaggcacgtaaatgcagaaccggagaccccaaacatggacgtaatcggcgaacgtattaaacgcataaaggaagaacataactcaacatggcattatgatgacgaaaacccatacaaaacttgggcatatcatggaagttatgaagttaaggctacaggaagcgctagttccatgataaacggggtggtgaaactacttacaaagccttgggacgttgttcccatggttacccaaatggccatgacagatacaactccttttggtcaacaacgagtatttaaggagaaagtagacactcggactcccaggtccatgcctggcacacgacgagtaatgggtattacagcagaatggttatggagaacacttggacggaataagaaacctcgtctctgtacaagggaagagttcacaaagaaagtaagaacaaacgcggcgatgggggctgtctttacggaagaaaatcaatgggatagtgccaaagccgctgttgaagacgaggatttctggaagctagtagatagagaacgcgagctacataagctcggaaaatgcggatcttgtgtatacaatatgatgggtaagcgtgaaaagaaattaggagaatttgggaaagccaaagggagtagagcaatttggtatatgtggctcggtgcgaggtatcttgaatttgaggcccttggattcctaaatgaggaccattggttctctagggaaaattcatattctggagttgaaggcgaaggattacacaaattaggctatatactccgggacatttccaaaataccgggcggagcaatgtatgcggacgacaccgctggttgggatacaagaataacagaagatgatttacataatgaagagaaaataacacaacaaatggatccagaacatcgacaattagctaatgcgatattcaaacttacttatcaaaataaagtggttaaagtccaacgcccaactccaactggtacagtaatggacataataagcagaaaggatcaacgaggatctgggcaagtaggaacatacggtctaaatacatttacgaacatggaagcgcagctaataagacaaatggaaggagaaggagtcttaagcaaggcggatttagaaaacccccacttacccgagaagaaaataacacaatggcttgagacaaagggtgttgaacgacttaagcgtatggcaatatcaggggatgattgtgtcgttaaaccaatagacgaccgtttcgccaatgccctacttgctctaaacgatatgggcaaagtaaggaaagacataccccaatggcaaccaagtaagggttggcacgattggcaacaagttccgttctgtagtcatcatttccatgaactaataatgaaagatggaagaaaactggttgtaccgtgcaggccacaagacgaactgatcggtagagcaagaatttctcagggtgcaggttggagtcttcgagaaacagcatgtttgggaaaggcttacgcacaaatgtggtctttaatgtacttccatagaagagacctaagactagcatccaatgcgatctgttcagccgtgccagtgcattgggttccaacaagccgaacaacttggtcgatccacgcccaccatcaatggatgacaaccgaagatatgttgacagtgtggaacagagtatggatagaggacaacccctggatggaagacaaaacaccagtaaccacgtgggaaaacgtaccatatctcggaaaaagggaagatcaatggtgcggtagtctcatagggttaacaagtagagcgacctgggcgcaaaatatccctacagcaatacagcaagtacgatccttaataggtaatgaggagttcctagactacatgccagccatgaagcgattcaggaaggaagaagaatcagaaggcgcaatctggtga

SEQ ID NO: 23415 - RNA, 9873 nt, synthetic construct
  misc_feature 1..9873: note = derived and/or modified CDS sequence (opt6) from DENV-3__FJ639780__SS-prME
  source 1..9873: mol_type = other RNA
acatccttatgcttaatgatgatactacctgctgctctagcattccatttgacatctcgggacggtgaaccgcgcatgattgtaggcaaaaatgaacgcggaaaaagtttattatttaaaacagcctccggaatcaacatgtgtacattaatagcaatggaccttggcgaaatgtgtgatgatacggttacatataaatgtcctcacataacagaagtggagcccgaagacatagattgctggtgtaacttaacatctacatgggtaacgtatggaacttgcaatcaagcgggagaacacagaagagataaaaggtccgtagcactggccccacatgtgggaatgggtttagacacaaggacacaaacatggatgtccgctgaaggtgcctggagacaagtagagaaagtcgaaacatgggcacttcgccacccgggatttacaattctggctttattcttagcgcattacattggtacctcactgacgcaaaaagtagtaattttcatactgcttatgttagtaactccatcaatgacgatgaggtgcgtcggggtaggaaatcgagatttcgttgaaggtttgtccggagccacatgggtggacgttgtattagaacacggtggatgcgtaactacaatggccaaaaataaaccgacattagacatcgaactacagaaaacggaagcgacccaattggctaccctacgcaaactttgcatagaagggaaaattacaaacataactacagattcccgttgcccaacacaaggagaagcagttctccccgaagaacaagatcaaaattacgtatgcaaacatacatacgtggatcgtggttggggaaatgggtgcggcttgttcggaaaagggagtttagtcacgtgcgcaaaattccaatgcctggaaccaatagaaggcaaagtagtacaatatgaaaacctaaaatacaccgtgattattaccgtgcatacaggcgaccaacatcaagtgggcaacgaaacccagggagtaactgcggaaataacgccgcaggcttctacaacagaagcaattcttccagaatacggtacactaggcctggagtgctcccctagaaccggtttagattttaacgaaatgatattactgacaatgaagaataaagcctggatggttcatcgacagtggttctttgatctacctctaccatggacctcgggcacaactacggaaactcctacatggaaccgtaaggaactcctggtaactttcaaaaatgcacatgctaagaaacaagaagtagttgtacttggaagccaagaaggagcaatgcacacagcgctgaccggggctacggagatacaaaacagtggagggacatccatatttgcagggcacctaaaatgcagactaaaaatggataaattagagctaaaaggaatgtcttatgcaatgtgcacaaatacctttgtattgaagaaagaagtgagtgagacccagcacggtaccatattgataaaggtcgaatacaaaggcgaggacgtcccttgtaaaataccgttctcaacagaagatggacagggtaaagcacataacggacgattgataactgcaaacccagttgtaactaagaaagaggaacctgtaaatatcgaagcagaacctcccttcggtgaatcaaatatcgtgatcggcattggtgacaacgctttgaaaataaactggtataagaaaggttcttcaattgggaaaatgtttgaagcgacagcaaggggagctagacgcatggctatactcggtgatactgcgtgggatttcggttcagtgggtggagttctcaatagtctagggaaaatggtccaccaaatattcggaagtgcatatacggccttattttctggagtatcatgggtcatgaaaatcggaataggagtgttattaacgtggataggacttaacagcaaaaatacatctatgtctttctcatgtatcgcgattggaataataacattatatcttggcgcggttgtacaagcagatatgggctgcgtaatcaattggaagggcaaggaactaaaatgcggatctggaatatttgttacaaatgaagttcatacatggacagaacagtataagttccaagccgactcaccaaaaaggcttgcaactgccatagccggcgcgtgggaaaacggagtgtgcggaataagaagcacgacgagaatggaaaatctactatggaaacaaatagcgaatgaattaaactatatcttatgggaaaataatataaagttaacagttgtcgtaggagacatcatcggagtcttagaacaaggaaagaggacattaacacctcaaccaatggaattgaaatattcctggaagacttggggcaaagcgaaaatcgtaactgcagaaacccaaaattcaagttttattatagatgggccaaacacacccgaatgtcccaatgccagccgagcatggaatgtttgggaagttgaggactatggattcggagtttttaccacaaatatctggctaaaactaagagaggtttatactcagctctgtgatcaccgtcttatgtcagcagctgtgaaagatgaacgagcggtgcacgctgatatgggctattggattgaaagtcagaaaaatggaagttggaaacttgaaaaagcatccctaatcgaggttaaaacatgtacgtggccaaaatctcacacattatggagtaatggagttctagaatcggatatgattattcctaaatcgctagcgggaccgatctctcaacacaattacagaccgggataccacacacaaactgctggaccatggcatctgggtaagttagagctagacttcaattattgcgaggggactacggtagttataaccgaaaactgtggtactaggggccctagtctgcgaactactaccgtttcgggtaaacttatccatgaatggtgctgcagatcttgtacattaccaccattgagatacatgggtgaggacgggtgttggtatggtatggaaatccgacctatatccgagaaggaagaaaacatggtcaaaagtcttgtttcggcaggctctggcgaagtggataactttacaatgggtgtactatgcctagccattttatttgaagaagttatgagaggaaaatttggcaaaaagcacatgatcgcaggagtattctttacattcgtattactattatcaggacaaataacatggagagatatggcccatacattaataatgattggatcgaacgcttcagatagaatgggtatgggagtcacatatctagctttaatcgcgaccttcaagatccagcctttcttggcattaggattctttctccgtaaactcacgtcgagggaaaacctactattaggtgtcggattagctatggcgaccacactgcaattgccagaagatatcgagcagatggccaatggaatcgcgctggggttaatggcattaaaactcataacacaatttgaaacctatcaactgtggacggctttgatcagtttaacatgctcaaacacaatatttacactaactgtcgcatggaggacggccactttaatattagcaggggtatccttgttacctgtatgccaatcttcctcaatgagaaaaaccgactggttgcctatgactgtcgcagcaatggggataccgccactcccacttttcatattctcactaaaagacacattgaagcgacgaagttggccactaaatgagggagtcatggcagttggcttagtgagtattctcgcctcctcattattaagaaacgatgttcctatggcaggtccacttgtggcaggcggattgctaattgcttgttacgttatcacaggcacgtctgcagatcttacggtagaaaaggcagctgacgttacttgggaggaagaagcagaacaaacaggcgtttctcataaccttatgattacggtagatgacgacggtaccatgcgcataaaagacgatgaaacagaaaatatattgacagtattgctcaaaacggctttgttaatagtgtccggtatttttccctattctatcccggcaacactattagtttggcatacgtggcagaagcagacgcaacgaagtggggtcctatgggatgttccatcacccccagagacacagaaagccgaactagaagaaggtgtttataggattaaacaacaaggaatattcggtaaaacacaagtgggcgtaggtgtccagaaagaaggtgtttttcatactatgtggcatgtaactcgtggtgccgtgttaacgtataacggcaaaagattagaaccaaattgggcaagcgttaagaaagatttaatttcatatggcggaggatggaggctttcagctcagtggcaaaaaggcgaggaggtacaggtgatagcagttgaaccggggaaaaatcccaagaattttcagacaatgcctggaacttttcaaaccacaacgggggaaattggagcgatcgcgctcgattttaaaccaggtacaagtggatctccaataattaaccgagaaggaaaggttgtaggtttatatggtaatggtgtagtgacaaagaacggaggctacgttagtgggatagcacaaacaaacgctgaacccgatgggcccacaccagaattagaagaggaaatgtttaaaaagagaaatctaacaatcatggacttgcatccggggtctgggaaaacgcgtaaatatcttccagccattgtacgggaggcaataaaaagacgcttacgaactcttatactagcaccaacgagagttgtggcagctgaaatggaagaagctcttaaaggtttaccaattaggtatcagacaactgccactaaatcagaacacacgggacgcgagattgtggacctaatgtgccatgcaacgtttacgatgagactattatcccctgttcgagttccaaattacaatttaattattatggatgaagcacattttaccgatcccgctagcatcgccgccaggggatatatctccaccagggttggcatgggtgaagccgcagcgatatttatgaccgcgacaccgcccggtactgcagatgctttccctcaatccaatgcccccatacaagatgaagaaagagatatacccgaaagaagctggaactcaggaaatgaatggataacggattttgctggaaagactgtatggtttgtcccctcaattaaagcaggcaatgacatagcaaattgtttacggaaaaatggaaagaaggttatccaattatcaagaaagactttcgatacggagtaccagaaaacaaaactaaacgattgggactttgtagtaactactgatatatctgaaatgggcgcaaatttcaaggcagatagagtaatagacccccgcagatgtttaaaacccgtcattttaacagacggaccagaaagagtaattttagcgggaccaatgccagtgactgcagctagcgccgcacagcgtagaggtagagtaggtcgaaatccacagaaagaaaatgatcaatacatattcactgggcaaccgcttaataacgacgaagatcatgcacattggacggaggcaaaaatgctattagacaatatcaatacacctgagggcattataccggcattgtttgaaccggaaagagagaaaagtgcagctatagacggagagtatagattaaaaggggagtcaaggaaaacttttgtcgaactaatgagaaggggtgacttaccagtatggctagcacataaagtagcatctgaaggcataaaatatacagatagaaaatggtgctttgatggacaaagaaacaatcagattctagaagaaaacatggatgttgaaatttggaccaaggaaggcgaacgaaagaaactaagaccacgctggttggacgcacgtacatactcagatcctctcgccttgaaagaatttaaagacttcgcagcgggaagaaagtcgatagcactagatcttgtcactgaaataggaagggtaccaactcatctggcacacagaacgcgcaacgcattggataatcttgtaatgctacacacatccgagcatggaggaaaagcctaccgacatgctgtagaagaactacctgaaacgatggaaacgctacttctattaggccttatgatattgctgacaggtggagctatgctctttttgatttctggaaaaggcatcggaaaaaccagcataggtttaatatgtgtgatcgcatcatcaggaatgttgtggatggccgaaatacctctacaatggatagcatcggctatagttttagagtttttcatgatggttctactaatacctgaaccggaaaaacaaaggacaccacaagataatcaactcgcatacgtagtcatagggattctcacattagcggcaataatagctgcgaacgagatgggtctactagagacgacaaaaagggacctcggaatgagcaaggagccaggggtcgtttctcctacatcatatctagatgtcgatctacatccagcttctgcatggacactgtacgcagtagcaactactgttataactcctatgctaagacatacaatcgaaaactcgacagccaatgtatcattagccgccatagcaaaccaagcggtcgtactcatggggttagataaaggatggccaatctcaaaaatggacctaggtgtccctttattagctctaggatgctatagccaagttaatccactaacgcttactgcagcggtacttttgttgataacacactacgctataataggtcccggtttgcaagctaaagcaacgagggaggcccaaaaacgaactgcagctggtataatgaaaaacccgactgtggacggaataatgactatagacctagatcctgtcatttatgatagtaaattcgagaagcagttagggcaagtaatgttgttagtactatgcgcggtgcagctcttgttaatgcgaacgagttgggcactatgcgaggcactcacactcgctactggtccaataactacactttgggaaggatctcccggaaagttttggaatacaacgatcgccgttagcatggcaaatatattcagaggatcctaccttgccggagccggtctagcttttagtataatgaaaagtgtaggtactggcaaacgtgggactggttcgcaaggggaaacattaggagagaagtggaagaagaaattaaaccaactcagcagaaaagaatttgacctatataagaaaagcggcatcaccgaggttgataggactgaagcaaaagaggggctgaaacgaggggaaattactcatcacgcggtgtcaagaggcagtgctaaactacagtggttcgttgaacgaaatatggtcatcccagaaggccgcgtaatcgatctaggatgtggaagaggaggttggtcctattattgtgcgggcttaaagaaagttacggaagtcaggggttatactaaaggaggtccaggccatgaagaacctgtgcccatgtctacttacggttggaatatagttaagctgatgtccggaaaagacgtattttatctaccgccagaaaagtgtgacacactcctatgcgacataggagaaagcagtccaagtccaaccgttgaggaatcccgaacaataagagttttgaaaatggttgaaccctggttgaaaaataatcagttctgcataaaagtcctaaacccatatatgcctgcagttatcgaacatttagagagactgcaacgaaagcatggaggcatgttagtgcgtaacccattgtctagaaacagtacacacgaaatgtattggataagtaatgggacagggaatatagtggcttccgttaatatggtcagtaggttattactaaacagatttacgatgacacacagaagaccaaccatagaaaaagacgtagatctcggtgcaggaacaagacatgtaaacgctgaacctgagactccgaacatggacgtgatcggagagagaattaaacgtataaaagaagaacataattcaacatggcactatgatgatgagaacccatataaaacatgggcatatcatggaagctatgaagtaaaagcaacgggctcagcttctagcatgattaatggagttgtcaaactgttaactaaaccctgggatgtagtaccaatggtaacccaaatggccatgacagatacaaccccatttggacaacaaagggttttcaaagagaaggttgacaccagaactccccgatcgatgccgggaacgagacgagttatgggtataacagcagaatggctctggcgtacgttgggccgtaataagaaaccgaggttatgcaccagagaagagtttaccaagaaagttagaactaacgctgcaatgggagctgtgtttactgaagaaaatcaatgggacagtgcaaaagctgccgtggaagatgaagatttctggaagttagtagatcgagaaagggaattacataaacttggaaaatgcggttcttgtgtctacaatatgatgggtaaaagagagaagaaacttggagagttcggtaaggccaaaggatcacgagccatatggtacatgtggttaggagccaggtacttagaatttgaggcactaggattcctaaatgaagatcactggttcagcagggaaaatagttactcgggagtggaaggagaaggacttcacaaattgggatatattcttcgagatatctcaaaaatacctgggggagccatgtacgcggacgatacggcaggatgggatacaagaataacagaagatgatttgcacaatgaagagaaaataactcaacaaatggaccctgaacatcggcaactagcaaatgcaatattcaaattaacctatcagaacaaggtggttaaagtacaaaggcctacacccacaggtactgtaatggatattatatctaggaaagatcaaagaggatctggacaagtgggaacctatggcctgaacacgtttacgaatatggaggcacagttaatccgtcaaatggaaggtgaaggtgtactctccaaggcggatttagaaaatccgcacctacccgagaagaaaataacgcaatggcttgagactaaaggagtggaaagattaaagagaatggccatctctggagacgattgcgtcgttaaacccatcgacgataggtttgcgaacgcactactggctttaaatgatatgggaaaggtgaggaaagatattccgcagtggcaaccgtcaaagggatggcatgattggcaacaagttccgttttgttctcatcatttccacgaactaatcatgaaagatggaagaaaattagtagtgccttgccgtccacaagatgaattaattggcagagctcgtatatcacaaggagcaggatggagcctgcgcgagaccgcatgtttgggtaaggcttacgcgcaaatgtggagcctaatgtactttcatcgacgcgacctaagattagcctctaatgcaatatgttccgcagtccctgttcactgggttccaactagccgcacaacatggagcatacatgcacatcaccaatggatgacaacggaagacatgttaacggtatggaatcgagtatggatagaagataatccgtggatggaagataagactcccgtcacgacgtgggaaaacgtcccatatctagggaaacgagaagatcaatggtgtggctcattaattgggttaacctcgagagccacatgggcccaaaacattccaacagcgatacaacaagttcgaagtctaataggaaacgaggagttcctagattatatgccaagcatgaagagatttagaaaagaagaagaaagcgagggcgcaatttggtga

SEQ ID NO: 23416 - RNA, 9873 nt, synthetic construct
  misc_feature 1..9873: note = derived and/or modified CDS sequence (opt6) from DENV-3__FJ639781__SS-prME
  source 1..9873: mol_type = other RNA
actagcttatgtttaatgatgattttaccagctgctttagcctttcatttaacttcacgagatggtgaacctcgtatgatagtcggtaaaaacgaaagaggaaaaagtttgctatttaaaacggcctcaggaatcaatatgtgcactctgatagccatggatcttggagaaatgtgcgacgacactgttacttataaatgtcctcatataaccgaagtagaaccagaagatatagactgctggtgtaacctcacaagtacttgggttacatacggcacctgtaatcaagcgggggaacacagacgagataaaagatcggtagctttggcaccacatgttgggatgggactagatacgagaactcaaacgtggatgagtgcagaaggagcttggaggcaagtggaaaaagtagaaacgtgggcactcaggcaccccggctttaccatattagccctattcttagcacagtatataggcacgtccctaacacaaaaagttgtgatctttatcttattgatgcttgtaaccccatccatgacaatgcgttgtgtaggtgttggaaatcgagactttgtagaaggactttccggtgccacttgggtcgatgttgtattagaacatggtggctgtgtgacaacaatggccaaaaataaaccaaccctagatattgaactccagaaaactgaagccacacaattagcgacactaaggaaattatgtatagaaggtaaaataactaatattacgacagactctcgttgtcctacccaaggtgaggctgtgctgccagaagaacaagatcaaaattacgtttgcaaacatacatatgtggatagggggtggggcaatggatgtggcctattcggcaaagggagtttggtaacctgtgcaaaatttcaatgtttggaaccaatagaaggcaaagttgttcaatacgaaaacctaaaatacaccgttattattacagttcatactggggatcaacatcaagtgggcaatgaaacgcaaggtgtaacggcggagattacaccacaagcaagcactacagaagcaattctgcctgaatatggtactttgggactggagtgctctccacgaacaggcctagattttaatgagatgattcttcttacaatgaaaaataaagcatggatggtgcatcggcaatggttcttcgacttacctttaccttggacatcgggtgcaacaactgagacacccacttggaatagaaaagaactactcgtaacgttcaaaaacgcacacgctaagaaacaagaggtcgttgttctagggagtcaagaaggagctatgcacacggcgctaacaggcgcgactgaaatacaaaacagtggagggacatcaatatttgcgggacatcttaaatgtcgattaaaaatggacaaattagagcttaaaggcatgtcttatgctatgtgtacaaatacatttgtactaaagaaagaagtaagtgagacacaacacggaaccatactaatcaaagtcgaatataaaggtgaagacgtgccatgcaaaataccattttcaacagaagacgggcaaggaaaagcccataatggtcgtttaataacggctaatcccgtagtgacaaagaaagaagaacctgtaaatatcgaagcagaaccaccttttggagaatctaacatagttataggtataggagataatgccctcaaaataaactggtacaagaaaggatcatcaataggaaaaatgtttgaggcgaccgcacggggcgcgcgaagaatggctatactaggggacacagcatgggattttggtagcgtcgggggagtacttaactcattagggaaaatggttcaccaaatattcggaagtgcatacacggcattgttcagtggtgttagttgggtgatgaaaatcggtattggtgtcctactcacatggattggattaaatagtaaaaatatatcaatgtctttttcctgtatcgccataggaataataacattatatctgggggcagtagttcaggctgatatgggctgtgtaataaactggaaaggaaaagagctgaagtgtggctcaggaatattcgtaacaaatgaagttcacacgtggacggagcaatacaaattccaggccgattctcctaagcgactggcaacggctattgcgggtgcatgggaaaatggagtctgcggaattagatctacgactaggatggaaaacctattatggaaacaaattgccaacgaactaaattatattttatgggaaaacaatataaaactaacagttgtagtcggggatacaattggagtactcgaacagggtaaacgaaccttaacccctcagccaatggaacttaaatactcgtggaaaacatgggggaaagcaaaaatagtaacggcagagacacaaaactctagttttataatagatggcccgaatacgcctgaatgtccatcagcttctcgagcctggaatgtatgggaagtagaagactacggttttggagttttcacgactaacatttggctaaaacttagggaagtctacacccaactctgtgatcaccgcctgatgtccgcagctgtcaaagacgaacgagctgttcacgcggatatgggatattggatagagtcacaaaagaatggaagttggaaactggaaaaggcttcacttatagaagtgaaaacatgcacatggccaaaatcacacactctatggtcgaatggtgtactcgaaagcgatatgattatccccaagagtttagcaggacctatatctcaacataactataggccagggtaccatacacaaacagccggtccttggcacctcggtaaactagagctagatttcaattactgcgagggaacaacagtcgtcattacagagaattgtggaactagaggaccatctctccgaaccacgacggtatctgggaaattgatacacgaatggtgttgtcgttcgtgtacacttcctccacttcgctatatgggagaagatggatgctggtacggaatggaaattaggccaataagcgagaaagaagaaaacatggtgaaatcgttagtcagcgctggctcaggagaggttgataatttcaccatgggtgtattgtgtctagcaatactattcgaggaggtcatgcgaggaaaatttggcaagaaacatatgatagcaggggtatttttcacgtttgcgctcttgctttccgggcaaattacttggcgagatatggcacataccttaattatgataggttcaaatgcttcagacaggatgggtatgggggtgacctatctagcattgatagcgacgtttaagattcaaccatttcttgcattaggattcttcttaaggaaactcacatcgcgagaaaatttattgctaggagtaggactagctatggcgaccacacttcagttacccgaagatattgagcaaatggcaaatggaatagcactgggattaatggcgttaaagttgataacacagtttgagacatatcaattatggaccgcactaatttctcttacatgtagtaacacaattttcacattgacagtagcctggcgtacagcaactctaattcttgcgggtgtaagtctgctgccggtatgtcagagtagctcaatgcggaaaactgactggttgcccatgaccgtggctgcaatgggtgtaccgcctctgccactttttatatttagtttgaaggatactttaaaaagacgtagttggcctctcaatgaaggggtaatggctgtaggactcgtctctatattagcgtcgagtttgctaagaaacgatgtacccatggcagggcctttagtagccggtggactgttgatagcttgttatgtaattaccggaacaagtgcggatttaacagtagagaaagcagcggatgtaacgtgggaagaagaagcggaacaaacaggagttagtcataaccttatgatcactgtagatgatgacgggaccatgcggataaaagacgacgagacagaaaatattctaaccgtgctcttaaagacagcgctcctgattgtctcagggatatttccctacagtattccagccactttacttgtatggcatacatggcaaaaacaaactcaacgttcaggagtactttgggatgtcccctctcctccagaaactcagaaagcagagttagaggaaggggtatatagaatcaaacaacaggggatctttggaaagactcaggtgggcgtaggagtacaaaaagaaggtgtttttcacacaatgtggcatgtaactcgtggggcagttcttacctataacggaaaaagattagaacccaattgggcatcggtcaagaaagatttgatttcatacgggggtgggtggcgattatcagcacagtggcaaaagggggaggaagtccaagttatcgcggtggaacccggaaagaaccccaaaaattttcaaaccatgccaggaacttttcaaacaaccactggggagatcggcgcgatcgcattagattttaaacccggaacgagcggaagtcctataattaaccgagaaggtaaggtggtgggattgtacggaaatggagttgttactaaaaatgggggctatgtatcagggatagctcaaacaaacgcagaacctgatggtcctacgccagaactagaggaagaaatgttcaagaaacgcaatctaacaataatggatttacaccccggatcgggaaaaacccgcaagtatttaccagctatagtgagagaagctattaaaagacgactgcgcactctcatactagctccaactagagtagtcgctgcagaaatggaggaagctctcaaaggtttaccaatacggtaccaaacaacagccacaaaatcggagcacactggcagggaaatcgtagatttaatgtgccatgcaacatttacaatgagattactttctcctgtaagagtccccaactataacttgataataatggatgaagcacactttaccgatccagcgtctatagccgccagaggatatatatcaacaagggtcggcatgggggaagcagcagcaatattcatgactgctacaccaccaggcacagctgatgcgtttccgcaatcaaatgcacctatacaggatgaggagagagatattcctgaacgatcctggaactcaggtaacgaatggataacagactttgcaggcaagaccgtatggtttgttccaagtatcaaggctggaaatgacatagcgaattgcctacgtaaaaatggcaagaaagtaatacaactaagcagaaaaacttttgatactgagtatcagaaaactaagttgaatgattgggactttgtagtaacaaccgacatatcagaaatgggagctaactttaaagctgatcgagtgattgatccacgaagatgcctgaaaccggtgattttaacagatggcccagaaagggtcatcctcgcaggaccaatgccggtgacagcagctagcgcagcacaaagaaggggacgcgtgggtaggaacccccagaaagaaaatgaccaatatatatttactgggcaacccctaaacaatgacgaagatcacgcacattggaccgaagcgaaaatgctactagataatatcaacactccagaaggaataataccggcactgttcgaaccggagagggagaagtcagctgcaattgatggagaataccgcttaaaaggtgagtccagaaaaactttcgttgaattgatgcgccgaggagatttaccagtatggttggcgcataaagtggcgagcgagggaattaaatacaccgatcgcaagtggtgtttcgatggccagcgcaacaaccaaatcctcgaagaaaatatggatgtggaaatatggactaaagaaggagagaagaagaaacttagaccgaggtggctagatgcgcgaacttactcggaccccctagccctcaaagaatttaaagacttcgccgccgggagaaaatcgattgctttagatctagttaccgaaataggacgtgtaccaacacatctagcacaccgtacgcgcaatgcactagacaatctagtaatgctccacaccagtgaacatggcggcaaagcctatagacatgcagttgaagaactacctgaaacaatggaaacgcttttactactaggtctaatgatactactaactggaggagctatgttatttttaatcagcgggaaaggaatcggaaagacctcaataggattgatttgcgttattgctagttcagggatgctgtggatggctgagataccactccagtggatagcatctgcgatagttctagaatttttcatgatggtactacttataccagaaccagaaaaacaacgaacaccccaagataatcaactggcatatgttgtaatagggattttaacactagcggcaacgatcgcagctaacgaaatggggcttctcgagacgacaaaacgggaccttggaatgtccaaagaaccaggggtagtatcgccaacaagttacttagatgtagacttacaccctgcatcggcttggacactgtacgctgtagcgacgaccgtcatcacgcctatgctacgacataccatagaaaacagcacagctaatgtgagcttagcagcaatagcaaaccaggctgtagtactgatgggtctagataaaggatggcccatttcaaagatggatctcggagtccctctcttggcacttgggtgttactctcaagttaatccactaactctaaccgcagctgtacttctactaattacacactatgcgataataggtcccggtcttcaagccaaagcaacaagagaagcacaaaagagaacagcggccggaattatgaaaaacccaacagtagatggtataatgactatcgatcttgatcctgtaatatatgactccaaatttgaaaagcaacttggccaagtaatgttacttgttctgtgcgcagtgcaacttctcctaatgcgcacttcatgggcattatgcgaagcccttactctggcaacgggtccaataaccactttatgggaagggagtcccggcaaattttggaacacaactattgccgtaagtatggcaaacattttcagaggttcttatctggctggtgcaggccttgcatttagcataatgaaaagcgttggcacaggcaaaagaggaacaggaagccaaggcgaaacattaggagaaaagtggaagaaaaagttgaaccaactgagcagaaaagaatttgacctttataagaaatccggtattactgaagttgatcgtacagaagcaaaagaaggactaaaacgcggtgaaattacacaccatgcagttagtagaggaagtgctaaattacaatggttcgttgaaagaaatatggttatacctgaaggaagagttatagaccttgggtgcggtcgcggaggctggtcatactattgtgcaggactaaagaaagttacagaggtcagaggttacactaaaggcgggcctggtcatgaggagccagtacctatgtcgacttatgggtggaatatagtaaaactaatgtcaggaaaagacgtattttatttacctcctgagaaatgcgatactttgctgtgcgatattggcgaatcttctccttccccgacggttgaagaaagtcggaccataagagttttaaaaatggtggagccgtggcttaaaaataatcaattctgtataaaagtcctaaatccgtacatgccgaccgtaatagaacacctagaacgtctacaaagaaaacatggaggtatgttagttcgaaatcccctgagtagaaactcgactcatgaaatgtattggatctcgaacggaacaggtaacatcgtagcgtctgtgaatatggtatcgagactattgctaaatcgatttacgatgacacacagaagaccaactatagaaaaagatgtagacttaggagctggcacaagacatgtaaacgcagaaccggaaactccaaatatggacgttattggtgagagaattaaaaggataaaagaagaacataattctacatggcattatgacgacgaaaatccttataaaacatgggcataccacggtagctacgaagtaaaagcaacaggaagtgcgagctcgatgatcaatggcgttgtcaagttattgacgaaaccctgggatgtcgtaccgatggttacgcaaatggctatgactgatacaactccttttggacagcagcgagtatttaaagaaaaggtcgatactagaacacctagatcaatgccaggtacgcgcagggtgatgggaattacagccgaatggttatggagaactttaggaagaaataagaagcctaggttatgtacaagagaggagttcacaaagaaagtacgaaccaacgcagctatgggagcagtgtttaccgaagaaaatcagtgggattcggcaaaagccgctgttgaagatgaagatttctggaagttagtagatagagaacgagagctccacaaactaggcaaatgtgggagctgcgtgtacaatatgatgggaaaacgcgagaaaaagttaggagagttcggtaaagccaaaggaagcagggcaatatggtatatgtggctgggagctcgatatctcgaatttgaggctttaggctttctaaatgaagaccactggttctctcgagaaaattcgtacagtggtgtagaaggcgagggcctccataaattaggttatatacttagagatataagcaaaataccaggaggtgcgatgtacgcagatgatacagcaggctgggatacgaggataactgaagatgatctacacaacgaggagaaaataacacaacaaatggatccggaacatcggcaattggcaaatgctatttttaagctgacctaccagaacaaggtggtcaaagtccaaagaccaacccctaccggaacggtaatggatataattagccgcaaagaccaacgaggaagcgggcaagttggcacttatggattaaatacattcacaaacatggaagcccagttaatccgacagatggagggagaaggtgttttatcaaaagccgacctggagaatccacatcttccagagaagaaaataacgcaatggttagaaacgaaaggagtcgaacgcctcaaacgaatggccatttccggggacgattgtgtcgtaaaaccaatagatgatagatttgcaaatgcacttttagccctgaacgacatgggtaaagtcaggaaagatatacctcaatggcaaccttcaaaaggatggcatgattggcaacaggtccccttctgctcccaccacttccacgagttaataatgaaagatggacgtaaacttgtcgtcccatgtcgaccacaggacgaattaatcggtagagcaaggatttcccaaggtgcgggatggtcattaagagaaactgcttgcctcggaaaagcatacgcgcaaatgtggtccttaatgtactttcatcgacgggacctacgacttgcttcaaacgcaatttgcagtgcagtgcctgtgcattgggtaccaacgtcaaggaccacgtggagtatacacgcacatcatcaatggatgactacagaagatatgcttacagtatggaatcgggtttggatcgaagataatccttggatggaggataaaactccagtaactacttgggaaaatgtcccgtatttgggaaaaagagaagatcaatggtgtggctcactaattggtttaacaagtagagcgacctgggcacaaaatataccgaccgctattcaacaggttagaagtttaatcggaaacgaagaatttctcgattatatgccaagcatgaaaagatttagaaaagaagaagagtcggaaggagcaatatggtag

SEQ ID NO: 23417 - RNA, 9873 nt, synthetic construct
  misc_feature 1..9873: note = derived and/or modified CDS sequence (opt6) from DENV-3__FJ639782__SS-prME
  source 1..9873: mol_type = other RNA
acaagcctgtgtctaatgatgatcttacccgctgcactggcatttcatctaacgtcacgagacggggaacctcgcatgatcgttggcaaaaatgaacgtggtaaatcattattattcaaaacggcgagcggaataaatatgtgtacgttaatagctatggatttaggagaaatgtgcgatgatacagtaacatataaatgtcctcacataaccgaagttgaacctgaagatatcgactgttggtgcaacctgacttctacctgggttacatatggcacttgcaaccaagcaggagaacatagaagagataaacgatcggttgctctggctccacatgtaggtatgggattagatacccgaacgcaaacgtggatgagtgcggagggtgcgtggaggcaagttgagaaagttgaaacttgggcattaaggcacccggggttcaccatccttgcactcttcctagcacactatataggaacttccttgacacaaaaagtcgtgatttttatattattaatgctggtcacaccaagtatgacaatgcgctgtgtcggcgtaggcaatagagactttgttgagggattgtcgggagctacatgggttgatgtggtattagaacatggtgggtgcgtcaccactatggccaaaaacaaaccaacgttagacatagagcttcagaaaacagaggcaacccaattagctactttacgaaaactgtgcatagaaggcaaaataacaaacatcaccacagattctcgatgcccaacgcaaggggaagctgtattaccggaagaacaggaccagaactacgtatgtaaacacacctacgtggatagaggttggggaaacggttgtggactatttggtaaaggatctctagttacctgtgcaaaattccaatgtctagaacccattgaaggtaaagtcgtgcaatacgaaaatctcaaatatacagtaataataacagtacatactggggatcaacatcaggtaggcaatgagacacaaggtgtaactgctgagatcactccgcaggcttctacgacagaagcaatattaccagaatatggaacactaggtttagaatgttcccctcgcaccggcctcgattttaacgagatgattttgctcaccatgaaaaataaagcatggatggttcatagacaatggttctttgatttaccgttaccatggacatctggagcgactacagaaactccgacttggaaccgcaaagagctgctcgtcacattcaaaaacgcacacgccaagaaacaagaagttgtcgtcttaggaagtcaggaaggggcgatgcataccgcactaacgggtgcaacagaaatacaaaattcagggggcacttccatctttgctgggcacttaaaatgtcgcttgaaaatggacaaattagaactcaaagggatgtcctacgcgatgtgtacaaatacatttgtactcaagaaagaagtatctgaaacgcaacacggcacaattctgattaaagtcgagtataaaggagaagatgtcccctgtaaaatcccttttagcacagaagatggccaaggaaaagctcataacggccgtttaattacagcaaacccagttgtaacgaagaaagaagaacctgtaaatatagaagcagaaccaccattcggggaaagtaatatagtaattggaattggagataatgcattaaaaattaattggtataagaaagggtcatcaataggtaaaatgtttgaggcaactgcacgtggagcgcgcaggatggcaattttaggtgacacagcatgggattttggtagcgtaggaggggtgcttaacagcctgggcaagatggttcaccaaatatttgggagcgcttacactgcgctattcagcggagtgtcttgggtaatgaaaattggtataggcgtcttgcttacatggattgggctaaactccaagaatacatctatgagtttttcctgcattgcaatcggaataattacactatatttaggagcagttgtacaggctgacatgggctgtgtaatcaactggaaaggaaaagagcttaaatgtggttcagggattttcgtaactaatgaagtacacacttggaccgaacaatataaattccaagcagactcgccaaaaaggcttgctactgcaatagcaggagcctgggaaaatggcgtttgcggaatcagatcaacaacgcgaatggaaaatcttctgtggaaacagattgcaaatgaacttaactatatactttgggagaacaatataaaattgacagtggtagtgggtgacataattggggtattagagcaaggaaaacgtaccttaacaccacagccaatggaattgaagtacagttggaaaacctggggtaaggctaaaatagtgacagcggaaacgcaaaactcatcttttattatcgatggcccaaatacaccggaatgcccatcagcatctagagcctggaatgtgtgggaggttgaggactatggcttcggtgtatttactacgaacatatggctgaaactaagagaagtgtatacgcaactttgcgaccatcggttaatgtcggcagcagtaaaagacgaaagagcagtacatgctgacatgggttactggattgaaagccagaaaaatggcagttggaaacttgaaaaagcatcactgatagaagtaaaaacatgtacttggcctaaatcacacactttatggtctaacggcgtccttgaaagtgacatgattatacctaaaagtttggctggtccgatatcccaacataattatcgacctggttatcatactcaaacagctgggccatggcacctgggcaaattggaactagacttcaattactgcgaaggcactactgtcgtaataaccgaaaattgcggaacacgtggtccaagtttgagaacgacaacagtaagtggaaaattaatacatgagtggtgttgcagatcgtgtaccttgccaccccttagatatatgggagaagatgggtgttggtatggaatggaaatccgacctatttctgaaaaagaggagaacatggttaaatcattagtcagcgcgggttcaggtgaggtcgataatttcactatgggcgttctttgccttgctatattattcgaggaagtaatgagagggaagttcggcaagaaacacatgatagcaggagttttcttcacattcgtactgctgttgtccggacaaataacctggcgtgatatggcacacacacttatcatgataggtagtaatgcaagcgacagaatggggatgggtgtaacttatcttgccttaattgcgacgtttaaaatacagccatttttagcgttaggattctttttaaggaagttaacctcaagagaaaacctcttacttggtgttggtttggctatggcaacaacattacaacttccggaagatattgaacagatggcaaatgggattgcgctcggattaatggcattaaaactcatcactcaatttgaaacgtaccaattatggacagctttaatatctctaacttgtagtaacaccatctttacactgacagtcgcatggcgaacagcaacattaatcttagccggagtatctttgcttccagtatgccaaagctcatcaatgagaaagaccgattggttaccgatgacagtagctgcaatgggtgttccacctctacctctatttatattcagccttaaggataccctcaagcgacgcagctggccactaaacgaaggcgtaatggcagtgggcttagtatcaatattggccagctcactgcttagaaatgacgttccgatggcaggtcctttggttgccggtgggttattaatagcgtgttacgttataacgggaacgtcagcagacttaaccgtagaaaaagcagcggacgttacttgggaagaagaagcagaacaaacaggagtaagccataatttaatgatcacggttgatgacgatggaactatgcgtattaaggatgatgaaactgaaaatatactgaccgtattactaaaaacagcactcctaatagtaagtggaatatttccttacagcattccagcaacgctgttggtttggcacacctggcagaaacaaacgcagagaagtggagtgctatgggatgtaccctcaccaccagagacccaaaaagcggaattagaggaaggcgtatatagaataaagcaacaagggatttttggtaagacacaggtgggtgtaggtgtacaaaaagagggagtattccacaccatgtggcacgtgacaaggggtgctgttctgacttataatgggaaaagactggaacctaattgggcgagtgtcaagaaagacttaattagctacggaggtggttggcgactatctgcccaatggcaaaagggtgaagaagtccaggtcatagcagtcgagccagggaaaaatcccaaaaacttccaaacgatgccaggtacgtttcaaacaacaacaggtgaaattggagcgatagccttagatttcaaaccaggtacatccggtagtcctataattaatcgagagggaaaaattgtaggtttatacgggaacggtgttgtcaccaaaaatggtgggtatgtatcgggtatagctcaaacaaatgctgaaccagacggaccaactccagaactcgaggaggaaatgtttaaaaagagaaatttaaccattatggacttgcatcctggatctgggaaaaccagaaaatatttgccagctatcgtacgcgaagccataaaaaggcggctaaggactctaatcttggcaccaacaagggtagtcgccgcagaaatggaagaagcactcaagggactaccaattagatatcagacaacagcaaccaagtcggaacacacaggcagagagatagtcgatttgatgtgtcacgcaacctttacgatgaggttgctgtcacctgtgcgagtcccaaattacaatttaataatcatggatgaagcacattttacagatcccgctagtatagcggcccgtggttacatttcaacaagagtcggcatgggtgaagcagcggcaatatttatgacggcaacaccacctggtacggctgatgcatttccacagagtaatgctccgattcaagatgaggaaagggatatacctgagagatcctggaacagtgggaatgaatggataaccgactttgcaggaaaaacagtctggtttgtcccgtcaattaaggctggaaacgatatagctaactgtctccgaaagaatggtaagaaagttattcagctatcaaggaagacttttgataccgaatatcaaaagacgaaacttaacgactgggacttcgttgtgacgacggatatatcagaaatgggggctaacttcaaagctgacagagtaattgatccaagacgttgtctaaaaccagtaatattgacagatggacctgaacgcgttatactagctggcccaatgccagttacagcagcaagcgccgctcaacgacggggtagagtaggaagaaacccacaaaaagagaacgatcaatatatctttacaggtcaaccactaaataatgacgaggatcacgcccattggacggaagcaaaaatgcttttggacaacatcaacacaccggaagggattatccccgcactttttgagccagaaagggagaaaagtgcagccattgacggcgagtatagactcaaaggagaaagtcgcaaaaccttcgttgagttaatgcgaaggggtgatttacctgtttggcttgcgcataaagttgcgtccgagggtatcaaatacacagaccgtaagtggtgctttgatggacagcgaaacaatcaaatactcgaagaaaatatggacgtggaaatctggactaaggagggcgagaaaaagaaattaagaccaagatggctagatgcaagaacatatagcgatcctcttgctttgaaggaatttaaagattttgcggcaggacgaaagagcatagcgttagatcttgtaacagaaataggaagggttcctacacacctagcacataggactcgcaacgcattagacaatctagtcatgcttcatacttcagaacacggaggcaaggcatataggcatgctgtagaggaactgccagaaacaatggaaacactactattactcggactaatgattctattaactggtggagcaatgttatttttaatcagtggaaagggcatagggaagacgtctataggattgatatgtgtcatcgcctcatcaggcatgttatggatggctgagataccgttgcagtggattgcatcagctattgttctggagtttttcatgatggttctgctaataccagagccagaaaaacagaggaccccacaagataaccaactggcttatgtagtcattggaatattaactctagccgctactattgctgccaatgagatgggactgttagaaactacaaaacgggatctgggaatgtcaaaagaaccaggagtggtatcacccacttcttatttagacgttgacctacatcctgcgtccgcctggactctctatgctgtggctacaaccgtcataaccccgatgttaagacacacaatagaaaattcaaccgcaaacgtcagtctagctgccatcgcaaaccaagccgtcgtacttatgggcttagataaaggctggccgatttcgaaaatggatcttggggtgccactattggcgttgggttgttattcccaagtaaatcctctaacgcttacggctgcagtactgctattaatcacacactacgccataattggtcctggactacaagccaaagcgacaagagaggcgcagaaaaggacagcagctggtataatgaaaaatccgacagtcgatggaataatgacgattgacctagatccagtaatctatgactctaagttcgaaaaacaattaggccaagtaatgctactggtcctatgtgctgtacaattgctcttgatgcgtacttcatgggccttatgcgaggcattaacactcgccactgggcccataacaacattatgggaaggttcgccaggaaaattttggaatacaacgatagcagtatcgatggcaaatatatttcgcggatcctatttagctggcgctggattagcgttcagcatcatgaagagtgttgggacaggaaaacgcggtacagggagtcagggcgaaacactaggggaaaaatggaagaagaaattaaatcaactgagtcgcaaagaatttgacctatataagaaatcaggaattacagaagtagataggactgaggctaaagaaggattaaaacgaggcgaaattacccatcatgcggtaagcagaggaagcgctaagctccagtggttcgtagaacgtaatatggtaattccagaaggcagggtaatagatttaggatgtggaagaggaggttggtcttattattgtgcaggactcaagaaagtgaccgaagtcagaggatacacaaaaggaggccccggacatgaagaacctgtgcctatgtcaacgtatggatggaatatagttaaactaatgagtggaaaagatgtattttaccttcccccagaaaaatgtgatactctattatgcgatataggagaatcgagccccagtcctaccgtcgaggaatcgcgaactattagagtcctaaaaatggtagaaccctggctaaagaataatcagttttgtattaaagttcttaatccgtatatgccaacagtgatcgagcacctagaacgattgcaaaggaaacatggcggtatgttagttaggaatccgctatccaggaacagcacccacgaaatgtactggatttcaaatggaacaggcaatatcgtggcaagtgttaatatggtatcaagactcttacttaatcgattcacaatgacatatcgaagaccaacaattgagaaggatgtggacttaggagctggaacccggcatgttaacgccgaacctgagactccaaatatggatgtaatcggtgaaagaataaagcgaattaaagaagaacataattcaacctggcattatgacgatgaaaacccttataagacatgggcttaccacggtagctacgaagtaaaagctacaggaagtgcaagcagtatgataaatggtgttgttaaattactgaccaaaccttgggacgtggttcccatggttacacaaatggcgatgacagatacaactcccttcggacaacagcgagtattcaaggagaaagtagatactcgaactccgcggtctatgccaggaacgagacgagtcatggggataaccgccgaatggttatggagaacccttggtagaaacaagaaaccacggctatgcacgcgcgaagaatttacgaagaaagtgagaacaaacgcagccatgggggctgtattcaccgaagagaatcaatgggatagcgcaaaagcagcagttgaagatgaggacttctggaaactggtcgatagggaaagagaattgcataagctgggtaagtgtggaagttgtgtatataatatgatgggcaagcgagaaaagaaattaggagaatttggcaaagctaaaggtagtagagctatatggtacatgtggctaggcgcaagatatctcgaatttgaagctcttggcttcctaaatgaggaccattggttctcgagagagaactcatatagtggcgtagaaggtgaaggattacacaaactagggtacattctacgggacatatcaaaaatacctgggggtgctatgtacgcagatgatacggctggctgggatactcggataacagaggatgacttacataacgaggagaaaattacgcaacaaatggaccctgaacatagacaactggctaacgcgattttcaaactaacatatcaaaataaagtggtcaaagtacaaaggccgacaccaacaggaacggttatggacattattagccgaaaggatcaaagaggctcaggtcaagttggaacctatgggttaaatacattcactaatatggaagcccaactaatacgccaaatggaaggagagggggtattgtcgaaagctgacctcgaaaacccacatttaccagagaagaaaataacgcaatggttggagaccaaaggagtagaaaggttgaaacgaatggctatctcgggtgatgactgcgtagttaaaccaattgacgatagatttgcaaatgcccttttagctctgaacgatatgggaaaggtaagaaaggatataccccaatggcaaccaagtaagggctggcacgattggcaacaagtacctttttgcagtcaccattttcacgaattaataatgaaagacggtagaaaattagttgtgccatgcagacctcaagatgaactaattggtcgagcacgaatatctcaaggagctggatggagccttcgagaaacagcatgcttaggcaaagcctatgcacaaatgtggtcgctcatgtactttcatcgacgtgacctacgtcttgccagtaatgcgatatgtagcgctgttcccgtacattgggtgcctacatctagaacaacgtggagtatacacgcacaccatcagtggatgacaaccgaagatatgttgactgtctggaatcgagtttggatcgaagacaacccatggatggaagataaaactccggtaactacgtgggaaaacgtcccatatttagggaagcgtgaagaccaatggtgcggtagcttaataggattgacctcgagagctacttgggcacaaaatatacccaccgccattcagcaagtaagaagtttgattgggaacgaagagttcttggattatatgccgagtatgaaacgatttagaaaagaagaagagtcggaaggcgcgatatggtaa

SEQ ID NO: 23418 - RNA, 9873 nt, synthetic construct
  misc_feature 1..9873: note = derived and/or modified CDS sequence (opt6) from DENV-3__FJ639785__SS-prME
  source 1..9873: mol_type = other RNA
acctcattgtgtttaatgatgatactccctgcagctttagcctttcacttgacgtcaagagatggagaacccagaatgatcgtaggtaaaaacgaacgcggaaaatcattactgtttaaaactgcatctggaattaatatgtgcactcttatagcaatggatctaggagaaatgtgtgacgatacagtaacgtataaatgccctcacatcactgaagtagaacctgaagacatagactgttggtgcaatctcactagcacctgggttacgtacgggacatgtaatcaagcaggagaacatagaagagacaaacgcagcgttgcattagcaccccatgtaggaatgggtttggacactagaacacaaacatggatgtcagcggaaggggcgtggagacaagttgagaaagtggaaacatgggctttgagacatccgggattcacgatactcgcattattcctcgcccattatatcggcacttcattaacacaaaaagtggtaatatttattctgcttatgctcgtaactcctagtatgacgatgagatgcgttggagtgggaaatagagatttcgttgagggactatcgggagcaacatgggttgatgttgttcttgagcacggtgggtgcgtaacgaccatggctaaaaacaaaccaactcttgatatagaattacagaaaactgaggcaacacaactcgccactttgcgtaaactatgtatagagggtaaaataacaaatataacaactgacagtagatgccccacacaaggcgaggcagtcttgccggaagaacaagaccaaaattatgtatgtaaacatacatatgtagatcgaggttggggaaatggttgcggattgtttggtaaaggtagtcttgttacctgtgcaaaattccaatgtcttgaaccaatagaaggcaaagtagttcagtacgaaaacctgaaatatactgttataataacggttcacacgggggatcagcatcaggtgggcaatgaaacgcaaggtgtgaccgcagagataacgccacaagcatcaacgacggaggcgatattacctgagtacggcacactaggtttagagtgttctcctcgaacaggactagactttaatgaaatgatactactgacaatgaaaaataaagcctggatggtacaccgtcaatggtttttcgacctgccactaccgtggacttctggggcaacaacagaaacaccgacgtggaatagaaaagaactattagtaacatttaaaaatgctcatgcgaagaaacaagaagttgttgtacttggttctcaagaaggcgcgatgcacacagcattgaccggcgccacagaaatacaaaatagtggtggtaccagcatttttgccggacatctcaaatgtcgactaaaaatggataaactcgaattaaaaggtatgtcttacgccatgtgtactaatacattcgtacttaaaaaggaggtaagtgagacacaacacggaacgattttgataaaggttgaatacaagggcgaagacgtaccatgtaaaataccattttcaacagaagacggacaaggaaaagcacataatggacgattaatcaccgcaaatcccgtagtaacgaagaaagaggaaccagtcaacatagaagctgagccacccttcggagagtctaacattgtaattggaattggtgataatgcattgaaaataaattggtacaagaaaggctcctcaataggtaagatgtttgaagcaaccgcaagaggtgcgagacgtatggccatattaggagatacggcctgggacttcggaagcgtcggaggggtattaaattcattaggaaaaatggttcaccaaatattcggatcagcttacactgcactattttctggcgtgagctgggtcatgaagataggaattggcgtactattaacatggataggactcaattccaaaaacacgtccatgtcgttcagctgcattgcgattggcattataaccctttatcttggagccgtagtacaagcagatatgggctgtgtgattaactggaaaggcaaagaactgaaatgtggaagtggaatattcgtgacaaatgaggtccatacatggactgagcaatataaatttcaggcagattcaccgaaaagactagcaacagccattgcaggagcatgggaaaatggagtatgtggcatacgatcaacgactagaatggaaaacttattatggaagcagatagccaatgagctaaactacattttgtgggaaaacaatataaaacttaccgttgtcgtaggagatacaataggcgtacttgaacagggtaagcgtactctcactccacaaccgatggaattaaaatattcatggaaaacgtggggaaaagctaaaatagtaaccgcagaaacccagaacagtagttttataatagatggacctaatacacctgaatgcccatcagcgtctagggcttggaacgtctgggaagtagaggactacggattcggagtctttacaaccaatatttggcttaagttacgtgaagtgtacactcaactatgcgatcacagactaatgtcagccgctgtaaaagacgaaagagctgttcatgcggatatgggttactggatcgaatcacagaagaatggatcttggaaacttgaaaaagcctcgcttatagaagtcaaaacttgtacttggccaaagagtcatacattatggtcaaacggtgtactagaaagcgatatgattataccaaaatctctagcaggtccgatctcgcagcataattacagaccgggatatcacacacaaactgctggtccatggcatttagggaaacttgaactagacttcaattactgtgaaggtacaacggtcgtcataacagaaaattgtggaactagaggaccatcgctgagaacaactactgtatcaggaaaactcatacacgagtggtgctgcagaagttgcaccctgccaccccttcgatatatgggcgaagatgggtgctggtacggaatggaaattagaccaatctccgaaaaagaagaaaatatggtaaaatcactcgtatccgccggaagcggggaagtagacaatttcacgatgggtgtactttgtctcgctatattgttcgaagaagttatgcgaggtaaatttgggaagaaacacatgatagctggagtattctttacctttgttctattactatcaggtcagattacgtggagagatatggctcatacattgattatgataggaagtaatgcttcagatcgtatgggcatgggggtcacctatctagctttaatagcaacttttaaaatacaaccttttcttgcactagggttctttctcagaaaattgacatcacgagagaacctgttattgggcgtaggattagcaatggcgactacactacaacttccagaagacatagaacaaatggcaaacgggatagccctaggcttaatggctttaaaacttatcacacaatttgaaacctaccagttatggaccgcactaattagtctaacttgcagcaacaccattttcacgttaacggtcgcctggaggacagctaccttaatattggcaggagtcagcttacttccagtttgccaatcaagttcaatgcgaaaaacagattggcttcccatgacagtagctgctatgggggtaccgccattgccactgttcatcttcagtctcaaagatacattaaaacgacgaagctggcccttaaatgaaggagtaatggctgttgggttagttagtattctcgcgtcatcacttttgcgtaatgacgtaccgatggctggtccacttgttgcgggaggtttactaattgcatgttatgttattactggtacaagcgcagatttgacagtagaaaaggcagcagacgttacatgggaagaagaagcggaacaaacaggagtgagtcataacctaatgattacagttgatgacgatggtacaatgagaatcaaagatgatgaaactgaaaatattttgaccgtcctgctgaaaacagcactcctgatcgtttctgggatatttccctattcaatcccggcaaccttgttggtttggcacacatggcaaaaacaaacccaacgctcaggagtattgtgggacgttccatcaccacctgaaacacaaaaagcggaattagaggaaggagtataccgaattaaacaacaaggtatttttggcaaaacgcaggtaggggttggtgtacaaaaagagggagtttttcacacaatgtggcatgtaacacggggagcagtcctaacgtacaatgggaagcgcctcgaaccaaactgggcatcagtcaagaaagatcttatctcatacggcggaggttggaggttatccgcgcagtggcagaaaggtgaagaggtgcaagtaatagctgtagaaccaggtaaaaatcctaaaaatttccaaactatgccaggtacatttcagacaactacaggcgagataggcgctattgctttagattttaagccaggaacaagcggtagccctataataaaccgagaaggcaaggtggtcggtctttatggaaacggagtcgtcactaaaaacggcggatatgtaagtggtatagcacagacgaacgcggaaccggacggacctaccccagagttagaagaagaaatgttcaagaaaagaaacttaacaataatggatttgcatcctggttcgggaaaaacgaggaagtatttacctgctattgtaagggaagccataaaacgcaggttaagaacactaatattagcaccaactagagtggtggcagccgaaatggaggaagcattaaaaggcttacccatacgctatcagaccacagcgacgaaatctgaacacacaggaagggagatagttgacttaatgtgtcatgcgactttcactatgcgtttattatcaccagttagagtcccaaattataatttaatcataatggatgaagcacacttcactgaccccgctagtatagctgcacgaggatacataagcacgcgggtggggatgggggaggccgcagcgatcttcatgacggccacacccccgggaacagctgatgcgtttccccaaagcaatgcaccgatacaagatgaagagagggatatacccgaacgctcatggaacagcggaaatgaatggatcacggattttgctggaaaaactgtatggtttgtgccgagcatcaaagcaggcaatgatattgcaaattgtctaaggaaaaatggcaagaaagttattcaactttcaagaaaaacattcgatacagaatatcagaaaacaaaactgaatgattgggattttgtagtgactaccgatatttcagagatgggggctaattttaaagcagatagggtaatagacccaagacgatgtttaaaaccagtaatcctaacagacggcccagaaagagtcatattagccgggcccatgccagtgacagcagcaagcgctgcccaaaggagaggaagagttggacgaaatccacaaaaagaaaatgatcaatacatctttaccgggcaaccactaaataacgatgaagaccacgcacactggactgaagcaaaaatgctactcgacaatattaatacaccagaaggaattattcccgccctattcgaacctgaaagagagaagtcggcagccattgacggggaataccgactaaagggggaatctagaaaaacgtttgtcgagttaatgagaagaggtgatctgccggtctggctggcccacaaagttgcatcggaaggcattaaatataccgaccgtaagtggtgtttcgacggccagagaaataatcaaatcctagaagaaaatatggatgtcgagatatggaccaaagaaggggaaaagaagaagttaagaccacgctggctagatgccagaacttacagtgatccattagcattgaaagaatttaaagattttgcagcaggtcgaaaatcaattgcccttgatttggtaactgaaattgggagagtacctactcatctggcgcatcgaacccgtaacgccttagataatttagtcatgttgcacactagcgaacatggaggaaaggcttaccgtcatgctgttgaagaactacctgagacaatggagacgttgttgctattagggttaatgatcttgcttacaggaggagctatgttgttcttaatatcgggaaaggggataggaaaaacaagcataggacttatttgtgtaattgccagtagtgggatgctatggatggcagagatacccttacaatggatagcaagcgctatcgtcttagaatttttcatgatggtacttttgattccggaaccagagaagcaacgaacgccacaagataatcaactcgcgtacgtagtaatcggtatattaacactggctgcgacaatagcagcaaatgaaatggggctgttggaaacaacaaaaagagatttagggatgtcaaaagaaccaggagtagtttcccccacaagctatttagacgtcgatcttcatcccgcgtctgcttggaccctttacgcggtagctaccacggttataactccaatgctacgacacaccatagaaaacagtacagctaacgttagtcttgcagcgatagctaaccaagcagtcgtgctaatgggtctagacaaagggtggcccatatctaagatggacttgggcgtgccactattagctttgggctgctattctcaggtaaatccattaacacttactgcggcagtattactcctaatcactcactatgcaattataggtcctggcttacaagccaaagctacacgtgaagcgcaaaagagaacagcggcgggtataatgaaaaacccaaccgtagatggtataatgaccattgatttagaccctgttatctacgacagcaaattcgaaaagcagctgggacaagtcatgttattggtgctctgtgccgttcaacttctcttaatgcgtacaagttgggccctttgcgaagccctaacactcgctacaggccctattacaacgttatgggaagggagtccaggaaaattctggaatactactattgccgtttctatggcaaatatttttaggggttcgtatttggccggcgctggtttagccttctcaattatgaaaagcgttggcacagggaaaaggggaacgggcagccagggcgagacattaggtgaaaaatggaagaagaaattgaatcagctatcacgaaaggagtttgacctgtataagaaatctggtataacagaagtcgatcgtacagaagcgaaagaaggactcaaacgaggcgaaattactcaccatgccgtgtcgcgtggaagtgcaaaacttcaatggtttgttgaaagaaatatggtaatacctgagggcagagttattgatctaggctgtgggcggggaggatggagttattactgtgcagggctcaagaaggtaactgaggtaagaggatatactaaagggggacctggccatgaagaaccagttccaatgagcacctacggatggaacatagtaaaactgatgagtggtaaagatgttttctaccttccgccagaaaagtgcgatactttgttatgtgatatcggagagtcgtcaccttctcctacagtagaggaatctagaactataagggtacttaaaatggtcgagccatggttgaaaaataaccaattctgcattaaagtgctaaatccatatatgccaactgtaatagaacatctagaaaggttgcaaagaaaacacgggggaatgttggttagaaatcccctatcgagaaactctacgcatgaaatgtactggatatctaatggcaccggaaatatagtggcatcagttaatatggtatcaaggttattgctcaacagatttactatgacccatagacgaccgacaatcgaaaaagacgtagacttaggagcagggacgagacatgtaaacgccgaaccagaaacaccgaacatggacgtgataggagagcgcattaaacggataaaggaggaacataattccacgtggcattatgatgacgagaatccatataagacatgggcatatcacgggtcatatgaagttaaagctacgggaagtgcatcaagtatgattaatggagtggtcaaactccttactaaaccctgggatgttgtaccgatggtcacccaaatggctatgaccgatacaacaccattcgggcaacaacgggtttttaaagagaaagtagatacaaggaccccaagaagcatgccaggcacgaggcgcgtaatgggcattacagcagaatggttatggaggacattaggccgtaataaaaagcctcggctttgtactcgagaagaatttaccaaaaaggtccgaaccaatgcagctatgggcgctgtattcacggaagaaaatcaatgggatagcgcaaaagctgcagttgaagatgaagatttctggaagctcgtagatcgagaaagagaattacataaactaggtaagtgtggttcatgcgtatataacatgatgggtaagagggaaaagaaacttggcgagttcggaaaagctaaaggaagccgtgctatttggtatatgtggctaggcgccaggtatttagagttcgaagcactgggattcctgaacgaagaccattggttctcaagggaaaattcttatagcggtgtcgaaggtgagggcctccataaattaggatacatactgcgtgatatatcaaaaatccctggcggggcaatgtacgctgacgatacagcaggttgggacacacgcataactgaagatgatctacataacgaagagaaaattacacaacagatggacccagaacatcggcaattagcgaacgctatttttaaactcacttaccagaataaagtggtaaaagtacaacgcccaacgccgacaggaacagttatggacataatctcaagaaaggatcagagaggatcaggccaagtcggaacatacggcttaaatacttttacaaatatggaagcacaactaatccgccaaatggaaggtgaaggtgtcctttccaaagcagatctagaaaacccacatctcccggagaagaaaatcacacaatggttagagaccaaaggagtcgagagattaaaacgaatggccatcagtggagacgattgtgtagtaaagcctattgatgatcggttcgcaaatgcccttctagcgctaaacgatatgggaaaggtgagaaaagacattccgcaatggcaaccaagcaaaggatggcacgactggcaacaggttccgttctgcagccatcatttccatgagctaataatgaaagatggaagaaagctagtagtcccatgccgtccccaagacgaattgataggtagagccagaattagccaaggagctgggtggtcacttagagaaactgcctgcttaggaaaagcctatgcgcagatgtggtccctaatgtacttccatcgcagggatctcaggttggcatcaaatgcgatatgttcagcagtaccggtacattgggtaccaacatcaaggacaacatggtcaattcatgcgcaccatcagtggatgaccactgaggacatgctaaccgtctggaatcgcgtttggatagaagacaatccgtggatggaggacaaaacacctgtaacaacttgggagaatgtcccttatctcggtaagagagaggatcaatggtgtggatcactaataggattaacgagtagagcaacctgggctcaaaacattcccacggcaatccaacaagtacggtcacttattggcaacgaagagtttttagactatatgccatctatgaaaagattccgaaaagaggaagaatctgaaggagcaatttggtag

SEQ ID NO: 23419 - RNA, 9873 nt, synthetic construct
  misc_feature 1..9873: note = derived and/or modified CDS sequence (opt6) from DENV-3__FJ639786__SS-prME
  source 1..9873: mol_type = other RNA
acatccctgtgtttaatgatgatcctacctgctgctctcgcatttcatttaacaagcagggacggtgaaccccgaatgatcgtcggtaaaaatgaacggggaaaatctttgctgttcaaaacagcatctgggataaacatgtgcacattaatagcaatggatctcggagaaatgtgcgatgacaccgtaacctataaatgtccacatataaccgaagtagaaccggaagatattgactgctggtgtaacttaacttcgacgtgggtgacatacgggacgtgcaaccaagctggagaacaccgaagagataaaaggtctgtggcgctagcaccccacgtaggaatgggactggatacaagaacacaaacgtggatgagtgcagaaggcgcttggcggcaagtagaaaaagtggaaacgtgggcattgagacacccgggattcaccattctagcgctgtttttggcacattatatagggacatcactaactcaaaaagttgtgatcttcatacttctgatgttagtgacaccaagcatgacaatgaggtgcgtaggagtaggaaatcgcgattttgtcgaaggactatcaggagcaacatgggtcgatgtagtactagaacatggtggatgcgtaacaacaatggccaaaaataaacctaccttagacattgaattgcagaaaacggaagcgacacaattagctacattgaggaaactttgtattgaaggcaaaattactaacattacaactgactcacgatgtccaacacagggtgaagctgtactccccgaagaacaagaccagaattacgtatgcaaacacacttatgtcgatagaggttggggaaatgggtgcggactattcgggaaagggtcgctggttacttgcgcaaaattccagtgcttagaacctattgaggggaaagttgtgcaatacgaaaatcttaaatacactgtaataattacagtgcatacaggagatcagcaccaggtaggtaacgaaacacaaggagtaactgcagagattacaccacaagctagtaccaccgaggctatacttccagaatatggaactttggggctcgagtgttctccaagaaccggattagattttaatgaaatgatattgctaacgatgaaaaacaaagcatggatggtacaccgacagtggttctttgatttgcctctaccatgggcgtcaggagcaacaacagaaactcccacctggaatagaaaagaattgttggtgacattcaaaaatgcgcatgccaaaaagcaagaggtagtagtgctaggatctcaagaaggcgcaatgcatactgcactaaccggggcaacagaaatacagaactccggaggcacctctatatttgcaggtcatttaaagtgtcgtcttaaaatggacaaattagagttgaaaggcatgtcatatgcaatgtgtacgaacactttcgtacttaagaaagaggtctcagagactcagcacggaactatactaataaaggtagagtataaaggagaggacgtaccgtgtaaaatcccattttctacagaagacgggcaaggcaaagctcataatggacggctaattacagcaaatccagtagttacgaagaaagaagaacctgtaaatatagaagcagagcctccatttggtgagagcaacattgttattgggattggagataacgctttaaagataaactggtataagaaaggcagttccatcgggaaaatgtttgaagctactgcacgaggcgcaagacgtatggcaatattaggagacacggcatgggactttggctcagtcggtggtgttttaaactcgttgggaaaaatggtacaccaaatctttggttcagcatatacagcgttattcagtggcgtctcctgggtaatgaagataggaataggggttttattaacctggatcggattaaattccaaaaatacatcaatgtctttctcctgtatagcaataggaattattactttatatctcggtgcggtagtacaagctgatatgggatgcgtcataaattggaaaggaaaggaactgaaatgcggtagtggcatttttgttaccaacgaggtacatacatggactgaacagtacaaatttcaagcagactctcccaagcgcctggcgacagcaattgcaggggcctgggaaaacggtgtatgtggaataaggtccacaacaaggatggagaatttactctggaagcagatcgccaatgaactaaactacatactctgggagaacaacataaaacttaccgttgtagtaggtgatataataggtgtgttagaacaagggaaaagaacactcacaccgcaaccaatggagttaaaatactcttggaaaacgtggggcaaagccaaaatagtaaccgcagaaacacaaaatagctccttcataatagatggaccaaatactccagagtgcccgtcagcttcaagggcgtggaacgtctgggaagttgaagattatggattcggcgtcttcacaaccaacatttggttaaaactaagagaagtctatacccaactctgtgaccaccgattgatgagcgctgctgtgaaggacgaaagagcggtacatgctgatatggggtattggatagaaagtcaaaagaatggatcctggaaactcgaaaaggcttcgctaatagaagtgaaaacatgcacatggccaaaatcacacacattgtggtctaacggggtgttagaaagtgacatgatcatcccgaaatctctagctggtccaataagtcaacacaattaccgaccaggttatcatactcaaaccgcaggaccctggcacctcggaaaattagaattggattttaactattgcgagggaacgaccgtcgttatcacagagaattgtggcacaagaggaccctccttgcgaacaacaacagtctcaggtaagttgattcatgaatggtgctgtagatcatgcactttgccgcctctacgctacatgggagaggatgggtgctggtacggaatggaaatccgaccgatatcagagaaagaagaaaacatggttaagtctctagtatcagccggatctggagaagtagataacttcactatgggcgtcctatgtttagcaatcctatttgaggaagtgatgagagggaagtttggcaagaaacacatgatagctggtgtattctttacattcgtcctacttctaagtggtcagatcacttggagggacatggcacatacgttaattatgattggttccaatgcttctgatagaatgggaatgggcgtaacctacttggcacttatagccacgtttaaaatacagccctttttggccttaggatttttccttaggaaattaactagccgagagaacttgcttttaggagtcgggttagcaatggctaccacattgcaattacctgaggatattgagcaaatggctaatggaattgctctaggtctcatggcccttaaattaataactcaatttgaaacataccagctatggacagctctaataagtcttacttgcagcaacacaatatttacacttacagtggcatggcgcacggcgactttgatcctagctggtgtcagcttacttcctgtatgtcaaagcagttcaatgaggaagacagattggctaccaatgacagtagcagctatgggagtgccaccccttcccttgtttatcttttcactaaaagatacactgaaaagaagaagctggccattaaatgaaggtgtgatggcagttggactggtatccattctggccagttcacttttgagaaacgatgtccctatggcaggtccattagtggccggtggtctgttaatcgcttgctatgtcataacgggtacaagcgcagatcttacggtagagaaagcagcagacgtaacctgggaggaagaggcagaacaaaccggagtatcccataacttgatgataacggtagatgatgatggaacgatgagaatcaaggatgatgaaactgaaaatatacttacagttctattgaagacggcgctacttatagtgagtggtatatttccatacagcatacctgcaacactactcgtatggcacacatggcaaaagcagacgcaaagaagcggtgtactttgggacgtaccgagcccacccgagacacaaaaagcagaactagaagaaggtgtctacagaattaaacaacaaggaatcttcggtaagacacaagtcggtgtaggggtacaaaaggaaggagtttttcacacaatgtggcatgtaacccggggcgctgttttaacatataatggcaaacgtctagaacccaattgggcaagtgttaagaaagatttaatatcctatggtggcgggtggaggctatcagcacagtggcaaaaaggcgaagaagtgcaagttatagctgtagaacctggcaaaaatccgaaaaattttcaaaccatgccaggtacttttcaaacaaccacaggcgaaatcggagcgatagcacttgatttcaaaccagggacgagcggctcaccaataataaatcgtgaaggaaaagtcgtaggactatacggcaatggagtagtaactaagaatgggggttatgtcagtggaattgcacaaaccaacgcagaaccagatggtccgacacccgaacttgaagaagaaatgttcaagaagcgcaaccttacaattatggacttacatccagggagcggtaagaccaggaaatacttaccagcaatcgtaagagaagcaattaagcgcagactaagaacattgatactagcacccacgagagttgtagcagcagagatggaagaggctttaaaaggacttccaatcaggtaccagacaacagctacgaagtctgaacacacagggcgtgaaatagtagacctaatgtgtcacgccacatttacgatgcgtttacttagtccagtgagagtaccgaactataatttgatcataatggatgaagcccattttacagatccggctagtatagcagcgagaggatatatctccacgagggtgggcatgggggaagcagccgccatcttcatgacagcgacccctccaggcacggccgatgcctttccgcagagcaatgcacctatacaagatgaagaaagagacatacctgagaggtcatggaactcaggtaacgaatggattactgatttcgccggcaaaacagtgtggtttgttccctctataaaagcaggtaatgatatagccaattgcctgaggaaaaacggcaagaaagtcatccaattatctcgcaaaacattcgacacagagtaccaaaagacaaaacttaatgactgggactttgtagtcacgacagacatatccgaaatgggagctaatttcaaaacagacagggtaatagaccccagacgttgcctcaagccggtaattcttaccgatggaccagagcgagtgattctagcagggccgatgcctgttacagcagcatcagcggcgcaaagaaggggtagagtaggaagaaacccccaaaaggaaaatgaccaatatatatttacgggacaacctttaaataacgacgaggaccatgcacactggacagaagcaaaaatgttgttagataatattaatactcctgaaggaataattccagctttattcgaaccggagcgagagaaaagtgcagcaatcgacggggaatatcgactaaagggggaatctcggaaaacatttgttgaactaatgagaagaggagatcttccagtctggttggcccataaagtagcatcagagggaataaagtataccgatagaaaatggtgtttcgacggacaacggaataaccagatcctggaggagaatatggatgttgaaatttggactaaagaaggggagaagaagaaattacgacctcgatggcttgatgcacgtacttatagcgacccactagcactaaaagaatttaaggactttgccgcaggaaggaaatcaattgctttagatttagtgactgaaattggccgggtaccgacacatctagcgcaccggaccagaaacgcccttgacaatttagttatgttacacacttcagaacacggcgggaaggcatatcgacacgccgtagaggaactacctgaaactatggaaacattgctcttgctcggcctaatgattcttcttactggaggtgctatgctatttctaattagtggtaaagggatcggaaaaacgtcaataggattaatttgtgtaatagcatctagcggaatgctttggatggcagaaatcccattacaatggattgcatctgcgatagttttagaatttttcatgatggtattgttaattcctgaacctgagaaacaacgaaccccgcaggataatcaacttgcgtatgttgtcatagggatcttgacacttgcagcaattattgcggctaacgaaatgggccttcttgagactactaaaagagatctggggatgagtaaagaaccaggcgttgtaagtcctactagctatcttgatgtggacttacacccagcttctgcttggacattgtatgctgttgcaactactgtgattactcctatgttgcgacataccatagagaactccactgcgaatgtatcacttgccgcaatcgccaatcaagccgtcgtcttgatgggtttagataaagggtggccgatatcaaaaatggacttgggtgtaccacttttagctcttggttgttatagccaagttaacccactcacgctaaccgcggcggtactactgttaataacgcattacgcgataattgggccaggcttgcaagcaaaagcaacaagagaagcccaaaaacgaacggcagcagggattatgaaaaacccgactgtggatggaataatgactattgatctagatccagttatatacgattctaagtttgaaaaacaacttgggcaagtaatgctattagtattatgcgctgtacaattactcttaatgagaaccagttgggccctatgtgaggctttaaccctcgctacaggaccaattactacactatgggagggctcacctgggaaattctggaatactactatagcggtatcaatggccaatattttcagaggaagctatctggcaggggcagggctagctttcagcataatgaaaagtgtgggcacaggaaagagaggaactggatcccaaggcgaaactttgggagaaaaatggaaaaagaaactaaaccagctcagcagacgcgagtttgacttgtataaaaagagtggaataactgaagtagaccggacggaggcgaaagaaggactaaaaagaggtgaaataacacaccatgcagtctcaagaggctcagcaaaacttcaatggttcgtggagcgaaatatggtaatcccagaaggcagagtgattgacttgggttgtggacgaggaggttggagctattattgtgcaggcttgaagaaagttactgaagtacgaggctacactaaagggggtccagggcatgaggaacctgtgccgatgagcacctatggatggaatatagtaaaactcatgtcagggaaggacgtattctatttaccacctgaaaaatgtgatacattgctatgtgacattggtgaatcatcaccttctcccacagtagaggaatcacgaacaataagggtccttaaaatggtcgaaccatggttgaaaaataatcagttttgtattaaagttttaaacccatatatgccaaccgtgatcgagcacctagaaagacttcaaaggaaacacggaggaatgcttgttagaaatcctctaagcaggaatagtactcatgaaatgtactggatatcgaacggaaccggtaacatcgttgcaagcgtaaatatggtaagccgtctattattaaatcgatttactatgacacaccgacggcctacaatagaaaaagacgttgacttaggtgcgggcaccagacacgtaaatgcagaaccagagaccccaaatatggatgttattggcgaaagaatcaagaggattaaagaagaacacaattcaacttggcattatgatgatgaaaatccttataaaacatgggcataccatggaagttacgaagttaaagctacaggctccgcatcttctatgattaacggagtagttaaacttctcaccaaaccatgggatgtagtacccatggtaacccagatggcgatgacagacacgaccccattcggacaacaacgggtctttaaggaaaaggtggatactagaactccccgaccaatgccaggtactcgtagagtaatggggataacagcagaatggttatggagaacgctaggacgtaataagaaaccaagattgtgcacgcgggaagaatttaccaagaaagttagaaccaacgcggcaatgggagcagtttttactgaggagaaccaatgggactccgcaaaagccgctgtcgaggatgaagatttttggaaattagtagacagggaacgggaactccataaacttggaaaatgcggcagctgtgtctacaacatgatggggaagagggagaagaaactaggagaatttgggaaagcgaaagggtcacgggccatatggtatatgtggttgggggcaagatacttagaatttgaagcattaggatttttaaatgaagatcactggtttagtagagaaaatagttatagcggagtagaaggggaggggttacacaaacttggatacattctcagagatatcagtaaaatccccgggggtgcaatgtatgccgatgatacggcaggttgggatacgagaataacagaagatgacctacataatgaagagaaaataacacagcaaatggatcccgaacatagacaattagcgaacgctatttttaaactgacataccaaaacaaggtcgtaaaagtccaacgaccaactccaacaggaacagtgatggatataataagccgcaaagatcaaagagggtccgggcaagtaggtacttatgggctcaatacgttcacgaacatggaagcccagcttatcagacaaatggaaggtgaaggtgttttatcgaaggctgacctggaaaatccgcatctgccagagaagaaaatcacacaatggttagaaacgaaaggcgtagaaagactaaaacgaatggcaatatcaggagacgattgtgtagtaaaacccattgacgacagatttgcaaatgctctgctggctctaaacgacatgggtaaagtgcgaaaagacattccacaatggcaacccagtaaagggtggcacgactggcaacaagttcctttttgttctcatcattttcacgagctaataatgaaagacggaagaaagctagtcgtaccatgccgtcctcaagatgaactaataggtcgggcccgaatctctcaaggggcaggctggagtcttagggaaacagcttgcttaggcaaagcgtacgctcaaatgtggtcactaatgtatttccacaggagagacttgcgattagctagtaatgcaatctgctcggccgttccagtacattgggttccaacctcgagaacaacgtggtcgatacacgcacatcaccaatggatgacaacagaagatatgttaacagtgtggaacagagtttggatcgaagataacccgtggatggaggacaagactccagtaactacgtgggagaacgttccatacttaggaaaacgtgaggatcagtggtgtggctcactaattggtctaaccagcagagccacatgggcgcaaaacattagtacagctattcaacaagtcagaagtttaatcgggaacgaagaatttcttgactacatgccgagtatgaaacgatttagaaaagaagaagagtcggaaggagcgatatggtaa

SEQ ID NO: 23420 - RNA, 9873 nt, synthetic construct
  misc_feature 1..9873: note = derived and/or modified CDS sequence (opt6) from DENV-3__FJ639787__SS-prME
  source 1..9873: mol_type = other RNA
acatcactctgtttaatgatgatattacccgcagcgctagcctttcatcttacttcaagagatggagaacctaggatgattgtcgggaaaaatgaacgaggaaaatcccttttattcaaaactgcctcaggtattaatatgtgcacgctcatagccatggacttgggagaaatgtgcgatgacacggtgacatataaatgcccacacattactgaagtcgaacctgaagacattgattgttggtgtaaccttacatctacgtgggtaacctatggaacttgtaatcaggcgggagaacatagaagagacaaaagatcagtagcactagcaccccatgttggaatgggtcttgatacccgcactcagacttggttatcggcagaaggagcttggcgtcaagtggaaaaagtagaaacttgggcgcttagacatccgggatttactatattagctctattcctggctcactacattgggacttcgttaacgcaaaaagtagtcatattcatattactgatgttagtaactccttcaatgactatgagatgtgtcggagtaggaaacagggactttgtagaaggattaagcggagcaacgtgggtggacgtagtccttgaacatggaggatgcgtaactacgatggctaaaaacaaacctacactcgatattgaattgcagaaaacagaagcgactcaactagcgactctacgtaaattatgtatagaagggaaaataacaaatataacgactgactctcgttgcccaacacaaggagaagcagttctaccagaagaacaagatcagaactatgtgtgtaaacatacgtacgtagatcgcgggtggggaaatgggtgtggactattcggaaaagggagcttagtcacatgtgccaaatttcaatgcctggaacctattgaaggtaaagttgtgcaatacgaaaatctaaaatacactgtaataataacggtacacaccggcgatcaacaccaagtcggtaacgagacacaaggcgttactgctgaaataacgccgcaagctagtacaactgaagccattttacctgaatacggtaccttgggattagaatgtagtccacgaacaggactagatttcaatgagatgatattgctaacgatgaaaaacaaagcctggatggttcatcgacaatggttctttgatttgcccctaccatggacaagcggagctacaacagaaacacctacatggaataggaaagaattgctagtaacatttaaaaatgctcatgctaagaaacaagaggtggtggtactagggtctcaggagggagcaatgcatactgccttaacgggtgccaccgaaattcaaaatagcggagggacatccatcttcgcaggtcatttaaaatgtcgtttaaaaatggacaaattagaattaaaaggaatgagctatgcgatgtgtacaaatacatttgtgctaaagaaagaagtttcagaaactcaacatggtactatactaattaaagtcgaatataaaggggaggatgtcccctgtaaaattcctttttcaacagaagacggtcaggggaaagcgcacaatggacgtttaataacagccaatccagtggttacgaaaaaggaggaacctgtaaatattgaagcagaaccaccgtttggcgagagcaatattgtcattggtattggagataatgctttaaaaataaattggtataagaaaggctccagtatcggtaaaatgtttgaggcaacggcaaggggtgcccgacgcatggcaatcctaggcgatacagcctgggacttcgggtccgttggaggagtcctgaatagtttggggaaaatggtccatcaaatatttgggtctgcctatacagcactattttcaggagttagttgggtcatgaaaattggaattggagtacttttaacttggattggtttaaattccaaaaatacaagtatgtccttttcttgcatagcaatcggtataataactctctatttgggtgcagtcgtacaggcagatatgggatgtgtaattaactggaaaggcaaggaactcaaatgcggtagtggcatatttgtcacaaacgaagtacacacgtggacagaacaatataaattccaggcagattcaccaaaaagattagctacagctatcgcgggagcgtgggaaaatggggtctgtgggatccgtagcactactaggatggaaaacttattatggaaacagattgcaaatgaactaaattatatactatgggagaacaacatcaagttaacagtagttgtaggagatactattggtgttctagaacaaggcaaaagaactttaaccccacaacccatggaactcaaatacagctggaagacatggggcaaagccaagattgttacggcagagacccaaaattcaagttttattatagacgggccaaatacacctgaatgccctagtgcaagccgtgcctggaatgtttgggaagtagaagattatggctttggcgtattcacaacgaatatttggctaaaattgagggaagtatatacacagctctgcgaccatcgtttgatgtcggcagcagtcaaagacgagcgcgcagtacatgcggatatgggatactggatagaaagtcagaagaacggtagttggaaactagaaaaggcctcacttatagaagttaaaacatgcacctggcctaaatcacacactctatggtcgaacggagtactagagtccgatatgataatacccaagtcacttgcaggccctattagtcaacataattataggcctggttatcacacacaaacagcaggcccatggcacctgggaaaattagagttagattttaattattgtgagggtaccactgtcgttataactgaaaattgtgggacaaggggaccgagcctgagaacaacaacggtttctggtaaactaatccatgaatggtgttgtcgatcatgtaccttacctcctctgcggtacatgggtgaagatgggtgctggtatgggatggaaattcggccaatctcggagaaagaagaaaacatggtcaaatctctagtctcagcgggttctggagaggtagataatttcacaatgggagtactatgtctagcgatacttttcgaagaagtaatgagaggaaagttcggcaagaaacatatgatagctggggtcttctttacattcgtattacttttatccgggcagatcacatggcgggacatggcacacactctcattatgataggatctaatgcgagtgataggatgggcatgggtgtaacttacttagccttgatagcgaccttcaagatacaaccatttctagcattgggcttctttctcaggaagttaacatcaagagaaaatttgttgctaggcgtgggactcgcaatggccacaacgttacagctacctgaagacatcgagcaaatggccaatgggatagcgttaggcttaatggctctgaaactaataacccagtttgagacctaccagttatggaccgcgttaatatccttaacgtgctctaatacaatttttaccttgaccgtggcttggagaactgctacattaatcttagcaggagtgtctttactaccggtatgccagagtagttccatgagaaaaacggattggcttccaatgactgtggcagcgatgggtgtaccacccctacccttatttatattttcattgaaagacaccttaaaaagacgatcatggcccttgaatgaaggtgttatggcggttgggctcgtctcgatcttagcttcatcactcttacgaaatgatgtgccaatggcaggtccccttgtagcgggcggactcctaatcgcatgctacgtaatcacaggtacgagtgcagatctaaccgttgaaaaagcagccgacgtgacatgggaagaagaagcggaacaaacaggtgtgagtcacaacctaatgataacggttgacgacgatggaacaatgagaataaaagacgatgaaaccgaaaatattttaactgtactactcaaaacagcattgttgattgtttcaggcattttcccatattctataccagcaactctccttgtttggcacacatggcagaaacaaacacagaggagcggtgttttgtgggatgtaccatcaccacctgaaactcagaaggcagaactagaagaaggtgtatataggatcaaacaacaaggaatatttggtaaaacacaagtaggagtcggagttcaaaaggagggagtattccacaccatgtggcacgtaacaagaggggccgtattaacatataatggcaaaagacttgaacctaactgggcctccgttaagaaagatttaatctcttatggaggtggttggagactttccgcgcaatggcaaaaaggtgaagaagtccaggtaattgccgttgagcctggcaaaaatccgaaaaattttcaaacaatgcctggcacttttcaaacaacgacaggcgaaataggagcgatagcactagatttcaaacctgggacatcgggttcgcctataattaacagagaaggaaaagtcgtaggtttatacggaaacggcgtcgtgacgaaaaatgggggatatgtaagcggtattgctcaaacgaatgcagaaccagatggccctacgcccgaattagaggaagaaatgtttaagaaacggaatctaacaataatggatttacacccgggatcggggaaaaccagaaaatacttaccagctatagtcagggaagcgattaaacgcagattaagaaccttaatcctagcaccgacaagagttgtagcagcagaaatggaagaggcactaaagggactccccattaggtatcagacgacagctaccaaaagtgaacatacaggaagagagatagtagacttgatgtgtcatgcaactttcacaatgcgactactaagcccagtccgagtaccaaattataatttaataataatggacgaagcgcatttcacggatccagcgtccattgccgcacgtggctacataagcactcgcgtgggtatgggtgaagcggccgccatattcatgactgcaacgccaccgggtactgcggatgcatttccccaaagtaacgctccaatacaagacgaggaacgagatatacccgagcgcagttggaacagtggcaacgaatggattactgactttgcaggcaaaaccgtatggtttgttcctagcattaaggctggtaatgatatagccaattgtctacgaaagaatggcaagaaagtcatacagttgagtcgtaaaacatttgatacggaatatcagaaaacaaaattaaacgattgggacttcgtcgtaactacagacattagtgaaatgggagcgaatttcaaggcagatagagtaatagatccacgccgatgtctcaagcctgtcatattaacagatgggcccgagcgagtcattcttgcaggaccaatgcctgttacagcagctagcgctgcgcaaagacgaggtcgcgtcggcagaaaccctcagaaagagaacgaccaatatatattcaccggacaaccactaaacaacgacgaggaccacgcgcattggaccgaagcaaaaatgctgctcgataatatcaatacacctgaggggattattccagctttgtttgaaccagaaagggagaaaagtgccgcaatagatggtgagtaccgtctcaaaggagagagtcgtaaaacattcgttgaactaatgagacggggcgacttgccagtttggttggcccataaagttgcttctgagggaatcaaatatacagaccgaaagtggtgcttcgacggacaaagaaataaccaaattttagaagagaatatggacgtagagatttggacaaaagaaggagagaagaagaaacttcgaccacggtggttagatgcaagaacatatagcgatccactcgctttgaaagaatttaaagatttcgccgccggaaggaaatccattgcactagatctagtgactgaaataggtcgagtgcctacgcatttagcgcaccgaactaggaacgccctagacaatttagtaatgcttcacacaagcgaacatgggggaaaagcatacagacatgcagtagaagaattgccagagactatggaaaccttactgctcttgggattgatgatattgcttactggaggtgcgatgttatttctcataagtggcaagggcatagggaaaaccagcatcggattaatctgcgtcatagcatcctcaggaatgttatggatggccgagatcccgctccaatggatagctagcgcgatcgttctggaatttttcatgatggtattgttaatccccgaacctgagaaacaaagaacccctcaggacaaccaactagcatacgtagtgataggtattctcacattagctgctactatagcagcaaacgaaatgggcctactcgagacaactaaacgggatttgggaatgagtaaagaacccggagtagtaagtcccacaagctacctggacgtagatttacacccagcatctgcatggactttgtacgctgtagctactacggtgattactccgatgttaagacacacaattgaaaattccactgccaacgtcagcttagcggccatagctaatcaagcagtagtcctaatgggactagataaaggatggccaattagtaaaatggatttaggcgtcccccttctggcacttggatgttactcacaagtgaatcctttgacactaactgcagctgtcctactgctcattacacattatgctattatcggtccgggactacaagctaaagctacgcgagaagctcagaagcgtacagctgccggaattatgaaaaatcctactgtggatggcataatgacaatagacctcgacccagtaatttatgattcaaaatttgaaaaacagctcggacaggtcatgctcctagtgctttgcgcagtacaactgctactaatgcgaacttcttgggcattatgtgaggctttaactttggcaacagggcctataacaactttatgggaaggcagtcctggaaagttttggaatacaacgatcgcggtttcgatggcaaatatatttaggggctcctatctagcaggggcaggactggctttctccataatgaagagtgtgggtaccggaaagagagggacaggaagtcaaggcgaaacgttaggtgagaagtggaaaaagaaactaaatcaattatctcggaaagaatttgatctctacaagaaaagtggaattactgaagtagatagaaccgaggcaaaagaaggactaaaacgtggagaaataacacatcatgctgtttcgcgtggatcagctaaattgcagtggtttgtggaaagaaacatggttatcccagaaggacgcgtaatagatcttggatgtggaagaggcggctggtcttattattgcgcagggttgaagaaagttaccgaggtaagaggttatacaaagggtggtcccggacacgaggaaccagtaccaatgtcaacttacggatggaatatagtaaaattaatgtcaggcaaggatgtattttacttaccacccgaaaaatgtgacacactactttgtgacattggagaatctagtccatcaccaacagtagaggagagtaggacgataagagttttaaaaatggttgaaccatggctcaaaaataatcaattttgtattaaagtactcaatccatacatgccaacagtgatagaacatctagaaagactacaacgcaaacatggcgggatgttagttcgaaatccactatctaggaacagtacccatgaaatgtactggattagtaatggtacaggtaatatagtagccagtgtaaatatggtcagtcgtttattactaaaccggttcaccatgactcatagacgacccacaatagagaaggatgttgatctaggtgccggcactagacacgtaaacgcagagccagagacccccaatatggacgtaattggtgaacgtatcaagcgaatcaaagaagaacacaattccacatggcactatgatgacgaaaatccctataaaacttgggcatatcatgggtcttacgaagttaaagccactggaagtgcatcatctatgataaatggtgtggttaaacttctaacaaagccttgggacgtcgtaccaatggtcacgcaaatggccatgactgatactactcctttcggacagcaaagagtgtttaaagagaaggttgacacaagaacgccacgtagcatgccaggaactagaagagtcatggggattaccgccgaatggttgtggagaactttggggagaaataagaaaccaagactatgtacaagggaagaatttacaaagaaagtaagaacaaatgccgcaatgggggccgtattcacagaggaaaatcaatgggacagtgctaaagcagcagtggaggacgaggatttctggaaactcgtggaccgagaacgagagctccacaaacttggtaaatgtggatcttgtgtttataacatgatgggcaaacgagagaagaaactcggggaatttgggaaagcaaaaggtagtagagctatatggtatatgtggttaggcgcaagatatttagagtttgaagcacttgggttcctaaacgaagaccattggttcagtagagaaaactcgtactcaggagtcgagggagaaggcttacacaaattgggatacatactaagggatatttccaaaattcctggcggtgcaatgtacgcggatgatactgctggttgggataccaggataacagaagatgatttacataacgaagagaaaattactcaacaaatggatccggagcatcgtcaattagctaacgcaatattcaaattgacttatcaaaacaaagttgttaaagttcaaagaccaacacctacaggcactgtcatggacataatatcccgtaaagaccaacgtggttcaggacaggttggaacttatggactcaacacattcacgaacatggaagcccagctaatccgacaaatggagggcgaaggggtattatccaaggcagaccttgaaaaccctcacttacctgagaagaaaataactcaatggctagaaacgaaaggagttgaaagattaaaacgtatggcgatatctggtgacgattgcgttgtaaagcctatagatgacagatttgccaacgcacttctggctctaaatgacatgggcaaagttagaaaagacattccgcaatggcaaccttcaaaaggatggcatgattggcagcaagtgcccttttgctcgcatcattttcatgaactaattatgaaagacggtcgtaaattagtggttccttgtcgaccacaggatgaattaataggacgggcgcgcatatcgcaaggtgcaggatggtcgcttcgtgaaacggcttgcttaggcaaagcctatgcgcaaatgtggagtcttatgtactttcatcgacgtgatctacgacttgcgtcaaatgctatatgttccgcagtaccggttcattgggtacccacttcgcgtacaacatggtccatccacgcgcatcaccagtggatgacgaccgaagatatgctgactgtctggaatagggtttggatagaagacaatccatggatggaggacaagacgccagtaaccacttgggagaacgtaccctatctaggcaaacgtgaagatcagtggtgtggatcattaataggattaacctcaagggcaacatgggcacaaaatattcccacagctatacaacaagtaagatctctaattggtaacgaggaatttcttgactatatgccgtcaatgaaacgctttcggaaggaagaagaatcagagggagcaatctggtaa

SEQ ID NO: 23421 - RNA, 9873 nt, synthetic construct
  misc_feature 1..9873: note = derived and/or modified CDS sequence (opt6) from DENV-3__FJ639790__SS-prME
  source 1..9873: mol_type = other RNA
acctcactctgtcttatgatgattttgccagcagcattggctttccacttaacgagtcgggatggagaacctcgaatgatagtgggcaaaaacgaacgaggaaaatcacttttatttaaaacagcgagtggaataaatatgtgtaccttgatagcaatggaccttggagaaatgtgcgacgatacggtcacgtacaaatgtccgcacataactgaagttgaacctgaagatatagattgttggtgtaacctcacttcgacatgggtgacatacggtacttgtaaccaagcgggcgaacaccgacgggataaacgcagtgtagctttggcgccacatgtaggcatgggcctggataccagaacacaaacctggatgagcgctgaaggggcttggaggcaagtggaaaaagtagaaacgtgggcattacgtcatcctggatttacgatattagctctgtttttggctcattacataggaacttcgcttactcaaaaggttgtgatattcatactgttgatgctcgtcacaccttcgatgactatgagatgcgtaggtgtgggtaatcgcgattttgttgaaggcctttcaggggcaacgtgggttgatgtagttttagagcacggaggatgtgtaacaaccatggccaaaaacaaaccaacactagacatcgagctccaaaagacagaagctacacaattggccacgttaagaaaattatgcattgagggtaaaataactaatatcaccacggattctagatgcccgacgcagggagaagccgttctcccggaagaacaggaccaaaattatgtatgtaaacatacatacgtagatagggggtggggaaacggttgcggactttttggcaaaggctctttggtcacgtgcgcaaaattccaatgcctggaaccgatagaaggtaaagtggttcaatatgaaaatcttaaatataccgtcattatcacagtacacacaggagaccaacatcaagtcggcaacgaaacccaaggagttacggcagaaataaccccacaagcatcgactacagaggcaatcttacccgaatatggtactctgggcttagaatgttctcctagaacgggactagattttaacgagatgatccttctaacaatgaaaaataaagcctggatggtgcaccgccagtggttctttgacctccccctaccatggacgtctggtgcaactacggaaacgcccacatggaatcgcaaagaattacttgttacgtttaaaaatgcacatgccaagaaacaggaagtagttgtactgggaagccaagagggggcaatgcacacagcactgactggtgcaaccgaaattcaaaattccggtggcacgtcaatttttgctggacatctaaaatgcaggctcaaaatggataaattagaactcaaaggaatgagttacgctatgtgtacaaacacatttgttctgaagaaagaagtttcagaaacccaacatggtacaatcttaataaaagtagaatacaaaggagaagacgtcccatgtaaaattccttttagtacggaagatggacagggcaaagctcacaacggtaggcttataacagctaatcccgtagtaactaagaaagaagaaccagtaaatattgaggctgaacctccattcggagagagtaatattgtaattgggattggggataacgccctcaaaattaattggtataagaagggaagtagtattggtaaaatgtttgaggcgactgcgagaggggcacgacggatggcaatactaggagatacagcctgggattttggtagcgtagggggtgtattaaatagtttgggaaaaatggtgcatcaaatatttggaagcgcgtatacggcattatttagtggagtgagttgggttatgaaaatcggcattggggttttactcacctggataggattgaatagcaaaaacacaagtatgtctttctcatgcatagcaataggtataataaccttatatttaggagccgtggttcaagcagatatgggatgcgtaatcaattggaaaggaaaagagctgaaatgtggatcaggaatatttgtaacaaatgaagtacacacctggacagaacagtacaaatttcaagccgattcacctaaaaggctagcaacagccatcgccggtgcatgggaaaacggcgtatgtgggattcgatcaacgacccgcatggaaaaccttctttggaagcaaatagctaacgaactaaattatatactatgggaaaacaatataaaattgacagtcgtagtgggagacattatcggagtattagaacaaggcaagcggactttgactccccaaccaatggaactcaaatatagctggaagacatggggtaaagcaaaaatagtaacagcagagacgcaaaattcctctttcataattgatggaccaaatactcctgaatgtccaagtgcgtcaagagcttggaacgtatgggaagtcgaagattatggtttcggtgttttcacaactaatatatggttaaaattaagagaagtttacacacaattatgtgaccatagactaatgtcagcagcagttaaagatgagcgcgctgtacacgcggatatgggttactggatagaaagccagaaaaacggatcatggaagttagaaaaagccagcttaatagaagtgaaaacatgcacatggcctaaatcacatacactctggagtaacggcgttttagagagcgacatgataattccaaaatcactagcagggccaatatcccaacacaactacaggcccgggtatcatacacagacagcgggcccatggcatctgggaaagctagaattagattttaattattgcgagggaacaacagtggtaattactgagaattgtggaacacgaggtccctcgctgagaacgacaaccgtatccggaaaattaattcatgaatggtgctgtagatcatgtactctaccaccacttcgatacatgggagaagacggatgctggtatggtatggagatacgaccgatatcagagaaagaagaaaacatggtaaaaagcctcgtcagtgcagggtccggagaggttgataactttacaatgggcgtactctgtttggccatcttattcgaagaggtcatgaggggtaaattcggaaagaaacacatgattgccggtgtattcctcacttttgttctacttttaagtgggcagattacatggagggacatggctcatactctaataatgatcggaagtaacgcttcagacagaatgggtatgggggtcacgtatttggcactaattgcaacatttaaaattcagccatttttagctctaggattctttctaagaaaattaacaagcagagagaacctactgctaggtgttggccttgcaatggcaacaactctccagctacctgaggatattgaacaaatggcaaatgggattgcactaggacttatggccctgaaactgatcacacagtttgaaacatatcaactatggacagcactcataagtctgacgtgcagtaatactatatttacactaactgtagcatggcgaacagcaactttaatactagcaggcgtatcactcctccctgtatgtcagtcgagttcaatgagaaaaactgactggctcccgatgacagtcgcggccatgggggtaccaccattgccactctttattttcaatttgaaagatacactaaaaagacgatcctggcccttgaatgaaggtgtcatggcagtagggttggtatcaatattggcatctagtcttctacggaacgatgttccaatggccggtccgttagttgcgggaggactcctaattgcttgttatgttatcacaggtacttcagcagacttaaccgtagaaaaagcggcagacgttacatgggaggaggaagcggaacaaactggcgtatctcacaacttaatgatcacagtggatgatgacggtacgatgcgaataaaagacgacgaaacggaaaacatattgacagtactgctaaaaacggcgctattaatagtgtccgggattttcccatatagcatacctgcgaccttattagtctggcatacgtggcagaaacaaacacaacgatcaggcgtattatgggatgtaccatcccctcctgaaacgcaaaaagcagaactggaagaaggggtgtatagaataaaacagcaaggtatattcggaaaaacacaagttggcgttggtgttcagaaagaaggcgtttttcacacgatgtggcacgttaccagaggagctgtgctaacgtataatgggaaaaggctagaaccgaactgggccagtgttaagaaagatttgatctcatacggaggaggctggaggttatctgctcagtggcagaaaggagaagaagtgcaagtaatcgccgtggaacctgggaaaaatcccaaaaatttccaaacgatgccaggaacctttcaaaccacaacaggagaaataggcgcaatagctttagatttcaaaccgggaacaagtggatcaccaattataaatcgagaaggtaaggtagtaggcctatatggaaatggtgtagttacaaagaatggtggttatgtatccgggatagcacagactaacgcggaaccagacggtccaaccccggaattagaagaagaaatgtttaagaaacgaaatttaacgattatggatttacatcctggatcgggaaagaccagaaaatacttacccgctattgtaagagaagctataaaaaggagattaagaacgttgatattagcgccaactcgagtggtagctgcagaaatggaagaggccctcaaaggtctgcctatacgttatcaaactacagctacaaaaagcgagcatacagggagagagatagttgacctaatgtgccacgcaaccttcactatgcgattactctcaccggtaagagtaccgaactataatttaataatcatggacgaagcgcacttcactgatcctgcgagtatagccgcgagaggatacatctccacacgggtgggaatgggagaggcggccgcaatatttatgactgccacgcctcctggaacagcagatgcgttcccccaatctaatgcccctatccaggacgaagaacgtgatatcccagaacgctcgtggaacagtggaaatgagtggatcactgacttcgccggtaaaactgtatggtttgttccaagcattaaggccggtaacgacatcgctaattgcttgaggaaaaatggaaagaaagttatacaacttagcagaaaaacctttgacacagaatatcagaaaacgaaactcaacgactgggactttgtagtgacaacagatatatcggaaatgggggcaaatttcaaagctgatagagtcatagacccaaggagatgtctaaaacccgttatattaacggatgggccagagcgcgtcatacttgctggaccaatgccagtaactgccgcaagtgcagcacagagaaggggacgagtaggtcgtaatccccaaaaggaaaatgaccaatatatttttactggacagcccttaaacaatgacgaggaccacgctcattggactgaggcgaaaatgctacttgataatatcaacacaccggaaggtattataccagccttatttgaaccagaaagagagaaaagtgccgcaatagatggcgaatatcgcttaaaaggagagtcacgaaaaaccttcgtagaactgatgaggcgaggagatctcccagtgtggttagcccacaaggttgcatcagaaggtataaagtataccgatagaaaatggtgtttcgacggccaaagaaacaatcaaatacttgaggaaaatatggacgtagaaatttggactaaagaaggagagaaaaagaagttgagaccgcgttggcttgatgctcgtacctattcagaccccttagccttaaaagaatttaaagattttgcggcaggacgaaaaagcatagctttagacctagttacggaaattggaagagtcccaacacatttagctcacagaacacgcaacgcacttgacaacttagtaatgttacatacatcagaacacggagggaaggcttatcgacacgcggtagaggaacttccagaaactatggaaacactgctacttctcggactgatgattctcttgacagggggagctatgctatttttgataagtggaaagggaatcggcaagacctcaataggactaatatgtgtgattgcctcatcaggtatgctttggatggcagaaataccattacagtggattgcatccgcaatcgtattagagtttttcatgatggtactcttaattcccgaaccagaaaaacaacggactccccaggataatcaactagcatatgtagtcataggtattctgacactagccgctattattgcagcgaacgaaatgggactattagaaactacaaaaagagatctgggaatgtcaaaagagccaggtgtagtttcacctactagctatcttgatgttgacctccatccagcctcagcttggactttgtatgctgttgccacgacagtaattacaccaatgctccgacataccattgagaacagcactgcaaatgtatcactcgcagcaattgcaaaccaagctgtcgtactaatgggactagataagggctggccaatttcaaagatggatttaggagtaccattacttgcacttggctgttattcgcaagtaaaccctttaactctcacggctgctgtgcttttattgataacccactatgctataataggtccaggattgcaggcaaaagcaacgcgcgaagcacagaaaagaacggctgccggtatcatgaaaaatcccaccgtagatggtatcatgacaatagacctggatccagttatatatgactcaaagttcgaaaaacagttaggccaagtgatgttgttagtgctatgcgctgttcagttattactcatgcgcacatcatgggcactttgcgaagccctaacactagcaacgggacccatcacaacgctttgggaaggttcccctggcaaattttggaatacaacaatcgcggtgtcgatggccaacatattccgaggatcatacctcgccggagctgggttagctttctcaatcatgaagagtgttgggaccgggaaacgcggaacaggcagccaaggcgaaaccctaggtgaaaaatggaaaaagaaactaaaccaactaagtaggaaagaatttgacttatataagaaatcaggcataacagaagtggatagaacggaagcgaaagaaggattaaaacgtggagaaataacgcatcacgcagtatccaggggttccgcaaaattacaatggtttgttgaacggaatatggtaataccggaaggtagagtaatagatctaggttgcggacgaggcggttggtcgtattattgtgctggtttaaagaaagtaaccgaagtgagaggctatacaaaaggtggacctggtcacgaagaacctgtcccaatgtcaacctatggctggaacattgtcaaactaatgagcggtaaagatgtcttctatcttccgccagaaaaatgtgacacacttctctgtgatattggagaatccagtccaagtcctacagttgaagaatcccgaacgataagggtgttaaaaatggtagaaccatggctcaaaaacaatcagttttgtattaaagtacttaacccttacatgcctacagtaatcgaacacttggaaagattgcaaaggaaacacggaggaatgctagtaaggaaccctttgtccagaaattctacccatgaaatgtactggataagtaacggaacgggcaatattgttgccagtgtcaacatggtttctcgcttgttgttaaatcggtttacaatgacccatcgtaggccaacaatagaaaaagatgtcgatttaggggcgggcactcgacatgtaaacgcagaacctgagacccctaatatggatgtaattggagaaagaattaaaagaatcaaagaggaacataattccacatggcactatgatgatgaaaacccttataaaacttgggcctatcatggttcatatgaagtgaaggcaacaggtagtgccagttcaatgataaatggggttgtgaaactcctaacaaaaccatgggatgtagtaccaatggtcactcaaatggctatgacggatacgacaccattcggacagcaacgagtattcaaagaaaaagttgacacacgaacacctcggtcaatgcccggcactagaagagtaatggggataacagctgaatggttgtggagaaccctcggccggaataagaaacccagactctgtacccgggaagaatttaccaagaaagtaagaaccaatgcagcaatgggtgccgtatttacagaagaaaatcagtgggactctgcaaaagcggctgtagaggatgaagatttctggaaacttgtagatcgtgaacgagaactccacaagctaggcaaatgcgggagttgtgtatataacatgatgggaaaaagagagaagaaactgggcgaatttggtaaagctaaaggcagtcgtgcgatatggtacatgtggttaggggccagatatctagagttcgaggctttaggcttcttaaacgaagatcactggttctcaagggaaaactcatatagtggcgttgaaggagagggacttcacaagctgggatatatattgcgggacattagtaaaataccgggcggagcaatgtacgcagatgacaccgcgggatgggatacacgtataactgaggatgatcttcacaacgaagagaaaattacgcaacagatggaccctgagcataggcaattggcaaatgcaattttcaaacttacttaccaaaacaaagtcgtgaaagtacaaagaccaacccctgcaggaacggttatggatataataagtagaaaagaccaaaggggaagcggtcaagttggtacttacggattgaatacatttactaatatggaagcacaattaatacgccaaatggaaggtgaaggagtactctctaaggcagatcttgaaaacccacacttacccgaaaagaaaataacccagtggctggaaactaaaggagttgaacgcctaaaacgaatggcaatatcgggtgatgactgtgtcgtaaaacctatagatgatcgttttgcaaatgcgctattagcacttaatgacatgggtaaagtcagaaaagatataccccaatggcaaccatcgaaaggctggcacgattggcaacaagtccccttttgcagccaccattttcacgagctaattatgaaagacggtaggaaattagtcgtaccttgcagaccacaagatgagctcataggacgcgcacgcatttcccaaggagctggttggtctctacgagaaacagcttgtcttggtaaagcatatgcgcaaatgtggtccctcatgtatttccacagaagagatttgcgcctagcatcaaatgcaatttgttcagcagttccagtacactgggttccaacaagtcgtactacctggtccatccatgcacaccatcagtggatgactacggaagacatgctaacagtatggaaccgtgtgtggattgaagataacccatggatggaagacaagacgccagtaacaacttgggagaatgtaccgtaccttggcaaaagggaggatcaatggtgcgggagtttaatcggcttgacaagtagggccacatgggctcaaaatatacccactgccatacaacaagtcaggagcttaatcggaaatgaggaatttcttgattatatgccttcaatgaaaagattcagaaaagaagaagaatctgaaggagccatttggtga

SEQ ID NO: 23422 - RNA, 9873 nt, synthetic construct
  misc_feature 1..9873: note = derived and/or modified CDS sequence (opt6) from DENV-3__FJ639791__SS-prME
  source 1..9873: mol_type = other RNA
acatccttatgtttaatgatgattcttccagcggcactggcgtttcatctgacatcaagagatggagaaccccgaatgatcgtaggcaaaaacgaacgcggaaaaagtctattatttaaaacagctagtgggatcaatatgtgtacgctgattgcgatggatctgggtgagatgtgcgacgacacggtaacatacaaatgtccgcatataacggaggtagaacctgaagatatagattgttggtgtaatttgacaagtacctgggtaacatacggaacatgcaatcaggcgggagagcacagacgggataaaagatcggtggcgttagcaccacacgtaggaatgggactagatactagaacgcaaacttggatgagcgcggagggagcatggcggcaagtagaaaaagtagaaacgtgggcgcttagacatcctggatttacaatactagccctatttttggcccattatataggtacatccctaactcaaaaagttgtaatcttcatattgctaatgctggttacgccttccatgacaatgcgttgcgtcggtgtcgggaatagagatttcgtcgaaggactatcgggggctacatgggtagatgtggtactagagcatggagggtgcgtgactaccatggccaaaaataagccaacactagacattgagttacaaaagacggaggcaactcagttggctaccttacggaaactatgcattgagggtaagattacaaacattaccacagattctcgatgtccaacgcaaggggaggcagtgctgccggaagaacaggatcagaactacgtctgtaaacatacctatgttgacaggggatgggggaacggatgcggtttatttggaaaaggtagtttagtgacgtgcgcaaaatttcaatgcttagaaccagtggaagggaaagtagtacaatatgaaaacctaaaatacacagttatcattacagttcacacgggtgatcaacaccaggtaggcaatgaaacacaaggtgttacagctgaaatcacgccgcaagcatccacaacagaagcaatattaccggaatatggcacattagggctagaatgcagtccaagaactggattggattttaatgaaatgattctattaacaatgaaaaacaaagcctggatggttcatagacaatggttctttgacttaccattaccttggacgtctggtgctacaactgaaaccccaacttggaacagaaaagaactcctagtcacttttaagaacgcccacgccaaaaagcaagaggttgttgttctaggtagccaagaaggcgctatgcacaccgctctaacaggcgcaactgaaatccaaaatagcggagggacttctattttcgcagggcacctaaaatgtcgattgaagatggataaacttgagctcaaagggatgagctatgcgatgtgcaccaataccttcgttctgaagaaagaggtctcagaaactcagcacggaacgatattaataaaagtcgaatacaaaggagaggatgtgccctgtaaaatccccttcagtaccgaagacggacaaggtaaagcgcacaatggacgtctaataaccgccaaccctgtggttactaagaaagaggaaccagttaacattgaagctgaaccaccttttggagaatctaatattgtaattggcataggagataacgctctaaaaataaattggtataaaaagggtagctcaattggtaaaatgttcgaagccactgctcgtggtgcacgaagaatggctatcctaggagatactgcctgggacttcggatcagtaggaggtgtgttaaacagtctgggtaagatggtacaccagatatttggaagcgcttacactgcactattttcgggagtctcatgggtaatgaaaataggcattggtgtactcttaacgtggataggtttaaattctaaaaatacctctatgagttttagttgcatcgcaataggtatcataaccctttatttaggagcagtcgtacaagcagacatgggatgcgttataaattggaagggaaaagaattaaaatgtggatcaggcatttttgtaaccaacgaagttcatacatggacggaacaatataagtttcaggcagactcacccaaaagattagctaccgctatagcgggtgcctgggaaaatggcgtatgtggcatcagaagtacaacaagaatggaaaatctactctggaaacaaatagcaaacgaattaaattacatcttatgggaaaataacattaaactaacagtagtagtcggagatataattggggtgttagaacagggaaaaagaactcttacaccccagcccatggaattaaagtacagctggaagacatggggaaaagctaaaattgtgacggccgaaactcaaaattcctcctttatcatagatgggccaaacacacccgaatgtccatcagcctcaagagcatggaacgtctgggaagttgaagattacggtttcggagtctttacaactaatatctggttaaaattgagagaagtctacacacaattatgtgaccatcggctgatgtcagctgcagtcaaagatgaaagggccgttcatgcagatatgggatactggatagaatcccagaaaaatggctcttggaaattagaaaaagctagccttattgaggtaaagacttgcacttggccaaagagtcatactctttggtctaatggtgtcctagaatcagatatgattataccaaaatcactcgcagggccaatctcacaacataactataggcccggataccatactcaaacagccggcccatggcacctgggaaagttggaacttgatttcaactactgtgaaggaactacagttgtcatcactgagaattgcggaacaagaggtccatcactgcgcacaacgacagtcagcggaaaattaatacacgaatggtgttgtagatcctgtacactacctcctttaagatacatgggggaagatgggtgctggtatggaatggaaattaggcccattagcgagaaagaagaaaacatggtcaagtcgttggtaagcgcgggtagcggagaagtcgacaactttactatgggggtgctatgtttagcaatactcttcgaagaagtaatgcgtggcaaattcgggaagaaacatatgattgccggtgtattctttacatttgttttattattgagcgggcagatcacctggcgagatatggctcacacacttatcatgatcgggagtaacgcatcagatcggatggggatgggggtgacatatttagcattaatagcaacattcaaaatacaaccatttttagcattaggtttctttcttagaaagttaacatcgagagagaaccttctattaggagttggattagctatggccactacattgcaactcccagaagacattgaacaaatggcaaacggaatagccctgggtctcatggcgttgaaacttatcacacaatttgaaatctaccaactctggactgcactaataagcctgacttgcagcaacacaatatttactcttacagtcgcctggaggacagccacactgatattagctggtgttagccttcttccagtttgtcaatctagttctatgagaaaaacagattggctaccaatgacagtagcggctatgggtgtcccgccgttgcctctattcatttttaatttaaaagatacgttaaagcgacgatcttggccactgaatgaaggtgtaatggcagttggtttagttagtatcctcgcaagcagcctacttcgcaatgatgtaccgatggcaggaccattggtagccggaggcctattaatagcatgttacgtaatcacaggaacttcggccgatttaacagtagaaaaagcagcagatgtgacttgggaagaagaagctgagcagacaggagtaagccataatctaatgattactgtggatgacgacggaacaatgcgaataaaagatgatgaaactgaaaacatccttacagttctcttaaaaactgctcttttaatagtaagcggaatattcccctatagtattccggctacgctattagtatggcatacctggcagaagcaaacgcagaggagcggagtactctgggacgtgccaagtcccccagaaacacaaaaggcagaactagaggagggagtgtaccgaataaaacagcaaggaatcttcgggaaaacacaggttggagttggtgtacagaaagaaggcgtcttccatacaatgtggcatgtaaccaggggagctgtacttacatacaacggaaaaagattagaaccaaactgggcatccgtcaagaaagacctaataagctatggcgggggatggcgactttccgctcaatggcaaaaaggggaagaagtacaggtaatagctgttgaaccgggcaaaaatcccaaaaactttcaaacaatgccgggcacatttcaaacaacaacgggagaaataggagcgatagcattagattttaaacccgggacgagtggatcccctataataaatagagaaggtaaagtcgtagggttatacggaaacggggtggttaccaaaaatgggggttacgtttccggaatagcacaaacaaatgcagaaccggatggaccaaccccagaattagaagaagaaatgtttaagaagagaaacttgacaattatggacctccatcctggttcgggaaaaacacgtaaatatttgcccgccatagtgcgcgaggcgattaaacgtaggctaaggactttaatactagcacccacaagggtggtagctgcagaaatggaagaagccttgaaaggactccctattagataccagacgactgcgacaaaatcagaacatactggccgggaaatagttgatttaatgtgccacgcgacgtttactatgcgactattatcaccagtgcgggttccaaactataatttgataattatggatgaagctcattttacagatcctgcttcgatcgctgcgaggggctatattagtacacgcgtaggaatgggagaggccgctgcaatatttatgactgctacaccccctgggacagctgacgcattcccacagagtaatgctcctatacaagatgaggaacgcgacatacccgaaagatcttggaatagcggaaatgaatggatcacggactttgctggcaagactgtttggtttgtaccctccatcaaagcaggcaatgatatagccaattgtttaagaaagaatggtaagaaggttattcaattaagccggaaaacattcgatactgagtaccagaaaaccaaactcaacgattgggattttgttgtcaccacggacattagtgaaatgggagcgaatttcaaagcagaccgcgtcattgatccacgtcgatgtttaaaacctgtaatattaactgatgggccagagcgtgtaatactagcaggcccaatgccagtaactgcggcgagcgcggctcagaggcgtggtcgggtgggaagaaatccccaaaaagagaatgatcaatatatattcacgggtcagcctttaaataatgatgaggaccacgcacattggaccgaggcaaaaatgttactggataatataaatacaccagaaggaatcatacctgcattattcgaacctgaacgagagaaaagtgcggcaatagatggcgagtatagattgaaaggggagtcaagaaaaaccttcgttgaattaatgcgaagaggagatctacctgtttggcttgcacataaggtagcatctgaaggaattaaatatacagacagaaaatggtgtttcgatggtcagcggaacaatcaaatactcgaggagaatatggatgttgagatctggactaaggaaggagagaaaaagaaacttaggccacgatggttagatgcgcgtacgtatagtgacccgcttgcactgaaagaatttaaagacttcgctgcagggagaaagagcatagccctcgatctagtcactgaaataggaagggtaccaacacacctggcacatcgtacaagaaacgcattagataatctagtcatgctacacacttctgagcatgggggaaaggcttaccgtcacgctgtcgaggaattacctgaaactatggagaccttattgcttcttggtcttatgatattactgactggcggtgctatgttatttctgatttctggcaaaggaattgggaaaacttcaatcggcctaatatgtgtaattgcctccagcggaatgctctggatggctgagatcccactacaatggatagcgtcagcgatagttttagagttctttatgatggtactactcatccccgaaccagagaaacaaagaactccacaagataatcagttagcctacgtggtgattggaatattgacactagcggcgataatcgctgccaatgaaatgggactactggaaactaccaagcgtgatcttggaatgagcaaagaaccgggtgtagtttctccaacatcttatttagatgtggaccttcatcccgccagtgcttggaccctttatgcggtcgcaactacagttataactccgatgctaagacacactatagaaaatagcactgcaaatgtatcgctagcagctatagctaaccaagcagtggtgctcatgggccttgataaaggatggccaattagtaaaatggaccttggtgttccacttctcgcgctcggttgctactcacaagtaaatcccctgacgctcacagccgcggtgctgctactaataactcactacgccattatcggacccggactccaggcaaaagcgacaagagaggcacagaaaaggacagccgcaggtattatgaaaaatccaacggtggatggaataatgacaatagatctagacccagtaatatacgattctaaatttgagaagcaacttggacaagtcatgcttttagtattatgcgccgtccaacttttgcttatgaggacaagctgggctttatgtgaagcattaacactcgccactgggccaataacaacattgtgggaaggatcaccagggaaattttggaataccaccatagctgtgtcgatggcaaatatctttagaggaagctatttggcaggagcaggattagcttttagcataatgaagtccgttggcacaggtaaaagagggacgggtagtcagggagaaacacttggagaaaaatggaagaagaaactaaaccagttgtcgagaaaagaatttgatctctataagaaatcaggcataacagaagtagacagaaccgaagcgaaagagggcttgaaaagaggagagattacgcaccatgcagtctcacgaggttcggcaaaattacaatggttcgtagagcggaatatggtaattcctgaagggagggttattgacttaggttgcggaagaggaggttggtcgtactattgtgctggactcaagaaagttacagaagttaggggatatactaaaggcggtcctggtcatgaggagccggtacctatgtctacttacggttggaatatagtaaagttaatcagcggaaaagatgtcttttacttgcccccagaaaagtgtgatactttactttgcgacattggggaatccagcccatctcccacagttgaagaatctagaacaataagggttttaaaaatggttgaaccatggctcaaaaataatcaattctgtatcaaggtgttaaacccgtatatgccaacagtaatcgaacacctagaacgacttcagagaaaacatggaggcatgttagttcggaatccattatcaagaaactcaactcacgagatgtattggatatccaacggaagtgggaacatcgttgcctctgtaaacatggtatcaagattactcttgaatcggtttactatgacccaccgacgacccacaattgaaaaagatgtggatcttggagctggaacacggcatgtaaacgctgaaccagaaacacccaacatggacgttataggagaacgaattaaaaggataaaagaagaacacaattcaacatggcattacgatgacgagaacccttataaaacgtgggcgtaccatgggtcctatgaggtaaaagcaacaggatccgcttcatcaatgataaacggagttgttaaattactaaccaaaccatgggatgtagtaccaatggttactcaaatggcgatgaccgataccacaccattcggacaacaaagggtatttaaagaaaaagtagacacgagaacaccgaggtctatgcctggaacgagaagggtaatggggataacagcagaatggctttggagaacgttaggaagaaacaagaaaccaagattgtgtactcgagaagagtttaccaagaaagttagaaccaacgcagcaatgggagccgtatttactgaagagaatcaatgggattcggcaaaagccgcggtagaagacgaggatttttggaagctagtagatcgtgagcgagagctacataaactcggaaaatgtggttcgtgcgtgtataacatgatgggaaagcgggaaaagaaattaggtgaatttggtaaagcaaaagggtcgagggcaatctggtatatgtggttaggagcaaggtatttagaatttgaggccctgggatttttgaatgaagatcattggttctcacgagagaatagttattcaggcgttgagggggagggattacacaagttaggatatattcttagagatatttccaaaataccaggaggagcaatgtacgctgatgatacggcaggatgggacactagaattacagaggatgatctacacaacgaggaaaagataacacagcaaatggacccagaacacagacaattagcaaacgccatatttaaattgacataccaaaataaggtagtgaaagtgcaacgaccaacacctactggtacagttatggatataatatcacgcaaagatcaaaggggcagtggtcaggtaggtacctatggattaaatacatttacaaatatggaggcgcaattaatccgccaaatggaaggagaaggcgtactcagtaaagcggacttagaaaatccacacctacctgagaagaagataactcagtggctcgaaactaaaggagtagaaagactaaagaggatggccatctcgggagacgattgtgttgtaaaaccaattgatgatagatttgctaacgcattgttagcgctaaacgacatggggaaagtaaggaaggatattccccaatggcaaccttcgaaagggtggcacgattggcaacaagtcccattctgtagtcatcacttccatgaacttatcatgaaagacggacgtaagctcgtagtaccatgtagacctcaagatgagctaatcggtcgagctcgaatttcccaaggtgcaggctggtcgctacgagaaactgcgtgcttagggaaagcctacgcacaaatgtggtctttgatgtattttcacagaagagaccttcgattggctagcaatgcaatttgttctgcagtgccagtacattgggttccaacttcccgaaccacatggagcatacatgcacatcaccaatggatgacaactgaagatatgttaactgtatggaatagagtatggatagaggacaacccttggatggaagataaaaccccagtaactacatgggaaaatgttccatatctgggaaaaagagaggatcagtggtgtggctcactgatcggcctcaccagtcgcgcaacgtgggcacagaatatacctacggcaatacaacaggtaaggagcttgattggcaacgaggagtttttagactacatgccaagcatgaaaagatttcgtaaggaagaggagagcgagggagcaatatggtaa

SEQ ID NO: 23423 - RNA, 9873 nt, synthetic construct
  misc_feature 1..9873: note = derived and/or modified CDS sequence (opt6) from DENV-3__FJ639792__SS-prME
  source 1..9873: mol_type = other RNA
acgagtttatgtttaatgatgatactccccgctgcactcgcattccacctaactagccgagatggagaacctagaatgatagttggtaaaaacgaacgagggaaaagccttctttttaaaactgcaagtgggatcaatatgtgtactttgatcgcgatggacctaggagaaatgtgtgatgacactgtaacttacaaatgcccacatataacggaagtagaacctgaagatatagactgctggtgtaatttgacaagcacttgggtcacttatggcacctgtaatcaggctggagaacatcgtagagataaaagatctgtggctttagcacctcatgtcggtatgggtttagatacacgaactcaaacttggatgtcagcggaaggtgcttggcgacaagtcgaaaaagtagaaacatgggccttgcgccaccctggatttacaatacttgcgttgtttttagcacactatataggtacatcgctaactcaaaaagtagtgatttttatattattaatgttggtaactccgagcatgactatgcgttgcgtcggcgtgggtaacagggatttcgtagaaggcttaagtggtgcaacatgggttgatgtcgtgttggaacacggaggctgcgttacaacaatggccaaaaacaaacctactttggatatagaattacagaaaactgaagctacacaacttgccactttaaggaaattatgtatagaaggtaaaataaccaacataaccacggatagccggtgtcctacacaaggcgaagcagtgttacccgaagaacaagaccaaaactacgtatgcaaacacacgtacgtcgaccggggttggggcaacggatgtggactatttggtaaaggttccttggtaacatgtgccaaatttcaatgtctggaaccgatagaaggaaaagtcgtccaatatgaaaatcttaaatacaccgtcatcataacggtgcacaccggagaccaacaccaagtaggaaacgaaacacaaggtgtaactgctgaaataacaccacaagcaagcactacagaagcaatcttaccagagtacggtacattaggcctagaatgcagtccacggacgggcctagactttaacgagatgatacttttgacaatgaaaaataaagcatggatggtacacaggcaatggttcttcgacttaccattaccatggactagcggcgccactactgagacgcctacttggaatagaaaagaacttctagtcacatttaaaaacgcgcatgcgaagaaacaggaggtagttgtcctcggctcacaagaaggtgcaatgcacacggctcttacgggagctacagaaatacaaaattcgggagggacaagtatattcgctggccatttaaaatgccgtcttaaaatggataaacttgaattaaaaggaatgtcttatgctatgtgtacgaatacattcgtcttgaagaaagaagtatcagagacacaacacggcacaatcctaataaaagtagagtacaaaggcgaagatgtaccgtgtaaaattccattctcaacagaggacggtcaaggtaaagcacataacggaagattaataaccgcgaaccccgtcgtaaccaagaaagaagaacccgtaaatatagaagccgaaccccctttcggagagtcgaacatagtcatcggcatcggagacaacgcactcaaaattaattggtacaagaaagggtcatcaataggtaaaatgtttgaagcaacagctagaggagcgagaagaatggcgatattaggagatacagcatgggactttggttcagtgggaggtgtcctgaatagcctgggtaaaatggtacaccagatttttgggtcagcttacactgccttattctcaggcgtaagctgggtcatgaaaattggtatcggtgtcctactaacctggattggactaaattccaaaaatacatcaatgagcttctcatgcatagccataggtattataacattgtatttgggtgcagtagtccaagcagatatgggctgtgtgattaactggaaaggtaaagagcttaaatgtggttctggaatttttgtgaccaacgaagttcacacttggacggaacaatataaatttcaagctgattcaccaaagcgtctggctacggcgatcgcgggagcctgggagaatggagtttgcgggatacgaagcacgacccggatggaaaacttactatggaaacagatcgcaaatgaattgaattatattctatgggaaaataatataaaactaacggtagttgttggagacataataggcgtactcgaacagggaaagagaactcttacaccacaacccatggaactgaaatactcatggaaaacatggggaaaagccaaaatcgtgacagcggaaacacagaatagtagtttcataatagacggacccaacacgccggaatgcccttcggcttcgagagcatggaatgtgtgggaagtggaagattatggctttggggtattcactacgaatatttggcttaagttacgtgaagtatacacacaactatgtgaccatcgattaatgtcagctgcagtaaaggatgaaagggcagtgcacgcagatatgggatattggatagagtctcagaaaaatggatcgtggaaattggaaaaagcatctttaatcgaggttaaaacatgcacttggccaaaatctcacacgttatggagtaacggagtactcgaatcagatatgataataccaaaaagtttggccggcccaataagccaacataattatcgtcccggttaccatacacaaacggctggaccatggcatttaggcaagctcgaactagatttcaattactgcgaaggcactacagtagtcattacagaaaattgtggaaccagaggaccatccttgagaactacaaccgtatcgggaaaattaatacatgaatggtgctgtagatcctgtacactgcctcccttgagatatatgggcgaggatggttgttggtatggaatggaaattagaccaatttcggaaaaggaggaaaacatggtaaaatcacttgtatcggcgggttccggtgaagtagataactttacaatgggagtactgtgcctagcaatcctctttgaggaagtaatgaggggaaaatttggcaagaaacatatgattgctggtgttttctttacgttcgtgttacttctttcaggccaaataacatggagagacatggcacatacattaatcatgattggttctaacgcttcagaccggatgggcatgggagtaacatatttagcactaatagcaacatttaaaatacaaccgtttctagcgttaggattctttcttagaaaattaacttcacgagaaaatctactgctaggcgtggggctagcgatggcgaccactctacaactacctgaggatattgaacaaatggcaaatggaattgcactgggactaatggctttgaaattaattacgcaatttgagacatatcaactgtggacagcgttaataagtttgacttgttcaaatacaatttttacactaactgttgcgtggagaaccgcaaccttgatactggctggagtatcattattaccagtatgccagagttcttcaatgcgaaagacggattggctaccaatgacagtagcagctatgggagttccaccactcccgttgttcatattttctctaaaggatacccttaaaaggaggagctggccgttaaatgaaggcgtcatggctgttggcttagttagtatattagcgtcatcgcttttaaggaatgacgtacccatggctgggcctttggttgccggaggattactcatagcctgttatgtaataacaggtacatcagcggatctcaccgtagagaaggctgctgacgtaacctgggaagaggaagctgaacagaccggtgtatcacataatctaatgatcacagtagatgacgacggcacaatgcgtatcaaagacgatgaaactgaaaatattttaacagtccttttaaaaactgcattattaatagtatctggtatttttccatattcgattcctgcgactttgctagtatggcacacctggcaaaaacaaactcagagatcgggcgtgctgtgggatgtcccatcaccgccagagactcaaaaagcagaattagaagagggagtttaccgaataaagcagcaaggtatatttggaaaaacccaagtaggcgtcggagtacagaaagagggagtctttcataccatgtggcacgtgactcgaggcgcggtgttaacacacaatggcaagaggctcgaacctaattgggctagtgttaaaagagatttaataagttacgggggcggatggcggctttctgctcagtggcaaaagggggaagaggtacaagtaatagcagtagaaccgggcaaaaatcccaaaaattttcaaaccatgccaggcacattccaaactaccacaggagaaatcggagctatagcactcgattttaaacccgggacctcaggatcgcctataataaacagagaaggaaaagtagtcggactttacggcaacggagtagtcactaaaaacgggggatatgtgagcggaattgcacagaccaatgcggagcctgatggtccgacaccagaattggaagaagaaatgttcaagaaacgaaacttaaccataatggatttacatccaggaagcggaaaaactaggaaatatctacctgctatagtaagagaagcaattaagagaagattaagaaccctgattctagcaccgacaagagttgtggctgccgaaatggaggaagcattaaagggattacctatacgttatcaaactactgcaacaaaatctgaacacactggaagagaaattgttgacctcatgtgccacgctaccttcaccatgaggctgctatcacctgtgcgtgtgcccaattacaatctgataattatggatgaagcccactttacagacccggcttctattgctgcaagaggatatatcagtacacgtgttggtatgggggaagccgccgccattttcatgactgcaacaccccctggtacggccgatgcgtttccacagtctaatgctccgattcaagacgaggaaagagatatacccgaaagatcatggaactcaggcaatgagtggatcacggactttgcaggtaaaaccgtgtggtttgttccaagtataaaagcaggtaacgatatagcaaattgtctaagaaagaacggtaaaaaggtgatacaactatccagaaaaacgttcgataccgagtaccagaaaactaaactaaacgattgggatttcgttgtaactactgacatatctgaaatgggcgcgaactttaaagctgatagggtcattgatccaagaagatgcttaaaaccagtaatactgactgatggaccagaaagagtaatcttagcgggccctatgcccgtaaccgcggcaagcgctgcacaacgacgcggaagagtcggacgaaatccccaaaaagagaacgatcaatacattttcacaggtcaacctctgaataatgacgaagatcacgcgcattggaccgaagcaaaaatgcttttggacaacataaacacgccagaaggcataattcctgcattgttcgaacccgagcgagagaaaagcgcggctatagatggggaatataggttaaagggagaaagcagaaagacttttgtcgaactaatgcggcgaggtgaccttcccgtttggctagcgtacaaggtagcatctgaagggataaagtacacagacagaaaatggtgtttcgatggacaaagaaacaatcaaatcttggaggaaaacatggacgtggagatatggacaaaggaaggtgagaagaagaaactaaggcctcggtggctagatgctcgtacctatagtgatcctctggcattaaaagagttcaaggattttgcagcaggacgaaagtctatagccttggaccttgtaacagaaataggaagggttccaacccatctagcccaccgaacacgaaatgcattagataatttagtaatgttacatacaagtgagcatggtgggaaagcatatagacatgccgttgaagaacttcctgaaaccatggaaactttactattactaggactaatgatactcctaactggtggggcaatgctatttcttatatcgggtaagggaataggtaaaacttcaatcggcctaatttgtgttatagctagctcaggaatgttatggatggcagagataccacttcaatggattgcgtcggccatcgtattagagttctttatgatggtacttttaataccagaaccggaaaaacagcgaaccccacaagacaaccaacttgcatacgttgtaataggaattttaacactggcggcaattatagcggctaatgaaatgggactcctagaaactacaaaaagggatcttgggatgtctaaagaaccaggagttgttagtccaacatcatatctcgacgtagacctccacccggcaagcgcgtggactttatatgcagtagcaacaacagtaataacaccaatgttacgacatactattgaaaattcaacagcaaacgtttctctggctgctatcgctaatcaagcggtagttttaatgggattagataaaggctggcccatttcaaaaatggatttgggtgtaccacttttggccctaggttgctattcacaggttaatccattaacattaaccgcagccgtattactcctcataacccattatgcaattatcggacctggattgcaagcaaaagctacgagggaagctcaaaagcgcacagctgccggtattatgaaaaacccaacagttgatggaatcatgacgattgatttagatcctgtgatatacgactcaaaattcgaaaaacagttaggacaagttatgcttttagtattatgcgccgtccaactactactcatgcgaacctcgtgggcattatgcgaagccctaactctcgcgacgggaccaataactacactctgggaaggttccccgggtaaattctggaatactacaattgcagtatcgatggctaatatattcagagggagttacctagctggagcaggacttgcattttctatcatgaaaagcgtaggtacaggtaaacgtggtactggttcccaaggtgaaacactaggggaaaaatggaagaagaaacttaaccaattaagccgtaaagagtttgacctttataagaaaagtggaataactgaagtagaccgcacagaagccaaagaaggtctgaaaagaggagaaattactcatcatgctgtaagtcgagggtcagcaaaattacaatggttcgtcgagcgcaacatggtaatacccgaaggcagagtgatagacctaggatgtggtcgcggtggctggagctattactgcgccggactaaagaaagtaactgaagtcagaggttacactaaaggtggaccaggacatgaagaaccagtgcccatgtctacttatggttggaatattgtaaaacttatgagtggtaaagacgtcttttatctaccgccagaaaaatgtgacacgttattgtgtgacattggtgaatcatctccctctccaaccgtagaagagtctagaaccatcagggtactaaagatggtggaaccttggctgaaaaacaaccaattttgcatcaaagttcttaatccgtatatgcctacggtcatagaacatctagagagattgcagagaaaacatggaggtatgctggtaagaaatccactttcacgaaactctacccatgagatgtattggatttcaaacgggacgggaaacatcgttgcttcggtaaacatggtttcgcgattgttactcaacaggtttactatgacacacagacgacctacaatagaaaaagacgtggacctaggtgccggaaccagacatgtaaacgccgaacccgagacccccaacatggatgtcattggagagagaataaagcggatcaaagaagaacacaactcaacttggcactacgacgatgaaaatccatataaaacgtgggcttatcatggttcatacgaggtaaaggctaccggaagtgcttcaagtatgattaatggcgtggttaaattactaacaaagccctgggacgttgtacctatggtgacccagatggcaatgacagatacaaccccattcggacaacagagggtatttaaagaaaaggttgacactaggacgccccgttcaatgcccggaactcgaagggtaatgggaataacagcagaatggctctggagaacattgggaagaaacaaaaagccaaggttatgcacaagggaagagttcaccaagaaagtacggactaatgccgcaatgggtgcagtctttaccgaggaaaaccaatgggactccgccaaagccgcagtagaagatgaagacttttggaagttggttgaccgagaaagagaattacacaaattaggtaagtgtggatcatgcgtatataacatgatgggaaagcgagagaagaaattaggggaatttgggaaagccaagggatctcgcgcaatatggtatatgtggttaggagccagatatttggagttcgaagcacttggctttctaaacgaagatcactggtttagcagagaaaactcttacagcggggtggaaggtgagggattacacaaattaggatatatcttaagggacatttcaaaaatcccaggtggagcgatgtacgctgacgataccgcaggatgggacacacgaataacagaagatgatttacataacgaagagaaaatcacacagcaaatggatcctgagcacagacaattagctaatgctatttttaagctgacataccaaaataaggtagttaaagtacaacgaccaacaccaaccggcaccgttatggatataatttcaaggaaagaccagcgaggatccggacaagtcggaacctatggactcaacacgtttacaaatatggaagctcaattaataagacaaatggaaggggaaggtgtactctctaaagccgacttagaaaacccacatttgccagagaagaaaattactcaatggttagaaacaaaaggagttgaaagattgaaacgtatggcaatttctggcgatgactgtgtcgttaaacctatagatgatcggtttgcaaatgctctactagccctaaatgacatgggaaaagtccgaaaggatatcccgcaatggcaaccatcgaaaggatggcacgattggcaacaggtcccattttgctcacatcactttcatgaattaatcatgaaggatggacggaagttggttgtaccttgcagacctcaagacgaacttataggtagagctcggatctcacagggtgccggatggagccttcgtgaaacagcctgcctcggaaaggcttacgcacaaatgtggtcgttaatgtatttccatagacgagacttaagacttgcctccaacgcgatatgctctgctgtaccggtacattgggtaccaacaagtcgaacaacgtggtcaatccacgcacatcaccagtggatgacaacggaagacatgttaacagtatggaacagagtatggattgaagataatccatggatggaggataaaacccccgttactacgtgggaaaacgtaccttacctagggaaacgggaggatcagtggtgtggatcacttattggtctaacaagtcgtgctacatgggcacagaatattccaacagctatacaacaagtaaggagtttaataggcaacgaggagttcttggattacatgccgagcatgaaacgctttcggaaagaagaagaatcagaaggagcaatatggtag

SEQ ID NO: 23424 - RNA, 9873 nt, synthetic construct
  misc_feature 1..9873: note = derived and/or modified CDS sequence (opt6) from DENV-3__FJ639793__SS-prME
  source 1..9873: mol_type = other RNA
acaagcctttgtctaatgatgatactaccagcaacactggcatttcaccttacgtcacgcgatggagaaccacggatgatcgtagggaaaaacgaaagaggaaaatcccttctattcaaaactgcgtcaggaataaatatgtgcacattgatagcgatggatttaggtgaaatgtgtgatgataccgttacatataaatgtccgcacataacagaagtggaaccggaagatatagattgctggtgtaatctaacatctacatgggttacatatggcacatgcaatcaagccggtgaacatcggcgagataaacggtctgtagcgttagcaccccatgtagggatgggactcgacacacggactcaaacatggatgtcagcagaaggagcttggcgacaagtggaaaaagtggaaacctgggctctacgccaccccggattcaccattctagctttgtttctggcgcattatattggtacatcattgacccaaaaagtagtaatattcatactattaatgttagtaactccgagtatgactatgcggtgtgttggtgttggaaatagagatttcgttgaagggttatcaggggcaacttgggtagacgtagtccttgaacacggtggatgtgtaacaaccatggccaaaaacaaacccacactcgacatcgaattacagaaaactgaagctacccagttagcaaccctacgtaaactatgcatagaaggaaaaataacaaacatcaccactgattcaagatgtcccacccaaggtgaagctgtactcccagaagaacaagaccaaaattacgtttgcaaacatacctacgtcgacagaggttggggcaatggttgtggtttgtttggtaaagggtcattagtcacatgtgctaaatttcaatgccttgaacctatagaagggaaagtagtacaatacgaaaatctcaaatatacagtaataataacagtgcacaccggagaccaacatcaggtaggaaatgagacacaaggcgttactgcagagattacgccacaagcaagtactacggaagcaatcctcccagaatatggaactttaggtttggagtgtagccctaggaccggactagattttaacgaaatgatattgctgacaatgaaaaataaagcgtggatggttcatcgccaatggttctttgacttaccattaccgtggacaagcggcgctactaccgaaacaccgacatggaatcgaaaagaactgctagttacatttaaaaacgcacatgcgaagaaacaagaagttgtggtgctagggtctcaagaaggcgcgatgcataccgcactaacaggagccactgaaatacaaaattcgggcggaacttcgatatttgccggacacttgaaatgtcgcctgaaaatggacaaactcgaattgaaaggaatgtcatatgcaatgtgtaccaatacattcgtactcaagaaagaagttagcgaaacacagcatggcaccatacttataaaagtggagtataaaggagaggatgtaccatgtaaaataccgttctctactgaggatggacaaggaaaagcacataatggtagattaattacggccaacccagtagtcacgaagaaagaagaacccgtgaatattgaagctgaaccaccatttggcgaaagtaatattgtaataggaataggtgataacgcattaaaaataaactggtacaagaaaggatcatcaataggaaaaatgttcgaagcgacagcccgtggggcacggaggatggcgattctcggtgatacagcgtgggattttggctcagtgggtggagtccttaatagcctaggaaaaatggtacaccagatatttggcagcgcttatacggcactattttctggtgtttcgtgggtaatgaaaataggcattggcgtccttctaacgtggatagggttaaatagcaaaaatacttcaatgtcattctcttgcatagctattggaataatcacattatatttaggcgcagtggtgcaggcggatatgggatgtgttatcaattggaaagggaaagaactgaaatgtggtagcggtatatttgtaacgaacgaggttcatacgtggactgaacaatataaattccaagctgattcgccgaaaaggttagcaacagctatagctggagcctgggaaaacggagtctgtggtataagatctacaacgcgaatggaaaatttattatggaaacaaatagcaaacgaacttaattatatcctttgggaaaataatatcaaattaacagtagttgtgggagacataattggggtgttagaacaaggaaaacgaaccttaactccgcagccaatggaattaaaatattcatggaaaacttggggcaaagctaaaatagtgactgcagaaactcaaaattcaagtttcataatagatggccctaacacgccagaatgtccgtcggcaagtcgtgcatggaatgtctgggaagtagaagattatggttttggagtatttaccacaaacatttggcttaaacttcgtgaagtgtacacgcagttatgtgaccatagacttatgagcgcagcggtaaaggacgaacgggcagttcacgcggatatgggatactggattgaaagccagaaaaatggcagctggaaactagagaaagcatcacttatcgaagttaagacatgtacctggccgaaaagccatacactatggagcaatggagtattggaatcagacatgatcataccaaagagcttagcaggaccaataagccagcataactatcggcctggatatcatacacagaccgcaggtccctggcatttagggaaactggaattagatttcaactactgcgaaggaacaactgtagtaataacagaaaattgtggaacgcgcggcccaagcctaagaacaactacagtatctggcaagttaatacatgaatggtgttgtcgctcatgcacattaccacccttgaggtacatgggagaagatggttgttggtacggcatggaaatacgtccaacttcagaaaaagaagaaaatatggtcaaaagtctggtgtccgctggcagcggcgaagtagacaactttaccatgggtgttctttgtttagcaatattgtttgaggaagtaatgcgcggaaagtttgggaagaaacatatgatagccggtgtgtttttcacatttgtattgcttttatctggacaaataacatggcgagacatggcacacacactcataatgataggtagtaatgcaagtgatagaatggggatgggcgtgacctatctcgccttaattgctacttttaaaattcagcccttcctcgcgttgggattcttcctccggaaattaacatcgcgggagaacctattacttggtgtcggattggctatggcaacaacgttacaattgcctgaggacatcgaacaaatggctaatggaattgctctaggacttatggcattaaagctaatcacacaatttgaaacctatcaattatggactgcccttatttctcttacatgtagcaatactatattcaccttgacagtagcttggagaacagcaaccttaattctagcaggagttagtttactcccggtctgtcagtcatcgtcaatgcgtaaaacggattggcttccaatgaccgtagcagcgatgggcgttccaccactcccattattcatattctcacttaaggacacccttaaaaggcgctcttggcccctaaacgagggtgtcatggcggtcgggcttgttagtatactcgcgtctagtttattgcgaaatgacgtaccaatggctgggcctctagtggctggagggttacttatcgcttgttacgtcataacggggacctcagccgatttgacagtcgaaaaggcagccgatgtcacgtgggaagaagaagcagaacaaaccggagtaagccataatttaatgataacagtagatgacgatggaacgatgcggattaaagatgatgaaactgaaaacatcttgacagttcttctgaaaaccgctttgttgatagtaagcggaatttttccatattcgattccggcaactctattagtatggcatacgtggcaaaaacagacacaacgttcaggtgtcttgtgggatgttccaagtccccctgaaacacaaaaggccgaattagaggagggcgtttatagaataaaacaacaaggcatctttggaaagacacaagtgggagttggtgtgcaaaaagaaggggtctttcatactatgtggcatgtcacaaggggagccgttcttacatacaacggtaaaagattagaaccaaattgggctagtgtgaagaaagatttaatctcttacggaggcgggtggaggctatctgcacagtggcaaaaaggtgaagaagttcaagttatagcggtggaaccgggcaaaaatcccaaaaattttcaaactatgccaggaacatttcaaaccacaaccggggagatcggtgccattgctcttgacttcaaacccggaaccagtgggtccccaataataaacagagaagggaagatagtaggattgtacggaaacggtgtagtaaccaaaaatgggggatacgtctcgggaattgctcaaaccaatgcagagcctgacggacctacacctgaattagaagaagaaatgttcaagaaacgtaatttaacaataatggacttgcatccaggttctggaaaaacacgaaaatatttgccagccatcgtacgcgaagcaataaaaagaagactcagaactttaatcctcgcgcctacaagagtagtggcagcagagatggaagaagcgttaaaaggactcccgataagataccaaaccacagcaactaagagtgaacatacaggcagagaaatagtagaccttatgtgtcatgctacctttacaatgagattgctaagtccagttcgagtgcctaattacaacttaataataatggacgaagcacatttcacagacccagctagtattgcagccaggggatacatttcaacgcgagtaggcatgggagaagcagcagctatattcatgacagcaaccccaccgggaacagcagatgcgttcccccagtcaaatgcgcccatacaggatgaggaacgagatatacctgaaagatcgtggaatagcggtaacgaatggataacagattttgcaggaaaaactgtatggtttgtcccgtctatcaaagctggcaacgatatcgctaattgtttaaggaaaaatggcaagaaagtaatccagttgtctagaaaaacatttgacaccgaataccaaaagaccaaactaaatgattgggatttcgttgtgaccactgacatatcggagatgggcgctaattttaaagcggatcgagttatagacccacgcagatgtctcaagcccgtaatacttactgacggacctgagcgcgttattcttgcaggtcccatgcctgttacagcggctagcgctgctcaaagaagagggagggttggacgtaacccacagaaagagaacgaccaatacatatttacaggacaacctctaaataatgatgaagatcatgcccactggacggaagcgaaaatgctacttgacaacataaacacaccagagggtattattcccgctttattcgaaccagaacgcgaaaagtcagcagccattgacggcgaatatcgactaaaaggcgaatcacggaaaacattcgtggaactaatgaggagaggtgatctacccgtttggttagcacataaagtggctagtgagggtattaagtataccgatcgaaagtggtgttttgatggtcaaagaaataatcagattttggaagagaacatggacgtagagatatggacaaaagaaggggagaaaaagaaattgcgaccgagatggctggatgctcgcacctacagcgacccattggctttgaaagagtttaaggattttgccgctggtcggaaatctattgctcttgatttagtcactgaaattggtagagtcccaactcacctggcccaccgaacaagaaacgcactagacaacctggtcatgctgcatacatctgagcatggagggaaagcatatagacatgctgtggaagaactgccagaaactatggagactcttctgcttctgggattaatgattctattgactgggggagcgatgttatttttgatttcgggaaaaggaattggtaaaaccagtattggccttatatgcgtgatagcatcaagcggtatgttatggatggctgaaatacccctccaatggatcgccagtgctatagtccttgaatttttcatgatggtactactaataccagaacccgaaaaacaaaggacaccacaggataatcagttagcctatgtcgtaataggaatcttaacattagcggcaataatagccgctaacgaaatgggacttttggagaccacaaaacgagatctgggaatgtcaaaggaacctggagttgtgagtcccacatcatatttagatgtagatttgcatcctgcaagtgcatggactttatatgcagttgccacaacagtgataactcctatgctaagacatactattgagaactcgacggcaaacgttagcttggcagcaattgcaaatcaagcagtagtattaatgggacttgataagggatggccgatttctaaaatggatttaggagttcctttactagctctgggctgttactcccaggtaaaccctctaacgttaacggcggcagtattactacttatcacacactacgctataataggtcccggcctccaagctaaagcaacacgagaagcccagaaaagaacagcagcaggtataatgaaaaatcctacagttgatggaattatgactatagacctagacccagtaatatatgattctaaatttgaaaaacaactaggccaagtaatgttgttagtgctctgtgcagtacaattattacttatgcgaacaagttgggcactgtgtgaggctctaacactagcgactggacccattaccaccttgtgggaaggaagtcctggtaaattttggaataccactatagccgtatcaatggcaaatatttttcgaggaagttatttggctggtgctggattagcattcagtgtgatgaaatctgtcgggaccggcaagcgtggcacaggatcacagggcgagacgctgggtgaaaaatggaagaagaaattaaaccaattatctagaaaagagttcgacttatacaagaaaagcggaattacggaagtagaccgtacggaagctaaggagggactaaaaagaggagagataacgcaccatgccgtaagccgaggaagtgctaaacttcaatggtttgtagaacgaaacatggttattcctgagggacgagtaatagatttaggatgcggacgaggaggatggtcatattattgcgccggactcaaaaaggtgacagaagtacgcggatatactaaaggtggaccgggtcacgaggaaccagtaccaatgagcacttacgggtggaatatagtgaaactaatgagtggaaaagatgtcttttacctgcctcccgaaaagtgtgatacattactatgtgacatcggagaaagttcgccctcaccaactgtcgaagaaagcaggacaattcgtgtattaaaaatggttgaaccatggctcaaaaataaccaattctgtatcaaagttttaaacccatacatgccaaccgttatagaacatcttgagaggttgcagaggaaacatggtggtatgcttgtgcgaaaccctctaagtcgaaattctacccacgagatgtactggatttcaaatggaactggtaacatagtagctagcgtaaatatggtctcacggctattgttaaatcgctttacgatgacacaccgaagacctactattgaaaaagatgtcgatctaggagcaggaactagacatgttaatgccgagcccgaaacgccaaacatggacgtaataggggaacgaataaaacgtattaaggaagaacacaacagtacttggcattacgacgacgaaaatccatacaaaacctgggcataccacggttcatacgaagtcaaagctacgggctcagcaagttccatgatcaatggtgtcgtaaaactcctaacaaaaccttgggatgtggtacccatggtgacacaaatggcaatgacggatacaacaccatttggacaacaaagggtctttaaggaaaaagttgatacaaggacccccagatccatgccaggcacacgaagagtcatgggcataactgctgaatggctatggaggacactaggaaggaataagaaacctcgcttatgtacacgagaagaatttacaaagaaagtccgtaccaatgcagccatgggggctgttttcactgaagagaaccaatgggacagtgcgaaagcggcagtagaagacgaagatttttggaagctagtagaccgagaaagggagcttcataaattggggaaatgtggatcttgtgtttataacatgatgggcaagcgagagaagaaactaggtgagtttggtaaggcaaaaggctcacgtgcaatatggtatatgtggcttggcgcacgttatttagaatttgaagccttgggtttcttgaacgaggaccactggttcagtagagaaaatagctacagcggtgttgagggagagggactacataaactaggatacatactgagagatatatcgaaaatcccagggggagccatgtacgctgatgacaccgctggttgggacacgcgtataacagaagatgatttgcataatgaagagaaaataactcaacagatggacccagaacacaggcagctcgctaatgcaatctttaaacttacataccagaacaaagttgttaaagtacaaaggccaacacctacgggaacggtcatggatattataagtcgaaaagaccagcgtggttctggtcaagtgggcacgtatggattaaacacattcacaaacatggaagcacagctaatacgccaaatggaaggggaaggagtactcagtaaagcagaccttgagaatcctcacctaccggaaaagaagataacacaatggctggaaacaaaaggagtcgaacggctcaagcgcatggctataagcggcgacgattgcgtagtaaaacccatcgatgatcgattcgcaaatgccttgctggctctcaatgatatggggaaagttcgcaaggacataccgcaatggcaacctagtaagggatggcatgattggcaacaagtaccattctgctcccaccatttccatgaactgatcatgaaagacggaagaaaacttgttgtaccatgccgcccccaagatgaattgatagggagagctcgaatctctcaaggggctgggtggagcctcagagaaactgcatgcttgggcaaggcatatgctcaaatgtggagcttgatgtactttcaccgaagggatctgcgtcttgcatcaaatgcgatatgtagtgccgtgcctgtacactgggtgcccacatcacgcacgacctggagtatacacgcccatcaccaatggatgactacagaggacatgttaactgtgtggaaccgggtatggattgaggataatccttggatggaagataaaactccggtaacaacctgggaaaatgtaccttatcttggtaagcgagaagatcaatggtgtggcagcctcataggtctcacatctcgagcaacctgggcacaaaatattccgacagcaattcagcaggtaagaagtttgatcggtaacgaagaatttttagattatatgccgtctatgaaaagattcagaaaggaagaggaaagcgaaggagccatatggtaa

SEQ ID NO: 23425 - RNA, 9873 nt, synthetic construct
  misc_feature 1..9873: note = derived and/or modified CDS sequence (opt6) from DENV-3__FJ639795__SS-prME
  source 1..9873: mol_type = other RNA
acgtctctttgcctgatgatgatcctaccagcagcactcgctttccatctcacgtcaagggatggagaaccacgaatgatcgtggggaaaaatgaaaggggaaaatcattactatttaaaactgcaagtggaataaatatgtgtacattaatcgcaatggacttaggagaaatgtgtgacgatactgtgacatacaaatgcccacatataactgaagttgaaccagaagatatagattgctggtgcaaccttacctcaacatgggttacttacggaacgtgcaaccaagcgggtgaacatagaagggacaaacgaagtgtagcattggcaccacatgtaggtatgggactagatacacgaacacaaacgtggatgagtgctgaaggagcatggcgccaagtagaaaaagtagaaacatgggcgctaagacacccgggatttacgatattagcactcttcctagcacactatataggcacatcactaactcaaaaagtggtaatattcattctgctgatgttagtaacgccaagcatgacgatgcgatgcgtcggggtaggcaacagagattttgtcgaaggtttaagcggtgcaacgtgggtagacgtcgttttagaacatggaggatgtgttacgactatggccaaaaacaaaccaacattggacatagaactacagaaaacagaagcgacgcaacttgctaccttaagaaaattatgtatagaaggaaaaataacaaacattacgacagactccaggtgcccgactcaaggagaggcggttctgccagaggaacaagatcaaaattatgtttgtaaacatacatacgtcgatcgaggatggggtaacggatgtgggttatttggtaaaggctcgttggtcacatgtgctaaatttcagtgtctagaaccaatcgaaggaaaagtcgtacaatacgaaaacttaaaatacacagtaatcataactgtccacaccggtgaccagcaccaagtcggcaacgaaacacaaggagtgacagcggaaatcactccacaagcatcgaccacggaagccatcttaccggaatatgggacactaggtctagaatgtagcccgcgtacggggttggacttcaatgaaatgattttactcaccatgaaaaacaaagcctggatggtgcatagacaatggttctttgaccttcccttaccctggacttcaggcgctactacggagacaccaacatggaatagaaaggaactcctagtgacgtttaaaaatgcccacgccaagaaacaggaagtagtggttttaggcagtcaagaaggtgctatgcatactgcgctaactggagctacagaaatacaaaattctggaggaacaagcatattcgcgggacatctcaaatgtagactaaaaatggataaacttgaattaaagggcatgagttacgcgatgtgcaccaatacgtttgtactcaagaaagaagtatcggagacccaacacgggaccattttaataaaagtggagtataaaggcgaggacgtcccatgcaaaatcccatttagtacggaagacgggcaaggaaaagcacacaacggtcgcctaataacagctaatccggtggtaactaagaaagaggaacctgttaacatagaagcagaacctccttttggcgaatcaaatattgttattggaatcggagacaacgcattaaaaattaattggtacaaaaagggtagctctataggaaagatgttcgaggcaacagcacgaggagcaagacgaatggcaattttaggggacactgcgtgggactttggcagtgtcggtggggttttaaacagtttgggaaaaatggtacaccaaatattcggtagcgcatatactgccttatttagcggagtgtcttgggttatgaagataggaattggagtattgttgacgtggataggtctgaatagtaaaaatacttcaatgagtttcagttgtattgcaataggcataattacattatatctaggtgcggtagtgcaagccgacatgggatgcgtaataaactggaaaggaaaagaacttaaatgcggttctgggatatttgtcacaaatgaagtacatacgtggacagagcagtataaatttcaagccgactcacctaaacgtctggcaaccgctatcgctggcgcttgggaaaacggtgtttgtggaatacggagtactactaggatggaaaaccttctatggaagcaaatagccaatgaattaaattacattttgtgggagaacaatattaagctgacagtagtagtaggcgacactatcggtgtattagaacagggtaaaagaactctcactcctcaacctatggaattaaaatattcatggaagacatggggaaaagcaaaaatagtaactgctgaaacacaaaacagtagttttattatagatggacctaacacgcctgaatgcccctctgcaagtagagcatggaacgtatgggaggtcgaagattatggcttcggtgtctttacaacaaatatatggctgaagctaagagaagtttatactcaactctgtgaccacagattaatgagtgcagcagtcaaagatgaaagggcggtacatgcagatatgggctattggatagaatcacagaaaaatggtagctggaagttagaaaaggccagcttaattgaagtcaaaacgtgtacatggccaaaatcccatacattatggtcgaatggtgttctagaatcagatatgataataccgaagagtttagcaggacccattagccaacataactatcgtccgggataccacacccagacggcaggtccatggcatctcggaaaacttgaactggatttcaattattgtgaaggaactacggtagttataacggaaaattgtggcacgcgaggtccctcgctaagaacaactaccgtcagcggcaaacttatacatgaatggtgctgcagatcatgcacgctaccccctttaagatatatgggcgaagacggatgctggtatggtatggaaattcgacctatttcagaaaaagaagagaacatggtaaaaagcctcgtttccgctggaagtggagaagtagataattttacaatgggagtactttgtttagcaatattgtttgaagaagtcatgagaggaaaatttggaaagaaacatatgatagctggagtattctttacattcgtattattactaagtggtcagattacttggcgtgatatggctcatacactaatcatgattggatcgaatgctagtgataggatgggtatggggataacgtacctcgcattaatagctacattcaaaattcaaccctttctcgccctaggattctttttaaggaagttgacaagtagagaaaatttattacttggagtcggtttggcgatggcaacaacattacaactaccggaagacatcgaacaaatggccaacggtatagcgctcggcctaatggctttgaaactaataacgcagttcgaaacataccaattatggacggcgttgatttcacttacatgtagcaacaccatatttaccttaactgttgcgtggcggacagcaactctgattcttgcgggagtaagtcttcttccagtttgtcaatcatctagcatgcgaaaaacagattggctgcccatgacggttgcggctatgggtgttcctccattacctttattcatattcagcttaaaagacacactaaagcgccggagctggccactaaatgaaggagtaatggcggtaggcctagttagtatcctagcatcaagtcttctaagaaatgatgtaccgatggctggtcccttggtcgctggtgggctgctaatcgcctgctatgtaatcacgggcacgagcgccgatttgacggtagagaaagcggctgatgtgacctgggaagaagaggcagaacaaacgggagtatcgcataacttaatgatcactgtagacgatgatggaacaatgagaataaaagacgatgagacggagaacattcttacagtcctactcaaaaccgccttattaatagtcagtggaatatttccatactccatacccgcaacactacttgtatggcatacatggcagaagcaaacgcaacgcagcggcgtgttatgggacgtaccttcaccaccagagacacaaaaggcagaacttgaagaaggtgtatatcgcattaaacaacaaggaatatttggaaaaacacaagttggtgtaggggtccaaaaagagggtgtttttcacacaatgtggcacgtgacaagaggggctgttttaacctacaacggtaaacggttagagcctaattgggcaagtgtgaagaaagacctaataagttacgggggaggatggagactaagcgcccagtggcaaaaaggcgaagaagtacaagttattgccgtggaacccggcaaaaatccgaaaaattttcaaacaatgcccggaaccttccaaactaccacaggagaaataggcgcaatagcattagatttcaaacctggtacaagtggctcaccaatcattaacagggaaggaaaagttgtcggtctttacggtaacggagtagtaacgaaaaacgggggatatgtgtccggcatcgcccaaacaaatgcagagccggacggccctacacctgaacttgaagaagaaatgttcaagaaacgaaacctaactataatggatttacatccaggctcggggaaaactcgcaaatatttgccggcaatagttcgagaggcaattaagagaaggttaagaacattgatacttgcaccaactcgagttgttgcagcagagatggaagaagcgttgaagggattgccaatccgttatcaaaccactgccaccaaatccgagcatacaggtagggagatcgtggatttaatgtgtcacgctacgtttacaatgagactattgtctcctgtacgagttccaaattataatctgataatcatggatgaagctcactttactgaccctgcctcgatagccgccagaggatatataagtaccagagtggggatgggtgaggcggcagccatctttatgactgcgacgccacccggaacagctgacgcatttccgcagtccaatgcaccaatacaggacgaagaacgagatataccagaacgcagttggaatagtggcaatgaatggataacagactttgcaggcaagactgtctggtttgtgccatcaataaaagcaggtaacgatatagcgaattgcctacggaaaaacgggaagaaagtcatacaattatcaagaaaaacatttgatactgagtatcagaaaacaaaacttaacgattgggacttcgttgtaacaactgacatttctgaaatgggagctaatttcaaggccgatagagtaatcgacccgagacgttgtttgaaaccagtaattttaacagacggacctgaacgagtaatattagcgggcccaatgccggtaacagcggcaagcgctgcacaacgaagaggaagggtagggcgaaacccacagaaagaaaatgatcaatacatattcacggggcaacccctgaacaatgacgaagatcatgcccactggacagaagcaaaaatgttgcttgacaacataaacacacctgagggtataatcccggcactatttgagccggaaagggaaaaatcagcagcaattgatggtgagtatcgcttaaaaggcgaaagtagaaagacgtttgtggagctaatgagaagaggtgatctgcctgtgtggctcgcgcataaagtcgccagtgaaggtataaagtacacagaccggaaatggtgctttgatggacaaaggaataatcagatattggaagagaatatggatgtggaaatatggactaaggaaggggagaagaagaaattgagaccaagatggttagacgcgcggacatatagcgacccactagcactaaaagaatttaaagacttcgcagctggtcgaaaatcaattgctttggacttagtgacagaaataggcagagtgccgacacatctcgcacacaggacccgaaacgctctggacaatcttgtcatgctacacacgtctgaacatggcggtaaagcctatagacatgctgtggaagaattgccagagacaatggaaacgctactgctgctcggacttatgattctattaactgggggcgctatgctatttttaattagtggaaaaggtataggaaaaacgagcatcggattaatatgcgtgatagcaagttcaggcatgttgtggatggcagaaatccccctacaatggatagcctctgctattgtccttgaatttttcatgatggtactacttatacccgaaccagaaaaacaacgtacaccccaagataatcaactagcatatgtggtgataggtatacttacacttgcggctactatagccgcaaatgaaatggggttgctcgaaactacaaagagagatctcggaatgagtaaggaacctggagtagtctcgcccacatcgtacctggacgtagacttacatccagcatccgcatggactctctacgcagtcgccacaaccgttattaccccaatgttaagacacacgatagagaactcaacagccaatgttagtttagctgcaatagcaaaccaggcagtagttttaatggggctagacaaaggctggccgatatcgaagatggacctcggagtacctctcctagctttaggatgttactctcaagtaaatccactcacattaacagcagccgtactcttattgataactcattatgctattatcggacctggactacaggctaaagcaactagggaagcacaaaaacggacggcagctggtataatgaagaaccccacagtggatggaataatgacaatagatttagaccctgtaatatatgattccaagtttgagaaacaactaggtcaagttatgctcctcgtcctttgtgctgttcagctcctactcatgagaacaagttgggcgctatgtgaagccttaactctagcgacaggacctataacaacattatgggaaggcagtcccggaaaattctggaacacgacgatagcggtatcaatggctaacatattcagaggatcgtacttagcgggcgcaggtttagcattcagcataatgaaaagtgttgggaccggcaaaagaggaacgggcagtcaaggcgaaacgttaggagagaaatggaagaagaaattaaaccaactgagccggaaggagtttgatttatataagaaaagtggaattacggaagtagatagaaccgaggcaaaagaaggactgaaaaggggagaaatcacgcaccatgccgtttcgaggggctcggctaaacttcagtggttcgttgagcggaatatggtgataccagaaggtagggtgatagatctaggatgcgggagaggtggatggtcctactactgcgcgggtctaaagaaagtaacagaagttagaggctatactaaaggaggaccgggacatgaagaaccggtaccgatgagcacgtatggttggaacatagtaaaactaatgtcgggaaaagacgtcttttacttgccaccggaaaaatgtgataccttattatgtgacataggagagtcgtccccgagtcctactgtagaagaatctcgaactatacgagtcttaaaaatggtggaaccgtggttgaaaaataaccaattttgtataaaggttttaaatccctatatgcccacagtaattgaacatctagaaagactgcaaagaaaacacggtgggatgctagtaaggaatcctctatcaagaaacagtacccatgaaatgtactggataagtaacggaacaggaaatatagtagcttctgtcaacatggtctctagactattattgaaccgattcactatgacacatagaagaccaactattgagaaagatgttgatttgggagcaggaaccaggcacgtcaacgctgaaccagaaactcctaacatggatgtgataggagaaagaattaaaagaattaaagaagaacataatagtacttggcattacgacgacgaaaatccttacaaaacttgggcgtatcatggatcttatgaagtcaaagctacaggttcagcatcaagtatgattaacggagtagtcaaactgctaactaagccatgggatgtggtcccaatggtgacccaaatggctatgactgatactactccattcggccaacaacgggtattcaaagaaaaagtggatactagaacaccaagatccatgccaggaacacgtcgcgttatgggaataactgcggaatggctatggagaacactaggcagaaataagaaaccacgtttatgcaccagagaggaatttactaagaaagttcgcacaaacgctgccatgggtgccgtattcacagaagaaaatcaatgggactcagcaaaagcagcagtcgaagatgaggatttttggaagctagttgacagagaaagagaactacataaacttggtaaatgtggtagctgtgtttataatatgatgggaaaacgagagaagaaacttggggagttcggtaaggcaaaaggatctcgagctatatggtatatgtggttaggagcacggtatctcgaatttgaggctttagggttcctaaatgaagatcattggttttctcgcgaaaacagttattcaggagttgaaggagaagggttgcataaattagggtatatacttagagatattagtaaaatacctgggggtgccatgtacgccgatgatacggctggctgggatactagaataactgaagacgatctccataacgaagagaaaattacgcaacaaatggaccccgaacacaggcaacttgcgaatgcgatatttaaattaacataccagaacaaagtggtaaaagtgcaaaggcctactcctacaggcactgttatggatattatatctagaaaagaccagcgcggttctggacaggtgggtacttatggactcaatacattcaccaatatggaagcacagctaatccgacaaatggagggtgagggagtattgttaaaggctgaccttgaaaatcctcatttaccggagaagaaaataacacaatggcttgagaccaaaggagttgaacgactcaaaagaatggcaatatcaggagacgattgcgtggtaaaaccgatagatgaccggttcgccaatgcccttctggccttgaacgacatgggtaaagtaaggaaagacataccacaatggcagccatcaaaaggctggcatgattggcaacaggttcccttttgttctcatcattttcacgagctcataatgaaggatggaagaaaacttgttgttccttgtcgcccacaagatgaacttataggccgggcaagaataagtcaaggtgcgggctggtcactccgagaaaccgcgtgcttagggaaggcgtacgctcaaatgtggtcattaatgtacttccatagaagggatctaagacttgctagcaacgccatatgtagtgcagtgcctgtacattgggtcccaacctcacgtaccacatggagtatacacgcacaccaccaatggatgacaacggaagatatgttaaccgtgtggaatagggtgtggattgaagacaatccttggatggaagataaaactccagtaactacttgggaaaacgtaccgtatttaggaaagcgcgaagaccaatggtgtggatctctgataggattaacgtcgcgagcaacatgggctcaaaatatccctacagccatccaacaagttaggtcattgataggcaacgaagagttccttgattatatgccttcaatgaagaggttcaggaaagaagaggaatcggaaggggctatatggtaa

SEQ ID NO: 23426 - RNA, 9873 nt, synthetic construct
  misc_feature 1..9873: note = derived and/or modified CDS sequence (opt6) from DENV-3__FJ639798__SS-prME
  source 1..9873: mol_type = other RNA
acaagtctttgcctgatgatgatcctgccagcagcattagcatttcacctgacttctagagatggggaaccacgtatgatagtaggtaaaaacgaaagaggaaaatcattactttttaaaacagcgtccgggataaacatgtgcacactaatagctatggaccttggagaaatgtgtgacgacacagttacatacaaatgtccacatattacagaagtagaaccggaagacatagattgctggtgcaatttaacatcaacttgggtcacatatggtacatgtaatcaagcaggagaacatagacgtgataaacgaagtgtagcgttagcaccccacgtaggaatgggattagatactcgaacacaaacatggatgagtgcagaaggagcatggcggcaagtagaaaaagttgaaacatgggctctaagacatccaggttttaccatactcgctctatttttggcgcactacataggtaccagcttaacacaaaaagtagttatttttattctacttatgctcgtaaccccatcgatgactatgagatgcgtaggtgtaggtaaccgcgacttcgtagaagggttgtcgggagcgacatgggtagatgttgttctagaacatggtggatgtgttactactatggccaaaaataaacctactcttgatatcgaactgcagaaaacagaggctacacaactcgctactctgaggaaactttgcatagaaggtaaaattacgaatataactacagacagtagatgtccaacccaaggcgaagcagtgctacctgaagaacaagatcaaaactatgtttgtaaacatacctatgtggatagaggatggggcaatggatgcggtttattcggaaaagggagcctagtaacgtgtgcgaaattccaatgtctagagccagtggaaggcaaagtagtacaatacgagaacttaaaatatacagttataattactgttcatacgggcgatcaacatcaagtagggaacgagacacaaggcgtaaccgcggaaataaccccacaggcttcaactaccgaagcaatactgcctgaatacggcacacttggccttgagtgtagtccacgtacagggctcgatttcaatgaaatgatactattaacgatgaaaaataaggcttggatggtacatagacaatggttcttcgacttaccactaccttggacgtcgggagcgacgaccgaaacgccaacatggaacaggaaagagttgctagttacattcaaaaatgcacatgccaagaaacaggaggtggtggtccttggaagccaagagggagcaatgcacactgctctgactggtgccacagagattcagaactctggaggtacttctatattcgcaggacatctcaaatgtagattaaaaatggataaattggaattaaaagggatgtcatatgcgatgtgtacaaacacattcgtcttgaagaaagaggtttccgaaactcaacatgggactatcttaatcaaagtcgaatacaaaggagaagatgtaccatgtaaaatcccatttagtacagaagacggtcaaggcaaagctcacaacggacgattaataacggcaaacccagttgttacgaagaaagaagaaccggtgaatattgaagccgaacctcccttcggggaaagcaatatagtgattggcattggagacaatgcactgaaaataaattggtataagaaaggcagtagcattggtaaaatgttcgaagccaccgctagaggagcaagaagaatggcaatacttggagacacagcatgggacttcggttcagtgggtggagtgcttaactcacttggaaaaatggttcatcagatattcggctctgcgtacactgcgctattttcgggcgtttcatgggttatgaaaataggcataggagtattactgacctggataggattaaattctaaaaacacatctatgtcattcagttgtattgctattggtatcatcacactgtacctgggagccgtagtacaagcggatatggggtgcgtcataaactggaaagggaaagaactcaaatgcggcagtggtatctttgtcaccaacgaagtccatacttggacggaacagtataaatttcaggcagacagtcctaaacgtttagccacggccattgccggtgcatgggaaaatggagtttgtggaataagatctacaactagaatggaaaatttactgtggaaacaaattgcaaatgaattaaattacatattgtgggaaaataacataaaacttactgttgtcgtaggagatattataggggttttggaacaaggtaaaagaacattaacccctcaaccaatggaactgaaatatagctggaaaacttggggaaaagctaaaatagtaacggcggagactcaaaacagtagttttataatagatggcccgaatacccccgaatgcccctcagcaagccgtgcttggaacgtctgggaagttgaagactatggttttggcgtatttacaaccaatatctggcttaaactaagggaggtgtatacgcaattatgtgatcaccgactaatgtcagccgccgtaaaagacgaaagagcagtacatgcagatatgggatactggattgagagccagaaaaatggatcatggaaattggaaaaagcatccttaatagaagttaaaacatgcacctggccgaaaagtcacaccctatggtcgaatggcgtcttggaaagcgacatgataatacctaaaagccttgctggacctatatcgcaacataactatcgtccgggctaccatactcagacagctggtccatggcacttaggaaaactagagttggacttcaattactgcgaagggacgaccgttgtcatcactgaaaactgcggtactcgtggtccttcactcagaacgactactgtatcaggaaaactaattcatgaatggtgctgtcggtcgtgtactttaccacccttacgctacatgggagaagatggatgttggtacggcatggagataagacctatttccgagaaagaagaaaatatggtaaaatcccttgtaagtgcaggatcaggagaggtggataattttacgatgggagtattgtgcctagcaatcttgtttgaagaagtaatgaggggaaaatttggcaagaaacacatgatcgccggtgtctttttcacattcgtactgctactatctggccaaataacatggcgtgatatggcacataccttaataatgatagggagcaatgcaagtgatagaatgggaatgggcgttacctatctagccctaatagcaacattcaaaatacagccctttctggccttaggatttttcctacgcaagctcacatcacgagaaaacctactactaggcgtaggactcgcaatggccacaacgttacaattacctgaggacattgaacagatggccaacggtatcgcccttggtttgatggctttaaaattaataacacaattcgaaacatatcaactctggacggctttgatcagtctaacctgtagcaatactatcttcacattaacagtagcatggcgaacggcaacattaatattggctggagtgtcattactacccgtatgtcagtcctcatctatgcggaaaacagattggctacccatgacggtagctgcgatgggagtcccacccctacctctatttatattttccttgaaggacacattaaaacgtcgctcttggcccttaaacgaaggagtgatggcggttggtttagtgagtattctagccagtagcttactacggaatgatgtcccaatggcaggtccattagtagcgggcggcttactcattgcttgctatgttataacaggaacgtcagctgatttgactgtagaaaaggcggcagatgtaacatgggaagaagaagctgagcaaacgggagtttcccataacctcatgataacagtagatgatgatggcacaatgagaataaaggatgatgaaactgaaaacattttaacagtcctattaaagactgcattacttattgtgtctggcatctttccctacagtattcctgccacgctcttagtttggcatacttggcagaagcagacacaaaggtccggcgtactatgggatgtcccaagcccaccagagactcaaaaagcagagttggaagaaggggtctacagaataaaacagcaaggtatcttcggaaagacacaggtaggtgtaggcgtacaaaaagagggagtatttcatacgatgtggcacgtcacacgcggtgcggtgctaacatataatggtaaaagactagaaccaaattgggcgtcagtcaagaaagacctaatatcatacggaggagggtggagattgtccgctcaatggcagaagggggaagaggtccaagtaatcgccgtcgagccaggaaagaatcccaaaaattttcagacaatgccaggtacatttcaaactactacaggagagatcggggccatagcgctagattttaaacccggaacttcaggaagtccgataatcaaccgggaaggaaaggtagtaggtctgtacggcaacggtgtagtgaccaaaaatggtggttacgtaagtggaatcgcccaaactaatgccgaacccgatggcccaactcccgaattagaagaagaaatgttcaagaagagaaacttaacaataatggatctacatccgggaagtggcaagacaaggaaatatctgccggctatagtccgtgaggcaataaaaaggaggctaagaacactcatcttggcaccaactagggtcgtagcggctgaaatggaagaggccttaaaaggcctacccataagataccaaacaaccgctacaaagtccgagcacacaggaagagaaattgtggacctaatgtgccatgctacatttacgatgagactactctcacccgtccgagtacccaactataatctcataataatggatgaagctcatttcaccgatcccgcatcaatagccgcgagaggttatataagcacccgagtgggaatgggcgaagcggctgcaatatttatgacagctactccgcctggaacggctgatgcatttccacaaagcaacgctccaatacaagatgaagaaagagatatacccgaaagatcctggaactcagggaacgaatggataaccgactttgcagggaaaacagtctggtttgtacccagtataaaagcaggcaatgatatagctaattgtctgcgtaaaaatggaaagaaagtgatacagctatcacggaagacgttcgatactgagtaccagaagactaagctcaatgactgggatttcgtagtaacgacagatattagtgaaatgggagcgaatttcaaagcggatcgagtaatagaccctcgtcgctgtcttaaacctgttattctcacagacggacccgaacgagttattttggcaggaccgatgcctgtcactgccgcgagcgctgctcagcgacgtggacgagttggtagaaatcctcaaaaagaaaatgatcaatacatatttactgggcaacccctaaacaatgatgaagaccatgcacactggaccgaagccaagatgctgcttgataacatcaacacccctgaaggtattatccctgcgctatttgagccggaaagagagaaaagcgccgcaatagatggggaatatcgcttaaaaggagaatcccgaaagacattcgtagaactaatgagaagaggtgaccttcctgtatggctagcgcataaagtagcgagtgaaggcatcaaatataccgatagaaaatggtgtttcgatggccaaagaaacaatcaaatactcgaggaaaatatggatgtcgaaatctggacaaaagagggtgagaagaagaaactaaggccaagatggttagacgcacgaacatacagtgatcctctggcattgaaagagtttaaggattttgctgctgggagaaaatctatagcattagatttggtcactgaaataggtcgagtacccacccatcttgcacacagaacaagaaacgcattagataatttagttatgttacatacatctgaacatggaggtaaagcctaccgacatgcagttgaagaactcccagaaacaatggaaacactactccttttgggcctgatgatactattaacgggcggtgctatgctatttcttatctcaggtaagggcattggtaaaacgtctataggtcttatatgtgtaatagcgagctcaggaatgctctggatggcagagataccccttcagtggatcgcatctgcgatcgtattagaatttttcatgatggtcctcttaataccagaacccgagaaacaacgtacaccgcaagataaccaacttgcctatgtcgtgataggaattttaacattagcagccaccatagctgcgaatgaaatgggactgctagaaacaacaaagagagacctaggtatgagtaaagaaccaggagtagttagccctacatcatatttggacgtagatctgcaccctgcatcagcgtggacattatatgcagttgcaacaactgtaattacaccaatgcttagacatacgatagaaaactcaacagcgaatgtttcactagccgccattgcaaaccaagcagtcgtcctgatgggcttagacaagggatggcccataagtaaaatggacttaggtgtgccgctattagctttgggatgctacagccaagtcaaccctctaacacttacagcggcagtcctactattaattactcactatgcgatcataggtccaggtttacaggcaaaagctacgagagaggctcaaaaacgaaccgccgcgggtataatgaaaaatccaaccgtcgacggtatcatgacaatagacttagaccccgtcatttatgactcaaaattcgaaaaacaacttggtcaagtaatgctcctagtactatgtgcagtccaactgctgctcatgcgtacatcatgggcattgtgtgaagcattaacattagcaacaggaccgattaccaccttatgggaagggtcccctggaaaattttggaatacaacaatagccgtatctatggccaacattttccgaggatcatatttagcaggagccgggctagctttcagtattatgaaaagtgtaggaacaggcaaaagaggaacaggtagccaaggagaaactctaggagaaaaatggaagaagaaattaaaccaactgtcccgaagagagttcgatttatacaagaaatctgggataaccgaagtagaccggacggaagctaaggaaggcttaaaacgaggcgaaatcacacaccatgcagttagtcgcggctcggcgaaactgcagtggtttgtcgagcgtaatatggtaatcccagagggaagggtcattgatctcggttgcgggcgaggagggtggtcgtattattgcgccggcttgaagaaagtaaccgaggtacgtggatataccaaaggcggccccggacacgaagaaccagtccccatgagtacatatgggtggaatattgtaaagttaatgagcggcaaagacgtattttatttacctccagaaaagtgtgacaccctcttatgcgatataggcgagagttctcctagtcccacagtagaagagtcccgtaccatccgggtactgaaaatggttgagccctggcttaaaaacaatcaattttgtataaaagtactgaatccatacatgccaactgtaatagaacatcttgagcggttacaacggaaacacgggggaatgcttgttcgcaatccactgtctcggaatagtacacatgaaatgtactggattagtaatgggaccgggaacatagtagcctcagtaaatatggtgtcccgacttcttcttaaccgatttacaatgacacatagacgaccaacaattgaaaaagacgtcgacctaggcgccggaacccggcatataaatgctgaaccagaaaccccaaacatggatgtaataggtgagagaatcaagcgtataaaagaggaacataattccacatggcattatgacgaagagaatccatacaagacctgggcttatcacggatcatacgaggtaaaggctacaggctcagcaagcagtatgataaacggcgtcgtaaaactactgactaagccgtgggatgttgtccctatggttacacaaatggcaatgactgacacaacaccattcggtcagcagagagttttcaaagagaaagtcgatacacggaccccgcgacccatgcctggaacgcgtagagttatggggatcacagcggagtggttgtggagaactctagggagaaacaagaaaccgagattatgcaccagagaagagtttacaaagaaagtaagaactaatgctgcaatgggggctgtctttactgaggagaatcaatgggacagcgctaaagccgccgtagaagatgaagatttttggaaacttgttgaccgtgaaagggaattgcacaaattaggaaaatgcggttcttgtgtgtataatatgatgggtaaacgagagaagaaactcggagaatttggaaaagcaaaaggttcacgtgcaatatggtatatgtggctcggagctcgatacctagaatttgaggcacttggatttttgaatgaagaccactggtttagtagagaaaattcatattctggagttgaaggcgagggattacacaaattaggatatattttacgtgatatctcgaaaattccaggtggagcaatgtacgcagatgacaccgcaggttgggatacgaggatcactgaagatgatttacataacgaagaaaagataacacagcaaatggacccagaacaccgtcaactagccaacgctatatttaaattaacttaccaaaataaagtagtaaaggtgcaaagaccaactcctacagggacggtaatggacattataagccgcaaagatcagcgaggatcgggccaggtgggtacatatgggttgaatacttttacaaatatggaagcacaactgataagacaaatggaaggtgaaggagtactaagtaaagccgatctcgagaacccacatcttccggagaagaaaattacacaatggctggaaactaaaggtgtagaaaggctcaaacggatggccatcagtggtgacgattgcgtagtaaaaccaatagacgataggtttgcaaatgcgttactagcacttaatgatatgggcaaggtgcgaaaagatattcctcaatggcaaccctctaaaggttggcatgattggcaacaagtgccgttttgttcacaccattttcacgaactaataatgaaagacgggagaaaattggttgttccttgtagaccacaagatgagctcataggacgggcgcggataagccaaggagcaggatggtccttaagagagacggcatgtctaggtaaggcatatgctcaaatgtggagcctaatgtatttccacaggagagacctcagacttgctagtaatgcaatctgtagtgcagttcccgtacactgggtcccaacatcacgaactacatggtcaatacatgcacatcatcagtggatgacaactgaagacatgctaacagtctggaatagagtgtggatagaagataatccctggatggaagataaaacacctgtaactacatgggaaaatgtaccctatctaggaaaacgagaagaccagtggtgtggatcgttaatcggtttgacgtcacgtgcaacatgggcccagaacataccaacagctattcagcaagtaagaagtctcataggtaatgaagaatttttggattacatgccaagcatgaaacgcttcagaaaagaagaagaatcagaaggagccatttggtaa

SEQ ID NO: 23427 - RNA, 9873 nt, synthetic construct
  misc_feature 1..9873: note = derived and/or modified CDS sequence (opt6) from DENV-3__FJ639799__SS-prME
  source 1..9873: mol_type = other RNA
accagcttatgtctaatgatgatactcccagcagcgctcgcattccatctgacatcgcgcgacggagaaccacgcatgatagtaggcaaaaatgaaagggggaaaagtctactattcaaaacagcctcaggcataaatatgtgtacattaatagctatggaccttggagaaatgtgtgatgatactgtgacttacaaatgtccccatatcacggaagtagaaccagaagatatcgattgctggtgcaacctaaccagtacatgggtaacatacggtacatgcaatcaagccggggaacatcgacgtgataaaagatctgtagcgctcgcgccccacgtagggatggggctcgatactagaacacaaacatggatgagtgctgaaggagcatggagacaagtagagaaagtggaaacatgggccttaagacacccaggatttactatcctcgcattatttttagcgcattatataggcacatcattgactcaaaaagtggttatattcatattgctaatgttggtaaccccatcaatgacaatgaggtgtgtcggagttggaaaccgagactttgtggaagggttatcaggagctacgtgggtagacgttgtcttagaacacggaggctgtgtgacgactatggccaaaaataaaccaacacttgacatagaattacagaaaactgaggcaacacaacttgcaacactcagaaaattatgcattgagggaaaaattacaaatgtaacaacagattcacgatgtccaacacaaggagaagcagtgctaccggaagaacaagatcaaaattatgtttgtaaacatacttatgttgatcggggttggggtaatggctgtggtttatttggtaaagggtcattagttacatgtgcaaaatttcaatgtctagaaccgatagaaggaaaagtagttcaatatgaaaacttaaaatatactgtaataataactgtccataccggcgaccaacaccaagtgggaaacgaaacacaaggagttaccgcagaaataacaccacaagcgagcaccaccgaagcgatactaccggaatatggaacgttgggcttggaatgctcaccgcgtacgggattagacttcaacgaaatgatcctactaactatgaaaaacaaagcatggatggttcatagacaatggttctttgatctaccgcttccttggacatcgggggccacaaccgagacgcctacctggaatagaaaagaattgctagtaacttttaagaatgcacacgccaagaaacaggaagtagtagtcctaggctcccaggaaggggcaatgcacacagcccttacgggggcaacagagatacaaaattctggaggaacttcaatttttgcaggtcatttaaaatgtagattaaaaatggataaactggaattaaaaggtatgagctacgccatgtgcacaaatactttcgtgctcaagaaagaagtaagtgaaacacagcatgggactattttaatcaaagtagaatacaaaggcgaagatgttccatgtaagattccattcagcactgaggacggacaaggtaaagcacataacggcagactaatcacggctaaccccgtcgtgaccaagaaagaagaaccagttaatatagaggcagagcctccatttggagaaagtaacattgtaatcggtatcggagataacgccttaaagatcaattggtacaagaaagggtcaagtataggaaaaatgtttgaagcgacggcacgaggggctagaaggatggcgattctaggcgacacggcatgggacttcggcagcgtagggggagttctgaactcgctaggtaaaatggttcatcaaatctttgggagtgcatacacggctttattcagcggtgtgtcatgggtaatgaaaataggaataggggtactactgacatggatagggttaaattctaaaaatacgtcaatgtcgttttcttgtatagcaataggtattattaccctttatcttggagccgtggtccaagctgacatgggatgtgtaatcaattggaaaggtaaggagctaaaatgtgggtctggtatatttgtaacaaacgaagttcatacatggacggagcaatacaaattccaagccgattcacccaaaagattagccacagcaatagccggcgcctgggagaacggcgtttgcggaatacgtagcacaacaagaatggaaaacttgttgtggaaacaaattgctaatgaattaaattacatactttgggaaaataatataaagttgacagtagtagtgggagatataataggcgtcttggaacaaggtaaacgaaccttaactccacaaccaatggaactgaaatattcatggaaaacatgggggaaagcaaaaatcgtaacagcggaaacacaaaattcatcctttattattgacggaccaaacacacccgagtgtccgagtgcatcgagagcttggaacgtttgggaagtcgaagattatggatttggagtatttaccacaaacatatggctaaaattaagagaagtctacacacaactttgtgaccatagactaatgagcgcggccgtaaaagatgagagggcagtgcatgcagatatgggatactggatagaatcgcagaaaaatggatcgtggaaattggaaaaggcatcgttaatagaagtgaaaacatgtacatggcccaaatctcatacactatggagtaatggggtactcgagagtgacatgattataccaaaaagtttagcgggacccatatcacagcataattataggccgggatatcacactcagaccgcgggcccctggcatttaggaaaactagaactagattttaactattgcgagggtaccaccgttgtcataacggaaaactgtggcacaaggggtcccagtctgagaacaacgactgtaagtgggaaattgatccacgaatggtgttgcagatcatgcactctcccaccattgcgatacatgggagaagacggttgctggtatgggatggaaatacgaccgatttcagagaaagaagaaaacatggtaaaaagtttagtaagtgccggaagtggtgaagtcgataactttaccatgggagtcctatgtctggcaatactttttgaagaagtaatgagaggaaagtttggaaagaagcatatgatagctggggtattcttcacattcgtgcttttactatcaggtcaaataacatggcgcgacatggcccacacattaattatgatcggatctaacgcaagcgacagaatgggtatgggtgtaacttacctagcattaatagcaacctttaaaatccaaccatttttagcattaggtttctttttgagaaaattaacatctcgcgaaaatctacttttaggggttggactagctatggcaacaacgcttcaattaccagaagacatagaacaaatggccaacggaatagcgctcggattaatggcattgaaattaatcacgcaatttgaaacgtatcaactatggacggcactaatcagcttaacatgtagcaatacaatattcactttaacagtagcgtggcgaactgctactttaatattagcgggggtgagcctacttccagtctgtcagagctcatcaatgcgaaagactgattggttacctatgacagtagctgcaatgggagttccgcctctacctctcttcatcttcagcctaaaagatacattgaaaagacgcagctggccgttgaacgagggagtcatggcagtggggctcgtctcaatcctagcgagctcattattacgaaatgacgttcccatggcaggtccgttagtagctgggggtctgttaatagcctgttatgtgataactggtacatcagcggacctaactgtcgaaaaagctgcagatgtgacctgggaggaagaagccgaacaaacaggtgtttcccacaatctgatgataacagtagatgatgacggaacaatgcgtataaaagatgatgagacagagaatatattaacagtactactaaaaactgccttacttattgttagcggaatattcccgtatagtattccagcgacactactggtctggcatacatggcaaaagcaaacgcaaagaagtggtgtactttgggatgttccttcgccgcccgaaacacagaaagctgagttagaagaaggcgtttacagaataaagcaacaaggcatatttggaaaaacacaggtaggagtcggcgtacagaaagaaggtgtgttccacacgatgtggcatgtaacaagaggagcagttctaacatacaatgggaaacgtctcgaaccgaactgggcctcagtaaagaaagatttaatatcatacgggggcggttggagacttagcgcgcagtggcaaaaaggtgaagaggtgcaagtaatagcagtggaaccgggaaagaaccccaaaaattttcagactatgccgggtacatttcaaacaactacaggggagataggtgctatagccttggacttcaaacccggcacaagtggttcacccataataaacagagagggaaaagtagtagggttgtacggaaacggagtcgtgaccaaaaatggcgggtatgtaagcggaatagcacagaccaacgccgaaccagacggaccaacacccgaactggaggaagagatgtttaagaaaaggaatttgactataatggacttacatcctggaagtggaaaaacaaggaaatacttaccggccatagtgcgagaagcaataaaaagaaggttacgtactttaatactcgcacccaccagagtggtggcagcagagatggaagaagcgcttaaaggattaccaatcaggtaccaaacaactgctaccaaaagtgagcacaccggccgcgaaatagtggatctaatgtgccatgcaacctttactatgcgactattatcaccagtacgcgtcccaaactataacctaatcattatggatgaagcacactttacagaccctgcctcaatcgctgcaagaggctatatttcaacccgggttggaatgggcgaagcggcagcaatattcatgacagcaactccacctggcaccgccgatgcgtttccacaaagcaatgcccccattcaagacgaagagagagacattcccgagagatcgtggaactccgggaacgagtggatcacagatttcgcaggaaaaaccgtatggtttgtcccctctattaaagctggtaacgatatcgcaaattgtttgaggaaaaacggcaagaaagtgatacagttatcaagaaaaacattcgataccgagtaccagaaaacgaaacttaacgactgggattttgttgtcaccacggatatcagtgaaatgggagcaaacttcaaagccgacagggttattgatccacggaggtgtctaaagcccgtgatacttactgacggtcccgaacgagtaatactagcaggtccaatgcctgttacagcagcttctgctgcacagagacgcggtcgtgttggaagaaatcctcaaaaggaaaacgatcaatacatattcacagggcaaccgcttaataacgacgaggaccacgcacattggacagaggcaaagatgctacttgataacataaacacgccagaagggataataccggccttattcgaaccagaacgagaaaaatcggcagcaattgatggagaatatcgactcaaaggagaatctagaaaaacttttgttgaactcatgagaagaggggatcttcctgtgtggcttgcacataaagtggcgagtgagggtatcaaatacacagaccggaaatggtgctttgacgggcaacggaacaatcaaatacttgaggaaaacatggatgtagaaatctggacaaaagaaggtgagaagaagaaacttagaccgaggtggctagatgctcgtacgtactcggatcctcttgcactcaaggagtttaaagattttgccgctggtagaaaaagtatcgcattagatctagtaaccgaaatcgggcgtgttccaactcaccttgcacatagaaccagaaatgcattagacaacctcgtgatgttgcacacttcagaacacggaggaaaggcttatagacacgcggttgaagaattacctgaaactatggagactctgcttttactcggattaatgattttattaacgggaggggcaatgctattcttaataagtgggaaaggaatcggcaaaacgtcaatcgggctaatctgcgtaattgcgagtagtggtatgttatggatggctgaaataccgcttcaatggattgcatctgcgattgtcctagaatttttcatgatggttctcttaatacctgaacctgaaaaacagagaactccacaagataatcaattagcgtacgtggtgataggtattcttaccttagcagccataatagcagccaatgaaatgggcttgcttgaaacgactaagcgtgacctaggtatgtcccgggagccgggagtggtcagtcctacttcctatcttgatgtagatttgcatcctgccagtgcatggactttatacgcggtggccacaacggttatcacgccaatgctgcggcacacaattgaaaactcaacagccaatgtgtcactggcagctatagctaatcaggcggttgtactgatgggtttagataagggctggccaatcagtaaaatggatttaggggtaccccttttagctctgggttgctactctcaagtcaaccctttgacacttacggctgctgtccttttacttattactcactatgctataattggtcctggactgcaagcaaaggctacaagagaagcacaaaaacgaacagccgcaggtataatgaagaatccaacagtcgatggcattatgacaatagatttagatccagtcatctatgatagcaagttcgaaaaacaattaggacaagttatgttactggtgctgtgcgcggttcaattactattaatgcgaacaagctgggctctatgcgaggcattaacattagcaaccggacccataactacgctctgggagggttcaccaggcaaattttggaatacgacgatcgcagtatcgatggcgaatatattccgagggagttatcttgccggtgcaggattagccttttcaatcatgaaaagtgtcggtacggggaaacgaggtacaggatcgcaaggtgaaacgcttggcgaaaaatggaagaagaaattgaatcaattgtcacgtaaagagttcgacctatacaagaaatcgggtataaccgaagtagatagaacagaagccaaagagggattgaaaaggggtgaaattacacatcacgcagtatcccgaggatctgcgaaactccaatggtttgtagaacgaaacatggtcattccagagggacgggtcatagacttgggatgtggacgtggtgggtggagctattattgcgcgggtctaaagaaagttactgaggtaagaggctatacaaaaggaggtccaggacacgaggaacctgtacccatgagtacatatggatggaatattgtaaaactaatgtctggtaaagacgtattctacttgccaccagaaaaatgtgataccttgctttgcgacattggtgaatcctccccctcgccaacagttgaagaaagtcgaactataagagtattaaagatggtggaaccttggttgaagaataaccaattttgcattaaggtactaaatccgtacatgcctgctgtaattgagcatttagaacgattacagcgtaaacacgggggaatgttggtgagaaatccgctttccagaaatagtacgcatgaaatgtactggatatctaatggcacaggtaatatagtagccagtgttaacatggtaagccgtctactactgaacagatttactatgacgcataggagaccaactatagaaaaagacgtcgatttgggcgcaggaacacgacacgtgaatgcagaacctgaaactcccaacatggatgtaataggagaaaggatcaagaggatcaaagaggagcacaatagtacgtggcattacgacgacgaaaatccatataaaacttgggcctatcatggctcctacgaagtaaaggcgacaggttctgcatcgtctatgattaatggcgtagtaaaacttcttacgaaaccatgggatgtagtacccatggtaacacaaatggcgatgacagacactacaccgttcggccagcagagagtattcaaggagaaagtagatacgcggactccgcgatccatgccgggtacgcgacgagtcatgggcattactgctgaatggttatggagaacattgggtcgaaataagaagccgagactatgcacacgagaagagttcaccaagaaagttcgaacgaacgccgcaatgggcgcggtcttcaccgaagaaaatcaatgggattctgctaaagcagccgtagaggatgaagatttttggaaacttgtagaccgggagagggaactacacaagctcggaaaatgtggttcgtgcgtatataacatgatgggaaaaagggagaagaaactaggcgagttcggcaaagcgaaagggagtcgagcaatatggtatatgtggttgggtgcacgataccttgagttcgaagcattaggatttttaaatgaagatcactggttttcccgggaaaatagttattcgggagtggaaggcgaaggactacataagttaggttacatcctaagggacatatctaaaattccgggaggtgcaatgtatgcagatgataccgcaggctgggacacaagaataacggaggatgatttgcacaatgaggagaaaataacacaacaaatggatccagaacatagacagctagctaacgcaatctttaagctaacatatcagaacaaagtagtaaaagtacaacgacctacaccgacaggcactgtaatggatattatatcacgcaaagatcaaagaggaagtggtcaggtggggacatacggcttaaatacctttacaaacatggaagcacagctaataagacaaatggagggagagggtgtgctatcaaaagccgatctagaaaatccacaccttccagagaagaaaataacccaatggctagaaacaaaaggtgtggaaagacttaaaaggatggcaatatcaggtgacgattgcgtagttaaaccaatagatgaccgttttgcaaacgctttattggcattaaacgatatgggaaaggttagaaaagatatcccacagtggcaaccttctaagggttggcatgattggcaacaagtaccattttgttctcatcactttcatgagctcatcatgaaggatggacgtaaacttgtggttccgtgtagaccacaggatgaacttataggtcgagcacgtatttctcagggggccggctggtcgttaagagaaacagcctgtttgggaaaagcgtacgcacaaatgtggagtttaatgtatttccaccgaagggacttacgattagcatcaaatgcaatatgctccgctgtacctgtacattgggtacctacttcaagaactacatggagtatacatgcacaccaccaatggatgactacagaagacatgttgactgtttggaacagagtctggatagaggataacccctggatggaagacaaaaccccggtcaccacgtgggagaatgtaccttatcttggaaaaagagaagatcaatggtgcggtagtcttataggtctaacaagtagagccacttgggctcaaaacatacccacggcaattcaacaagtccgcagcttgattggcaacgaggaatttttagattatatgccatcaatgaaacgatttagaaaagaagaagaatcggaaggggctatctggtaa

SEQ ID NO: 23428 - RNA, 9873 nt, synthetic construct
  misc_feature 1..9873: note = derived and/or modified CDS sequence (opt6) from DENV-3__FJ639800__SS-prME
  source 1..9873: mol_type = other RNA
acttctctttgtctaatgatgatactaccagcagccctagcgttccaccttacatcacgtgacggcgaacccagaatgatagtgggcaaaaatgaaaggggtaaatccttactattcaaaacggcttctggaataaatatgtgtacattaatcgctatggaccttggggaaatgtgtgatgacactgtaacatacaaatgcccacatataactgaagttgaaccagaagatatagattgctggtgtaacctgaccagtacgtgggttacctacggtacatgcaaccaagcaggcgaacaccggagggataaacgatctgtggccttagccccacatgtaggtatgggcttagatacaagaacacaaacgtggatgagtgcagaaggggcctggaggcaagtcgaaaaagtagaaacttgggcattgaggcatccaggatttacaattttagctctatttctagcacattatataggcacgtctctgacacaaaaagtggtgatatttattttactcatgctagtcacacctagcatgaccatgcgatgcgtgggagtggggaatcgagactttgtggaaggcctaagtggcgccacatgggtagacgtagtccttgaacacggtggttgtgtcacgactatggcgaaaaataaacccacattagatatcgaactccagaaaactgaagcaactcaattagctacattgaggaaattatgtatagaaggaaaaataaccaatataaccacagactcgagatgtcccacacaaggagaagcggtgttaccagaagaacaagatcaaaattacgtatgtaaacacacatacgtagacagaggttggggaaacgggtgcggcctctttggaaagggaagcctagtaacctgtgccaaattccaatgcttagaaccgattgaaggaaaagttgtacaatatgaaaatttaaagtacacagttattataacggtacatacaggtgaccaacaccaagtaggaaatgaaactcagggagttaccgctgaaataacacctcaagcaagcacgacagaagcaatactgcccgaatacggaaccctaggattggaatgcagtccgcgcaccggacttgattttaacgaaatgatactgcttaccatgaaaaataaagcatggatggtgcaccgccaatggttctttgatcttccattaccttggacaagtggggcaacaaccgaaacccccacatggaacagaaaggaactattggtgacgtttaaaaacgcccatgctaaaaagcaggaagtggtagtcctaggatcccaggagggagcaatgcacacagcattaacaggagcaactgaggtacagaacagtggtgggacatcaatttttgctggtcatctaaaatgcaggctaaaaatggataaactagagctaaaaggaatgagttatgccatgtgtactaatacatttgtgttgaagaaagaagtatctgaaactcaacacggcacaattttaattaaggttgaatataaaggggaagatgtaccatgtaaaataccgttttcgacagaagatggccagggaaaagctcacaatggacgcctcattaccgcaaaccctgtagtaacgaagaaggaggagccagtaaacatagaagcggaaccaccgtttggagaatcaaatatagtcatcggtataggtgataacgcgctacgtattaattggtacaaaaagggatccagtattggtaaaatgttcgaggcgactgcccgaggtgcaagaagaatggctatactaggagatacagcttgggatttcggaagtgtcgggggagtgctcaactcattaggtaagatggtacaccagatatttgggtcagcctacaccgcgttgttttctggggtaagctgggttatgaaaattggcataggagtccttctaacgtggataggcctaaactcgaaaaatacgtcaatgagtttctcgtgtatagcgatcggaatcatcacactatatctaggagccgtagtccaagcagatatgggctgtgtaataaactggaaggggaaagagcttaaatgtggctccggaatattcgtaacaaacgaagtacacacatggactgaacaatataagttccaagccgattcaccaaaaagactagcaacggctatagctggagcttgggaaaatggtgtttgtggaataagaagcacaacgcgcatggagaacttactttggaaacaaatagccaacgagctaaactatatcctgtgggaaaacaatataaaacttacagtagtagtcggtgatacaataggagtacttgaacaaggtaaacgaacactgacaccacagcctatggagttaaagtacagttggaaaacatggggtaaagctaaaatagtaaccgcggaaacgcaaaattcctcatttataatagacggtcctaatactccagaatgtcctagtgccagtcgagcatggaatgtatgggaggtagaagactatggcttcggggtattcactacaaacatctggcttaagctacgcgaagtatacactcagctctgcgatcatcgactcatgtctgcagctgtgaaagacgaaagagcagtacacgcagacatgggatactggatcgaatcccagaaaaatggatcttggaaattggaaaaagcaagccttattgaggttaaaacatgtacatggcctaaaagtcatactttatggtcaaatggcgtgctcgaatcagatatgataattccaaagtcccttgctggccctatcagccaacacaattacagaccgggttatcatacacaaaccgccggtccatggcatctcggcaaactcgagctagattttaactattgtgagggaaccaccgtggtgataacagagaattgcggtacacgcggtccttcattacggacgaccactgtatcaggaaagttaatacacgaatggtgttgtcgaagctgtacacttccaccactaagatacatgggagaagatggttgttggtatggaatggaaatccgaccaataagtgaaaaagaggaaaacatggttaaatccttagtatcagcaggatctggggaggttgacaatttcaccatgggggttctatgtttagcaatcctcttcgaagaggtaatgaggggaaagtttggcaagaaacatatgatagccggtgtgtttttcacttttgttcttctgttaagcggccagattacatggcgtgatatggcgcacacattaataatgataggttccaatgctagcgacagaatgggtatgggcgtaacatatttagcactgatagcaactttcaaaattcaaccattcttagctttaggtttctttttgagaaaacttacgagccgagaaaacctactacttggcgtgggtttagcgatggcgacgacactacaattaccagaagatatagagcagatggccaacggaatagcccttggactaatggctttgaaactcattacccagtttgaaacatatcaactttggacagcattaatctcgttaacatgctcaaatacgatatttactctcacggtagcatggagaactgcaacactcattctagcaggagtctcactattgcccgtctgtcaaagcagtagtatgcgaaaaacagattggctacccatgacagtagcagctatgggagtcccaccactacctttgtttatttttaatctaaaagatacattaaaaagaagaagctggccactaaatgaaggggtaatggctgtcggcctagtctcaatattggcatccagtttgttacgtaacgacgttcctatggcgggtccgctagtagcaggagggttgctcatagcatgttacgttatcacaggaaccagcgctgatttaacagttgaaaaggcagcggacgttacttgggaagaggaagccgaacaaactggggtttcacacaacttgatgatcacagttgatgatgacggcaccatgagaataaaggatgatgagacagagaatatattaactgttttgcttaaaacagcattacttatagtttccggaatcttcccatatagtatacctgccactctcttggtttggcacacatggcaaaagcaaacacaaagatcaggagttctctgggacgtaccaagcccaccagagactcaaaaagccgagctggaagaaggtgtctacagaataaaacaacaggggatattcggcaaaactcaagttggggtaggagtccaaaaagaaggagtcttccataccatgtggcatgttacaagaggtgctgttctaacctacaacggaaaacgacttgaacctaactgggccagtgtaaagaaggacttgatttcctacggaggaggttggcgtttaagtgcacaatggcaaaagggggaggaggtccaagtaatagcagtcgaacctggcaagaatcctaaaaatttccagactatgcccggaacgttccaaacgacgacaggagaaatcggcgcgatagccctggactttaaaccaggcacatctggatccccaataataaatagggagggaaaggttgtaggattatatggcaacggggtagttaccaaaaatggaggatacgtaagtggaatagcacaaactaatgcagaaccagatggaccaacgccagagctcgaagaagagatgttcaagaaaagaaatttgacgatcatggacctacacccgggcagtggtaaaacacgcaaatatttgccagcaattgtccgtgaagccataaaaagacggctacgcaccttaattctagcgccgactagggtagttgctgccgaaatggaggaagcattaaaaggattacctattagataccaaactacagcgactaagtcagaacatacaggtagagaaatagtggatctaatgtgtcacgccactttcactatgaggttactatcacccgtcagggtaccaaattacaatttgataattatggatgaagcacattttaccgatccggcatcaatagcagcgagagggtatatctcaaccagagtgggaatgggggaagcagctgcgatctttatgactgcgacgccaccaggcacagcagacgcttttccccaatctaacgcaccgatacaagatgaggaacgagacattccagaaagatcttggaactctggcaatgaatggatcacagatttcgcggggaaaacggtatggtttgttccctctataaaagccggtaatgatatagccaattgcctgaggaagaatggtaagaaagtgattcaattatctagaaaaacatttgatacagaatatcagaaaacgaaattaaatgattgggattttgtggttactaccgatatatcagaaatgggggctaattttaaagcggatagggtaatcgatccgaggaggtgcttaaaacctgtcattctaacggacggaccggaacgagtaattctcgcagggcctatgccggtcaccgcagcaagtgctgctcaaagacgtgggcgagtaggtaggaatccacagaaggagaatgatcaatacatcttcacaggacagcccttaaataatgatgaagatcatgcacattggacggaagcaaaaatgcttcttgacaacataaatacccctgaaggtataatacctgcactctttgaaccagagcgagaaaagtcggctgcaatagatggagaatatagattaaaaggagaaagtaggaagacttttgtagaattaatgagaagaggtgatttaccagtatggttagcgcacaaagtagcatcagaaggtatcaaatacaccgatagaaaatggtgctttgatggccaaagaaataatcaaatcttagaagagaatatggacgtcgagatatggactaaagagggtgaaaagaagaaactccgccccagatggctcgacgcacgcacttattcagacccacttgccctcaaagaatttaaagactttgcggccggacggaaaagtatcgccctcgacttggtcactgagattggacgcgttccgactcatctggcacatagaactaggaatgcactagataatttggttatgctccatacaagtgaacatggaggtaaggcatataggcatgccgtcgaagaactaccagaaaccatggagacgcttctactccttggacttatgatattgctgacgggaggtgctatgttgttcctaatatcaggtaaaggcattggaaaaaccagtataggattaatttgcgtgatagcctctagtggcatgctatggatggctgagatacctctacaatggattgcttcggccattgtactggaatttttcatgatggtccttctcataccagaaccggagaaacagaggactccacaagacaatcaattagcctatgttgttatcggtatacttacactcgctgcaataattgccgcaaatgaaatgggtttactagagacaacaaaacgagacctagggatgagcaaagaacccggagttgtttcgccaacatcctaccttgatgtcgatttacatcccgcaagtgcctggaccctatatgccgttgcgacaacggtgataaccccaatgttaagacacacaattgaaaattccaccgcaaacgtctcgctagccgcaatagcgaatcaagccgttgtactgatgggactagacaagggatggcccatttcaaaaatggatttaggagtacctttgctggcgctagggtgttacagtcaagtaaatccgttaacactcactgcagccgtattactactaattacacactatgcgataataggcccgggtttacaggcaaaggcaacacgcgaggcccagaaaagaaccgcagctggcataatgaagaacccaaccgttgatgggattatgactattgacttagaccccgtcatatatgatagtaaatttgaaaaacagctcggccaagtgatgttgcttgttttatgcgccgttcagctacttttaatgcgtacttcctgggctctatgtgaagcattgacactagccacgggacctataactacattatgggagggatctcctggtaagttttggaatacaactatagctgtttcaatggcaaatatatttcggggaagttacttagctggagcgggattagctttcagtatcatgaaatctgtgggaaccgggaaaagaggtacaggttcacagggcgaaacgctaggcgaaaaatggaaaaagaaattaaaccaactgtctagaaaagagttcgacctatataagaaatcaggaataacggaagtcgatcgcacagaggccaaagaaggtctgaaaagaggtgaaataactcatcacgcagtctcacgcgggtcggcaaaacttcaatggtttgttgaaaggaatatggttataccagaagggagggtcatagatctaggatgtggacgaggcggatggagttattattgtgcaggtttaaagaaagttacggaagtgcgcggatataccaaaggcggacccggacacgaagaacccgtaccgatgagtacctacgggtggaacatcgttaaattaatgtctggcaaagatgtcttttatcttcccccagagaaatgcgacacactactatgtgacataggtgaatcttcacctagcccgactgtagaagaaagtcgaactataagagtattaaaaatggtagaaccctggctcaaaaataaccaattttgcattaaagtcctaaacccatacatgcccacagttatcgaacatctcgaaagattacaaagaaaacatggaggaatgttagtgagaaacccgctctcaaggaacagcacacacgagatgtattggatttcaaatggaagtggaaatatagtcgcgtcggtcaacatggtatcaagactgcttttgaatagattcactatgacgcatcgccggccgacaattgaaaaagacgtggacttaggagcaggcaccagacatgtaaacgcagaaccggagactccaaacatggacgtaataggcgagagaatcaaacgtatcaaggaagaacataacagtacgtggcattatgacgacgaaaacccgtataaaacatgggcatatcatggaagctatgaagtcaaggccacggggtccgcatctagcatgattaacggtgtagtaaaactattaaccaaaccatgggacgtagtaccaatggtgacccaaatggcaatgaccgacactactccgtttgggcaacaaagagttttcaaagaaaaggtagatactagaactcccaggagcatgccgggaaccaggagggttatgggcataacagcagaatggttatggcggactcttggacgaaacaagaaacccagattgtgtactagagaggagttcaccaagaaagttcgtacaaatgcagctatgggagcggtcttcacagaagaaaatcaatgggattcggctaaagcagcagtagaagacgaagacttctggaaattagtggatagagagagggaattacataaacttggtaaatgcggatcatgtgtatataatatgatgggaaaaagagaaaagaaattgggcgaatttggaaaggcaaaaggaagcagagcaatttggtacatgtggctgggtgctcgttatcttgagttcgaagcgctagggtttttaaatgaggatcattggttttcacgtgagaactcatattcaggagttgagggcgaagggctccacaaactaggatacatactgagggacatctctaaaataccagggggagcaatgtacgccgatgataccgccggttgggacactcgaataaccgaggatgaccttcacaatgaagagaagattacacaacagatggatccggaacaccgacagttagcgaacgccatcttcaaacttacttaccaaaataaagttgtgaaagtacaaagaccgacacctacagggaccgtaatggacattatctcccgaaaagaccaacgaggatcaggtcaagtgggtacgtatggtttaaacactttcaccaatatggaagcgcaattaatacgacaaatggaaggagaaggcgtattaagtaaagccgatctagaaaaccctcatttaccagagaagaaaataacacaatggctagaaaccaaaggtgtagagcgattgaaacgaatggctatcagtggagacgactgcgtcgttaaaccaatagacgatcggtttgccaatgctctattagcacttaatgatatgggaaaagttcgaaaagacatacctcaatggcaaccttcgaaaggctggcatgattggcagcaagttccgttctgcagccatcattttcatgagttaataatgaaagacggtcgaaaacttgttgtaccgtgtcgtccacaggatgaactgatagggcgagccaggatatcacaaggagcaggttggagtctcagagaaacggcatgtctaggaaaagcgtacgcccagatgtggtcactaatgtacttccataggagagatctaagacttgcaagtaatgcgatatgcagtgccgtaccagtacactgggtaccaacgtccagaacgacatggagcatacatgctcatcatcaatggatgacgactgaggacatgcttacagtatggaacagagtttggatcgaagataatccatggatggaagacaagaccccagtaaccacgtgggaaaatgtgccctacttaggaaagagagaagatcaatggtgtggaagtttgatcggactgacaagccgagctacatgggctcaaaatataccaactgcaatacagcaagtgagatcattaataggtaacgaagagttcttagattacatgccatccatgaagagatttaggaaagaagaagaatcagaaggggcgatttggtaa

SEQ ID NO: 23429 - RNA, 9873 nt, synthetic construct
  misc_feature 1..9873: note = derived and/or modified CDS sequence (opt6) from DENV-3__FJ639801__SS-prME
  source 1..9873: mol_type = other RNA
actagcctatgcctaatgatgattctaccggcagctcttgcattccaccttacatcacgcgatggtgaaccgaggatgattgtcggtaaaaatgaacggggaaaatcattactattcaaaaccgcgtcggggattaacatgtgcacactaattgcaatggatcttggtgaaatgtgtgatgatacagttacctacaaatgtcctcatattacagaggttgagcctgaggacatagattgttggtgcaatttaacgagtacatgggttacgtatggaacgtgtaatcaagcaggagagcataggagagacaaacgtagtgtagcacttgcaccacatgtcggaatgggtttagataccagaacacaaacttggatgagcgcggaaggcgcttggcgccaagtagagaaagtcgaaacatgggctctacgacatcctggtttcacgatattagcacttttcttggcacattatatcgggacgtcattaacgcaaaaagtagtgatatttatattattaatgttagtaacaccatcgatgactatgaggtgcgttggagttgggaatagggactttgtagagggtctatcgggcgcaacatgggttgacgtcgtactcgaacatggtggctgtgtaaccacaatggctaaaaacaaacctacattagatatagaattacagaaaaccgaagcaacccaattagccacccttagaaaactatgtatagaaggtaaaataactaatatcacgaccgattcaaggtgccccactcaaggagaagccgtgttaccagaagaacaagatcaaaactatgtgtgcaaacatacttatgtagaccgagggtggggtaatggatgcgggttatttggcaaaggatcactggtaacttgtgcaaaatttcaatgtttagaacctatagaagggaaagttgtgcaatacgaaaacttaaaatacacggtaataataacggtacatactggggatcaacatcaagttgggaatgaaacccaaggagtcacagccgaaataaccccacaagcgagtacaacagaagcaatactaccagagtacggtaccttgggcttagagtgctcaccacgaacgggattagactttaatgagatgatcttactgactatgaaaaataaagcatggatggtacacagacaatggtttttcgatcttcctttaccctggacctcaggggctactacagaaacaccaacatggaacaggaaagaactccttgtaacatttaaaaatgctcacgcgaagaaacaagaggttgtggttttggggagccaagaaggagctatgcacacagcattaactggtgctaccgaaatccaaaactctggagggacaagcatatttgccggccacttgaaatgccgccttaaaatggataagttggaattgaaaggaatgtcatatgcgatgtgcacaaatacttttgtactaaagaaagaggtatcagagacacagcacggaacaattttgatcaaagtagaatacaaaggagaggacgtaccctgcaaaataccattctctaccgaagacggtcaaggaaaagcacataacggtcgtttaataacggctaatccagtagtaactaagaaagaagaacctgttaacatagaagccgaaccaccttttggtgaatcaaatatcgtaataggcatcggtgataacgcactaaaaataaattggtacaagaaaggttcttccataggtaagatgttcgaagctaccgcccgaggcgcaaggagaatggccattttgggggatacggcctgggacttcgggtcggttggaggtgtattaaatagcctaggtaagatggttcatcagatttttggtagcgcgtacacggcattattttcaggggtcagttgggttatgaagataggaataggagtgctactaacctggatagggctaaacagtaagaacacaagcatgtccttcagctgcatcgctatagggatcataactctgtacttgggtgcagtagtgcaggctgacatgggatgtgttataaattggaaaggcaaagaactaaaatgtgggtctggcattttcgtcactaatgaagtacatacctggacggagcagtataagtttcaagccgatagtcctaaacggttagctactgcgatagccggtgcatgggaaaacggtgtatgtggcatcagatcaactacaaggatggagaatcttctgtggaagcaaatagcaaatgaactgaattacattttatgggagaacaacattaaactaactgtagttgtcggtgacactataggggttctcgagcaagggaaaaggacattaacgccacagccgatggaactgaaatatagttggaagacctggggaaaagcaaaaatagtaacggcagagacacagaatagttcatttataattgatggacccaatacaccggagtgcccttctgcgtccagagcttggaacgtgtgggaagttgaggattacggcttcggagtgttcacaaccaatatttggttaaaactccgagaagtctatacacaactttgtgatcatcgcttaatgtcagcagcagtaaaggatgaacgggccgtccacgcagacatgggatattggattgaaagccagaaaaatgggagttggaaattagagaaagcatctctaatagaagtaaaaacttgtacttggcctaaatcacatacattatggtcgaacggagttctagaatctgatatgataataccaaagagtttagcagggccaataagccaacacaactatcgacctggatatcacactcagactgcagggccgtggcatttgggaaagctagaactagattttaactactgtgaaggaacaacagtcgtgataactgagaactgtggcacgagaggaccgagtctaaggactacaacagtttctggcaaactaattcatgaatggtgttgcagaagctgcactttaccacctttaagatacatgggagaggatggatgctggtatggtatggaaatccgtccaataagcgaaaaggaggaaaacatggtaaagagtcttgtcagtgcgggatcgggagaggtggataactttacaatgggggtactttgcctagctatattatttgaagaggttatgcgcgggaagttcggtaagaaacatatgatagctggagtatttttcacttttgtcctactattatccggacaaatcacatggagagatatggctcacactctcataatgataggtagtaacgctagcgatagaatgggaatgggcgtcacgtacttggctcttatagcaactttcaaaatccaaccatttttagcactaggatttttcttacgtaagttgacgtctagagaaaatctgttgctaggagtaggtttggctatggctactacgttgcaactaccagaagatattgagcaaatggcaaacggaatagctctcggactaatggctttaaaactcataacgcaattcgaaacctaccaactttggaccgcattaatatcattaacctgttctaacactatctttactttaacggtggcttggagaacagctacgttaatactcgccggtgtttctctattaccagtgtgtcaatcctcttctatgagaaagacagactggctcccaatgacagtagcagctatgggagttccaccccttccattattcatattttcactcaaagatactttaaagaggagaagttggccacttaatgaaggagtgatggcagtaggcttagtatcaattcttgccagttcattattaagaaatgatgtcccaatggcaggaccgctcgtagcgggaggattattgatcgcttgttacgtcatcactggtacaagtgcggatctcacagtcgaaaaagccgcagatgtaacatgggaagaagaagcagaacaaacaggagtgtcacacaacctaatgatcacagtagatgatgacggaactatgagaatcaaagatgacgaaactgaaaacatacttacggtacttttgaaaacagccctacttatagtttcaggaatattcccttattcgataccggcgacactcctagtttggcacacctggcaaaaacagacgcaacgaagcggcgtgctgtgggacgtcccatcaccacccgaaacccaaaaagcagaactagaagaaggagtgtaccgaattaaacagcaggggatcttcggtaaaactcaagtaggtgtaggcgtacaaaaagaaggggtatttcatacaatgtggcatgtaaccaggggagccgtattaacatgtaatggaaaaagactagaaccaaactgggcgtcagtgaagaaagatttgatctcgtatgggggtggatggagattgtccgcacagtggcaaaaaggggaagaagttcaagtaatcgcagtggaacctggcaaaaatccaaagaacttccaaaccatgccaggaacattccaaactaccacgggagaaatcggagctatagccttggattttaaacctggcacgtctggtagtcctatcatcaatagagaaggaaaagttgtaggtttatacggcaatggagtggtgaccaagaatggcggatacgtgagcgggattgctcaaacaaatgctgaacctgatggaccaaccccagagctcgaagaagaaatgttcaagaaaaggaacttgacaataatggatttacacccaggctcgggtaaaacccgaaagtatctccccgcgatcgttcgcgaagcaattaaacgtagattacgaacgttgatattagcccctacaagagtcgtggcggcagagatggaagaagcattgaaagggctacctatacgataccaaacaactgcaaccaaaagtgaacatactggacgtgaaatagtagatttaatgtgtcacgctacattcaccatgcgattgctatcccctgtaagggtccccaattataatctaattataatggatgaggcacattttacagatccagcatccatagcagcaagaggctacataagtaccagagtaggcatgggtgaagcggcagcaatcttcatgacagctacaccacccggtaccgcagacgcatttccacaaagcaatgctcctattcaagatgaagaacgcgatataccggaacgatcttggaacagtggaaatgagtggataacggacttcgccggtaaaacagtctggtttgtgcccagtatcaaggcaggcaatgatatcgcgaattgcctgcgcaaaaacggtaaaaaggtaattcaattgtcaaggaaaacgtttgatacagaatatcagaaaactaaactaaatgattgggactttgtggtgacgacagatatctctgaaatgggagctaatttcaaagcagatagagttatcgatccaaggcgatgtttaaaaccagtaatattgactgatggtcctgaacgcgtaatacttgctggtcccatgcctgttacggctgcgtccgcagcgcaaagacgtggaagagtcggtcgaaatccccagaaagaaaatgaccaatatatatttacgggacaacccctcaacaacgacgaggatcatgcccattggaccgaagcgaaaatgttattggataatatcaatacacctgaaggcataatccctgcactattcgaaccagaacgtgagaagtcagctgctatcgacggcgagtatagattgaaaggggaatcgcgaaagacctttgtcgaactaatgagacgaggagatttgccagtttggttagcacacaaggtagcatcagaaggcataaaatatacagaccgcaaatggtgttttgatggtcaaaggaataatcaaatattagaagaaaacatggatgttgaaatatggaccaaagaaggtgaaaagaaaaagctcagaccaagatggttagacgctcgtacatactcagaccccctcgcactgaaagaatttaaggattttgcagcaggaagaaaatcaatagcgttggaccttgtaaccgaaataggaagagttccaacacatctcgcacatcgcacacgaaatgcattagacaatttagtaatgcttcacactagcgaacatggcggcaaagcataccgccatgcagtagaagaattgcctgagacaatggagaccttactccttttaggattaatgatcttacttaccggtggagctatgttattcttaatatcggggaaaggtataggcaaaacttcgataggtctaatctgtgtcatcgctagcagcggaatgctctggatggcggaaattccattacaatggatagcatcagccatcgttttagagttctttatgatggttctacttattccggaaccggaaaaacaacgaacgcctcaagataatcaacttgcgtatgtagtaatagggatcctaactctcgcagctaccattgcggcaaacgaaatgggcctgctagagacaacaaaacgcgatctcggtatgtcgaaagaaccaggtgtcgtatccccaacatcttatttggatgtcgatcttcatccagcttcggcatggaccttgtacgcagttgcaaccaccgtaatcactcctatgctaaggcataccattgaaaatagtactgcaaatgtatcgttggctgccatagcaaatcaggcagtggtcctgatgggtctagacaaagggtggcctatatcaaagatggacttaggtgtgccgttgctagcattaggttgttactctcaagtaaacccacttacactaacagcggcggtattgctattaatcacacactacgcaataataggtccaggtctacaggcaaaagcaacgcgagaggctcaaaaacgcacagcggcgggaataatgaaaaatcctaccgtcgatggaatcatgacaatagacctagatccggttatctatgactcaaaatttgaaaaacaactaggtcaagttatgttgttagtcctttgtgctgtacaacttcttcttatgagaactagctgggcgttatgtgaagctcttacacttgcaaccggtcccataactacgttatgggaaggttctccaggaaaattttggaatactaccatagctgttagcatggcaaacatttttaggggcagttacttggcaggagcaggattagcattctctataatgaaaagtgtgggaacaggtaagagaggaactggttcacaaggagagactttgggtgagaaatggaagaaacgccttaaccaactatcacgtaaagaatttgatttatacaagaaaagcggaataactgaagtggataggaccgaagctaaagaaggtttaaaaagaggggaaataacgcatcatgccgtatctcgtgggtctgcgaagttacaatggtttgttgaaaggaatatggtcatccctgaaggtagagttatagatctcggatgtgggaggggcggatggagttactactgtgcggggctaaagaaagtaacagaggtaagagggtatacaaaaggaggaccgggccatgaagaacccgtgccaatgtctacatatggatggaatatagtaaaactaatgtcgggtaaagatgtattttatttacccccagaaaaatgcgatacacttctgtgcgacattggagagagctcaccatcccccacagtagaagaaagtaggacaatcagagttttaaagatggttgaaccctggcttaaaaacaaccaattctgcatcaaagttttgaacccatatatgccgaccgtcatagaacatttggaacgcctacaaaggaaacatggaggaatgttagtcagaaatccattgtcccgcaatagtacacacgagatgtattggatatctaacggaacggggaatatcgtggcttccgttaacatggtctcacgtctactgctaaacaggttcacaatgacacacagacgacctacaattgagaaggatgtagacttgggtgctggaacgagacacgttaacgcggaaccagaaacaccgaatatggatgtcatcggagagagaataaagcgcataaaagaagaacataattcaacctggcactacgatgacgaaaatccttacaaaacgtgggcttatcacgggagctatgaagttaaagctacaggtagtgcttcaagcatgattaacggagtggttaaattgctaacaaagccatgggatgtagtaccaatggtgacacaaatggcgatgacggacacaactccattcggacaacagagggtttttaaggaaaaagtagacacacgaacccctagatcgatgccaggcactagaagggttatgggtataactgctgaatggctatggagaactctcggtaggaataagaaacctaggttgtgcacccgagaagagttcactaagaaagtacggacgaatgcagcaatgggcgcagtattcacagaggagaaccaatgggattccgcgaaagccgcagtcgaagacgaagacttctggaagctagttgaccgggaacgtgaacttcacaagctgggcaaatgcggttcctgtgtctataacatgatgggtaaaagagagaagaaactaggtgaatttggcaaagccaaaggatcaagggcgatttggtacatgtggttgggtgcgcgctacctagaatttgaagcactaggcttcttaaacgaagaccattggttctccagagaaaactcatattccggagtcgaaggcgaagggttacataaattagggtacatcttacgagacataagtaaaattccaggaggggctatgtatgcggatgatactgccggatgggacacaagaataactgaagacgatttacacaatgaggagaaaataactcaacaaatggatccagaacatcgtcaacttgcaaacgctatatttaaattaacctatcagaacaaagttgttaaggtacagagaccgacacccactggtacagttatggacataatatcaagaaaagaccaaagaggctcaggtcaggtaggaacctacgggcttaatacgttcacaaatatggaagcacaactaattagacagatggagggagaaggagttttgagtaaggcagacttggaaaaccctcacctacctgagaagaaaatcacccagtggctagaaacaaagggcgtagaacggttgaaacgcatggcaatctctggagacgattgtgtagttaaaccaatagatgatcgtttcgcgaatgctttattggccctcaatgatatggggaaagtaagaaaggatattccacagtggcaaccgagcaaaggatggcacgattggcaacaagtaccattctgtagccatcacttccacgagcttattatgaaggacgggagaaaactcgtcgtaccttgtcggcctcaagacgagctgataggccgagcacgtataagccaaggtgccggttggtcgttaagagaaaccgcctgtttaggaaaagcgtacgcacaaatgtggagtttaatgtacttccatagacgagacctccgcctcgcaagtaatgcaatatgtagtgcggtcccggtacattgggtgccaacttcaagaactacatggtccatacatgctcaccaccaatggatgaccacagaagatatgctcacagtttggaatagagtatggatagaagacaacccctggatggaagataaaactccagttacaacatgggaaaatgtcccatatttgggaaaacgtgaagaccaatggtgtggtagcctcataggtcttacaagtcgggcaacctgggcacaaaatattccgacagccattcaacaggttcgcagtttaataggcaatgaagagttcttagactatatgccaagtatgaaaagatttcgaaaagaggaggagtcagagggggcaatatggtga

SEQ ID NO: 23430 - RNA, 9873 nt, synthetic construct
  misc_feature 1..9873: note = derived and/or modified CDS sequence (opt6) from DENV-3__KF955471__SS-prME
  source 1..9873: mol_type = other RNA
accagtctctgcctgatgatgatactcccagcggctctagcttttcatctgacttcaagagatggagaaccaagaatgattgtaggtaaaaatgaaagaggtaaaagtttactatttaaaactgcatctggtattaacatgtgtactctcatcgcaatggatttaggtgaaatgtgcgacgataccgtaacctataaatgtcctcacataacagaagtcgaaccagaagatatagattgctggtgtaacctgacaagcacttgggtaacatatgggacatgcaatcaagcaggagaacatcgtagagataaaaggtcagtagcactagcgcctcacgtaggaatgggattagacacgcgcacacaaacatggatgtcagcagaaggagcttggcgacaagtggaaaaagtagaaacatgggctttaagacaccccggtttcactatattagcacttttcttggcccattacataggaacatcgctaactcaaaaagtcgtaatctttattctattaatgttggtcactccttctatgacaatgcggtgtgtgggtgtaggtaaccgagacttcgtcgaaggtttgtcaggagccacgtgggtggatgtagttctagaacatggcgggtgcgtcacaacaatggccaaaaataaaccaacattagacatagaactacagaaaaccgaagcaactcaactcgccactctacgtaaattgtgcattgagggaaaaattacgaatataacaacagatagccgatgcccgactcaaggagaagcagtattgccggaagaacaagatcaaaactatgtgtgtaaacatacctatgttgatcggggttggggtaacgggtgcggacttttcggaaaaggcagtctagtgacttgcgcaaaattccaatgcttagaacccattgaagggaaagtagtccaatatgaaaacttaaaatatacagtcatcataacggttcacactggagatcaacatcaagtagggaatgagacgcaaggtgtgactgccgaaataacaccacaagcgtccacaacagaagcaatattaccggaatacggaacattaggcttggaatgtagccctcgtacaggactggactttaatgaaatgatacttctaacaatgaaaaacaaagcatggatggtgcaccgacaatggttctttgatctccccttaccgtggacatctggagcaaccacggaaactccaacatggaatagaaaagagctattagtaacatttaaaaacgcccacgcaaagaaacaagaagtagtagtcctgggttcgcaagaaggagcaatgcatactgccctcacaggagcaacagagattcaaaactccggaggaacatcgatatttgcgggacacttaaaatgtagactaaaaatggataaattggaactcaaaggaatgtcgtatgctatgtgtacgaacacgttcgtactcaagaaagaagtatcagagactcaacatggaacaatattaatcaaggttgaatataaaggtgaagatgtgccgtgcaaaatacctttttcaacagaagacggccagggaaaagcccataacggaagattaataactgccaatccggtagtaacgaagaaagaagaacctgttaatatagaagcagaacctccgttcggagaaagtaatatcgtaataggaataggagataacgctctgaagataaactggtataagaaaggtagtagtattggtaagatgtttgaagcaacagcacgaggcgcccgaagaatggcaatactcggggacaccgcatgggattttggcagcgtaggaggtgttttaaattcgctaggtaaaatggtccaccagatatttggatcggcatataccgcacttttctcgggagtaagttgggtgatgaagattggaataggtgtattgttaacttggatcggcctaaatagtaagaatacatctatgagcttttcatgtatagcaattggcatcatcacattatatctcggtgcagtagtgcaagcggacatgggttgcgtcattaattggaaaggaaaagaattaaaatgtggatcgggaatattcgtaactaacgaagtgcatacctggacagaacaatacaaatttcaagcagacagtcctaaaagactcgccacggccatcgcaggcgcttgggaaaatggagtatgtggaatccgtagcactacaaggatggagaacctgctatggaagcaaattgcgaacgagttgaactatattttatgggaaaacaatattaaactaacggtagtagttggagatatcataggcgtgctagaacaaggaaaaagaactctaactccgcaacctatggaattgaaatattcctggaaaacttggggaaaagctaaaatcgtaaccgccgagacgcaaaacagttcattcattatagacggtcctaacacacccgaatgtccttcagcctctcgtgcttggaatgtgtgggaggtagaggattacggtttcggcgtgtttacgactaatatatggctaaaacttcgagaagtatacacccaactatgtgatcatcgactaatgagtgctgctgtaaaagacgaaagagctgtacacgccgatatgggttactggatagagtcacagaaaaacggaagttggaagttagaaaaggcatctttaatagaagttaaaacctgcacatggccgaaaagtcatactctgtggtcaaacggggttcttgaatcggacatgataatacccaaatcattagcagggccaatcagtcaacataactatagaccaggctaccacactcaaactgcaggaccatggcacttaggcaaattagagttagatttcaattattgcgaaggaactacggtcgtcatcactgaaaattgtggaaccagaggtccgagcctgagaacaacaacagtaagtggaaagttaattcacgaatggtgctgtcgctcatgtacattgccaccactaagatacatgggagaagatggatgttggtacggaatggagattcgacctataagtgaaaaggaagaaaatatggtgaagtcattggtatcggcaggctcaggtgaggttgacaacttcacaatgggagttctatgcttggcaatactgtttgaagaagttatgcgaggaaagtttgggaagaaacacatgatagcgggcgtcttcttcacatttgtattactattgtccgggcaaataacttggcgtgacatggctcatacgctcattatgattggaagtaacgcttcggaccgtatgggaatgggagtaacgtacctagcactaattgcaacatttaaaatacaaccattccttgcgttaggtttcttcttgcgaaagttaacttcacgtgagaacctattactaggagtgggtctagcaatggctactaccttgcaattaccagaagatatagaacaaatggccaacggaatagctttaggactaatggctctaaaattaattactcagttcgaaacatatcaactttggactgcactaatatcgttaacttgtagtaataccatatttacacttactgtagcgtggcgtacagcaacacttattctagccggcgtatccctactgcctgtttgtcaaagctcctccatgcgcaaaacagattggttgcctatgacggttgccgcaatgggtgtcccaccactcccgttattcatatttaatcttaaagatactctaaaacgaaggagctggcccttaaacgagggggtcatggcggttggattagtaagtatcctagcttcgtcattacttagaaacgatgtaccaatggcaggacccttggttgctgggggactattaatagcatgttatgtaattaccggcacaagtgcagatttaacagtggaaaaagcagcagacgttacttgggaggaagaggcagaacaaacaggtgtctcacataatcttatgataacagtggatgacgacggtactatgcggataaaagacgacgaaacagaaaacatattaaccgttctcttaaagacagcgctattgatagtatctggaattttcccctatagtattcctgcaactctattagtgtggcacacatggcaaaaacagacccagagatcgggtgtactatgggacgtgccgagtcctccagagacacaaaaagcagaactggaagaaggcgtttatcgcataaaacaacaggggatatttggaaaaactcaagtaggcgtaggtgtgcaaaaggagggagtttttcacacaatgtggcacgtaacaagaggtgctgttcttacttacaatggcaaacgattggaaccgaattgggctagtgttaagaaagatttaataagttatggaggaggctggaggttgtcagcacaatggcaaaaaggtgaagaggtacaagtcatagccgtggaacctggcaaaaatcctaagaatttccaaactatgcccggaacgtttcaaacaactacaggcgaaatcggtgctatcgcgctcgattttaaacctggaacaagcggtagcccaataattaatcgtgagggaaaagttgttggattatatgggaatggagttgtgactaaaaatggaggttatgtatccggtatagcccaaactaacgcagagccagatggtcctactcctgagttagaagaagagatgtttaagaaacgaaacttaaccataatggatctgcacccaggttcagggaagactagaaaatatctaccagctatcgttagggaagccataaaaagaaggttaagaacattgatactcgcaccaacaagggtagtcgcggccgaaatggaagaggctttaaaaggactaccaataagataccagacaactgctacaaagtcagagcacacaggtagggaaatcgtagacctaatgtgtcacgcaacttttacaatgagattattgtcacccgtaagagtacccaactataatctaataattatggatgaggcccacttcacggacccagcatcgatcgcagcccgtggttacataagtacaagagtcggcatgggagaggccgcggcaatatttatgacagcaaccccgccgggtaccgcagacgcattccctcaatccaatgcaccaatacaggatgaggagcgggatatcccggagagatcatggaactccgggaacgaatggataacagattttgctggaaaaactgtctggttcgtgccatctataaaggccggaaacgatattgctaattgtcttcgcaaaaatggtaagaaagtcatacaattgtcacgaaaaacttttgatacggagtaccagaaaacgaaattaaacgattgggactttgtagtcacgactgatatatcagaaatgggcgctaatttcaaagcggatagagtgatagacccacgtagatgcttaaaacctgtcatattaacagatggaccagagcgagtaatattagctggaccaatgccagtaactgcggcatctgctgcacaacggagaggacgagtcgggagaaatccccaaaaagaaaatgaccaatatatatttactggacagccactaaacaacgatgaagaccatgcacattggacagaggccaaaatgcttcttgataatattaatactccagaaggcatcataccagctctgtttgagcctgaacgggagaaaagtgccgctatagacggagaatacaggctaaaaggagaaagtagaaagacttttgtagagctgatgcgtagaggggatttaccggtttggctggcacacaaagtcgcaagtgaaggtataaaatacacggatagaaaatggtgtttcgatggacaacgaaataatcagatactagaagaaaatatggatgtagaaatctggacaaaggaaggagagaagaagaaactccgaccaagatggctagatgctcgcacatactcagatccactggcattgaaagaatttaaagattttgctgctggacgtaagtctattgcccttgatttagtaacagagatcggcagagtgccgacacatttggcccaccgaacacgaaacgcgttagataatctagtaatgctacacaccagtgaacatggtggaaaagcatatagacatgcagttgaagaactgccagaaactatggaaactctactactactcggcttaatgatccttctaacgggtggagcgatgttattcttaattagcgggaagggaattggaaaaacttcaattggccttatctgtgtgatagccagttcaggcatgttatggatggccgaaataccccttcagtggatagcttctgccatagttcttgagttcttcatgatggtccttctaattcctgaacctgaaaagcaacgaacaccacaggacaatcaacttgcgtatgtggtaataggcattctgacattagcagctattattgcagctaacgagatgggattacttgagaccacgaaaagagacctggggatgagcaaagaacccggtgtcgtcagtccaacatcatacttagatgtagacttacatcctgcatctgcctggactttgtatgctgtggcgacgacagttattactccaatgcttagacatactatagaaaatagtacagctaatgtaagtctcgcagccattgcaaatcaggcagttgtattaatgggtctagataaaggatggccaataagtaagatggacctaggggtgccactactagcgctaggttgttattcgcaagtcaatcctcttactttaactgctgcagttctactcttgatcactcattatgccatcataggaccaggtttacaggcgaaagcaacaagagaagctcagaaaagaaccgcagcaggaatcatgaaaaacccaacggtagacggtataatgaccatagatttggatccggttatatacgattcaaaattcgaaaaacaactgggacaagtaatgttgcttgtattatgtgcagttcaattattgcttatgagaacaagctgggctctatgtgaagccctcacacttgctactggaccaatcacgacgttatgggagggctcaccagggaagttttggaataccaccattgccgttagcatggcaaatatatttcggggtagttatctagccggtgcaggtttagcattttctataatgaagtctgttgggactgggaagcgaggaacaggctcgcagggagagacattaggcgaaaaatggaagaagaaattaaaccaattatcaagaaaggaatttgatttgtataagaaatcaggcataacagaagtcgacaggacggaagctaaagaaggacttaagagaggggaaattacacatcacgctgttagtaggggatcagcgaaactacagtggtttgtcgaaaggaatatggtaattcctgagggccgagtcattgatctgggatgtggccgcggaggttggtcttactactgcgctggcttgaagaaagtaaccgaggtcagggggtacacaaaaggaggtccaggacacgaggaacctgtaccgatgtccacttatgggtggaatattgttaaattgatgagcggcaaggatgtattttacttaccaccggagaaatgtgatactctcttatgtgacattggcgaatcgtcaccaagtccaacagtagaagaaagcagaactataagggtactgaaaatggttgaaccctggctaaagaataatcaattttgtattaaagtacttaacccatatatgcccacagttattgaacacctagaacgattacaaagaaaacacggagggatgctggtacgtaaccccctttctagaaatagcacacacgaaatgtattggatcagtaatggctcggggaacattgtagccagcgtaaatatggttagtcgcctgcttcttaacagatttacaatgactcaccgtagaccgacaattgaaaaagacgtagatctcggagctggaacaagacatgttaatgctgaacctgaaacgccaaacatggatgtaattggggaaagaatcaagcgaataaaagaagaacataactcgacatggcattatgatgatgaaaatccttataaaacttgggcctatcacgggtcatacgaggtaaaggccaccggttcagcttcctcaatgataaatggagttgtgaaacttcttaccaaaccatgggatgtagtgcccatggttactcaaatggccatgacagacactacaccattcgggcagcaaagagtttttaaagagaaggttgacacccgtactccgcgatcaatgccagggacccgtagggtaatgggcataactgctgagtggctatggcgaactttgggtcgaaataagaaaccgagactatgtacgcgagaagaatttacaaagaaagttcgcacaaatgcagccatgggggcggtttttacagaagagaaccaatgggattcagctaaagcagcagttgaggacgaagatttttggaaacttgttgacagagagcgtgaactacataaattaggtaagtgcggttcatgtgtttataatatgatgggtaagcgcgaaaagaaattaggtgaatttggcaaagcaaaaggtagtagagctatttggtacatgtggctcggagcacgatatctggaatttgaagcacttggatttttaaatgaagaccactggttttcgagagaaaattcatattcaggcgttgaaggggaaggactccacaaattgggatacatattacgtgatatatcaaaaatacccgggggagcaatgtacgcagatgatacagcaggctgggacacaagaatcacggaggacgaccttcataacgaggagaaaattacccagcaaatggatccggaacacaggcaactagcaaatgccatatttaaactaacgtatcaaaacaaagttgtaaaggtacaaagaccgactccaacagggacggttatggatatcataagtagaaaagaccaaagaggaagtggacaagttggtacatatgggttgaatacctttacaaacatggaagcgcaattaatacgtcaaatggagggagaaggagtattgtccaaggctgacttagaaaatccacacctacctgaaaagaaaattacccagtggctagaaacaaagggagttgaacggcttaaaaggatggcaatatctggagacgactgcgttgtgaagcctatagatgacagatttgcgaatgcacttttggcgttaaatgatatgggcaaagtaagaaaggatatacctcagtggcaaccttcaaagggttggcatgactggcaacaagttcctttctgctctcatcacttccatgaactcataatgaaagatggccgaaagctagtagttccttgtaggccgcaagacgaattaataggtagagcacgaatctcacagggagcgggatggagccttcgggaaaccgcctgtttaggtaaggcttatgctcaaatgtggagcttgatgtacttccataggagagacctacggttagcgtccaacgcgatctgttcagccgttccagtccactgggtaccaaccagtcgcacaacgtggtcgattcatgcacatcaccaatggatgacaactgaagatatgctaacagtatggaaccgggtatggattgaagacaatccttggatggaagacaaaacacctgtaacaacatgggagaatgtcccatacttaggaaagagagaagaccagtggtgtggctcattgataggtctcacatcgagagcaacgtgggcgcaaaatatacctaccgccatacagcaagtcagaagcctcatcggaaatgaagagttcctcgactacatgccctcgatgaaacgtttcaggaaggaagaagaatctgaaggggcaatttggtaa

SEQ ID NO: 23431 - RNA, 9873 nt, synthetic construct
  misc_feature 1..9873: note = derived and/or modified CDS sequence (opt6) from DENV-3__FJ639803__SS-prME
  source 1..9873: mol_type = other RNA
acttctttatgcttaatgatgatacttcctgcagcactagcattccacttgacaagtcgtgacggggaaccgagaatgattgtgggcaaaaacgaaagaggaaaatccttactctttaaaactgcgtcaggaatcaatatgtgcacgttaatagctatggacttaggagaaatgtgtgatgatactgtcacgtataaatgcccccatatcactgaagttgaacctgaagatatcgattgctggtgtaacctgacatccacatgggtaacgtatggaacatgcaatcaagcaggggaacacagaagagataaaagatctgtagctttagcaccccacgtaggaatgggtcttgatactcgtacgcaaacgtggatgagtgctgaaggagcatggagacaagtggaaaaagtggaaacctgggcactgcgacaccctggtttcacaattttggcactatttttagctcactacataggaacatcactaacacaaaaagtagttattttcattttactcatgttggtaacgccaagtatgacgatgcgatgcgtcggagtaggaaaccgagattttgtggaaggattgtccggggctacatgggtagacgtggttctggaacacggagggtgtgtaactacaatggcgaaaaataaacctaccctcgatatagaactacagaaaactgaagcaacgcaacttgctacactcagaaaattatgcattgaaggcaaaattacgaacataactacggatagtcgctgtcccacccagggggaagcagtcttgccagaagaacaagatcagaattatgtttgcaaacatacatacgtggacagaggttgggggaatggttgcggtttattcggaaaaggatctttagtcacttgcgcgaaattccaatgtctagaacctatagaaggcaaagtcgtgcaatacgaaaatttaaaatatactgtgatcataacagtacataccggagatcaacatcaagttggtaacgaaacacaaggagtaacagcagaaatcacaccacaagcatctactacagaagctattttacctgaatacgggacactaggacttgaatgcagtcctcgaaccgggctcgattttaatgaaatgatattactaacaatgaaaaataaagcgtggatggtgcatagacaatggttctttgacttaccacttccttggacctcgggtgccaccactgaaacaccaacctggaatcgcaaagaattgctagtaacatttaaaaatgcccacgctaagaaacaggaagtagtagtactcgggtcccaagaaggagctatgcacactgctttaaccggcgctaccgaaattcaaaatagtggtggaacatcgatattcgcaggacatttaaaatgccgacttaaaatggataaattagaactaaaaggtatgtcttatgcaatgtgcacaaatactttcgtcttaaagaaagaagtgtcagaaacacagcatggtaccatactgataaaggtggaatataagggtgaagatgtaccatgtaaaataccattttctacagaggacggacaagggaaggctcacaatggtagattaatcacagcaaacccggttgtaacgaagaaagaagaacccgtgaacatcgaagcggaacctccattcggcgaaagtaacattgttataggaataggtgacaatgcactcaaaataaattggtataagaaaggctccagtatcgggaaaatgtttgaggcaacagcaagaggtgccaggcggatggcaattctgggcgacactgcatgggatttcggttccgtagggggtgtacttaatagtcttggaaaaatggtccatcagatattcggtagtgcctacacggctttgttctcgggtgtatcatgggtgatgaaaatagggataggagttctcctgacttggataggtctaaatagcaaaaacacgtcaatgagtttctcatgtatcgcgataggcattataacattgtacttgggtgcagtagtacaagcagatatgggctgcgtaatcaattggaagggcaaagagcttaaatgcggatctgggatctttgtaacaaacgaagtacatacttggaccgaacagtataagtttcaagcggactcaccgaaaaggctggctaccgctatagctggggcgtgggaaaatggcgtatgcggaataaggagtaccacgcgtatggagaatctattatggaagcaaattgcaaacgagttaaattatattctatgggagaacaatatcaaactaacagtagtagtgggcgatattataggagtattggagcaagggaaaagaacgttaaccccacaacctatggaactaaaatatagttggaaaacatggggaaaagccaaaattgttacagcagaaacacagaacagcagcttcataatagatggacctaatacaccagagtgcccatcagcctccagggcatggaatgtatgggaagtcgaagactatggatttggagttttcacaaccaacatttggttaaaactaagggaagtatacacacagttatgtgatcaccgacttatgagcgcagctgtaaaagatgaacgagcagttcacgcagatatgggctactggatcgaaagccagaaaaatggctcatggaagttagagaaggcttcacttatcgaagttaaaacatgtacatggcctaaatcccatactttgtggtcaaacggagtgctagagagtgacatgattatccctaaatcactagctggtcctatatcccagcacaattacagaccgggatatcatacacaaacagcaggtccctggcacttaggcaagttggagttagattttaattattgtgaaggcactactgtcgtgataacagaaaattgcggaactagaggcccgtccctcaggactactaccgtctcaggcaaacttatacatgagtggtgctgtagatcttgcacgcttccccctttgcgttatatgggcgaagatgggtgctggtatggcatggaaataagaccaatatcagaaaaggaagaaaacatggttaaatctcttgtctcagctggcagtggtgaggtcgataattttaccatgggtgtactgtgtttggctatcttatttgaagaagtaatgagaggaaaattcggaaagaaacatatgatcgcaggagtattcttcacctttgttttattactttccggccaaatcacatggagggatatggcacatacactaataatgataggctcaaatgcaagcgacagaatggggatgggagtgacataccttgccttaatcgcaacatttaaaatacagccctttcttgcattagggttctttctacgaaaattgacaagtcgtgagaatttactactcggggtcggactagcaatggcaacaacgctacaattgccagaagacatagaacagatggcaaatggaatcgcactcggactgatggcgttaaaattaataacacagtttgaaacatatcaattatggacggctctgatcagtttgacatgtagcaatacgatttttacgcttacagtggcttggagaacagctactttaatactagcaggagtaagcctcctacctgtatgccaaagcagctctatgcgtaaaactgattggttacccatgacagtagcagcaatgggtgtgcctccattacctcttttcatatttaatttaaaagataccttgaaaagaagaagttggcctttaaacgaaggcgtaatggcagtaggtttagttagcatattagccagtagcttattaaggaacgacgtcccgatggccggacctctagttgccggtgggttgcttatagcatgttacgtgatcacaggaaccagtgctgatctgacagtagaaaaagcagccgatgtgacatgggaagaagaagccgaacagactggcgttagccataatctaatgattaccgtagacgatgacggcactatgagaataaaagatgacgaaacggaaaatatacttaccgtcctcttaaaaaccgcattgctaatagtgtctggaatcttcccttacagtattccagcaaccctcctggtctggcatacttggcaaaaacaaactcaacggagtggagtactatgggacgtccccagcccacccgaaacacagaaagcggaattagaagagggtgtctatagaatcaaacaacaaggcatctttggaaaaacacaagtaggggtaggcgttcaaaaagagggcgtgtttcacactatgtggcatgtgacaagaggagcagtcctcacgtacaatggaaaaagattagaaccgaattgggcgagtgtcaaaaaggatttgatttcatatggaggtggttggagactatccgcacaatggcaaaaaggagaagaggttcaagtaatagcagtcgaaccaggcaaaaaccccaaaaacttccaaacgatgccagggacgttccaaacaacaacaggagaaataggagccatagcactagactttaaaccaggcacaagcggatcaccaataataaacagagaaggaaaagtcgtcggattatacggcaacggagtagttactaaaaacggtggatacgtatccggaatagcacaaacgaatgctgaaccagacggtccaacaccagaattagaagaagagatgttcaagaaaaggaatctaacaataatggatctacatccgggttctggaaagacacgaaagtatctaccggcgattgtcagagaagcaataaaaaggcgattaagaacactaattcttgctcctaccagagtagtagctgccgaaatggaggaggccttgaaaggattaccaatacgatatcagacgacagccacaaaatctgaacacacaggaagagaaatcgtagacctaatgtgccatgcaactttcaccatgaggttactgtctcctgtgcgagtcccaaattataaccttataataatggacgaggcgcactttacagatccagccagtatcgcagcgcgtggatacattagtacaagagttgggatgggagaagctgcagctatcttcatgacagctactccacctggtacggcggatgcatttccccaaagtaatgcccctatacaagacgaggaacgggatatcccagagagaagctggaacagcgggaatgaatggataacagactttgcgggaaagacggtatggttcgtgccgtcgattaaggcaggtaacgatattgccaactgcctgaggaaaaacggaaagaaagttatacaactaagccgaaaaacttttgatactgaataccagaaaacaaaactaaacgattgggatttcgtagtcacaaccgatatatcggaaatgggagctaattttaaagctgaccgagtaatcgatccacgacgttgtctcaaaccagtgatcctgaccgatggaccagaaagggtgattctggcaggacctatgcctgtcaccgctgcgtcagctgcacaaagaagaggccgagtcggtaggaatccgcaaaaagaaaacgatcaatacatattcaccggacaaccactaaataatgacgaagaccacgctcactggaccgaagctaaaatgctcctagataatataaatactccagaaggtatcatacctgcattgtttgaaccagaaagagaaaaatctgcagctatagatggcgaatacaggctcaaaggtgaatcaagaaaaacttttgtcgagttaatgagaaggggtgaccttcctgtttggttggctcataaagtagcttcagaaggtattaaatatacagatcgcaaatggtgttttgacggccagcggaataaccaaatattggaggaaaatatggacgtcgagatttggactaaagaaggcgagaagaagaaacttaggccacgatggttagatgcaagaacctattcagaccctctagcgctaaaggaatttaaggactttgcagctggaagaaagtcgattgcacttgatttagtcacagaaattggtcgagtacccacacatctagcgcatcgcacaagaaacgctctagataatttggtgatgctccacacgtcagaacatggaggaaaggcttatcggcacgcagtagaagaactgccggagacgatggaaacgttgcttcttttgggattaatgatactccttaccggtggggccatgctatttttaattagtggtaaaggaatagggaagacatcaatcggattaatatgcgtcatagtctcatcagggatgctatggatggcagaaataccattgcaatggatcgcctcagccatcgtattagagttctttatgatggtactactaatccctgaaccagagaaacaacggacaccacaagacaaccagcttgcttacgtagtcatagggatattaaccttggctgcaattattgccgcaaacgaaatgggccttctagagacaactaagagagacttaggaatgtcaaaggagcccggtgtagttagccccacaagttacctagatgttgacttgcatcctgcaagtgcatggactttatatgcagtggcgacaacagtgattactccaatgctacggcatacaatagagaacagcactgcgaacgtaagcctcgcggctatcgctaaccaggccgttgtcctcatggggttagacaaaggatggccaataagtaaaatggatcttggagtacctttgctagccttggggtgttattcacaagtgaatccattaacactcacagcggcggttctgttacttataacacactatgctattattggtccaggattgcaggctaaagccacacgcgaagcgcagaaaagaacagccgcaggcattatgaaaaatccaacagtagatggtatcatgacaatcgacttagatccagtgatttacgactctaaattcgaaaaacaactcggtcaggtaatgcttttagtactgtgcgcggtacaactgttgcttatgagaacgagttgggctctgtgtgaggccttgaccctagcgacaggaccgataaccactctctgggaagggtccccgggtaaattttggaatacaacaatagctgtgagtatggccaacatatttcgagggagctaccttgctggggcagggctagcattcagtataatgaaatcggttggaacaggtaagaggggtactggaagccagggagaaacattaggcgaaaaatggaagaagaaactgaaccaactatcaagaaaggagttcgacctatacaaaaagagcggtatcacagaggtggatcgtacagaagccaaagagggtttaaagagaggcgaaattacacatcatgcagtctcacggggaagtgcaaagttgcagtggttcgttgaacgaaacatggtaatccccgaaggaagggtgattgatttgggatgcggaaggggaggttggtcctattattgcgccgggctcaaaaaggtaacggaagtaagaggctatactaaaggcggaccaggacacgaggagccagtaccaatgagcacttatggatggaatatagttaaattaatgagtggaaaggacgtgttttatttaccaccggaaaaatgcgatacactactatgcgatattggagagtcatcgccttccccgactgtggaggaatcaagaacaatccgtgttttaaaaatggtagaaccgtggcttaaaaataatcaattttgtataaaagtactaaatccctatatgccaacagtaattgaacatctggaacggctccagcggaaacatggcgggatgctagtcaggaatccactaagcaggaactcgacacacgaaatgtattggataagtaacggtagcggcaacatagtagcaagtgtaaacatggtatcgcgtctattactcaaccgattcactatgactcacaggagaccaactatagagaaagacgtcgatctaggagcaggaacgagacacgtaaatgcggaaccagaaacaccaaacatggatgtaataggagaacgtataaaacgcattaaggaagaacacaactccacttggcattatgacgacgaaaatccctataaaacctgggcctatcacgggagctatgaggtgaaagcaacaggcagtgcttcaagcatgataaacggcgtagtaaaactattaacaaaaccatgggatgttgtacccatggtaactcaaatggcaatgaccgacacgacaccattcgggcagcaaagagtgttcaaggaaaaggtcgatacgagaacaccgaggtcgatgccgggaacgagacgtgtcatggggataaccgcagaatggctatggcgaacgcttggaagaaataagaaaccacgactatgcacgagagaggagttcactaagaaagtcagaaccaatgctgcaatgggtgcagtattcacagaagaaaatcagtgggatagtgccaaagccgcggttgaagatgaagatttttggaaattagtagacagagaacgagaactccataaactaggaaaatgtggttcgtgcgtctacaacatgatggggaaacgggaaaagaaattaggtgaatttggaaaagcaaaaggtagtagagcgatttggtatatgtggttgggtgctcggtacttggagttcgaagcgcttgggtttctaaatgaagatcattggtttagtcgtgaaaattcgtacagcggagtagaaggtgaaggcttacataaactcggctatattttgagagatatcagtaaaataccaggtggagcaatgtacgcggatgatacggcaggttgggacacgcgcataacagaggacgatctgcataacgaagagaaaattactcaacagatggaccccgagcacagacaactggcaaacgcaatatttaagttaacatatcaaaacaaggtagttaaagtgcaacgtccaactccaacgggtacagtaatggatattattagtcggaaagaccaacgaggaagtggacaagtaggtacatatggactcaacaccttcactaacatggaggcccaacttataagacaaatggaaggcgaaggcgttctctccaaagcagacttagaaaatcctcatttaccagagaagaaaatcactcaatggctagagacaaaaggagttgaacggttaaagagaatggcaatttcaggtgacgactgtgttgtgaaacccatagatgacagattcgcaaacgcattacttgcgcttaacgacatgggaaaagtaaggaaagatattccacaatggcaaccttccaaaggctggcatgattggcaacaagtgcctttttgcagtcatcactttcatgagttaattatgaaagatgggagaaaattagtagtaccatgtcgtccccaagatgaactgatcggtcgagctcgaatttctcaaggtgcagggtggagtctgcgagaaactgcatgcctcggtaaagcatatgctcaaatgtggagcttgatgtattttcataggcgagatttgcggcttgcatcgaacgccatatgctctgcagtaccagttcattgggtaccaacgagtcgcacgacttggtcgatacatgcccaccaccaatggatgacgacagaagatatgttaactgtctggaatcgagtgtggattgaagataatccatggatggaagataaaactccagtcaccacgtgggaaaatgttccatacctcgggaaacgcgaagaccaatggtgtggatctcttataggattaacttctcgcgctacttgggcccaaaatattcctacagcaattcaacaggtcaggtccctgataggaaacgaagagttccttgattatatgccaagtatgaaaagatttcggaaggaagaggagagtgaaggagcaatatggtag

SEQ ID NO: 23432 - RNA, 9873 nt, synthetic construct
  misc_feature 1..9873: note = derived and/or modified CDS sequence (opt6) from DENV-3__FJ639804__SS-prME
  source 1..9873: mol_type = other RNA
acttctttatgtctcatgatgatcttaccggcagctcttgcgtttcatctcacatctagagacggagaaccacgaatgattgtaggcaaaaatgaaaggggcaaatcattattgtttaaaacagcttcaggaataaacatgtgcacattgatagctatggatctcggagagatgtgcgacgataccgttacatacaaatgcccacacataacagaagttgaacctgaagatatagattgctggtgcaaccttacttctacatgggtaacatatgggacgtgcaaccaagctggtgaacatagaagagacaaacgatcagtagcattagcaccccatgttggtatgggactggacaccaggacgcaaacatggatgtctgcagaaggggcatggaggcaagttgaaaaagtcgaaacttgggcacttagacatccaggctttacaatattagcactgtttttggctcattacattggcacatcactgacccaaaaagtagtaatatttatactcttaatgttagtaacaccaagtatgacgatgagatgtgtaggtgttggcaatagagattttgtagaagggttgtcaggagcaacttgggttgatgtagttctggaacacggcggatgcgtaaccacaatggccaaaaataaacctacgctagacattgaactacagaaaaccgaggcaactcaactagcaacactaagaaaactatgcatagagggcaaaataaccaacataactactgactcccgatgcccaactcaaggagaagcggttttacccgaagaacaagatcaaaactatgtatgtaaacacacatacgtggatcgaggctggggaaatggctgcggattatttggaaaaggaagtttggtaacatgtgccaaatttcaatgccttgaaccaatagaaggcaaagtagtacaatatgaaaacctcaaatatacggtaataattactgtgcacacaggagaccagcatcaagtaggaaacgaaacacaaggagttacagctgagatcacgccacaagctagtaccacagaagcaattctaccagaatacgggacactaggtttggagtgcagtcccaggacaggattggattttaatgaaatgatcttgctgacgatgaaaaataaagcatggatggtgcaccgacaatggttctttgatctaccactgccctggaccagtggagcgaccacggagacccccacctggaataggaaagaattgttagtaacctttaaaaatgctcacgcgaagaaacaggaagtcgttgtactgggaagccaggagggagcgatgcatacggcacttacaggcgctacggagatacaaaatagcggcggaacttcgatcttcgccggtcacctaaaatgcagattaaaaatggacaaattagaactaaaaggcatgtcttatgctatgtgcaccaacacgttcgtactaaagaaagaggtatctgaaacacaacacggaactatattgataaaagttgagtataaaggagaagatgtaccatgcaaaatacccttctcgacagaggacggacaaggaaaagcacacaatggacgactcataacagcaaacccagtagtcacaaagaaagaagaaccagtaaacattgaagcagaacccccattcggggaatctaacatagtaatcggaataggggataacgctctaaaaataaattggtataagaaaggatctagtataggtaagatgttcgaagcaacagcgaggggagcacgtagaatggctatattgggagacacagcctgggattttggatcagtcggaggagttttaaattcactaggtaaaatggtacatcaaattttcggatcagcgtatactgcactattctcaggagtatcttgggttatgaaaattggaataggggtcctattgacttggatcggccttaacagtaaaaatacttccatgagtttcagctgtattgcgattggaataatcacactatacttaggagccgttgtacaagcggatatgggttgcgtaataaattggaaaggaaaggaattgaaatgcgggagtggaatcttcgtgacaaacgaggtccacacatggacagaacagtacaaattccaggcagactcgccaaaaaggttggcaacagcgattgcaggagcctgggaaaacggtgtgtgcggaataaggtcaactactagaatggaaaaccttctttggaaacaaattgcaaatgagttaaactacatattatgggagaataatataaaacttaccgttgtggtaggggacataatcggagtcctagaacaaggtaaaagaacgttaaccccacaacccatggaactaaaatacagttggaagacgtggggaaaagcaaagatcgtcactgcagaaacacaaaacagctcatttataattgacgggccaaacacacctgagtgcccatcagccagtagggcatggaacgtctgggaagtcgaagattatggattcggagtcttcacgacaaatatttggctaaagttacgagaagtatatacgcaactatgcgaccatagacttatgagtgcagccgtaaaagatgaaagagcagtacatgctgatatgggatattggatcgagagccagaaaaacggttcttggaaattggaaaaggccagcttaatagaggtaaagacttgcacatggccaaaaagccatacgttatggagcaacggtgttcttgagtcggacatgattattcctaaaagtctagcagggccgatatcacaacataattatcgacctggttaccacacacaaacggcaggcccttggcatttaggtaagctcgaattggattttaattactgtgaaggtacaacggtcgtaataaccgaaaattgtggtactagaggtccatccctaagaaccacaaccgtttcagggaaactaatacacgaatggtgttgtagatcatgcacccttccaccactgaggtatatgggcgaggatggttgttggtatggtatggagattagaccaataagtgaaaaagaggaaaacatggtgaagtccttagttagtgcgggatcaggtgaagtcgataattttacgatgggcgtactatgtttggcgattctatttgaggaagtgatgcgaggtaagtttggtaaaaagcatatgatcgcaggcgtattctttactttcgttctattactatcaggacagataacttggcgagatatggcccatactttaatcatgattggatcaaatgccagtgatcgtatgggcatgggagtgacgtatcttgctctaatagcaacattcaaaatccaaccgtttctagctctgggattctttctcaggaaacttacatctcgtgaaaacctgctactaggcgtcggtttagcaatggctacaacacttcaactgccggaagatatagaacaaatggcaaatggtattgcactcggtctgatggctctcaaactaataacccaatttgaaacgtatcaattatggacggctctgatatcattgacatgttcaaataccatatttacattaactgttgcttggagaacggcaactcttattctagccggagtatcattactacccgtgtgtcagtcatcttccatgagaaaaacagactggttaccgatgacagtagctgcgatgggggtcccaccacttcccctgttcatattttcacttaaggacaccttaaaacgaagaagctggccattaaacgagggcgtaatggccgtaggacttgtttctatattagcatcttcattattaaggaacgatgtccctatggcgggacctctggttgctggtggtcttctaatcgcatgttatgttatcacaggaacatctgcagatttaacagttgagaaagcggcagatgtcacttgggaggaagaagccgaacaaactggagttagccataacctaatgattaccgtggatgacgacgggaccatgcggatcaaggacgatgagaccgaaaacatcttaacagtattattgaaaacagcattacttatagtctcaggtatatttccatattccatcccggctactttgctagtatggcacacttggcaaaagcaaacccagcgtagcggggtcttgtgggatgtcccgagcccacctgagacgcaaaaagctgaattagaggaaggcgtctatagaatcaaacaacagggcatatttggcaagagtcaggttggagtaggcgtccaaaaagaaggagtgttccacaccatgtggcacgtaacgcgaggagccgtcctgacctacaacgggaagagactagaacctaattgggcaagcgtaaagaaagacttgatcagttatggaggtgggtggagattgtctgcacaatggcaaaaaggtgaagaggtgcaggtaatagccgtggaacccggtaagaatcccaaaaattttcagacgatgcctgggacctttcagacaaccactggtgaaattggagcgatagcattggatttcaaacccgggacttcgggcagtccaatcataaatagagaagggaaaattgtaggactttatggtaacggagtagtcacgaagaacggtgggtatgtgagcggtatcgcccaaacaaacgcggaacccgatgggccaacacccgaactagaagaagagatgttcaaaaagagaaacttaacgatcatggacctacatccgggcagcggcaaaactcgcaagtacttgccagcaatagttcgagaggcaattaaacgtaggctaagaactctcattttagcacctactcgagtggtagccgcggagatggaagaggccctcaagggcctcccgattaggtaccaaacaactgctacaaaatcagaacacactggaagagagatagtagatttaatgtgtcatgcaactttcactatgagattattaagtccggtaagagttcccaattataatttaattataatggacgaagcacattttacagatcctgctagtatagcagcgcgaggatatatatctactcgagtcggtatgggcgaagcagcagctatatttatgacagccactcctccaggtacagctgacgcttttccgcagagtaacgctccaattcaagacgaagaaagagatataccagaacgaagctggaactcaggcaatgaatggataacagatttcgctggaaaaaccgtttggtttgtgccatcgatcaaggcagggaatgatatagctaactgtttgaggaaaaatggtaagaaagttatccaactaagtaggaaaacctttgataccgaatatcagaaaacaaaattgaacgattgggattttgtagtgactacagacatctctgaaatgggagctaacttcaaagcagatcgagtaatagatccaagaaggtgtctgaagcccgtgatcttaaccgatggaccagaaagagtaattctggccggacctatgcctgtcacagcggcttcggcagcccagagaaggggaagagtggggagaaaccctcaaaaagaaaatgatcaatatatctttacaggacagccacttaataatgacgaagaccatgcacattggaccgaggcgaaaatgcttttagacaacattaatactcccgaaggcattatacccgctctttttgaacctgaaagagaaaagtcagcagcaatcgatggtgagtaccgactaaaaggtgaaagtaggaaaacgtttgtagagctaatgcgcagaggtgatcttccagtgtggttagcacataaagtagcgtcggagggcatcaaatatacagatcggaaatggtgttttgatgggcaacgcaacaaccagatactagaagagaatatggatgttgaaatttggacgaaagagggtgagaaaaagaaactgaggccacgatggctcgatgcccgaacttactcagatccattggcacttaaagaatttaaagatttcgcggcaggaagaaaaagtattgcattagatctagttacggaaatcggtagagtccccacgcatttggcgcaccgcactcgtaacgccttagataatctcgtaatgttgcatacaagcgagcatggtggcaaagcatatagacatgcagtagaagaacttcccgagaccatggagaccttacttttacttggcttgatgatactgttaacaggaggcgcaatgctattcttgatcagtggaaaagggatagggaaaacatctatcggtcttatatgtgtaatagcaagttccggtatgctttggatggctgaaataccattacaatggatagctagtgctatcgtattggagttctttatgatggttcttcttatacctgaacctgaaaaacaaagaaccccacaagataaccagttggcatacgttgtcatagggatattaacactcgcagcaacgatcgcggccaatgaaatggggttgttagaaactacgaaaagggacttgggaatgtcgaaagagcccggagtcgtctcccctacgtcgtatctagacgtcgatctacacccagcctccgcatggactctttatgcggttgctacgacagtaataacacccatgttacgtcatacaatcgaaaattcgaccgcaaatgtatcactagctgctatagcaaatcaagcggtcgtcttaatgggtttagacaagggatggccaatctcaaagatggatttaggagtcccacttctcgcactaggctgttattcgcaagttaatcccctaactttgacagcggcggtattattactcataacacactacgctataatcggtcctggcctgcaagctaaagcgacaagagaagcgcagaaaaggacagccgctggaataatgaaaaacccaactgttgacgggataatgactatagaccttgatcccgttatatacgattcgaaatttgaaaaacaactaggacaggtaatgctattggtactttgcgcagttcaattattgctaatgagaactagctgggcgttatgtgaagcacttactctagcaacaggccccataacaaccttatgggaaggtagtccaggaaaattctggaatacaaccatagcagtgagcatggctaatatttttcgggggagttatttggccggggcaggactggcatttagtatcatgaagtcagtaggaacgggtaaaagaggtacggggtctcaaggggaaacgctaggagaaaaatggaagaagaaattaaaccagttaagtaggaaagaatttgatttatataaaaagtcgggcataacggaagttgaccgtaccgaggccaaagaggggcttaaaagaggcgaaattactcatcatgctgtttcacgcggctctgcgaaattacagtggtttgtggaaagaaacatggtcataccggaaggaagggtaatagacttaggatgtggacgagggggatggtcgtactattgcgctggacttaagaaagtaacagaagtcagaggatacacaaaaggtggacctggtcacgaggaacctgtaccaatgtcgacatatggctggaatatagtaaaattaatgtcgggaaaggatgttttctatcttcccccggagaaatgcgacacacttctatgtgatattggcgagagctcaccatcaccaacagtcgaagagtcaaggactatcagagtacttaagatggtcgaaccttggcttaaaaacaaccaattttgtataaaggtattaaatccatatatgcccactgtcatcgaacatttagaacgactccaacgtaaacatggagggatgctagtgagaaatccattgagcagaaattccacccacgaaatgtattggatttccaacggaaccggcaacatagtagcatccgtcaatatggtaagcagattacttttaaaccgatttaccatgacgtatagaaggcccactatagaaaaagatgttgatctcggtgcaggaacaagacacgtcaatgccgagccggaaactccaaatatggatgttattggagaaaggatcgaaagaataaaagaggaacacaatagcacctggcattatgatgatgaaaatccatacaagacttgggcctatcacggtagctacgaggtcaaagcaactggttcagcatcgtctatgattaacggggtggttaaattactgacaaaaccttgggacgttgtccccatggtaacacaaatggcaatgacagataccaccccctttgggcagcagcgggtattcaaagaaaaagtagatactagaatcccgcgatcaatgccggggactagaagagttatgggcatcactgccgaatggctgtggagaacacttggtagaaataagaaaccacgcctatgtactcgggaggagttcacgaagaaagttcggacaaacgccgcaatgggggcagtcttcacagaggaaaaccaatgggacagcgccaaagcagcagtcgaagatgaagacttttggaaactcgtggatcgagaaagggaattacataaactaggcaagtgtgggtcatgcgtttacaatatgatgggcaaacgggagaagaaattgggcgaatttggtaaagccaaaggatccagagccatatggtatatgtggctcggcgcacgatatttagaatttgaagcattagggttcctaaatgaagaccattggtttagtcgagaaaattcttattccggagttgaaggcgagggattacataagctcggttacatcctaagagatataagcaaaataccaggaggagcaatgtacgccgatgatacagctgggtgggatactagaattacagaagatgatttacataatgaggagaaaatcactcaacaaatggatcctgagcatcgtcaactcgcgaatgcaatctttaaactaacttatcaaaataaagttgtaaaagtacagagaccaacaccgactggaacagttatggacataatttcaaggaaggaccaaaggggttcaggacaagtaggcacttatggactaaatacctttacaaacatggaggcacaattgataagacaaatggaaggagaaggtgttctctcgaaagcagatctcgaaaatccacacctacccgagaagaaaattacacaatggctcgaaacgaaaggggtagagcgactcagaagaatggccatatccggagacgattgcgtcgttaagccgatagacgatagattcgcgaatgctttgttggccttaaatgatatgggcaaggtacgaaaagatatcccccagtggcaaccgtctaaaggttggcacgactggcaacaggttccattttgttcacaccacttccacgagcttattatgaaagatgggcgaaaactcgttgtaccatgtagaccacaagatgaattgattggcagagcccgaatatcacagggagcaggttggtcactacgagaaacagcttgcctaggcaaggcatacgcacaaatgtggagcttgatgtattttcatagacgtgatttaaggctagcaagtaacgcaatatgcagtgcagtacctgtacattgggtacccacgagcagaactacttggagtattcatgcccaccaccaatggatgaccaccgaggatatgttaacagtatggaatagagtttggatagaagacaacccttggatggaggataaaacgcccgttaccacatgggaaaatgtgccctacctaggaaaaagagaagatcaatggtgcggtagcctcatcggactgacatctcgagcgacttgggctcaaaacatacctacggcaattcaacaagtgagaagtttaataggaaatgaagagtttcttgattatatgccctctatgaagagatttcgaaaagaggaggaaagtgaaggagctatttggtaa

SEQ ID NO: 23433 - RNA, 9873 nt, synthetic construct
  misc_feature 1..9873: note = derived and/or modified CDS sequence (opt6) from DENV-3__FJ639805__SS-prME
  source 1..9873: mol_type = other RNA
acaagcctttgccttatgatgatattacctgccgcattagcctttcacttaacctcacgtgacggagaaccaagaatgatagtgggaaaaaatgaacggggaaaatcattgttatttaaaacagcctctgggatcaacatgtgtactctcattgcgatggatttgggcgagatgtgtgatgatacagtaacatataaatgcccacacattacagaagtagagcctgaagatatagattgttggtgtaatttgacatcgacttgggttacgtatggaacatgtaaccaagccggagaacatagaagagataagcgttccgtggccttagctccacacgtgggtatgggactggatacccgcactcaaacatggatgtcagcagaaggagcatggcgccaagtagaaaaagtagaaacatgggctttaaggcaccctggctttaccatattagcactttttttggcacattacatcgggacctctttaacacaaaaagtagtcatatttatattactcatgctagtgactccaagcatgaccatgcgttgtgtcggtgtaggcaatagggatttcgttgagggacttagcggtgcaacctgggtggatgtggtattagagcatggcggatgtgtcaccactatggcgaagaacaagcctacgctagatatcgagctacaaaagacagaggcaacccaactcgccacattgaggaaattatgtatcgaggggaaaataaccaacatcactacggactcccgctgtcctacacagggagaagccgtactaccagaagaacaggatcaaaactatgtatgtaaacatacttacgtagaccgcggatggggaaacggctgtggattatttgggaagggaagcttagtcacttgtgcgaagtttcaatgcttagagccgatagaaggaaaagtagtacaatacgagaatttgaaatatacagtcattataaccgtacatacaggagatcaacaccaagtggggaatgaaactcaaggcgtaaccgcagaaattacacctcaagctagcaccacggaagctattctaccagaatacggtacactgggactagagtgcagcccaaggactggtctagactttaacgaaatgattctgctaactatgaaaaataaagcatggatggtgcatagacaatggttcttcgatctaccacttccctggacgagcggagccacgactgaaacaccaacatggaatcgaaaagagctattagtgacttttaaaaatgcacacgctaaaaaacaagaagtagtggtgcttggatcacaagaaggcgcaatgcatacagctctaacaggcgccacagagattcaaaatagtgggggaacttctatattcgcagggcatctaaagtgtagattaaaaatggataaactagagcttaagggaatgtcgtatgcaatgtgtactaacactttcgttttgaagaaagaagtgtccgaaacacaacatgggacgatacttataaaggtagaatataaaggtgaggatgtcccttgtaagattccattttcaactgaagacggtcaggggaaggcacacaatgggaggttaatcactgctaaccctgtcgttacgaagaaagaggaaccggttaacatagaggcagaaccgccattcggggaatccaacatagtaattgggataggggataacgcattaaaaataaattggtacaaaaaagggtcaagtatagggaaaatgttcgaagctacagcaagaggtgcgcgtcgaatggctattttaggcgataccgcctgggacttcggatcggttggaggagtactaaatagccttggaaaaatggtgcatcagatctttggatctgcttatactgcattattcagtggtgtaagttgggtaatgaaaataggtataggcgtgcttttaacttggataggcttgaattcaaagaatacttcaatgagtttctcatgcattgctataggaataattacattatatttgggagcagtcgtacaggccgatatgggatgtgtaataaattggaaagggaaagaattaaaatgtggatcaggtatcttcgtgactaacgaagtgcatacatggacagaacaatataagttccaggccgatagtcccaaaaggctagcaacagcgattgcaggcgcgtgggaaaacggagtctgtggaattagaagtacaactcgtatggaaaatctactatggaaacaaatagctaatgaactaaattacattctgtgggaaaacaatatcaaattaacagttgtagtaggtgatataattggtgttctagaacagggaaaacgcacactcactccgcaacctatggaactcaaatattcatggaagacatgggggaaagcaaaaatcgtaaccgcagaaacccagaatagctcctttattatagacggtccaaacaccccagagtgtcccagtgctagcagagcatggaatgtatgggaagtagaagactatggctttggcgtgttcactacaaatatatggctcaaattgagagaagtctatactcaactatgtgatcatcgtctcatgtcagcagcagttaaagacgaaagagccgttcacgctgatatggggtattggatagaaagtcaaaaaaatggaagctggaaactcgagaaagcatccttaatcgaagtaaaaacgtgcacatggcccaaaagccacacattatggtctaatggagtcctggagtcagatatgattatcccaaaaagtttagctggcccaatctcacaacataactaccgacctggatatcatacccaaacagcgggcccatggcacctaggcaaattagaactagattttaattactgcgaaggaactacggttgtaataactgaaaactgtggtactcgaggtcctagtctacggaccacgacagtcagcggaaaactaatacacgaatggtgttgccgtagttgtaccttaccccccttacgctacatgggcgaagacggatgctggtacggcatggaaattcgaccgatttcagaaaaggaggaaaacatggttaagtcgctagtttctgctggttcaggggaagttgataacttcactatgggagtactttgtctcgcgatattatttgaagaggtgatgagaggcaaattcggcaaaaaacacatgatagcaggtgtatttttaaccttcgtacttttgctttcaggacaaattacgtggcgcgatatggcgcacaccttaattatgataggtagtaacgcatcagaccgaatgggaatgggagtaacttatctggcccttatagcaacctttaagatacaacccttcctcgctttaggtttttttttaaggaaactaacgagtcgagaaaaccttcttctgggtgtaggtctagcaatggctacaacccttcagctacccgaggatatcgagcaaatggctaatggtatagcactgggattaatggctctaaagttaattacccaattcgaaacgtaccagctatggacggctctaatatcgctcacgtgttctaatactatattcacattgactgtcgcctggagaacagcaacattaatattggccggagtatcactattaccggtatgccagtcctcgagcatgaggaagactgattggttgcccatgaccgtggcggctatgggggtccctccattaccactttttatctttaatctcaaagatacccttagaaggcgaagttggcctttaaatgaaggagtaatggcagtaggacttgtatctatattagcatccagcttgcttagaaatgatgttccaatggcaggtcctcttgttgcaggaggacttctaattgcttgctatgtaattacaggaacatcggcagacctgaccgttgaaaaagcggcggatgtaacgtgggaggaagaagcggaacagacaggagtaagccataacttaatgattacggtagatgatgacggaacaatgcgaataaaggacgatgagaccgaaaatatactaacagttttactaaaaactgcactcttaattgtctccggaatttttccatattcgatacccgctactttactggtatggcatacatggcaaaaacaaacacaaagatccggagtactttgggatgtaccaagcccacctgaaactcaaaaagctgaactagaggaaggagtttaccgcataaaacagcagggaatcttcggtaaaacccaagtgggggtaggcgtgcaaaaagaaggcgtattccataccatgtggcacgttacacgaggagccgttttaacttataacggcaaaagattagaacccaactgggcaagcgtaaaaaaagatctaatttcgtacggaggtggctggagattatctgctcaatggcagaaaggagaagaagtacaagttatagcagtggaacccggtaagaatccaaagaattttcaaacaatgcccgggacgtttcaaactacaactggtgagattggcgctatagcattagactttaaacctggcactagtggttcacctattataaaccgagaaggtaaagtagtgggtttatatggcaacggagtagtgacaaagaatggtggatatgttagtgggatagcacaaacaaatgcagaaccagatggtccaacaccagaactggaagaggagatgttcaaaaaacgaaacttaacaatcatggatttgcatcctggctccgggaaaacccgcaagtacttaccagccattgtacgcgaagcaataaaacgaagacttagaactttaatcttagcaccaacacgagttgtagcagcagaaatggaagaagccctaaaaggactgcctatacgctatcagacaaccgctacaaaaagtgaacatacaggaagggagatagtggatttaatgtgtcatgcaacctttacgatgagactattaagcccagtacgagttcccaattataatttgatcataatggatgaagcgcacttcaccgatcccgctagtatagctgcacggggctacatcagcacacgagtcgggatgggggaagcagccgcgatatttatgacagccacaccacctggaactgccgacgcattcccccaatcaaatgcccctatccaagatgaagaaagagatattcccgaaagatcatggaactctggtaacgaatggataacggattttgcgggtaaaacagtatggttcgttccttcaataaaagctgggaacgatatagcaaattgcttacgaaaaaatggaaaaaaagtcattcaattaagtagaaagacatttgacactgaatatcaaaaaacgaaattaaacgattgggactttgtagtaaccacagatatttcagaaatgggagctaatttcaaagcagatcgagtcattgaccccagacggtgtctgaaaccagtgatacttactgatggccctgaacgtgtcatacttgccggacctatgccagtgactgccgcgtcagcagcacaacgtaggggtcgagtaggtagaaaccctcaaaaggaaaacgatcagtacatttttacaggtcagccgctaaataacgatgaagatcatgcccattggaccgaagccaaaatgttactcgataacataaatactccggaggggattatacccgcactgtttgaacccgaacgtgaaaaatcggctgccatagacggcgagtatagattgaaaggtgaaagcagaaaaacattcgtcgaactgatgcgccgaggagatctgcctgtatggttagcccacaaagtagcctcggaaggtattaaatatactgatcgaaagtggtgcttcgatgggcaacgaaataatcaaattttagaggaaaacatggatgttgaaatatggacgaaagagggtgagaaaaaaaaactccgtcctagatggttagatgcgagaacttactctgacccattggctctaaaagaatttaaagattttgcagctggcaggaagtccattgctttagacttagtcacagaaataggtagggtacccactcatttagcacatcgcacaagaaatgcactagataatctagtaatgcttcatacaagtgagcacggtggaaaggcatatcgccacgccgttgaagaactacctgagacaatggaaacacttctattgttaggtcttatgattctactaaccggaggggccatgttattcctgataagtggtaaaggtcttggtaagacttctattggactgatatgtgtaattgcttcatctggcatgctctggatggcggaaatccctctacaatggatagcttctgcaatagttttagaattctttatgatggtattacttatcccggaacccgaaaaacaacgaacccctcaagataaccagcttgcttatgtcgtaataggcattctcaccttagccgctataattgcagcaaatgaaatgggattattagaaacaactaaacgcgacctaggaatgagtaaagaacccggcgttgtcagccccacaagttatctagatgtagatcttcacccggcctctgcatggactttatatgcagtagcaacaacggtaataacaccgatgctccgacacactatagaaaattcgacggcaaacgttagtttggcagcgatcgccaaccaggccgtagtgcttatgggtcttgataaagggtggccaatttcaaaaatggatctaggtgtcccacttctcgcacttggttgttatagccaagttaaccctcttacgctcacagcagccgtgttgttattaattacccattatgcaatcataggacctggattgcaggccaaagccacaagagaagcacaaaagcgcaccgcagcagggattatgaaaaatccaacagtcgatggaataatgacaattgatctagacccagtaatatacgatagtaaatttgaaaagcaactcggtcaagtaatgctcttagtactctgtgctgtacaattacttcttatgcgaacctcatgggctctatgtgaggcattaactttagccaccggtccaataaccacactatgggagggaagcccaggtaaattctggaatactactatagctgttagtatggccaatatctttcgaggatcttatcttgcaggcgccggcctagccttctcaattatgaaatcagttggaactggaaaaagaggtacaggatctcaaggagaaacattgggtgaaaaatggaaaaaaaaattaaatcaactgagccgaaaagaatttgacctctacaaaaagagcgggataactgaggtcgatagaactgaagccaaagaagggctgaaaagaggcgaaattacccatcatgcggtgagcagaggatcagccaaattgcaatggtttgtggaaaggaacatggtaattccagaaggccgtgttatagaccttggttgtggaaggggaggatggagttactattgtgccggccttaaaaaagtaacagaagttcgaggctatacaaagggtggaccaggacacgaagaacctgttccaatgtctacctacggatggaatatagtaaaacttatgtcagggaaagacgttttttacctcccaccagaaaaatgtgacacactcttatgcgatattggagagagctcaccttctcctaccgttgaagagtccaggacaatacgtgtgctaaaaatggtagaaccatggctaaagaataatcaattttgtataaaagttttgaatccatatatgccaaccgttatagaacatttggaacggttacagcgaaaacacggaggaatgctcgtgaggaaccccctatctagaaatagtacgcatgaaatgtactggatttccaatggcacggggaacatagtcgccagtgttaacatggtttctcgcctgttgctaaatagatttacgatgacacatagaagacctaccatagaaaaagacgtagatctaggagcaggaacccgtcatgtgaacgctgaacccgaaacaccaaatatggatgtcatcggggaacgaataaaacgtataaaagaagaacataattccacttggcactacgatgatgagaatccgtacaaaacctgggcatatcatgggagttacgaggtaaaggctacggggtcagcaagctcaatgataaatggagttgttaaacttctgacaaaaccctgggatgtggtaccgatggtgattcaaatggcaatgacagatacaacccccttcgggcaacagagggtattcaaggaaaaagtcgatactcggacacctagaagtatgccaggcactcgtagagtaatgggaatcacagctgaatggctatggagaacactaggtagaaataaaaaacctcgattatgtacccgagaggaatttactaaaaaagtacgcaccaatgcagcgatgggcgccgtatttaccgaagagaatcaatgggatagcgcaaaggcagcagtagaagatgaggatttttggaaattggtggatagagaacgagaattgcacaagcttgggaaatgtggctcgtgcgtatataacatgatgggtaaaagagagaagaaattaggagagtttgggaaagcgaaagggtctcgtgctatttggtacatgtggttaggagctcgttacttagaatttgaagcactgggttttttgaatgaagaccattggttttctcgagagaacagctatagtggagtggagggtgagggattacacaaattgggttatatcttgagagatatctctaaaataccaggaggagcgatgtacgcggacgacacagctggatgggatacaaggattacagaagatgacctgcacaacgaggagaaaattacacaacaaatggaccccgagcacagacaattggctaatgcgatttttaaacttacctaccaaaacaaggtagtgaaagttcaaagaccaacgccaaccggaaccgtaatggacataatcagccgaaaggaccagagaggcagcggacaagttggaacatacggactcaacacatttactaatatggaggcgcagcttattcgtcaaatggaaggtgagggagtcttaagtaaagccgatttagaaaacccacacctacctgaaaaaaaaatcacgcaatggttggaaaccaaaggagtcgaaagactaaaacgtatggcaatctcaggggacgattgcgttgtaaagcctatagatgatagattcgccaatgccctattggccttaaatgatatgggaaaggtccgcaaggatattccccaatggcaaccaagcaaaggatggcatgattggcaacaggtgcccttctgcagccaccatttccatgaactaataatgaaagatggtcgaaagctagtagtgccctgtcgacctcaggatgaactcatcggccgagcaagaataagccagggagcagggtggagccttcgggagacagcttgcctgggtaaagcttacgctcaaatgtggagcctcatgtattttcatcgccgtgatttaaggttggcttcaaatgcaatctgcagcgccgtgccagttcactgggtaccgacctcgagaaccacctggtccatacacgcccatcatcagtggatgaccacggaggacatgctaacggtttggaatcgtgtttggatagaagacaacccatggatggaagataagacacccgtcactacctgggagaacgtaccatatctcggaaaaagagaagatcaatggtgcggctcgctgattggattaaccagcagagcaacttgggctcaaaatattcctactgcgatccagcaagtaaggtcactgataggaaacgaggaattcctcgactatatgccttctatgaaaagatttagaaaagaagaagagagcgaaggggcaatttggtaa

SEQ ID NO: 23434 - RNA, 9873 nt, synthetic construct
  misc_feature 1..9873: note = derived and/or modified CDS sequence (opt6) from DENV-3__FJ639807__SS-prME
  source 1..9873: mol_type = other RNA
acttcattatgtcttatgatgattctccctgcagctttagcatttcacctcacctcccgtgacggagaaccaagaatgatagtagggaaaaatgaacgtggtaaatctttgctgtttaaaacagcatcagggattaatatgtgtacgcttatagcaatggatttaggagaaatgtgcgatgataccgttacatacaaatgtccgcacataacggaagttgagccagaggatattgattgctggtgcaatctaacatctacatgggtaacttatgggacatgcaaccaagctggtgaacatcgtcgggataaaagaagtgtagctctagcaccgcacgttggcatgggactcgacaccaggacacaaacatggatgtcggcggaaggcgcatggcgacaagtagaaaaagtagaaacctgggcactaagacaccccggttttactatactagcacttttcttagcgcactatataggaacctctctaacccaaaaagtggttatatttatactactcatgttagtaacgccgtcgatgactatgaggtgcgtaggagtcggaaaccgagactttgtagaaggtttgtccggggctacatgggtggatgtcgtattagaacacggcgggtgcgtaacaaccatggccaaaaacaaaccaaccctcgatatagaactacagaaaactgaagcaacgcaacttgcaaccttgagaaaattgtgtatagaaggtaaaataacaaatattacgactgactcacggtgccctacgcaaggcgaggcagtgctgcctgaagaacaagaccaaaattatgtatgtaaacacacttatgtagatagaggatggggcaacggttgcggactctttgggaaaggcagccttgtgacatgtgcgaaatttcaatgtctagaacctatcgaaggaaaagtcgtacaatacgaaaacctcaaatataccgtgataataactgtgcataccggtgaccaacaccaagtaggcaacgaaacacagggtgtaactgcagagataacaccacaggcgtcaactaccgaagcaatcctcccagaatatgggaccctaggactagaatgcagcccaagaacggggctagacttcaatgagatgatactattaacaatgaaaaacaaagcatggatggtacaccgacagtggttcttcgatctccctctgccatggaccagtggagccacaacagaaactccaacgtggaacagaaaagaattgttagtaactttcaaaaacgcacatgccaagaaacaggaggtcgtcgtattaggtagtcaagaaggtgctatgcatacggccttaacaggagccacagagattcagaactccggaggaacgtcgatctttgccggtcatttaaaatgccggcttaaaatggataaattggaattaaaagggatgtcttatgctatgtgtactaatacatttgtactcaagaaagaagtttccgaaacacagcatggaactatattaataaaagtggagtataaaggggaggatgtaccgtgcaaaattccgttttctactgaggatgggcagggtaaagctcataatggtagattaataacagcaaatccagttgtcacgaagaaagaggaaccagtaaatatagaggcagagccaccctttggagaaagcaacatagttattggtataggagataacgccttgaaaatcaactggtacaagaaaggaagttccatagggaaaatgtttgaggcaacagcacgtggtgcaagaagaatggcaatattaggtgatactgcgtgggattttggaagtgtcggcggtgtactcaatagtttaggtaaaatggtacaccagatattcggcagtgcttacactgcactattttcgggcgttagttgggtaatgaaaataggtattggggtcttattgacctggatagggctgaactcgaaaaatactagcatgagtttcagctgtatcgcaataggaataattactctatatctcggggcggtggtgcaagccgatatgggttgtgtgataaactggaaaggaaaagagcttaagtgcggttcggggatttttgtgacgaatgaagttcacacttggacggagcagtataaatttcaagcagactcgcccaagcgactggcaacagcaatagcaggagcctgggaaaatggcgtttgtggcataagaagtacaacccggatggaaaatctactttggaaacagatcgccaacgaattaaactacatcctttgggaaaataatattaaactaacggttgtcgttggagatacaataggagtattagaacagggcaaacgtacactaacaccacaacctatggaactaaaatattcatggaaaacatggggcaaagcgaagatagtaacagctgagacacaaaattcatcattcatcattgatggtcctaatacacctgaatgtccaagtgcatcaagagcatggaatgtgtgggaggtcgaagactacggattcggtgtgttcacaacaaacatatggctaaaattaagggaagtatacacacaactttgcgatcacaggcttatgtccgccgccgtaaaagatgagagggcagtacacgcagatatggggtattggatagaatcccagaaaaatggtagttggaaattggaaaaagcatccctaattgaagttaaaacgtgcacttggccaaaatcacatacgttatggtcaaacggcgtattagaatccgatatgataataccgaagtctttagcaggccccatatcacaacacaattacaggccaggttatcatacgcaaacagcaggaccgtggcacttaggaaagctcgaattagacttcaactactgtgagggaacaactgttgtgatcacagaaaattgtggaacaagagggccttcactgcgaacaacaaccgtcagtgggaagctgatacacgaatggtgttgtcgaagctgtacacttccgccattacgttacatgggcgaggacggatgctggtatggaatggaaattcgacctatatcagagaaagaagaaaacatggtaaagagcttagtttcagctggctctggagaggtagacaatttcacaatgggagtattatgcttggcaatactgttcgaggaggtaatgcggggaaaattcggcaagaaacatatgatagccggcgttttcttcacattcgtgttactcctgtcaggacaaataacatggagagatatggctcacacattgataatgatcgggtcaaacgcaagtgaccgaatgggtatgggagttacatatcttgctttgatagccacattcaaaattcaaccatttttggcattaggatttttcctcaggaaactaacttcacgagaaaatctgttattaggggttggcctagcgatggcaacaacattgcaactcccagaagatattgaacagatggcaaacggtatagcactgggcttgatggcactgaaattaataacgcaatttgaaacgtaccagttatggactgccttgatttccttgacttgctccaacacaattttcacacttacggtagcttggagaaccgcgacattaattctggctggggtctcattgttgccagtatgccaatcatcgtcaatgcggaaaactgattggctaccaatgacggtagctgctatgggagttcctccactaccattatttatcttctcactgaaagacacgttgaagcgaaggagttggcctttgaatgaaggagttatggctgtcggattagtcagtattctcgcatcttctctccttcggaatgacgtccctatggcaggccccctcgtagctgggggtctactcatagcatgctatgtcataacaggtacctcggctgaccttactgtagagaaagcagcagacgtgacatgggaggaagaggcagaacagactggagtgagtcataatctcatgataactgtagacgacgacggtacaatgcggatcaaggatgatgaaaccgaaaatatattgaccgtattactgaagactgcactgttgatagtaagtgggatttttccgtacagcataccggcaactctattagtgtggcatacatggcaaaaacaaacacaaagaagtggcgtgctttgggatgtaccatctccacctgaaacacagaaagcagagttagaagaaggtgtatatcgaattaagcaacagggcattttcggcaaaactcaagtgggagttggagtgcaaaaagagggtgtattccacactatgtggcacgttacaaggggagcagtgttgacgtacaacggtaagcgcttagaaccgaactgggcaagtgtcaagaaagacttaataagttacggaggaggatggagattgtctgcacaatggcaaaaaggggaggaagttcaggtaatagcggtggaaccgggaaagaatcccaaaaacttccagaccatgccggggacattccaaactactactggtgaaattggagcaatagccttagattttaagcccggcacttcagggtcaccaataatcaatagagaaggaaaagtggttggtttgtacggtaatggtgtagttacgaaaaacggagggtatgtctcaggaatcgcgcagacgaacgctgaaccagacggtcctacaccagaactagaggaggaaatgtttaaaaagagaaatctaacgataatggacctgcatccaggctctggaaaaacgagaaaatatttaccagccatagtgcgtgaagctataaagagacgtctaagaacattaatactagcgccgacgagagtggtagccgcagagatggaagaggcattgaaaggtcttccaatccgttaccaaactacggcaactaaaagcgaacatacgggcagagagattgtggacctaatgtgtcatgccacttttacaatgaggctcttatctcccgtgagagttccaaattataacctaataatcatggacgaagcgcattttacggacccagcatctatcgcagcacggggttatatatcaacgcgtgtgggaatgggagaagctgcggcaattttcatgacagcaacccctccaggaactgcagatgctttccctcagagcaacgcaccaatacaagatgaagaaagagatataccggagagatcttggaatagcggtaacgagtggataactgattttgcagggaaaactgtctggtttgtcccatcaataaaagccggaaatgatatcgccaattgtttaaggaaaaatggaaagaaagttatacaattgagccgaaaaacttttgatactgagtatcaaaagacaaaactaaacgattgggattttgtagtgacaactgacataagtgagatgggagctaacttcaaggcggatagggtaattgatccaagacgatgcttaaaacccgtgatactaacagatggaccagagagagtcatattagcaggtccaatgcctgtcacagctgcatcagcggcccaaagacgcggtagagtcggtcgcaacccccaaaaagaaaatgatcaatatatttttacaggacaacctctaaataatgatgaagatcacgctcattggactgaggcaaaaatgttgcttgacaatataaacacacctgaaggaatcatacccgcactattcgagccggaaagagagaaatccgccgcaattgacggcgaataccgactcaaaggagaaagtcgaaaaacctttgtagaattaatgcggagaggtgatctacctgtctggctagctcacaaagtagcttcagaagggataaaatacacggatcgcaaatggtgcttcgacgggcaacgaaataatcaaattttggaagagaacatggacgtggaaatatggacaaaagaaggagagaaaaagaaacttaggcctagatggttagatgctcgtacctatagtgatccactggcacttaaagagttcaaggacttcgctgcaggtagaaaaagtatagcactagacctggtaaccgagattggtagagtaccaacccatcttgcgcacagaacacgcaatgcccttgataacttggttatgctacacactagcgaacatggtggaaaagcctatagacatgctgtggaggaacttccggaaacaatggaaaccctgttactgctcggtttaatgattctattaacgggtggtgccatgctgtttttaataagcggcaaaggtattggaaaaactagcattggcttaatctgtgtaatagcttctagcggaatgctctggatggctgaaatacctctccaatggatagcgtcagcgatagtacttgagttctttatgatggtactattaattcccgaacctgaaaaacagaggacccctcaagacaaccaactggcatatgtagtgattggtattctaactctagcagcaaccattgcagcaaacgaaatgggactactagaaactacgaaaagagatttaggaatgtcgaaggaacctggggtcgtaagtccaacaagttatctagatgtagatcttcacccagcatcggcctggactttatacgcagttgcaactaccgttataacgccaatgttacggcacactatcgaaaatagcacagcaaatgtgtcactcgctgctatagccaaccaagccgtggtcttaatggggctagataaaggatggccgataagtaaaatggacttaggggtgccattgctcgcactagggtgctattcacaagttaatccactaaccttaacggcagcggttctcctactcattactcattatgccataatagggccaggtctacaagctaaagcaactagagaggcacaaaaacgtacggcggcgggaattatgaaaaacccaacagtagacgggataatgaccatcgatttggatccagtaatatacgattctaagttcgaaaaacaattaggccaggtgatgctactcgtattatgtgcggttcaattattactaatgagaacttcttgggcgctctgtgaagccttaacgctagcaactgggcccattacaactctttgggaaggcagtccgggtaaattctggaacactacaatagcagtcagtatggccaatattttcaggggatcctatcttgcaggggcaggattagccttttctatcatgaaatcggtgggaactggaaaacgtggtacgggctctcaaggtgaaactcttggagaaaaatggaagaaacgattaaatcaactctcaaggaaggaatttgatttatacaagaaatctggaattacagaagttgacagaactgaagcaaaagaagggttaaagagaggtgagatcacgcaccacgccgtttctcgtggttcagccaaacttcagtggtttgttgaacggaatatggttattcccgagggtcgagtcatagatctgggttgcggacgtggtggatggagctactattgtgcggggttgaagaaagttactgaagtacgaggttacaccaaaggagggccgggacatgaggaaccggtcccaatgtcgacgtatgggtggaatatagtaaaattgatgtctggtaaagatgttttctatttaccgccagagaaatgtgatacactcctgtgtgatattggagagtcctcacctagcccaacagttgaagaaagtcgcacaattagggtgctaaaaatggtagaaccttggctaaagaataatcaattttgcataaaagtattaaatccttatatgcctaccgtaatcgagcacctagaaagattacaacgaaaacacggcggtatgttagtaagaaatccattgtcccgtaattcaacccatgaaatgtactggatatcaaatggtaccggaaatattgtagcatccgttaacatggtttccagacttttactaaatagattcacgatgacacacagaaggccaacaatcgaaaaagatgttgacctgggggcaggaactcgacacgttaatgcagaaccagagactccgaatatggacgttattggcgaaagaatcaagcgaattaaagaagaacataatagtacttggcattatgatgacgaaaacccttataagacgtgggcataccacggttcttatgaggtaaaagcaactggttcagcatctagcatgattaatggagtagtcaagttattaacgaaaccatgggacgttgtccccatggtgacgcaaatggcaatgaccgacaccactccctttggacagcaacgtgtatttaaggagaaagtcgatacaagaacaccaagatcaatgcccggcacacgacgtgtaatgggaataactgcagagtggctgtggagaacattagggagaaataagaaaccaagactctgcactagagaagaatttacgaagaaagtgcgaacaaacgcagcaatgggggccgtttttacagaagaaaaccaatgggatagtgcaaaagctgccgtagaagacgaagatttttggaaattagtagatagagagcgagaactgcacaagttagggaaatgcggttcatgtgtttataatatgatgggaaaaagagagaagaaattaggagagttcggaaaagcgaaaggctccagagctatatggtatatgtggttaggagccagatacctagagttcgaagcgttgggatttcttaatgaagatcattggttcagtcgcgaaaatagctatagcggagttgaaggagagggattgcataaactgggatacatattgcgtgacatatccaaaattccaggtggtgctatgtacgctgatgacaccgctggatgggacactaggattactgaagatgatttacacaacgaagaaaagataacccagcaaatggacccagaacatcgacagttggcaaatgcgatattcaaactaacctatcaaaataaagttgtaaaggtccagagaccaaccccgactggaacagtaatggatataatatcgagaaaagaccaaagaggaagtggtcaagtagggacatatggcctaaacacgttcactaatatggaagcacagttaataagacaaatggagggagagggtgtgctatcaaaggctgatttggaaaatccacatttaccagagaagaaaataacacaatggttagagacaaagggagtagaacgcctcaagaggatggctattagtggagatgactgtgtagtgaaacctatcgatgatcgctttgcaaacgctttgttggcactaaacgatatgggaaaagttcgaaaggatatacctcaatggcaaccatcgaaaggctggcacgattggcagcaggtacccttttgttcacatcactttcacgagttgataatgaaggatgggcgaaaattagtagtgccatgcagaccacaagatgagctaatcggacgagccaggatatcacagggcgcaggctggtcgttgcgagaaacggcctgtttaggcaaagcatatgcccagatgtggtcgcttatgtatttccatcgccgagatttacgacttgcaagcaacgccatatgttcggcagtacccgtacattgggtgccaactagcagaacaacatggtctattcatgcacaccaccaatggatgacaacagaagatatgctaacagtttggaatagagtatggattgaggataatccctggatggaagacaagaccccagtgactacatgggaaaatgtaccctatttaggcaaaagagaagatcagtggtgtggcagtcttataggacttacctctagggcaacatgggcacaaaatataccaactgccattcagcaagtcagatcgctaataggtaacgaagaatttctggattacatgccatcaatgaaacgattcaggaaggaggaagaatctgagggtgccatatggtaa

SEQ ID NO: 23435 - RNA, 9873 nt, synthetic construct
  misc_feature 1..9873: note = derived and/or modified CDS sequence (opt6) from DENV-3__FJ639810__SS-prME
  source 1..9873: mol_type = other RNA
acgtctctttgtctaatgatgattttaccagcggctttagctttccacctaacaagtcgcgatggtgaaccacgtatgatcgtaggtaaaaatgaacgaggtaaaagtttattatttaaaacagcttcagggataaatatgtgcacactaatagcgatggatcttggagaaatgtgtgacgacaccgtaacatataaatgtccacacataacggaagtagaaccagaagacattgattgctggtgtaatctaacatccacgtgggtcacttacggtacatgtaaccaagcgggtgaacacaggagggataaacgtagcgtggcactagcgccacatgtaggaatggggttagacactcgcacacagacctggatgtcagcagaaggagcgtggagacaagtcgaaaaagtggaaacttgggcgctacgacatcccgggtttacgattctagcactctttctagcacactacataggcacatctctcacccagaaagttgttatctttatactactcatgcttgtgactcccagcatgaccatgagatgtgtaggcgtaggtaatagagattttgtggaaggtcttagcggagcaacctgggtagatgttgtactagaacatggaggatgtgttacaacaatggctaaaaataaacccacccttgacatagagctacagaaaacggaggcgacacagttagctacattaaggaaattatgtattgaaggaaaaatcactaacataacaaccgattcaaggtgccctactcaaggcgaggctgtattgccagaagaacaagaccaaaattacgtatgtaaacatacttatgtagatcgtggatggggaaacggttgtggtttattcgggaaaggaagcctcgtgacatgcgctaaattccagtgtttagaacctatagaaggcaaagttgtacaatacgaaaacttaaaatatactgtaattattacagttcacacgggtgatcaacatcaagtaggaaatgaaacacagggcgtcacagcggaaataacacctcaagctagcacaactgaggcgatacttccagaatatggcacactagggttagaatgcagtccgaggaccggattggactttaacgaaatgatactcctaacaatgaaaaataaagcgtggatggtacatcgacaatggttcttcgacttaccattaccatggacgtcaggtgcaacgaccgagacccctacttggaacaggaaagagctattggttacattcaaaaacgcacacgccaagaaacaggaagtagtagttttaggaagtcaggaaggagcaatgcatactgcacttaccggcgcaactgaaatccaaaatagtggtggaacatcaatattcgctggtcacttaaaatgtcgattgaaaatggacaaacttgaattgaaaggcatgtcttatgcaatgtgtacgaatacctttgttctcaagaaagaagtttcagaaacacaacacggtacaatactaattaaagttgagtataaaggggaggacgtaccatgtaaaattccgttttccaccgaagatggtcaaggtaaagctcataacggaagactaataactgcaaaccctgttgtaacaaagaaagaagaaccagtcaatattgaggcagaacctccattcggtgaatctaacattgtgattggaataggagataatgcgctaaaaataaactggtacaagaaaggttcaagcattggaaaaatgtttgaagccacggctagaggtgctcgccgtatggcgatacttggagacacagcatgggattttggaagtgtgggaggagtattaaattcattaggaaagatggtgcatcaaatatttggttccgcgtacacagccctcttctccggcgtctcttgggttatgaagataggcatcggagtactattaacctggataggattaaatagcaaaaacacaagtatgtcattttcctgcatcgcaatcggaataataacactttacttaggagcagttgtacaagccgacacaggatgtgtaataaattggaaaggcaaagagctaaaatgtggaagcggaatatttgtaacaaacgaagtacacacttggaccgaacagtataagtttcaagccgatagtccaaaacggctagcaacggcgattgcaggggcatgggaaaatggagtatgcggcataagatccacgacacgcatggaaaatttactgtggaaacaaatagccaatgagttaaattatatcctttgggaaaacaacatcaaactaaccgtagtagttggagatattataggagtattggaacagggaaaaagaaccttaacacctcaacccatggaactaaaatacagttggaagacctggggcaaagcacgaatagtgacagcagagactcaaaatagtagtttcataattgatggacccaacacaccagaatgtcctaatacaagtagggcatggaacgtttgggaagttgaagactacgggttcggagtgtttacaacaaacatctggttgaaattgagagaagtgtatacccaactatgtgatcacagattaatgagcgcagcagtaaaagatgagagagcggtacacgcggacatgggatattggattgaatcccaaaagaacgggagttggaaattggagaaggcttcactaatagaagtgaaaacgtgtacctggccaaaatcacacactctatggtcaaacggggtattagagagtgatatgataattccaaaatccttagcgggtccaataagccaacataattatcggccaggatatcatactcaaacagctggtccgtggcatttagggaagctcgaactcgatttcaattattgtgagggaacaacagtcgtaataactgagaactgcgggacaagaggtccgtctttacgaacaacaacagtgtccggaaaactgatacatgaatggtgctgtcgatcatgtacattaccaccacttaggtatatgggcgaagacggatgttggtatgggatggaaatcagacccatctcagaaaaagaagaaaacatggtgaaaagcctggtttcagcggggtccggagaggtggataatttcaccatgggtgtgttatgcctcgccattctattcgaagaagtaatgcgaggcaaatttgggaagaaacacatgatagccggcgtcttatttacatttgtacttctactaagcggacaaatcacatggcgtgatatggctcacacattgatcatgatcggttcgaatgcatccgaccgaatgggtatgggagtaacgtacctagccttaatagccacatttaaaatacaacctttcttagccctaggatttttcctcaggaaactaaccagcagagagaatttactacttggcgtaggactcgcaatggcaactacattacaactgccagaagatatagaacaaatggcgaacggcatcgctctaggtctaatggcgttgaaacttattactcaattcgaaacatatcaactctggaccgccttaataagtttaacatgtagcaatacaatatttacattaactgtagcatggagaacagcgacactaatactggccggtgtgagtctgttaccagtgtgccaatctagcagtatgagaaaaacagattggctaccaatgacagtagctgctatgggagttccaccactacccctatttatcttttgtcttaaggacactcttaaacggagaagctggccacttaatgaaggcgtcatggcggtcgggttagtatccatattggcatcaagtctcttaagaaatgacgttccaatggcaggccccctcgtagccggaggactattgatagcgtgctatgttataaccggaacatcggcagacctcactgtagaaaaagcagcagatgtcacatgggaagaagaagccgagcagacgggcgtgtcacataatctaatgataacagttgatgatgatggaactatgcgaataaaagatgacgagacggaaaacatacttacagtactattgaaaactgcgctactaattgtaagtggaatcttcccttattcaattcccgctacactactcgtctggcatacatggcagaaacaaactcaaagatcgggagtactatgggatgtaccttcacccccagaaacgcagaaggcagagttagaggagggagtataccgaataaaacagcaaggcattttcggaaaaactcaagttggagtcggagtacaaaaagaaggtgtgttccacactatgtggcatgttacaagaggagcagtattaacatacaatggtaaaagactggaacctaattgggcatccgtaaagaaagatttaatatcttatggaggcggttggcgactgtccgctcaatggcagaaaggggaggaggtacaagtaatagctgtggaacccggcaaaaaccccaagaatttccagacaatgccgggcacgtttcaaacaactaccggagaaatcggggcaatagctcttgatttcaaaccgggaacttccggatctccaataataaatcgggaagggaaagttgtagggctatacgggaatggcgtagtgactaaaaatggaggatatgtatctggcatagcacagacaaacgcggaacctgacggaccaacaccagaattagaagaggaaatgtttaagaaacgtaacttaactatcatggatctccatccaggtagtggaaaaacgcgtaaatatcttccagcaatcgttagggaggctataaaaaggcgtttacgcactttgatactagctcctactagagtcgtggcagccgaaatggaagaggcactaaaaggtctaccgataagatatcagactacagccaccaaaagcgagcacacaggcagagaaatcgtagatctaatgtgtcatgccacatttactatgagacttttatcacctgttagagtccccaattataatttaatcatcatggatgaggcacattttacggatccagcttctatcgcagcaagaggttatattagtacacgagtagggatgggagaagctgctgcaattttcatgacagcaacgccaccaggaacagcggacgcgtttcctcagagcaatgcccctatacaagatgaagaacgtgatatacctgaacggagctggaatagtggcaacgaatggataacggattttgctggtaaaacggtctggttcgtaccgagtataaaagctggcaatgatattgccaactgcctacgaaagaatggtaagaaagtcatccagctttctagaaagacattcgacacggagtaccagaagacgaaattaaatgattgggatttcgtcgtaactacagacatatcggagatgggcgcgaactttaaagcggaccgggtaatagatccgaggcgatgtcttaagccggtaatactaacagacggcccagaaagagtcatattagcggggcccatgccagttacggctgcaagtgccgctcagagaagaggaagagtaggcagaaatcctcaaaaagaaaatgatcaatacatcttcacaggacagcccttgaacaatgacgaagatcatgcacattggactgaagcaaagatgttattagataatataaatacccccgaagggataatgccagctttattcgaacccgaacgtgagaagtctgccgctatagacggagaatatcgtctaaaaggagaatcaagaaaaacgttcgtagaacttatgcggagaggagatcttcctgtatggctcgcacataaagttgcaagcgagggtataaaatatacggacagaaaatggtgttttgacggacaacgaaataatcagattttggaagaaaacatggatgtggaaatttggacaaaagaaggggagaagaagaaattgaggccgagatggttagatgctcgtacgtactctgaccctctagccctaaaggaatttaaggacttcgctgctggtaggaaaagtattgcattggatctagttactgaaataggaagagtgccaactcatctcgcccatcgtacgcgaaacgcactggacaatttggtcatgttgcatacatctgaacatggtggcaaggcatatagacacgctgtagaagaactgcccgaaactatggagacccttttactgctaggcctgatgattctgctaacaggtggtgctatgctgttcctcatttcaggaaaaggaattggaaaaacgagcatcgggttgatatgtgtcatagcttcctccggaatgttatggatggcagaaatccctctacaatggattgcctcggcaatagtacttgagttctttatgatggtacttttaatacccgaaccagaaaaacaaagaacacctcaggacaaccaactcgcatatgtagtaattggcattctcacgctagctgctataatagcggctaatgaaatgggacttttggaaaccacgaagcgtgatcttggaatgtctaaggaacctggtgttgtatcaccaacaagctatcttgatgtagatcttcaccctgcatcagcatggacactttatgccgttgccacgaccgttatcacaccaatgcttagacatacgatagaaaacagcacggcaaatgtatccctcgctgccattgctaatcaagccgtggttctaatgggattagacaaggggtggccgattagtaaaatggatctaggcgtaccattgttagcactaggatgttattcccaggtcaatcctcttacattgacagcagcggtactattactaattacacattacgcgattatcggacccggactacaagctaaggcaacaagggaagcacagaagcgcacggcagccggcataatgaaaaatcctactgtcgatggcatcatgaccatagatttagatccagttatttacgatagtaagtttgaaaaacagctaggacaagtaatgcttctcgtcttatgcgctgtacaactgttgttgatgcgaacatcatgggcattatgtgaagctcttacgctagctaccgggccgataaccacgttatgggaaggatccccaggaaagttctggaacaccacgatagctgtatcaatggccaatatctttcgcggtagttacctggcgggtgcaggattggcattttctattatgaaatctgtaggaactggcaaaagaggtaccggttcgcagggcgaaacactgggagagaaatggaaaaagaaactcaaccaactgtcgagaaaggaatttgacctctataagaagagtggaattactgaagtggatagaacggaagccaaagaaggacttaaaagaggggaaataactcatcatgctgtgtctagagggtcggcaaaattacaatggttcgtagaaaggaacatggttatcccagaagggagagtgatagacctcggatgtggacgaggtggatggtcatattactgtgcaggactcaagaaagtaacagaagtaagaggctacacaaaaggaggacccggccatgaggaacctgttcccatgtcaacatacggttggaacatagtaaaattaatgtccggcaaagatgtattttacttgccacctgaaaaatgtgatacgttactatgtgatattggagaaagttcaccgtcaccgacagtagaagaaagtcgtacgatacgcgtactaaaaatggtcgaaccctggcttaaaaacaaccagttctgcatcaaagttctgaatccgtatatgccagccgtgattgaacatttagaaagacttcagaggaaacatggagggatgttggtacgcaatcccctatctagaaattcaacacatgagatgtattggatttcaaatggtactggaaacatagtagccagtgtcaatatggttagcagactattgcttaatcgatttacaatgacccatcgacgacctacgatcgaaaaagatgtggatttgggtgcaggaacccgtcatgtcaatgcagaaccagaaactcctaatatggatgttatcggagagaggattaaaagaattaaagaagaacataactcgacgtggcattatgacgacgaaaatccatataaaacatgggcatatcatggctcatatgaagtaaaagcaactggatcagcaagttcaatgattaatggagtagtaaagctgctaacgaagccgtgggatgtagtaccaatggttacacagatggccatgaccgatacgacgcctttcggccagcaaagagtatttaaagagaaagttgatactaggacgccaagatcaatgcctggtacaagaagagtgatgggtattacggcagaatggctctggagaacacttggaaggaataagaaaccccgtttatgcacccgggaagaatttacaaagaaagtgcgaacgaacgcagcaatgggagctgtatttacggaagaaaaccaatgggatagtgccaaagctgcagtggaagacgaggacttctggaagctagttgatcgcgaacgcgaactacataaacttggtaaatgcggatcatgtgtctataatatgatggggaagagggagaagaaattaggtgagttcgggaaagcgaaaggttcaagagcaatatggtatatgtggctcggtgcaaggtatcttgaatttgaagccttgggattcttgaatgaagatcattggttctctcgagaaaattcatactcaggtgtggaaggagagggattacacaaactcggttacatactaagagatataagcaaaatcccaggtggagcaatgtatgctgacgatacagcgggatgggacacacggattacggaagacgatctatacaatgaagaaaagataacacaacagatggatccggaacatagacaattggcaaatgcgatatttaagttaacttaccaaaataaagtagtaaaggtacagagacccacaccaacaggtaccgtaatggacataatatccagaaaagatcaacgcggatcaggtcaggtggggacctatggtttaaatacgttcacaaacatggaagctcaattgattcgacaaatggaaggagaaggagttttaagtaaagcagatctcgagaacccgcatctgccagagaagaaaattacacaatggttagaaacaaaaggagttgaacgactgaaacgaatggcgatttcaggagacgattgcgttgtaaaacctatagatgatcgtttcgccaacgctttgttagccttaaacgatatgggaaaagtccgcaaagacataccacagtggcaaccaagcaagggatggcacgattggcagcaggttccattctgctcacatcactttcatgaattaatcatgaaagatggaaggaagctagtggtaccgtgtaggccacaagacgaactaatagggcgtgcaagaataagtcaaggcgcaggttggtctttgcgagaaacggcatgcctgggaaaggcttatgcacaaatgtggagtttaatgtattttcatagaagagatcttagattggcatctaacgctatttgctccgcagtcccagtccattgggtgcccacatcgagaaccacctggtctatccatgcgcatcatcagtggatgactacagaagatatgttgactgtgtggaatcgagtttggatagaagataatccgtggatggaagacaagacccccgttacgacatgggaaaacgtcccatatttagggaaaagagaggatcagtggtgcggtagtttaataggtcttacaagtagagcgacatgggcacaaaatattcccactgctattcaacaggtaaggtcattaattggaaacgaagaatttcttgattatatgccttcaatgaaaagattcagaaaggaggaggagtccgagggcgcaatatggtag

SEQ ID NO: 23436 - RNA, 9873 nt, synthetic construct
  misc_feature 1..9873: note = derived and/or modified CDS sequence (opt6) from DENV-3__FJ639816__SS-prME
  source 1..9873: mol_type = other RNA
actagcctgtgcttgatgatgatattacctgctacattagcctttcatttgacaagtcgcgacggcgaaccaagaatgatagttggtaaaaatgaaagaggtaaatcgcttctatttaaaacagcgtcaggtataaacatgtgcacactgattgcaatggacctaggggaaatgtgcgatgacacagtcacatataaatgtccacatataacggaagtggaaccagaagacatcgactgttggtgtaatttgacttctacttgggtgacttacggtacatgcaatcaagccggcgaacatcgaagagacaaacgtagtgtagccttggcaccgcacgtaggaatgggattagataccagaacgcaaacatggatgtcagcggaaggtgcatggcggcaagtcgaaaaagtagaaacttgggcattgcgtcaccccgggtttacaatacttgcgttatttctcgcccattatatcggtacttcactgactcaaaaagtagtaatatttatacttcttatgttggtgacaccttcgatgaccatgcgctgcgttggggtaggcaatagagattttgttgaaggcttgtcgggagctacctgggtggacgtagtactggaacatggaggatgcgtaacaacaatggccaaaaacaaacccactttggacatagaactgcagaaaacagaagcgactcaacttgctaccttacgtaaattgtgtatagaaggaaaaataacgaatatcacaaccgacagtcgctgtccaacccaaggggaagctgtgttacccgaagaacaagatcaaaattatgtgtgcaaacatacctatgttgatcggggttggggaaatggttgtggattatttggcaaaggttcattagtaacatgtgcaaaatttcagtgtcttgaacccattgaaggcaaagttgttcaatatgaaaatctgaaatatacagttataataacagtacacacgggagatcaacaccaagtgggtaatgaaactcagggtgtcactgcggagattacacctcaggcttctacaacagaagcaattcttccagaatacggaactctggggttggaatgctctcccagaacggggcttgacttcaatgaaatgatcctgttgactatgaaaaacaaggcttggatggtgcataggcaatggttctttgatctcccactaccttggacctccggagctacgactgaaacaccaacctggaacaggaaagagctactggttacattcaaaaacgcacatgcaaagaaacaagaagtagtagtgttaggttcacaagagggggcaatgcataccgccctaacaggagccacagaaattcaaaatagtggaggaacgtctatattcgctggacatcttaaatgtaggttaaaaatggataaattagagttaaaagggatgagttatgcgatgtgcacaaacacgtttgtcttgaagaaagaggtgtcagaaacacaacatggcaccatactaattaaagtagaatataaaggagaagacgtgccctgtaaaataccatttagcacggaggatgaacaaggtaaagcacataatgggcgattgataacagcaaatcctgttgtgaccaagaaagaagaacctgttaacatagaagctgagccgccatttggagaatctaatatcgtaattggaattggagataacgccttaaaaattaattggtacaagaaaggttcatccattggaaaaatgttcgaggcaactgccagaggagctagaaggatggcgatacttggcgataccgcgtgggattttggaagcgttggtggtgtattaaatagcctaggcaagatggtacatcaaattttcgggagtgcatatacagcattattttccggcgtaagctgggtgatgaagattggaattggtgtgttactcacctggataggattaaactcgaaaaataccagcatgtcgttttcctgcatagccataggaataattacattataccttggagccgtggtacaggcggacatgggttgtgttataaactggaagggaaaagaattaaagtgtggaagcggcatttttgtaactaacgaagtacacacatggactgaacaatacaaattccaggcagatagtccgaaaagactagctacagccatcgcgggtgcatgggaaaatggcgtatgtgggatacgctctactacaagaatggaaaaccttctttggaaacagatagccaatgagctcaactacatactttgggaaaataatataaaattaactgttgtcgtaggggacattataggggtattagaacagggtaaaagaacattaacacctcagccgatggaattgaagtatagttggaagacgtggggaaaagcacgaattgtcaccgcggaaacgcagaactcctcatttatcatagatggtcccaacacacccgaatgtcctagtgcttcgagagcatggaatgtatgggaagtagaggattacggttttggtgttttcactactaatatatggttaaaactacgtgaagtgtatactcaattgtgcgatcatagattaatgtcagcggctgtaaaagacgaacgagccgtacacgcagatatgggttattggattgaatctcagaaaaatggatcttggaaactagaaaaagccagtctaatagaggtcaaaacttgtacatggccaaaatcccacacactatggtctaatggagtacttgaaagtgatatgataataccgaagtcattggcaggacctataagtcaacataattatagaccaggttaccatacacaaactgctggtccatggcacctaggaaagctggagttagatttcaattattgtgaggggacaacagttgtgattactgaaaactgtggtacacgcggtccgtcccttcgtacaacaacagtgtctggaaaactaattcatgagtggtgctgtcgaagctgcacattgccaccattgaggtatatgggagaagacggttgctggtacggaatggaaatacgacccatatcggaaaaagaggaaaatatggttaaatctttagtatcggctggaagtggagaagtcgacaactttaccatgggcgtgctctgcctagcaattctatttgaagaagttatgaggggaaaattcggtaagaaacatatgatagccggtgtcttctttacatttgtactcctgctatctggacagataacctggcgagacatggcacatacacttatcatgataggaagtaatgcaagcgacaggatggggatgggtgttacatatttggcgctaatagctactttcaagatacaacccttcctagctctcggattctttctaaggaaacttacaagtagagaaaacttactactaggagtcggcttggctatggcaaccactctccaactaccagaagatatagagcaaatggcaaatggcattgccttgggcctaatggctttaaaattaataacacaatttgaaacctatcaactctggacagctcttatatctttaacatgctcaaatactatattcacactcacagtagcatggcgaacggcgactttaatattagcgggcgtaagtcttttgcctgtatgtcaaagttcaagtatgcgaaaaacggactggctacctatgacggtagctgctatgggagttccacctctccccctattcatattctctcttaaggacacattaaaacgccgatcatggcctctaaacgaaggagtaatggctgttggactggtatcgattctcgctagcagcttattacgaaatgatgtaccgatggcgggaccgttggtagcaggaggattattaattgcatgctatgtaataactggaacatctgcagatcttacagtagagaaggcggctgacgttacgtgggaagaagaggcggaacaaactggagtgagtcataatctaatgattacagtggatgacgatggcacgatgagaataaaagatgatgagactgaaaatatactaacggttcttttaaaaacagcgcttctgatagttagtggcatattcccatattcaataccggcaactttgctagtatggcacacctggcaaaaacagactcaaagaagcggcgttctgtgggatgttcccagtccaccagaaacacaaaaagccgagctagaagagggcgtatataggattaaacaacaaggaatttttggtaaaacacaagttggcgtcggtgtgcaaaaagaaggagtttttcatacaatgtggcatgtaacacggggagcagtgcttacgtataacggcaaaagactagaaccaaattgggcctcagtcaagaaagacttgatatcgtatggaggtggatggaggttgtcagctcaatggcaaaaaggtgaggaagtgcaagttattgctgtagagccaggtaaaaatcctaaaaattttcagacaatgccaggtacgtttcagactacaacgggtgaaatcggggccatagctctggatttcaagccagggacttctggaagccccattataaacagggaaggaaagatagttggactatacggaaacggagtagtcaccaaaaatggaggttacgtgagcggtattgctcaaactaacgcggaaccggacggacccaccccagaactcgaggaagagatgttcaaaaagcgaaacctcacaatcatggatcttcatcctggatccggcaaaaccagaaaatacctacctgctattgtaagagaggcaattaaacgtcgactaaggacactgattcttgcacccacgagggtcgtagcagctgagatggaagaggcactgaaggggctaccaatacgatatcaaactacagccacgaaaagtgaacatacgggacgagagattgtggatttaatgtgtcacgctacgtttacaatgcgattgctatctccagtacgggtgccgaattataatctaattataatggacgaagctcattttaccgaccccgcttccatcgcagcccgaggttatatcagtactcgcgttggaatgggtgaggctgcagctatttttatgacagcaacgcccccaggaacagcagatgccttcccacaatcaaacgcacctattcaagacgaagagagggacataccagagagaagctggaatagcggaaacgaatggataacggacttcgcagggaagacagtatggttcgtaccaagcataaaagcgggcaacgatatagcgaattgtttaaggaaaaatgggaagaaagttatacaactatcacgtaaaacatttgatacggagtatcagaaaactaaattaaacgactgggatttcgtggtaactacggatataagcgaaatgggcgcaaacttcaaagcagaccgggtaatagaccctagaaggtgtcttaagccagtaattttgacagacggcccagaacgagtaatattagccggacctatgccagttactgctgcatcagcagcgcaaagaaggggaagggttgggagaaacccacaaaaagaaaacgaccagtatatctttactggtcaaccactcaacaatgacgaggaccacgctcattggacggaagcaaagatgctcttggacaatattaatacgcctgaagggatcataccagcactatttgaaccagaacgggaaaagagcgcagccattgatggagagtatagactaaagggagagagtcgtaaaacatttgttgaattaatgagacgaggggacttaccggtgtggttagcgcataaagttgcatcagaaggaataaaatatacagataggaagtggtgtttcgacggtcaaaggaataatcaaattctagaagaaaatatggatgtggaaatatggacaaaagaaggagagaagaagaaactgagaccacgttggctagatgcgaggacctactccgatcctttggcgttaaaggaatttaaagatttcgcagcaggtagaaaatcaatagcgttggacctagttactgagatcggtcgcgttccaactcatttagcgcatcgaacacgtaatgcattagataatttagttatgctacatacctcagaacatggaggcaaggcttaccggcatgcagtagaagaactcccggaaacaatggagactctactactgctaggtctaatgatactacttacgggaggcgctatgttattcctaatatctggtaaaggaataggcaaaacaagcattgggttaatatgtgtaatagcttcgagcggaatgctatggatggccgaaataccgttacaatggattgcttcggctatagttctagagttctttatgatggttctattgataccagaaccagaaaaacaaagaactccacaggataaccaactagcctatgttgttataggtatcctaacactagcggctaccatagcagcgaacgaaatgggcttattagagacaacaaaacgagatttaggcatgagtaaagaaccaggtgtggttagtccaacctcctatctagatgttgatctgcaccctgctagtgcttggactttatatgcagttgcgactacagttataactcccatgttacgacatactatagagaatagtaccgccaatgtttcactcgctgctatcgcgaaccaggcagttgtcttgatgggattggataaaggatggccgatatccaaaatggacttgggtgtacccctccttgcactagggtgttatagccaggttaacccgttgacgctaactgcagcagtattattattaataacacactatgccataatcgggccgggactacaagccaaggctacacgagaggcacaaaaacgaactgccgctggaataatgaaaaacccgaccgtagatgggatcatgacaatagatttagaccccgttatatatgactccaagtttgaaaaacagttgggacaagtaatgcttttagtgttgtgtgcagtacaattacttctaatgagaacatcatgggctttatgcgaagcattaacccttgcaacgggtcccattacaacgctgtgggaagggtctccgggaaaattttggaatacaacaatcgccgtatccatggcaaatatctttagaggatcatacttagccggtgcgggtctagcatttagcgtcatgaagtcggtgggtactggcaaaagaggaactggaagccaaggagagaccctaggggagaagtggaagaagaaattaaaccaactatcaaggaaagagtttgatttgtacaagaaatcaggtatcacggaagtggaccgcacggaagcaaaagaaggactgaaaagaggggaaataactcatcacgctgtgtcgagaggaagtgcgaaattacaatggtttgtagaaagaaacatggttatacctgaagggcgagtgatagacctggggtgtgggcgaggaggttggagttattactgcgcaggtttaaagaaagtaactgaggtaaggggatataccaaaggagggccaggtcacgaggaaccagtacctatgtccacatatggctggaacattgtcaaactaatgagcggaaaagatgtcttctatttaccacccgaaaaatgcgacacattattatgcgatattggtgaaagttcaccctcccccacagtagaagaatcaagaacaatacgggtgctaaaaatggtagaaccttggcttaaaaacaatcaattttgtattaaagttctcaacccatatatgccaacagtaatagaacaccttgaacgtttacaacgtaaacatgggggcatgctagttagaaatccgctcagtcgaaatagcacacatgaaatgtattggataagcaacggaactggaaatattgtagcctccgtaaatatggtatccaggcttctacttaatagattcacaatgacgcaccggagacctactatagaaaaagatgttgatcttggagccggaacaaggcatgttaacgcagaaccagagacaccaaacatggatgtcattggagagagaattaaaagaatcaaagaagaacataactctacctggcattacgatgacgaaaacccatataaaacatgggcctatcacggaagttatgaagtaaaagccacaggctcagcatcatcaatgataaatggcgtagtaaaattgcttactaaaccatgggatgtagtaccaatggtcactcaaatggcgatgaccgatactacaccgtttggacagcagcgtgttttcaaagagaaagttgatacaaggactcctcgtagcatgcccgggactcgccgagtaatgggcattacagcggaatggctctggagaacattaggaagaaataagaaacctcggctatgcactcgcgaagaatttaccaagaaagtgaggactaacgctgccatgggcgcagtttttacagaagaaaaccaatgggatagcgctaaagctgcggtggaggatgaggatttttggaaacttgtcgatagagaaagagaactccacaaattaggtaagtgtggatcatgcgtttataacatgatggggaaaagggagaagaaattaggtgaatttgggaaagcaaaaggatctcgagcaatctggtatatgtggcttggagcccgctatttagagtttgaagcacttggatttttaaacgaggaccattggttttcaagagagaatagttacagcggagttgaaggcgagggattacataaattaggatatattctaagggatataagcaaaatacccggcggagcgatgtatgcagacgatacagcaggttgggatacgaggatcactgaagatgatttacataatgaagagaaaataacgcaacaaatggatcccgaacacagacaactggccaacgcaatttttaaattaacttaccaaaataaagtagtaaaggtccaaaggcctacgcctacaggcactgtcatggacataattagcagaaaagaccaacgaggatcgggacaagtgggaacatatggtctaaacacattcacaaacatggaagcgcaattaataagacaaatggaaggagaaggggtgctgagtaaagctgacttggaaaacccacacctccctgagaagaaaattactcaatggctagaaacgaagggagttgaaagactaaaacggatggctatttcgggtgatgactgtgttgttaagcctatagatgatagatttgcaaacgcgctgttggcactcaatgacatggggaaggtaaggaaagacataccacaatggcaaccctcaaaaggttggcacgattggcaacaggtacctttttgttcgcatcatttccacgaattaatcatgaaagatggccgtaaattggtcgtgccctgcagaccacaggatgaattgattggccgagctagaatttctcaaggagcaggatggagcttaagagaaacagcctgtcttgggaaagcctacgcgcaaatgtggtctttaatgtactttcatcgaagggatcttagattagcaagtaacgccatttgctctgcagttccagttcattgggtccctactagcagaacgacctggtccattcatgcacaccatcagtggatgactaccgaagacatgttgactgtgtggaacagagtatggattgaagacaatccatggatggaagataaaacgccagtaacgacttgggaaaacgtaccatatttagggaaacgtgaagaccaatggtgcggaagcctcataggtctcacgagtcgcgctacatgggcgcagaatattccgactgcaatacagcaagtcagatcgctaattggtaatgaggaatttctggactatatgccctcgatgaaaaggttccgtaaagaggaagaatcagagggcgcgatttggtag

SEQ ID NO: 23437 - RNA, 9873 nt, synthetic construct
  misc_feature 1..9873: note = derived and/or modified CDS sequence (opt6) from DENV-3__FJ639817__SS-prME
  source 1..9873: mol_type = other RNA
acgtcgctatgcttaatgatgatattgcccgctgctttagcttttcacctcacatctagggacggggaaccccgcatgatagtaggcaaaaatgaacggggaaaatccttattatttaaaacagcatcaggaatcaacatgtgtacgcttatcgcaatggacttaggagaaatgtgtgacgatactgtaacttataaatgtccccatataactgaagttgaacctgaagacatcgattgttggtgcaatttgacgagtacatgggtcacttatggaacatgcaatcaagcaggagaacatagaagggataaacggtcagtggctctcgcgccccatgtagggatgggacttgacacacgcacacaaacctggatgagtgctgaaggagcttggcgtcaagtggaaaaagtagaaacttgggcacttcgccatccaggatttaccatactagctctatttctagcccattacatcggaactagcttgacacaaaaagtagtcatatttatccttctaatgttggtgacgccttcaatgacaatgagatgcgtgggagtaggtaatcgtgattttgtagaaggtttatcgggagccacatgggtagatgtagttcttgagcatggtggatgtgttacgacaatggctaaaaataaaccaacacttgacatagagctacagaaaaccgaagcaactcaattggccacactacgaaaactatgcatagaaggaaaaataactaacgtaacgacggattctcgatgtccaacacaaggtgaagcagtactgcctgaagaacaagatcagaactacgtatgcaaacatacctatgtggatagaggatggggtaatggatgtggcctatttggaaaagggtcgttagtaacatgtgcgaaatttcaatgtttggaaccaattgaaggaaaagtcgtgcaatatgaaaatctaaaatatacagtgatcatcacagtgcataccggagaccagcatcaagttggcaacgaaactcaaggagtcactgcggaaatcacaccacaggctagcactacagaagcaatacttccagagtacggtaccctgggcttggaatgtagtccgaggacaggtcttgacttcaacgaaatgattctactaaccatgaagaacaaggcttggatggttcataggcagtggttctttgacttgcctttaccgtggacaagtggcgcaactacagaaacgcctacatggaacaggaaagagttgttagtaacgttcaaaaatgctcatgctaagaaacaggaggttgtggttctaggttcacaggaaggagcgatgcatacagcattaactggtgctactgaaatccagaactctggcggtacaagtatattcgcgggacatttgaaatgcagattaaaaatggataaactcgaattaaagggaatgagttatgcaatgtgtactaataccttcgttttaaagaaagaagtaagcgagacccaacacggtacaatcttgatcaaggtcgaatacaaaggagaagacgtcccgtgtaaaataccattttctacagaggacgggcaaggaaaagcccataacgggcgtttaataactgcgaatccagtggtaaccaagaaagaagaacctgtgaacatcgaagcagaaccacccttcggagagtcaaatatcgtcataggaataggtgataacgctctaaaaatcaattggtataagaaaggatcaagtataggaaaaatgttcgaggcaaccgcacgaggggctagaagaatggcaatattgggtgacactgcatgggatttcggaagtgtaggtggggttttaaactcgctaggtaaaatggtacaccaaatctttggttctgcgtatacggcattattctctggtgtatcatgggtcatgaaaataggaataggcgtcctactaacgtggatcgggctgaactcgcggaacacatcaatgagttttagttgcattgcaataggtatcataacactgtatctaggcgcggttgtgcaagctgatatgggttgtgttattaactggaaaggaaaagaacttaaatgtgggtcgggcatatttgtaacaaatgaagtacacacatggacagagcagtacaaattccaagccgattcaccgaaaagattagcaactgccatcgctggagcttgggaaaatggagtgtgcggtatacgttcgacgacacgcatggaaaatttactatggaagcaaatagctaatgagctgaactacatattgtgggaaaataacataaagctaacagtagtagtgggtgatattattggtgtgctggagcaaggcaaaagaacacttacacctcagccaatggagttgaagtactcatggaaaacatgggggaaagctaaaatagtgaccgcggaaacgcaaaatagttcattcattatagacggacctaataccccggagtgccctagcgcttctcgagcttggaatgtttgggaagtagaagattacggatttggagtttttacaacgaatatttggttaaagttgcgtgaagtctacacacagctttgtgatcacagactaatgagtgcagctgttaaggatgaaagagctgtacacgcagacatgggttattggatagagtcccagaaaaatggttcttggaaattagaaaaggcttctttaattgaagtgaaaacttgtacatggcccaaaagtcatacactatggtcgaacggagtactagaatccgacatgattatcccaaagagcttagcaggtcctatatctcaacataattacaggcccggatatcatacacaaactgccggtccttggcacttgggaaaacttgagttagacttcaattattgcgaaggtacgaccgttgtaattacggaaaattgtggaacgagaggaccaagtttgcgaacaacaacggtatctggaaagctaattcacgaatggtgttgtagaagctgtacactgccaccattaagatatatgggagaggatggatgctggtatgggatggaaattagaccgatcagcgaaaaagaggagaacatggtaaaaagtctcgtgtcagcaggaagtggagaggtagataattttactatgggagtactctgtttagctattctgtttgaagaggtaatgagggggaaatttggcaagaaacatatgattgctggcgtattctttaccttcgtactacttttatctggccaaatcacgtggagggatatggcgcatacactaataatgattggatctaacgctagtgatcgcatgggcatgggcgtcacgtacctagcactgatcgcaacgtttaagatacagccttttctagcattaggattctttttacgtaaactaacatcgcgcgaaaatctgctattaggtgttgggctagctatggccactacactacaactaccggaagacatcgaacaaatggctaacggaattgccttaggtctaatggctctaaaactgataacgcaatttgagacatatcagctatggacagcgcttattagtctcacttgcagtaacacgattttcacgttaacggtagcttggaggactgctacgttaatactggcaggagtctcgctgctgcccgtatgtcaaagttcgtccatgaggaaaacagattggttaccaatgacagtagctgctatgggtgtacctcccttacctttatttatattttcgctaaaagacacccttaaaagaagaagctggccactcaatgaaggcgtaatggcggtagggctagtatcaatcctcgcttcaagtctattgcgtaatgatgtacctatggcaggaccgcttgtcgctgggggattactaatagcgtgttatgtgatcacgggaacctccgctgacctaactgtcgaaaaagccgcggatgtgacttgggaagaagaagcagaacaaacaggcgtatctcataatcttatgataactgttgacgatgacggcacaatgagaatcaaggatgatgagacagagaatattctgactgtacttctaaaaacggcactattaatagtaagcggaatatttccctattccataccagcaactttattggtttggcatacctggcaaaagcaaacacaacgatccggagttttatgggatgtgccaagcccacccgaaacacagaaggctgagcttgaagagggcgtatacagaattaagcagcagggtatttttggtaaaactcaagttggagttggagttcaaaaagaaggcgtcttccacacgatgtggcacgtaacaaggggcgcggttctaacctacaacggtaaaaggctggaacctaactgggccagtgtaaagaaggatttgataagttatggaggaggctggcgcttatcagctcaatggcaaaaaggcgaggaggtccaagtaattgccgttgaaccaggaaagaatccaaagaactttcaaactatgcctggaacttttcaaaccaccactggcgaaataggagctatcgcactggatttcaaaccaggtacatccggtagtcctattataaacagagaaggtaaggtagtagggctatatggtaatggcgtcgtaaccaaaaatggtggatacgtaagcgggatagcgcaaaccaacgcagaacccgatggtccaacaccagaattagaagaggagatgtttaagaaacgcaatttgactataatggatctgcaccctgggtcaggtaaaaccaggaaatatctaccggctatagttcgtgaggctattaagagaagattaagaactcttatactagcgccaaccagagtggtcgcggcggaaatggaagaagctctaaaaggtttaccgatacgctaccaaactacagcaacaaaatctgaacatacaggaagagaaatagtcgacctaatgtgtcatgcgacttttacaatgaggcttctgagtcctgtaagggtacccaattataatttgatcataatggacgaagctcatttcacagacccagcaagcatagcggcccgtggctatattagtactcgagtaggcatgggtgaagcagctgcaatatttatgaccgcaacacctcctggcacagcagacgcattcccacaaagcaacgcaccgatacaggatgaggaaagagatataccagaaaggtcttggaactcgggtaatgaatggattactgactttgctggaaaaactgtgtggttcgtaccatccattaaagcaggaaacgacatcgcaaactgccttaggaagaacggaaagaaagtaatccaactgtcacgaaaaaccttcgatacagagtatcagaaaacgaaattaaacgactgggatttcgtcgtaactaccgatatatctgaaatgggagccaactttaaagctgatcgtgtgatagatcctcgcagatgcctaaaaccggtaatattaaccgatggaccagagcgtgtgatacttgcaggacctatgccagtaacggcggcctcagcggctcaacgtagaggtagagtgggcagaaacccccaaaaagaaaatgaccaatatattttcacaggtcaaccccttaacaatgacgaagaccacgcacactggacggaagccaaaatgttattagataacatcaatacgcctgaaggaattatacctgctttatttgagcccgaacgtgagaaatcagcagcgatagatggagaatatcgattaaaaggagaaagtcgaaaaacatttgtcgaactaatgcgaagaggtgatttaccagtctggctggctcataaggtggctagtgaaggaattaaatataccgatcgtaagtggtgtttcgatggacaacgaaataatcaaattcttgaggaaaacatggacgtggaaatatggactaaagagggggagaaaaagaaactaagaccacgatggcttgacgccaggacatatagtgatccattagctttaaaagaatttaaagattttgcagccgggcgcaaatcgattgcgctggacttagtaactgaaataggccgtgtccctactcaccttgcacaccgcacgcgcaacgctcttgataacttagtcatgctccacacaagtgagcatgggggaaaggcttacagacacgcagtagaagaattgccagagacaatggagacactgttattgttaggacttatgatccttctaacgggaggagcaatgttattccttatttcgggaaaaggaattgggaaaacatctataggcttgatctgcgttatagcctcttcaggaatgctgtggatggcggagataccactgcaatggattgctagtgcaattgtcttagagttctttatgatggtgctactaataccagaaccggaaaaacaaaggacaccacaagataatcaactggcctacgtagtcataggcatacttaccttggcagcaattatcgcagccaacgaaatgggtttactagaaacaactaaacgcgatttaggaatgtcaagagaaccgggagttgtaagtccaacatcttatttagatgttgatctacatccagcaagtgcgtggaccctctacgccgtagcaacgacagtcataacaccaatgcttcgtcataccattgaaaactctactgcgaatgtatctctggcggcaatagcgaatcaggccgtggtactaatgggcttagataaaggctggcccataagtaagatggacttaggggtacccttgttagcgctaggatgttacagccaagttaatccacttacgttaacagccgctgtacttctactcatcacacattacgcaataattggtccaggcctccaagctaaggcaacccgagaagcgcaaaaacgaactgcggctggaatcatgaagaaccccacggtggatggaatcatgaccatagacttagacccagtaatttatgacagtaaattcgaaaagcaattaggacaggtcatgctattagttctttgtgcagtacaactattattaatgcgaacaagttgggcactgtgtgaagcgttaacactagcaacaggaccaatcacaacattatgggaaggttctccgggcaagttttggaacacaacgatagcagtaagcatggcgaacatttttcgtggctcctacctcgctggtgcggggttagcattttctattatgaaatccgtaggcacgggaaagcgtggaacaggctcacagggggagaccctcggagaaaagtggaaaaagaaactaaaccaattaagtcgcaaagaatttgatctctataagaaatctggaattaccgaagtcgatcgaacagaggcaaaggaaggattaaaaagaggggaaataacccaccatgcagtaagtagaggctcggcgaaattacaatggttcgttgaacggaacatggttataccagaaggtcgcgttatagacttaggatgcggccgaggaggttggtcctactattgcgctggactcaagaaagttaccgaagttagaggctacaccaaagggggaccaggacatgaagaaccagtaccaatgtcaacctatggatggaatatcgttaagctcatgagtggaaaagatgtgttctatttaccaccagaaaagtgtgacacactgctctgtgacattggagagtccagcccttctccaacagtggaagaatctcgtacaattcgagtacttaaaatggtagaaccatggctcaaaaataaccaattctgcatcaaagttctaaacccttacatgccagctgtaattgagcatttggaaagactacaaagaaaacatggaggaatgttagttaggaaccctctttcacgtaatagtacacatgaaatgtactggattagcaacggaacaggaaacatagttgcctcagtaaatatggtctctcgattactcttgaatcggttcactatgacacatagaagaccaacaattgagaaggatgtagatttaggtgctggaactagacacgttaacgcagagcctgagaccccaaatatggatgtaataggtgagcgaattaagaggatcaaagaagaacataatagcacctggcactacgatgatgagaatccgtataaaacatgggcttaccatggatcctacgaagtaaaagcgacaggatcagcatcaagtatgattaatggagttgtaaaactattaacaaagccttgggacgtagtaccaatggtgacccaaatggcaatgactgatacaactccattcggccaacaacgagtatttaaggaaaaagtagatacaagaacgcctagaagcatgccaggaactcgtcgagtcatgggtatcacagcagaatggctctggcgaacattgggacgtaataagaaaccgagactatgtacgagagaagagtttaccaagaaagtaagaacaaacgcagcaatgggcgctgtattcactgaggaaaaccaatgggactcagctaaagcagcagttgaagatgaagatttttggaagctagtagacagagaacgtgaattacataaattaggaaaatgtggttcatgtgtttataacatgatggggaagcgggaaaagaaactaggagaatttggaaaagcgaaaggtagtcgagcaatatggtatatgtggcttggtgcccgttatttagaatttgaggcactcggattccttaacgaggatcattggttctctagagaaaatagctactcaggtgtagagggagaaggattacacaaattgggatacatattgcgagacattagtaaaattccaggtggcgcaatgtatgcggatgataccgcaggctgggatacccgaatcacagaagatgacttacataacgaagagaaaataacccaacaaatggatccagaacaccgacaactagcaaacgcgatattcaaactcacgtatcaaaacaaagtcgtgaaagtgcaacgacccacaccgacaggaactgttatggatataataagcaggaaagatcaaaggggtagtggacaagtcgggacctatggcttgaacaccttcaccaacatggaggcacagcttatacgccagatggaaggagaaggtgttctttcaaaggcagatttagaaaatccacatcttccagagaagaaaataactcaatggttagaaacaaaaggtgttgaaaggttgaaacgaatggctataagtggggatgactgtgttgtaaaaccaattgatgacaggttcgcaaacgcgttgttagctttgaacgacatgggtaaagttcgaaaagacattccacaatggcaaccatctaaaggatggcatgattggcagcaggttcccttctgctcacatcactttcatgaactaataatgaaagatggtagaaaattagtagtcccgtgtaggccgcaagatgaattgattggcagagctcgaatttcgcaaggtgcaggttggtccttacgagagaccgcatgtttaggtaaagcatacgcacaaatgtggagcttaatgtatttccacagaagggacttaagactggctagtaatgcgatttgcagcgcagtaccagtccattgggtaccaacttcccggacgacctggtcaattcatgctcatcatcaatggatgacaaccgaggacatgttaacagtatggaatcgagtctggatcgaagataatccatggatggaagacaaaacgccggtcacgacctgggaaaacgtgccatatttagggaagagagaagatcaatggtgcggaagtcttataggtttaacgtcacgggcaacttgggcccaaaacataccaacagccatccagcaagtgagatctctaattggaaatgaagaatttttagactacatgccttccatgaaaagattcagaaaggaagaagaaagcgaaggagcaatatggtaa

SEQ ID NO: 23438 - RNA, 9873 nt, synthetic construct
  misc_feature 1..9873: note = derived and/or modified CDS sequence (opt6) from DENV-3__FJ639825__SS-prME
  source 1..9873: mol_type = other RNA
acatcactatgtctcatgatgatattaccggcagcattggctttccatctaacatcaagagatggagaaccaagaatgatagtagggaaaaacgaaagaggaaaatctctacttttcaaaacagcctctggaataaatatgtgtaccttaatagcaatggacctaggagaaatgtgtgatgacactgtaacatacaaatgtccacatataactgaagtcgaaccagaggacatcgattgctggtgtaatcttacatctacctgggtcacttatggaacttgtaaccaagctggagaacatcgtagagataaaaggtcagtagcgctagcgccgcacgtagggatgggattggacacgagaacgcaaacgtggatgagtgccgaaggcgcatggagacaagtagaaaaagttgaaacttgggcattaaggcaccctgggttcaccatactggccttattcttagcacattatatagggacatcactcacccaaaaagtggttatatttattttacttatgctggtaacgccgtcaatgactatgcgatgtgtgggtgtaggaaacagagactttgtcgaaggattatctggtgcaacttgggtcgatgtggtgttagaacacggaggctgtgtaacgactatggccaaaaataaaccaactttagatatagaattgcagaaaaccgaagcaacccaacttgccacacttagaaaattgtgcatagaaggtaaaatcacaaacataactacggatagcagatgtcccactcagggagaagcagtactaccggaggagcaagaccaaaattatgtatgcaaacatacatatgttgatagaggttggggaaatggatgtggtctcttcggaaaaggcagcttagttacatgcgctaaattccagtgtcttgaacccatagaaggaaaagtcgtccaatacgaaaatttaaaatataccgttatcattactgtgcacacaggagatcaacaccaggttggtaatgaaacgcaaggtgtgacggcagaaatcaccccgcaagcgtcgactaccgaggctatattgccagagtatggaacactcggattagagtgttcacccaggacagggttggacttcaatgaaatgatcttactcacgatgaaaaataaagcgtggatggtgcaccgacaatggttctttgacttacctttgccttggacgagtggagcaactactgaaacaccgacttggaataggaaagagctattagtgacattcaaaaatgcacatgcaaagaaacaagaggtcgttgtactcggaagtcaagaaggggcgatgcacacggccttgacgggcgccactgaaatacaaaacagcggtggcacttctatcttcgcaggacatctcaaatgccgtttaaaaatggacaaactggaacttaaagggatgtcttatgctatgtgcactaatacatttgtactcaagaaagaggtttccgaaacacagcatggtacaattctcataaaagttgactataaaggtgaagatgtcccatgcaaaataccattttctaccgaagatggacaaggaaaagcacacaacggaaggttaatcacagcaaatccagtagttacgaagaaagaggaacctgtaaatattgaagctgaaccaccattcggcgaaagtaacatcgtgattgggatcggggacaacgctttaaaaattaattggtataagaaaggttcttcaataggcaaaatgtttgaggcaacagcaagaggcgctcgtagaatggcaattttaggggacactgcgtgggactttggatcagtagggggcgttttaaattccttagggaaaatggtacaccagatcttcggatctgcttatacagcattatttagcggcgtctcgtgggtaatgaaaataggtatcggagtgcttcttacgtggataggattgaactcgaaaaatacatctatgtcgttttcatgcatagctattggtataattaccttatacctaggtgctgtggttcaagcagacactgggtgtgtgattaattggaaaggaaaagaattaaaatgtggttctggcatattcgtcaccaatgaagtacacacgtggactgaacaatataaatttcaagcggattcaccaaaaagattagcaaccgcaattgccggagcatgggaaaatggtgtttgtggcatcagaagcactacaaggatggaaaacctattgtggaaacaaatagcaaatgaactcaactatatactttgggagaataatataaaactcacagtagttgtcggagacattatcggagttttagaacaaggaaaaaggacactgaccccacaaccgatggaacttaaatattcctggaaaacatgggggaaagcaaaaatagttacagccgagacacaaaacagtagttttataatagacggtccaaacacaccggagtgtcccagcgcgtctcgagcttggaacgtatgggaagtagaagactatggcttcggagtatttaccacaaatatctggcttaaattaagggaagtttacacacaacaatgcgatcatcgactgatgagcgcagccgtcaaagatgagcgagctgttcatgcagatatggggtattggatagagtctcagaaaaatggttcatggaaactagaaaaagcatcacttatagaggtaaaaacttgcacgtggccaaaatctcatacgttatggtcgaacggtgtgttagagtctgatatgatcataccaaaatctttagcaggtccgatttcacaacacaactacagacctggttatcacacacaaaccgcaggaccctggcatttaggtaaacttgagcttgactttaactactgtgaggggacaaccgttgtaataacagaaaactgtggcactagaggccccagcttacggacaactacggtctcgggaaaattaattcacgaatggtgttgccgtagctgtaccctacctcctctaagatatatgggcgaggacggatgttggtacggtatggaaattcgaccaatctccgaaaaagaagagaacatggtaaaaagtctagtgtctgcgggtagcggcgaagtagacaactttactatgggcgttctctgcttagcaatcctgttcgaggaggtgatgcgtggcaaattcggaaagaaacacatgatagccggtgtattctttactttcgtactcttattaagcgggcaaatcacgtggcgcgacatggcacatacattaatcatgattggcagtaatgcgagcgacaggatgggcatgggagtgacttatcttgcccttatagcaacctttaaaattcaaccctttctagcattaggattctttttgagaaagttgacatcaagggaaaatctattgctaggagttggactagccatggcaaccacgcttcaattgcctgaagatatagaacaaatggcaaatggtatcgcccttgggctaatggcacttaagctaatcacccaattcgaaacctaccagctatggacggcccttatcagcttaacatgtagtaacacgatttttacattaactgtcgcttggcgtactgcgacactaatattagctggggtttcgctgctccccgtatgtcagtcatctagtatgaggaaaactgattggctaccaatgacagtagcagcaatgggggtaccgccattgcccctctttatcttttccttaaaagatactttaaaaagaagaagttggcccctaaacgaaggagtaatggcagtaggcctagtaagtatacttgctagttcattactaaggaatgatgtaccaatggccggaccccttgttgctggtgggctactgatagcatgttacgtcattactggtacatcagctgatcttactgtcgaaaaagctgctgatgttacatgggaagaagaagcagaacaaacaggtgtgtcccacaacttaatgatcactgtcgatgacgatggaacaatgagaataaaagatgatgaaaccgagaatattctcaccgtattgttaaaaacagctttattaatagtaagcggaatttttccatatagtatacccgcaactctactcgtttggcatacctggcagaaacaaacacaaaggagtggagtactatgggatgtcccatctccgcctgagacgcaaaaagcggagttggaggaaggagtatacaggataaaacaacaagggatttttggaaaaacgcaagtaggagttggggtgcaaaaagagggagtatttcacaccatgtggcatgtaacaaggggagcagtactaacttataacgggaagagacttgaaccgaattgggcgtcggtcaagaaagacttaattagctatggagggggttggcgattaagtgcacagtggcagaaaggagaagaagttcaagtaattgctgtcgaaccaggcaaaaatcccaagaacttccaaacaatgcccggaacttttcaaacgacgaccggcgaaataggggctatagctctagacttcaaaccgggcacgagtggtagcccaataataaaccgggaaggaaaagtagttgggctatatggcaatggcgtagtaactaaaaatggcggttatgtgagtggaatcgcacaaaccaatgctgaaccagacggtccaaccccagaattagaggaagaaatgtttaagaaaagaaacttaaccataatggatctgcacccaggttcgggtaagaccagaaaatatctccccgcaatagtgagggaagcgataaaacgcagattaagaacacttattttagcaccaaccagagttgtcgcagcagaaatggaggaagcactgaaaggacttcccatcagataccaaacaacagcgacaaaaagtgaacacacaggtagagagatcgtcgatcttatgtgtcacgcaacctttacgatgagactactgtcacctgtaagggttccgaattacaacttaattataatggatgaagcacacttcacggacccagcttctatagcagccaggggttacatatcaaccagagtgggtatgggcgaagcagcagctatttttatgacagctactccaccaggtacggcagatgcattccctcaatccaacgcaccaatccaggatgaagagagggatattcctgagcgaagttggaatagcgggaacgaatggattacggactttgctggcaaaactgtctggtttgtacccagcattaaagctgggaacgatatcgctaattgcttaagaaagaacggtaagaaagtgatacaattaagtagaaaaacctttgatacagaatatcagaaaacaaaattgaacgattgggacttcgtggtaactaccgacattagcgaaatgggtgctaatttcaaagcggatagagtaatagatcctcgtcgatgtttaaagccagtaatattaacagatggaccggaacgcgtaatactggctggacctatgccagtgacagcagccagcgctgctcagcggagaggacgcgtaggacggaacccccaaaaagaaaacgatcaatatatttttacaggacagccgctaaacaacgacgaagatcatgcccactggacggaggccaagatgttgttggataacataaatacccctgagggcatcatacccgctttgtttgaacctgagcgagagaaaagcgcagcaatcgatggagaatatagattgaaaggagaatcacgaaaaacatttgtagaactcatgagacgcggtgatctgcccgtttggttagctcacaaagttgcatccgaagggataaaatatacagacagaaaatggtgtttcgacggccagcgcaataaccagatactcgaagaaaacatggatgttgaaatttggactaaagaaggtgagaagaagaaattacgcccgagatggctggatgcaaggacctattccgacccgctggcactaaaggaatttaaggacttcgctgcaggacgaaaatctatagcactagacctcgtcacggagataggaagagtaccctctcatctcgcacatagaacgaggaatgcgcttgataatcttgtgatgctacatacgtcagaacacggtggtaaagcataccgacacgcagttgaggagttacccgaaacaatggaaacgttgcttctactagggctaatgattttactcactggaggcgctatgttatttctcatctcaggaaaaggtattggaaaaacttcaataggactgatttgcgttattgctagctcaggtatgctatggatggcagaaattccactccaatggattgcgtcagctattgtgctggaatttttcatgatggtacttcttattcctgagcctgagaagcaaagaacaccccaagataaccagttagcatacgtggtaataggaattttaacactggcagctataattgccgctaacgaaatgggtttgcttgaaaccaccaagagagacttaggcatgtccaaagaacccggagtagtttcaccaacgagctatctagatgtagacctccaccccgcaagtgcttggactctgtatgctgtagctactacagttataacaccaatgctccgccatacaatagagaacagtacagcgaacgtaagtttagccgcaatagcaaaccaagcagtggtgctgatgggcctcgacaagggatggcccataagcaagatggatctgggtgttccactccttgccttagggtgctactcacaggtaaacccattgacactcacggcagctgtgctattactaataacccactatgcaataatcggacctggactccaagctaaagccaccagggaggcccaaaaacgaacagcggcgggaataatgaaaaatccgacagttgatggtataatgactatcgacttggatccagttatctatgatagtaagtttgaaaaacaattaggacaagtaatgttgcttgtactgtgtgcagtacaactccttcttatgagaacatcatgggcactatgcgaagcgctgacgctagcaaccggacctattacaacactatgggaagggagtcccggaaaattttggaacacaacgattgctgtgagtatggcaaacattttcagaggctcctacttagcaggagcggggcttgcattttccattatgaaaagtgttggtacggggaaaagaggtactggtagtcagggcgaaactttgggggaaaaatggaagaagaaactaaatcaacttagtaggaaagaatttgatttatataagaagagtggtattactgaagttgatcgcactgaggcaaaggaaggcctaaaaagaggagaaattacacatcatgccgtaagtagaggatcggcgaagctacaatggttcgtagaacggaacatggtgatacctgaaggccgagtgattgacctgggctgtggaagagggggttggtcatattactgcgcaggtctaaagaaagttacagaagtacgaggctacacaaaaggaggtccaggtcatgaagaaccagtaccgatgagtacatacggatggaacatagtcaagctcatgtctggtaaagacgtattttacttaccccctgagaagtgtgatacactattatgtgacattggagaatcatctcctagtccaacagtggaagagtcacgaaccataagagtcttaaaaatggttgagccttggttaaagaacaatcagttttgcattaaagtattaaatccatatatgccaaccgttatcgaacatttagaacgcctacagcggaaacatggaggaatgcttgtgcgtaatccattaagcagaaacagtacacacgaaatgtattggatctccaacggaacaggcaacatcgtagcgagcgttaatatggtttcaagattgttactaaataggtttactatgacgcatcgtagaccaacgattgagaaggacgtagatttaggtgcaggaacacgtcacgtcaatgcagaacctgaaacgccaaatatggatgtgatcggggaaagaatcaaacgtataaaagaggagcacaacagtacatggcattacgatgacgaaaatccatacaaaacgtgggcatatcatggttcatacgaagtgaaagctacaggcagtgcatcaagcatgataaatggagtagtaaaacttttaactaaaccatgggacgttgtcccgatggtcacgcagatggcaatgacagacactactccatttggacaacagagggtgtttaaagagaaagttgatacacgcactcctcgctcaatgcccggcactaggcgtgtgatgggcatcacagcagaatggttatggcgaacattaggccggaataagaaaccccggctttgcaccagggaggagttcaccaagaaagtaaggacaaacgcagctatgggcgccgtgttcacagaagaaaaccaatgggacagtgctaaggcagcagtggaagatgaagacttttggaagctagtggacagggagagagaattacacaaacttggaaaatgtggatcatgcgtctacaacatgatgggaaagagggagaagaaacttggcgaatttgggaaggctaaaggaagtcgagcaatttggtatatgtggctaggagctcgttatttagagttcgaagccttaggtttccttaacgaagaccactggttctcgagagaaaattcatatagtggggttgaaggtgaaggcctccacaaattaggatatatactacgagacattagtaaaatccctggaggcgccatgtatgcagacgatacggcgggatgggatacaaggataactgaggacgatttacacaatgaagaaaagataacgcaacaaatggaccccgaacataaacagttagccaacgctatatttaaactaacgtaccagaataaggtagtaaaggtacaaaggcctacaccaacaggaacagtaatggatattatttcaaggaaggaccagagaggttcaggccaagttggtacttatggtttgaacacctttactaacatggaagcacaattaatacgtcagatggaaggtgaaggcgtattgagcaaggctgatttagagaaccctcacctcccagaaaagaaaataactcaatggttagaaacaaaaggtgttgaaagactaaaacgaatggctattagtggggacgattgcgtagtgaaacctatagatgatcgcttcgcaaatgcactgctagcgctcaatgacatgggcaaggtcaggaaagatatcccccaatggcaaccctctaagggatggcacgactggcaacaagttccattctgttcacaccattttcacgaattaatcatgaaggatggtagaaagttagtagttccgtgtcggcctcaggatgaattaataggtcgggcgcgaatttctcaaggagcagggtggtcactgagagaaacggcttgccttggaaaggcatacgcacaaatgtggagtttgatgtattttcaccgaagggatctgcggttagcctcaaacgcaatatgttcggcagtaccagtacattgggtgcctacaagtagaaccacttggagcattcatgcacatcatcaatggatgacaacggaggacatgctaacggtgtggaatagggtgtggatagaagacaacccctggatggaagacaagacaccagtaacgacatgggaaaatgtaccgtacttgggaaaaagagaggaccaatggtgtggctcattgattggactcaccagtcgggctacatgggctcaaaatattccaacagccatacagcaagtacgatcattaattggaaatgaagaatttttagattatatgccttcaatgaagcggtttcgaaaggaagaagaaagtgaaggcgctatatggtaa

SEQ ID NO: 23439 - RNA, 9873 nt, synthetic construct
  misc_feature 1..9873: note = derived and/or modified CDS sequence (opt6) from DENV-3__FJ639826__SS-prME
  source 1..9873: mol_type = other RNA
acgtctctatgtctaatgatgatattaccagcagcattagcatttcatttaacaagccgtgacggtgaacctcgaatgatcgtagggaaaaacgaacggggaaaaagtttattattcaaaaccgcctcaggaattaatatgtgcaccttaatagctatggacttaggggaaatgtgtgatgatactgtaacctacaaatgccctcacattaccgaagtagaaccagaggacatcgattgttggtgtaatttgacctctacatgggtaacgtacggtacctgtaatcaagctggtgaacataggagagacaaacggtccgtagcactagctccccacgttggaatgggactggatactcgaacacaaacttggatgtccgcagaaggtgcatggcgacaagtggagaaagtagaaacgtgggctttgagacaccccgggtttactatactagcactatttttagcacattatatcggcacctcactaacacaaaaagttgtaatttttatattgttaatgttagtcaccccgtccatgacaatgaggtgtgtaggagtaggcaaccgggacttcgtagaaggacttagtggcgcaacatgggttgacgtagtcctagaacatggtggctgcgtgacaacaatggcgaaaaataaaccaacccttgacatagaattacagaaaacggaagccacacaattagctactctaagaaaattatgtattgaaggcaaaataacaaacattactactgatagtagatgtcctactcaaggagaagcagttttacccgaagaacaagatcaaaattacgtatgcaaacatacttacgtagatcggggatggggaaacggatgcggattattcggaaaaggaagccttgtaacatgtgccaaattccaatgtctagaaccaatagaaggtaaagttgtacaatacgaaaatctcaaatatactgtaattattactgtacatactggagatcaacatcaagtcggaaatgagacacaaggtgtaacggcagaaattacacctcaagccagtaccacggaagcaattttgcccgaatacgggactttagggctcgaatgtagcccacgaactggattggacttcaatgaaatgatattactaacgatgaagaacaaagcctggatggttcatcgtcaatggttctttgaccttcccttaccctggacaagcggagccaccacggagacccccacctggaatcgtaaagaactcctagtaacatttaaaaacgcacacgccaagaaacaagaagtagtagtattaggtagtcaagaaggagctatgcatactgcactaacaggagcaaccgagattcaaaatagcggaggaacttctatcttcgccgggcacctaaaatgtagactaaagatggacaaactcgaactaaaaggaatgagctatgctatgtgcacaaacacatttgtactgaagaaagaagtatcagaaactcaacatgggacaatacttataaaagtggaatataaaggagaagatgtaccttgcaagattccatttagtaccgaagacggacaaggaaaagcgcataatggaagactaataactgctaacccagtggtgacaaagaaagaggaacccgtgaatatagaggcagaacctcccttcggtgagagtaatatagtaataggaattggagataacgccctaaaaataaattggtacaagaaggggagttcaataggcaaaatgttcgaagccactgcaaggggagcacgacggatggcaattcttggcgatacagcgtgggacttcggatcagtaggtggtgttcttaatagcctaggaaaaatggtacatcaaatcttcggtagtgcctataccgcattatttagcggggttagctgggtaatgaaaatagggataggtgtattactgacatggataggattaaactcgaaaaacactagcatgtcgttttcatgtatcgcaattgggattattacgctatatctgggggcggttgtacaagcagatacaggctgcgttatcaattggaaagggaaggagcttaaatgcggctccggtatattcgttaccaatgaagttcatacgtggacagaacaatacaaattccaagcagattctcccaaacgattagcgactgcaatagcgggggcatgggagaatggcgtatgtggtataagatcaacaacacgaatggaaaatttactttggaaacaaatagcaaacgaactgaactatatcttatgggagaataatattaagttgacggtcgttgtaggggacataataggtgtacttgaacaagggaaaagaacacttacgccacaacccatggaactcaaatatagctggaagacctgggggaaggctcggatcgtaaccgcagaaacacaaaactcatctttcattattgacggacctaatactccggagtgtccaaacacatccagggcatggaacgtgtgggaagttgaagactacggctttggagttttcacaactaacatctggttgaaattacgtgaagtatacactcaactatgtgaccacagattgatgtcggcggctgttaaggatgaaagagctgttcatgcagacatgggctattggattgaatcacagaaaaacggttcttggaagctagaaaaagcaagtctaattgaagtcaagacatgcacatggccaaaaagtcacaccttgtggtccaatggtgtactagaaagtgatatgataattcccaaatctttagcaggtcctatctcacaacataattatagacctggttatcatacccaaacagcagggccatggcacctcggaaaactggaattagacttcaactattgtgaaggaacgactgtcgttataacggaaaattgtggaaccaggggtccttctcttcgtacaactaccgtatcggggaagttaatacatgaatggtgctgccgatcatgtactttaccgcctctacgttacatgggtgaggacggatgctggtatggaatggaaatcagacctatttcggagaaggaagaaaacatggtcaaaagtttagtcagtgctgggtctggtgaagtggataatttcacaatgggtgttctctgcctcgcaattctttttgaagaagttatgcgaggtaaatttggcaagaaacatatgatagcgggggtgttcttcacatttgtcttacttctgagtggacaaattacatggcgtgatatggcgcatacgttaattatgatcgggagtaatgcaacagatcgaatgggaatgggtgtgacatacttagctctaatagctacattcaaaattcaaccatttctcgcattgggattctttctgcgaaaattgacgtctcgtgagaacctactactcggcgttggccttgctatggccacgacactgcaattaccagaagacatagaacaaatggcaaatggcatagcattaggtttgatggctttgaaactgattacccaatttgaaacatatcaactatggacagcattaattagtcttacatgctcaaatactatatttacattaacggtagcatggcgaacagccactttaatattggcgggcgtatcattattacctgtatgccaatcgagttctatgagaaagactgattggcttcccatgacagtggcagctatgggtgtacctcctttaccattattcatattttctttaaaagacactctaaaacgcaggagttggccattaaacgaaggcgtaatggctgtcgggctcgttagcattctggcaagcagtctgctccggaacgatgttcctatggccggaccgcttgtagccggtggtcttcttattgcatgttacgtaatcactggtacttcggccgaccttactgtcgaaaaagctgctgatgtgacatgggaagaagaagctgaacaaacgggtgttagccataatttaatgattactgttgacgacgatggaacaatgcggataaaggatgatgaaacagaaaatatcctaacggtattactaaagactgcgctgctcattgtaagtggaatattcccgtactctataccagccaccttacttgtgtggcatacttggcaaaaacagacccaaagaagtggggtgctatgggatgtaccaagtccgcctgaaacccaaaaagcagaattagaggaaggagtatatcgtatcaagcagcaaggaatcttcggcaaaacccaggtgggcgtaggcgttcaaaaggaaggagtgttccacactatgtggcatgttacacgcggagcagtattgacttacaacggcaaaagattagaacctaactgggctagtgtaaagaaagacctcataagttacggaggaggatggcgactcagtgcgcagtggcagaaaggcgaagaagtacaagttatagcagtggaaccgggcaaaaaccccaaaaatttccaaacaatgccaggtacctttcaaactacaacgggagaaataggtgcaattgcccttgactttaaacctggtacaagtggttctcctattataaatcgagaaggtaaagtcgtgggtttatacggaaatggagtggtaacgaaaaatggtgggtacgtctcaggcatagctcaaacaaatgcagaaccggatgggccaacacctgaactagaggaagaaatgtttaagaaacgcaatctaacaatcatggatctacatcccggcagtggaaaaacaagaaaatatttacccgcgatagttagggaagcaattaaaagacgactacgtacgctgatactagccccaactagggtagtagcagcagagatggaagaagcattaaaaggactgcctatcagataccaaactactgcaactaaaagtgaacacacggggagagaaattgtcgacctcatgtgtcacgctacatttaccatgcgcttattaagtcctgtccgggtaccaaactacaatttgatcattatggatgaagcccacttcacggatccagcatcaattgcggccagaggctacatttcaacccgagttggaatgggtgaagcagctgcaatattcatgaccgcaactccccctggtactgcggatgctttcccccaatcaaatgccccaattcaagacgaagaacgagacataccagaaagatcttggaatagcggcaacgagtggataacagactttacaggtaaaacggtctggttcgtgccatcgatcaaagcagggaatgacatcgccaattgcctaagaaagaatgggaaaaaggtaatccaactctcaagaaaaacttttgatacagagtatcagaaaacaaaacttaatgattgggactttgtggtaacaacagacataagtgaaatgggagcaaatttcaaagcggaccgcgtaatagatccgcgtcgatgcctaaaaccagtaatattaacggacggtcccgaacgagtgatattagctggaccaatgccagtcactgcagcgtcagcagcgcaacgccgcgggagagttggaaggaaccctcagaaggaaaacgaccaatatatatttaccggtcaacccctcaacaatgatgaagatcatgctcactggactgaagcaaaaatgttattagacaatataaatacccctgaaggaataatacccgctctgtttgagcctgaaagggagaaaagcgcagcaatagacggtgaataccgtttaaagggtgaatcaagaaaaacattcgtcgaattgatgcggcgaggagatctacccgtttggttagcgcacaaggtagcctcagaaggaataaaatacacggatcgtaagtggtgtttcgacggccagagaaacaaccaaatactagaggaaaatatggatgttgagatatggaccaaggagggtgagaaaaagaaattaagaccaagatggttagacgctcgaacctacagcgaccctctcgcattaaaagaatttaaggatttcgcagcgggaagaaagtcaatagctcttgacttagttacagagatcgggagggtcccaactcatttagcccaccgaacacgaaatgccttggacaatctagtcatgctacataccagtgaacacggcggcaaagcctatcgccatgcggtagaagaactgccagagactatggagacacttcttctactcgggttgatgatactgctaactggaggagccatgttgttcctcatctctgggaaaggcattgggaaaacaagtatagggttaatatgtgtaattgcatcatcaggcatgttatggatggccgaaattcccttgcaatggatcgctagtgctattgtattagagttctttatgatggtattactcattccagaacctgaaaagcagagaacccctcaagacaatcagctcgcatacgtagtaattggcatactaacactagctgccataattgctgcaaatgaaatgggattactggaaaccacaaaacgagatttgggtatgtccaaagaacccggagtagtttcacctacatcttatctggatgtagatctacatccggcttcagcttggacgctctatgcggtagcaactacagtaattaccccaatgttgcgacatacaatcgaaaactcaactgcaaacgtgagcttagccgcgattgccaaccaagcggttgtactaatgggtctcgataaaggctggcctatatctaaaatggacctaggggtaccactcttagcgctaggatgctattcacaagtaaacccattaacactgacagcagcagtgctcctcctcatcactcattatgcgatcataggaccaggcttgcaagccaaagcgacgcgagaagcacagaaaaggacggcagcaggcataatgaaaaaccctacagtagatgggataatgactatagacctggaccctgttatctatgactccaaattcgagaaacagcttggtcaagtaatgctattggttttatgcgctgttcagttattactaatgagaacgtcttgggcactttgcgaagcactaactctggccacagggcctataacaaccctatgggaaggtagcccgggaaaattctggaacactactatagccgtaagtatggcgaatatctttagaggaagctatctagcaggagctggacttgcttttagtataatgaagagtgtcggtaccggcaagagaggtaccggcagtcagggtgagaccctaggagaaaaatggaagaagaaactcaatcaactatcgcgaaaagagtttgatctatataagaaaagcggtattaccgaagtagatagaacggaagcgaaggaaggactcaagcgaggtgaaattacccatcatgccgtatcaagaggttcagcgaaacttcaatggttcgttgaaagaaatatggtcattccggagggacgggtgatcgatttgggatgtggaagaggtggatggtcttattactgcgccgggctcaagaaggtaacagaagtaagaggctatacgaaagggggaccaggacatgaggaacctgtaccaatgagtacctacggatggaatatagtaaaattaatgtctggaaaagatgttttctacctgccaccggagaagtgtgacaccctactttgtgatatcggtgaaagttcaccttcgcccaccgtggaagaatcaagaacgattagggtactgaaaatggtagaaccttggttaaagaacaatcaattctgcataaaggttcttaatccttatatgccagccgtaattgaacatctagaaaggctacaacgaaagcacggaggcatgcttgtacggaatcctttaagtagaaacagcacccacgaaatgtattggatcagtaatggtacgggcaatatagtagccagtgttaacatggtaagtcgtttacttctcaatcgcttcactatgactcatagacgtcccacaattgaaaaagatgtagatctaggggcaggcacacgccacgttaacgcagaaccagaaacacctaatatggatgttattggtgaacgaataaagcgaattaaagaggagcataacagtacgtggcattacgatgatgaaaatccttacaaaacttgggcctaccatggttcctatgaggttaaagcgacaggtagcgccagctcaatgatcaatggtgtagtaaaactgttaacaaaaccatgggacgtggtgccaatggttacacagatggccatgactgataccacccctttcggacagcaaagggtttttaaggaaaaagtagacacaagaacgcccagatcaatgcctggaactagacgagtaatggaaattaccgcggaatggctatggagaacactaggcaggaacaaaaagccccgactttgtacaagggaggaatttaccaagaaagtaagaacaaatgcggcgatgggagcggtattcacggaagagaatcaatgggactccgctaaagcggcagtagaagatgaggatttctggaaacttgttgatcgagagagagaattacataaacttggaaaatgtggaagttgtgtatacaacatgatgggcaagagagaaaagaaactaggtgagttcggaaaagccaaaggatcacgtgcaatatggtatatgtggttaggcgcccgatatttagaatttgaagcccttggctttttgaatgaggatcactggtttagtagagaaaatagttattcaggcgtcgaaggagaaggccttcacaaactgggatatattctcagagatattagcaaaatacctggaggagctatgtatgcagatgatacagcaggatgggacacacgcattaccgaggatgatttgcataatgaggagaaaattacacaacaaatggacccagaacatagacaattagcaaatgcaatcttcaaacttacttaccaaaataaagtcgtaaaagtacaacgaccaacgcctacaggtactgtcatggatataattagtagaaaagaccagcgcggatcaggacaggtaggcacatatggcctgaatacgttcacaaacatggaagcacagttgattagacagatggagggcgaaggcgtactaagtaaagcggatttggaaaatcctcatctaccagagaagaaaattactcaatggttagaaacaaaaggcgtagaacgcctaaagagaatggctatttccggtgatgactgcgtagtaaaaccaatagatgatagatttgccaatgcattactagcgttgaatgatatgggcaaagtaaggaaagacataccacagtggcaaccttctaaaggatggcacgactggcaacaagttccattctgcagtcatcacttccacgaactaattatgaaagacggacgtaaattggttgtgccttgtcgaccgcaagacgaacttattgggcgggcccgcatatcgcagggtgctggttggtctttaagagaaacagcatgtcttggtaaggcatacgcgcaaatgtggtcactaatgtatttccacagacgcgatttgcgattagcatcaaacgcaatatgctctgcagtcccagttcactgggtaccaacttcaagaaccacttggtccatacatgctcatcatcaatggatgacaactgaagacatgctaacagtatggaatagagtctggattgaagataatccatggatggaagataaaacacctgtcaccacatgggaaaacgtaccatacttaggtaaacgggaagatcaatggtgtggatcactcataggtttaacctcaagggcaacctgggcgcagaatataccgacggcaatccaacaggttcgatctttaataggaaacgaggaatttttagattacatgcctagcatgaaaagattcagaaaggaagaggaatcagaaggagcaatatggtaa

SEQ ID NO: 23440 - RNA, 9873 nt, synthetic construct
  misc_feature 1..9873: note = derived and/or modified CDS sequence (opt6) from DENV-3__FJ810416__SS-prME
  source 1..9873: mol_type = other RNA
acttcactgtgtctaatgatgattttaccggcagctttagctttccacttgacatcaagagatggagaaccgaggatgatcgttggtaaaaatgaaagaggaaaatcgttactatttaaaaccgcatcaggcataaacatgtgcacactaattgcgatggaccttggcgaaatgtgtgacgatacagttacgtacaaatgtcctcacattactgaggtagaaccagaagacatagactgttggtgcaaccttacatcaacttgggtcacatacggcacatgtaatcaagctggggaacatcgaagggataaacgttcagttgcactagctcctcatgtagggatgggcctagacactaggacccaaacctggatgagcgcagaaggtgcatggcgtcaagtagaaaaagttgaaacatgggcactaagacatccaggctttactattctagctctatttctagcacactacatcgggaccagtctaacacaaaaagtggtaatcttcatactgttaatgttggttacgccctccatgactatgcggtgcgtcggtgttgggaatagagattttgtagaaggattatcaggtgctacctgggttgacgtagtattagaacacggcggttgcgtcacaacaatggccaaaaataaacccacattagacatcgaacttcagaaaacagaagctacccaattagccacgctacggaaactatgcatagaagggaaaataaccaacatcactacagattcaagatgcccgacacagggcgaggcagttcttccagaagaacaggatcaaaattatgtttgtaaacatacttatgtggatagaggttggggaaacgggtgcggactttttggtaaaggaagcctagtgacgtgcgcaaaattccaatgtttagaacccatagaaggtaaagtggtgcaatatgagaatctaaaatatactgtaataataactgtccataccggcgaccaacatcaagtaggtaacgaaacccaaggagtaacggctgagattacgccacaagcgtctaccactgaagccattctaccagagtacggaacattaggattggaatgctcacctcgaactggcttggatttcaatgaaatgatactcctaaccatgaaaaataaagcgtggatggttcacagacagtggttcttcgatttacctttaccatggacttcaggcgctacgacggagacccctacttggaaccggaaagagttattagttacatttaaaaatgcacacgccaagaaacaggaagtagtagtgttagggtcgcaagaaggagcaatgcatactgcacttaccggtgctactgaaatccaaaacagtggtggcacatcaatttttgcaggccatttaaaatgtcggctaaaaatggacaaattagagttaaaaggcatgtcttacgccatgtgtacaaacacatttgtcctcaagaaagaggtatccgaaacgcagcacggtacaatactaatcaaagtggaatataaaggcgaggatgtaccttgcaaaataccctttagcacggaagatggtcagggtaaagcccacaacggtaggctcataacagcgaaccctgtagttaccaagaaagaagaaccagttaacattgaggctgagcccccatttggagaatcgaatatagttataggaatcggggacaacgcattaaaaatcaattggtataagaaagggtcgagtatcggaaaaatgtttgaagcaaccgcaagaggtgctaggagaatggcgatactaggagacaccgcatgggacttcggatctgttggaggtgtactaaattcgctaggtaaaatggtgcaccaaattttcggctctgcatataccgcattattctctggagtaagttgggttatgaaaattgggataggcgtactactaacatggatcgggttgaatagcaaaaatacgtcaatgagtttttcatgcatagcaatcggaatcataactctatatcttggagctgttgttcaagcagatatgggatgcgtcataaactggaaagggaaagagctcaaatgtggctcaggaatttttgtcaccaacgaagtccatacttggactgaacaatacaaattccaggcagattcgccgaaacgattagcgacagcaatcgctggggcatgggaaaatggagtatgtggcattagatccacaaccagaatggaaaatctattatggaaacaaatcgctaacgagcttaattatatcctgtgggaaaacaatatcaaactaacagtcgtagtaggtgatattataggcgtactagaacaaggaaaacgaacattaactccacaaccgatggagttaaagtattcatggaaaacatggggaaaagctaaaatcgttacagccgagacacaaaactcgtcatttataatagacggcccaaatacgcccgaatgtccctcagcaagtagggcatggaatgtttgggaagtcgaggactatgggttcggcgtgttcacaaccaacatttggttaaaactaagagaggtgtatacccaactatgcgaccatagactaatgagcgcggcagttaaagacgaacgtgctgtacatgcagacatgggttactggatagaatcacagaaaaatggatcatggaagttggagaaagcgagtctcatagaagtaaagacatgtacttggccaaagagccacactttatggtctaacggtgttctagagtcagacatgatcatcccaaaatcgcttgccggccctatttcccaacataattacagaccaggttaccatacacaaactgccggcccttggcatctaggaaaattagaattagactttaactactgtgagggaacaactgtggtcataacagaaaactgcggaactcgcggtcctagtttacgaaccactacggtatcaggaaaactaatccacgagtggtgttgtagatcatgcactcttccaccccttagatatatgggagaagacggatgttggtacggaatggagattagacctatatcagaaaaagaagagaacatggtaaaaagcctggtcagtgcagggtctggagaagtggataatttcacgatgggagtcctttgcttagctatattattcgaagaagtaatgaggggtaaattcggtaagaagcacatgattgctggtgttttcttcacctttgtattactgctttcaggtcaaattacatggagggatatggctcatactttaattatgattggatctaacgcatccgatcgtatgggaatgggcgtaacttacctcgctttaatagccacctttaaaatccaacccttcctggcattggggttctttctaagaaaacttacatccagggaaaatttgctattaggcgtaggtcttgccatggctaccaccctacaactaccagaagatatagaacaaatggcaaatggtatagcattaggacttatggcgttgaagctgatcacacaattcgaaacataccagctatggactgctctgattagtctcacctgttcaaacaccatatttaccttaacagtagcctggagaacggcaacattaattttagctggcgtatctctattaccagtttgtcaatctagtagtatgcgtaaaaccgattggctacctatgaccgtagctgccatgggtgtccctccacttccactatttatatttagcctaaaagatacactcaaacggcgttcttggccactaaatgaaggagtcatggcggtagggctagtctcgatattggcttcgtcactactacgcaacgacgtaccaatggctggacccttagttgcaggcggactattaattgcatgctacgttattacaggaacaagcgctgacttgacagtggagaaagccgcggacgttacatgggaagaagaagccgaacagactggagtgtctcataacctaatgattaccgtggacgatgatggcacaatgagaatcaaggacgacgaaacagaaaatatattaacagttcttctaaagacagcacttttgattgtcagcggtatttttccttatagcataccggctacgttactggtatggcacacgtggcaaaaacaaactcaacggagtggagttttgtgggatgtcccttcaccaccggaaactcaaaaagcggaacttgaagaaggggtatatcggataaagcaacaaggcatcttcggaaaaacacaagttggggtaggtgttcaaaaagaaggggtattccatactatgtggcacgtaactcggggtgcagttctaacttacaatgggaagcgactagaacccaattgggcctctgttaagaaagatttgatcagttacggcggtggctggcgtctaagcgcacaatggcaaaaaggtgaagaggtccaagtgatagctgtggaaccaggcaaaaacccgaaaaattttcaaactatgcccggcacatttcagactaccacaggtgaaatcggagccatagccttggacttcaagccaggtacttccggatcgccaatcataaatagagagggaaaagtagtaggattatacggaaacggggtcgtaacgaaaaacggcggttacgtatcgggtatcgcacaaacaaatgcagagcccgatggacccacacctgaactcgaagaagagatgtttaagaaaagaaatctaactattatggacttacatcccgggtcaggaaaaacaagaaaatatctaccagctatagtgagagaagccattaaaagaaggctgagaactttaatccttgcacccaccagagtcgtagcggctgaaatggaagaagcgttaaagggactaccgattaggtaccaaacaactgctactaaatcagagcacacgggaagagaaatagtagacttaatgtgccatgcaacatttacaatgagattactatcgcctgtacgagtacctaattataacttaattattatggatgaagcacactttacggatccagcttcgatagcagccagaggttacataagcactagagtgggaatgggagaggctgcagctatttttatgacagccactccaccaggaactgcagacgcgtttccccaaagcaatgcccctatacaagacgaggaaagagacataccagaacgatcttggaatagcggcaatgagtggatcacagactttgctgggaaaacggtatggttcgtacccagtatcaaagcaggaaacgacattgcaaattgcttgcgaaagaacggcaagaaagtgatccagctatccagaaaaactttcgacaccgagtatcagaaaacaaaactcaatgattgggatttcgtagttacaactgatatttcagagatgggtgccaactttaaagctgatagagttattgatccacgtaggtgcttaaagccagttattcttacggatgggccagagagagtaattctagccggaccaatgccagtaaccgctgcatctgcagcacaaaggcgaggacgcgtagggagaaacccccaaaaagagaatgatcaatatatttttactggtcaaccattaaacaacgatgaagatcacgcacattggacagaagcgaaaatgctcttagataatataaataccccagaaggaataattccagcattatttgaacctgaacgagagaaatcagctgcaattgatggcgaatacagattgaaaggtgaatcaagaaaaacgtttgtcgagttaatgagacgtggagatttacccgtatggctagcacataaagttgctagcgaaggaatcaaatatacagacaggaaatggtgttttgatgggcaaaggaataaccagatattagaagaaaacatggatgtagaaatttggactaaagagggagagaagaagaaattgagaccgcgatggttagacgcaagaacatattctgatccattagcattaaaagaatttaaagacttcgcggctggacgcaagtctatagcactcgatcttatgacagaaataggaagggtaccatcccatttagcccatcgtacaagaaacgcactggacaatttagtcatgttacatacatcagaacatggagggaaggcttatagacacgcggttgaggaactacccgaaactatggaaacgctactactactaggtttaatgatcctcttaactggaggagccatgctgttcttaataagtggtaagggaatcggaaaaacgtccattggtttaatctgtgtaatagcgagtagtggtatgttatggatggctgaaatacctttgcaatggatagctagtgcaattgtacttgagttctttatgatggttctgttaattcccgaaccagaaaagcaaagaacacctcaggacaatcagttagcttacgtagtgataggaatattaactttggcagcaataattgcagctaacgaaatgggactcttagaaactacgaaaagggatcttggtatgagtaaagaacctggtgtggtatccccaacctcctacctagatgtggatttacatccagcatcggcatggacattatatgcagtagcaacaaccgtaataacccctatgcttaggcatactatcgagaatagtacagcaaacgtcagtcttgctgcaatagcaaaccaagctgtagtattgatggggttagacaaagggtggccaatttcaaaaatggacttgggagtccccctcctagcactaggatgctatagccaagttaacccattgactctaactgctgcggttctccttttgataacacactacgctataatagggccaggattacaggccaaagcaacgagagaggctcaaaagagaacagcagccggaataatgaaaaatccaacagtggacggaataatgactattgatcttgatccagttatatacgatagtaaatttgaaaaacaacttggtcaggtaatgcttctagtcctatgtgctgtacaactactactgatgagaaccagttgggcgctgtgcgaggcattaacgctcgctactggacccataacaaccctatgggaaggaagtccgggtaaattctggaataccacaatagctgtgtctatggccaatatattcagagggtcctatcttgcaggggccggtctcgccttttcaataatgaaatccgtcgggaccggtaaacgaggtacaggaagtcaaggggaaaccctaggcgagaaatggaagaagaaacttaatcaactttcacgcaaagaatttgatctttacaagaaaagtggcattactgaggtagatagaacagaggcaaaagaggggttgaagcgtggagagattacacatcacgccgtctcaagggggtctgcaaaattacaatggtttgtagaacgcaacatggtaattccggaaggaagagtcattgatctaggatgcggccgaggagggtggtcttactattgcgcaggattgaaaaaggtgaccgaggtgagggggtacacaaaaggaggaccgggccacgaagaaccagtacctatgtccacatatggctggaatattgtgaaacttatgtcaggaaaggacgtattttatcttccacccgagaaatgtgatacgctactttgcgacataggagaatcaagtccgagccccaccgtagaagaaagtcggacaattagagtgcttaagatggtggagccttggctcaaaaacaatcaattctgcattaaagtattaaatccatacatgccaacggtagtagagcacttagaaaggctgcaaagaaagcatggcggaatgctagttagaaatccactatctcgaaattcaacgcacgaaatgtactggatatcaaatggcactgggaatatagtggcaagcgttaatatggtatcacgtttgttgttaaacagatttacaatgacacacagaaggcctacaatagaaaaagacgttgacttaggagcaggcacccgccatgtaaacgcggaaccagaaactcccaatatggatgtaataggagaacgaataaagagaatcaaagaagaacacaatagcacttggcattacgatgacgagaatccttataaaacgtgggcctatcacgggtcgtacgaagtaaaagctacaggctctgccagctcaatgataaacggtgtggtaaaactacttactaagccatgggacgtagtaccaatggtgactcaaatggcaatgactgacacgactcccttcggtcagcagagagtatttaaagaaaaagtggatactagaacgcccagatcgatgcccgggactagaagagtaatgggtataaccgcagaatggttatggaggacattaggacgtaacaagaaacctaggctctgtacgagagaagaatttaccaagaaagtaagaacaaatgcagccatgggagcagtatttacagaagagaaccaatgggattcagctaaggccgctgtagaagatgaagatttctggaaattagtagatagggaaagagaactacacaaacttggaaaatgtggctcgtgtgtgtataatatgatgggtaaaagggagaagaaattaggtgaatttggtaaagcaaaagggagccgcgccatttggtacatgtggctcggagcacgatacttggagttcgaagcactaggctttttgaacgaggatcattggttttcaagagagaatagttattcgggtgtcgaaggtgaaggtttgcataaactaggctatatactacgagatataagcaaaattccgggtggggcaatgtacgccgatgatacggctggatgggacacgagaataacagaggatgatttacacaacgaagagaaaattacacagcaaatggatccagaacaccgtcagcttgctaatgctatcttcaaattaacttaccagaataaagtagtaaaagtacaaagaccgacgccaacgggtacggtaatggacataatctccaggaaagatcagagagggtcggggcaagttgggacatatggattgaacaccttcacaaacatggaggctcagctcatccgacaaatggaaggagagggggtactaagcaaagcggacctagagaacccccgcttaccagagaagaaaatcacgcagtggctagaaacaaaaggagtagaacgacttaaaagaatggccatcagtggcgacgattgtgtagttaaacccatagatgaccgatttgctaacgccctactagctttgaacgatatgggaaaagtgcgaaaagacattcctcaatggcaaccatcaaaagggtggcatgattggcaacaagtgcctttctgtagtcaccactttcatgaactgatcatgaaagacggtcgaaagctagttgtcccatgtaggccccaggatgaactcatcgggcgagcaagaatctcccaaggcgcaggctggtcacttcgagaaacagcttgtctaggaaaagcctacgcacaaatgtggagcttaatgtacttccaccggagagacctaagactcgccagtaacgccatatgttcggccgtacctgttcactgggtcccgacaagcagaactacatggagcattcacgcccaccatcaatggatgactaccgaggatatgctcacggtctggaatagggtttggatcgaagataatccatggatggaggacaaaacccctataactacatgggaaaacgtcccgtatttagggaaacgagaggatcaatggtgtggtagtctaataggattaacatcaagggcgacgtgggcccaaaatataccaactgccattcaacaagttagaagtctgattggaaatgaggagtttttagattacatgccatccatgaaaaggtttcgtaaggaagaagaatcagaaggagccatatggtaa

SEQ ID NO: 23441 - RNA, 9873 nt, synthetic construct
  misc_feature 1..9873: note = derived and/or modified CDS sequence (opt6) from DENV-3__GQ252678__SS-prME
  source 1..9873: mol_type = other RNA
acctcactgtgtctgatgatgatattaccagcagcattagcatttcatttgacgtcccgagatggtgaacctaggatgatcgttggtaaaaatgaaaggggaaagagcttactattcaaaaccgcatctggtataaatatgtgtacactaattgcaatggacttaggtgaaatgtgcgacgatacggtaacttataaatgtcctcatataactgaagttgaaccagaagatatagattgctggtgtaatctaacaagcacttgggttacatatggaacctgtaatcaagctggagaacatcggcgagataaaagatctgtagcgttggccccacatgtaggaatgggattagatacaaggacacaaacctggatgtctgcggaaggagcctggcgtcaagttgaaaaagtggagacttgggcacttaggcaccccggtttcactatcctggcgctctttctggcgcattatatcggtacgtcacttactcaaaaagttgtaatatttatattattaatgctagtgactccaagtatgactatgagatgtgtcggagtcggtaacagagacttcgtagaaggactgtctggggctacatgggtagatgtcgtgctagaacatggaggttgcgtaaccactatggccaaaaataaaccaacccttgacatagaactacagaaaaccgaggcaactcaacttgcaacattacgaaaactctgtattgaaggaaaaataacgaacataacaacagattccagatgcccgacacagggagaggcagtattaccagaagaacaagaccagaactacgtctgcaaacacacttatgtggataggggttggggaaatggttgcggactgttcggaaaagggagccttgtgacatgtgctaaatttcagtgtctcgaaccaatagaaggaaaagttgtacaatacgagaacttgaaatataccgttataatcacagtgcatactggggatcaacatcaggtaggaaatgaaacccaaggtgtaacggcggagataacacctcaagcatcaacaacggaggcaatattaccagagtacgggacgctaggacttgagtgtagccctagaacgggtctagatttcaatgagatgatattattaactatgaaaaataaagcatggatggtccatagacaatggttctttgacctaccacttccttggacgtcaggcgcaactacagagacccccacttggaataggaaagaattactggtaacttttaaaaacgcacatgctaagaaacaagaagttgtcgtattaggatcccaggaaggcgccatgcacaccgcgttgactggagctacggaaatacaaaactccggaggcacctcaatcttcgccggtcatttgaaatgccgccttaaaatggacaaactagaattaaaagggatgtcatatgctatgtgcactaacacattcgtccttaagaaagaagtgtccgaaacccaacacggtactatattaattaaagtagagtataaaggagaagatgttccatgtaaaattccattttcaactgaagacggtcaaggcaaagcccataatggccgcttgattacagcgaatccagtggtcactaaaaaggaagaaccagtaaatattgaggcagaaccaccctttggcgaatccaacattgtaattggtatcggtgacaatgctttaaaaataaactggtataaaaagggtagttctataggtaaaatgtttgaggctaccgcacgtggcgctcgtagaatggcaatattaggggataccgcttgggatttcggtagtgttgggggagttttaaatagcttggggaagatggtacatcaaatatttggttcggcgtacacggctttattctcaggggtaagctgggttatgaaaataggaattggggtactacttacttggataggactcaattctaaaaataccagcatgtcctttagctgtatagctataggaataattacgttatacttaggcgcagtagtgcaggcagacatgggatgtgtgattaattggaaagggaaagaactcaaatgcggatccggtatatttgttacaaacgaagtacatacatggactgaacaatacaagtttcaagctgattcaccaaaacgattagctacagctatagcaggcgcgtgggaaaacggggtatgtgggatccgatccaccacacgaatggaaaacttattatggaaacaaatagctaatgagttgaactatatactttgggaaaataatataaaattaactgtagtcgtaggagacattatcggagtccttgagcaaggcaaaagaacgctgactccacaacctatggaacttaaatattcatggaaaacatggggcaaggcaaaaatagttacagcagaaacacagaacagcagttttataatagatggaccaaacactccagagtgtccatcagccagtcgagcatggaatgtatgggaagtcgaagactacggatttggtgtcttcactactaatatatggctcaaattaagagaagtttacacacagctctgcgatcatcgcttaatgagcgccgcagtaaaagatgaacgagccgttcacgcggatatgggctactggattgaaagtcagaaaaacgggtcctggaaactcgaaaaggcatccttaatagaagtaaagacgtgtacctggcccaaatcacatacactatggtcaaacggtgtattagagtcagacatgattataccaaaatcactagccggcccgatatcccaacataactaccgaccaggataccatacccaaactgcaggaccttggcacttgggcaaactcgaactagattttaactactgtgagggaacaacagtagtcataacagaaaactgcggaaccagaggaccttcgctccgaactacaacagtaagcggaaaactaatacatgaatggtgctgtagatcgtgtaccctccctcccttaagatatatgggagaagacggatgttggtacggcatggaaattcgtccaatttcagaaaaggaagaaaatatggtaaagtcacttgtttcggcaggcagtggtgaggtggataattttacgatgggcgttctgtgcttagccatactatttgaagaagtaatgcgtggcaaatttggcaagaaacatatgattgcaggcgtattcttcacatttgtacttctactcagcggccagattacatggcgcgatatggctcacacattgattatgatcggaagcaatgcatcggatcgtatgggaatgggagtaacatatctggctttaatagcgactttcaaaatacaacctttcttggcactagggttctttctaagaaaactcacatcacgagaaaatcttctactaggagtcggtctagcgatggcaaccacattgcagcttccggaagatattgaacagatggcaaacggtatagccctagggttaatggccttaaaattgataactcaattcgagacgtatcagttgtggacagcactgatatcactaacttgttccaatacgatatttacattgactgtagcatggagaacagccactttaattttggccggagtatcattactacctgtgtgccaaagttcttcaatgcgcaaaactgactggttaccaatgactgttgctgcgatgggtgtaccaccattgcccttgttcatcttttcactaaaagatactttaaaacgtcgttcatggccattaaatgaaggagttatggcggtgggcttggtaagtatcctagctagttctttgctacgtaatgatgttccaatggccgggccccttgtagcaggaggattattaatagcatgttatgtaataaccggcacctctgcagatttgaccgtcgaaaaagctgccgatgtaacatgggaagaggaagcagaacaaacaggagtcagtcacaatctcatgattaccgtggatgatgatgggacgatgcgaatcaaagacgatgaaacagaaaatattttgaccgtcctcttgaagacggcactgctcattgtatcagggatttttccttattcaatccccgcaaccttactggtatggcatacatggcaaaaacaaacccaaagaagcggtgttctttgggatgtcccatctcccccagaaactcagaaagcagagttggaggaaggtgtgtatagaatcaaacaacagggaatattcggtaaaacgcaggtcggagtaggcgtccagaaagaaggagtcttccacacgatgtggcatgttacacgaggagctgtattaacgcacaatggaaaacggctcgagcctaattgggcatcggtaaagaaagacttaataagttacggaggaggctggcgtctttcagcccagtggcagaaaggagaggaagttcaggttatagcagttgaaccagggaagaatcccaagaactttcaaaccatgcctggaacgttccaaacaacaactggagaaataggtgcaatagccttagacttcaaacctggaactagcggcagtccaataataaaccgtgaaggcaaagtcgtaggcttatatggaaatggagtggttacaaagaatggagggtatgtttcaggtatagcccaaacgaatgctgaacccgacggacccacgcctgaactggaagaagaaatgtttaagaaaagaaaccttaccatcatggatttacacccaggttcaggcaaaacgaggaaataccttccggctatagttcgagaggcgatcaaaagaagactccgaacattaatactggctccgacaagagttgtagcagcggaaatggaggaggcattaaagggactcccgattagatatcaaactacagcaacaaagtctgagcacactggacgagagattgtagatttaatgtgccatgcgacattcactatgcgacttttaagtccggtgagagtgcctaattataatttaattataatggatgaggctcacttcacagatccagcctcaatagcagctcggggctatatttcaacgcgcgtcggaatgggagaagcagccgctatatttatgaccgcgacacctccaggaactgcagatgcatttccacagtcaaatgcaccaattcaagatgaagaaagagacatacccgagcgatcctggaatagtggtaacgaatggataacagactttgcaggtaaaactgtttggttcgtaccatcaatcaaagcagggaacgatatagccaattgcctaaggaaaaacggcaagaaagttatacaactatctagaaagacattcgatacggaataccagaaaactaaacttaatgactgggactttgtagttactaccgacatttcagaaatgggtgcgaacttcaaagcggacagagtgattgaccccaggcgttgcttaaagccagttattctaacggacggtcctgaaagggtaattctagctggacctatgccagttacagctgcatcagccgcacaaagaaggggacgcgtaggaagaaacccgcaaaaagaaaatgaccaatacatcttcacgggtcagcccttaaataatgatgaagatcacgctcactggactgaggccaaaatgctattggacaatattaatacaccagaaggcataatccccgcactttttgaacctgagcgtgagaaatcagctgccattgacggcgagtataggctaaaaggagaaagccgcaaaaccttcgtagaattaatgcgaagaggagatcttccggtctggttggcacataaagttgcaagcgagggcataaaatacaccgaccgaaaatggtgtttcgacggccaacgaaataaccaaatcctagaagaaaatatggatgtggaaatttggacaaaagaaggcgagaaaaagaaattaagaccaagatggttagacgcgcggacgtattctgatcctcttgctcttaaagaatttaaagattttgccgcgggtcgcaaatcgatagctttggatttagtaaccgaaattggacgtgttcccacacatctcgctcataggacaagaaacgctttggacaacttagtaatgttgcatacatcagaacatgggggcaaagcatatagacacgctgtggaggaactacctgaaaccatggaaacattgcttctacttggtctcatgattttgctaactggcggagccatgttattcctaatctcaggaaaaggaataggaaaaacaagtatcggacttatatgtgtaattgcgagttccggtatgctgtggatggcagaaattcctctacaatggattgcttcagcaattgttctcgagttctttatgatggtcttacttatacccgaaccggaaaaacaacgcacgccacaggataatcagctagcctatgttgttattggaatattaactcttgcggcaattatagcagctaatgaaatgggtctactagaaactacaaaaagggacttaggaatgagtaaagaacccggtgtggtaagcccaacatcgtacttggacgtcgacttacatccagcgagcgcctggacgttgtatgctgtagcgacaacagtaattactccaatgttacgacataccatcgaaaacagcactgcaaatgtttccctagctgctattgcaaaccaagctgtagtacttatgggtttagataaaggatggccaatctcaaagatggatcttggtgtgcctctattagctctaggatgttatagtcaggtgaacccattaacacttactgcagctgtacttttattaatcacacactatgctataattggaccgggattgcaagcgaaagcgactagagaagcccagaaaagaacagcggcagggattatgaagaatcctacagttgacggcataatgacgatcgacttagacccagttatatatgactctaaattcgagaaacaattaggacaagttatgctcctagtcctgtgtgcagtacaattattattaatgcgaacaagttgggccttatgcgaagctctcacacttgcaaccggcccaataacaaccctttgggaaggatcaccaggtaaattttggaacacaacgattgctgtgagcatggcaaacatcttcaggggaagttacttggcaggggcgggtttagctttttcaataatgaaatcggtcggaacgggcaaaagggggaccggttcgcaaggcgaaacactaggtgagaaatggaagaagaaattgaaccaactatcgagaaaagaatttgatctctacaagaaatcaggaataacagaggtagaccggactgaagcaaaggaaggactgaaaagaggagagataacacatcatgcggtttctcgaggatcagcaaaactacaatggtttgtcgagagaaacatggtgatacccgaaggacgagttatagaccttggttgcggtcgtggaggatggtcttactattgcgcaggtcttaaaaaggtaaccgaagttaggggttatacaaagggaggaccaggtcacgaagaacccgtgcccatgagtacatatggctggaacatagtaaagttgatgagtggtaaagatgtattctatcttcctcccgaaaaatgtgacacattactttgtgatataggagaatcatctcctagccctacagttgaagaaagccgaaccataagagttctcaaaatggtagaaccttggctgaaaaataatcaattttgtatcaaagtgctaaatccatatatgcctacagttatcgaacatctagagagactgcaaagaaaacatgggggtatgttagtacgaaatccactttcaagaaattctacccacgaaatgtactggatatcaaatggaacaggcaacatcgtcgctagcgtaaatatggtatcacgcttactacttaatagattcactatgacacacagaagacctacaattgaaaaagacgtagatttaggcgccggtacgcgacatgtcaatgccgagccagagaccccgaatatggatgtaattggtgaaagaattaagaggattaaagaggagcacaattctacgtggcattatgatgacgaaaatccttataagacatgggcgtaccacggatcatatgaggttaaagctacaggttcggcatctagtatgattaatggcgtcgtgaaacttcttaccaaaccgtgggacgtagtccccatggtgacccaaatggcaatgactgataccacgccgtttgggcaacagagagtgttcaaggaaaaagtcgacacccgaactccgagatcaatgccaggcactagaagggtcatgggaataacagcagagtggttatggcggacactaggtagaaataagaaaccgagattatgtactagggaagaatttacaaagaaagtgaggacaaacgcagccatgggagcagtgttcacggaggaaaaccaatgggatagcgctaaagcagcagtagaagatgaagatttttggaaattagtggatcgagaacgtgaattacataagttaggcaaatgcggaagttgcgtatacaacatgatggggaaaagagagaagaaacttggtgaatttggtaaagcaaaaggtagccgtgccatctggtatatgtggttaggagctcgatatttagagtttgaagcactaggattcctaaatgaggatcattggttctcgagagaaaattcatattctggtgttgagggagaaggactacacaaactcggatacatattaagagacatatccaaaataccaggcggcgctatgtatgccgacgatactgccgggtgggatactaggataacagaagatgatttacataatgaggagaaaatcacccagcagatggatccagaacaccgccagcttgcaaacgcaatcttcaaactgacttatcaaaacaaagtagttaaagttcaaagaccaacaccaacaggaacggtgatggatataatatcaagaaaagatcagcgagggagcgggcaagtagggacgtatgggctgaacacttttaccaatatggaagctcaactcatacgacaaatggaaggagaaggggtactaagtaaagccgatctcgaaaacccgcacttaccggagaagaaaattacgcaatggttagaaacaaagggagtggagcgacttaaaagaatggcaataagtggtgatgactgcgtggtcaaacctatcgacgatagatttgctaatgcgctgcttgcactaaacgatatggggaaagtgaggaaggacatacctcaatggcaaccgtcaaaaggatggcatgactggcagcaagtccctttttgtagtcatcattttcatgaattaataatgaaagacggtcgtaaactggtagttccatgcagaccccaagatgagttgattggtagggctaggatctctcaaggagcaggatggtccctaagagaaactgcttgtctcggaaaggcatatgctcaaatgtggtctctaatgtactttcatagacgtgacttacgattggcaagtaatgcaatatgttccgctgtgccggtacattgggtacctacatcccgtacgacatggagtatccatgctcatcatcaatggatgacaacagaggatatgctaaccgtgtggaacagggtatggatagaagataacccctggatggaagacaaaacacctgtaacaacatgggagaacgttccttacctgggaaaacgcgaagatcaatggtgtggctcattaatcggactaacatccagagcgacgtgggcacagaatatatctacagcaattcaacaagtccgcagtttaataggcaatgaggaatttttggattatatgccatctatgaagagatttaggaaagaagaagagagtgaaggcgccatttggtga

SEQ ID NO: 23442 - RNA, 9873 nt, synthetic construct
  misc_feature 1..9873: note = derived and/or modified CDS sequence (opt6) from DENV-3__FJ850098__SS-prME
  source 1..9873: mol_type = other RNA
actagcttatgccttatgatgatacttcctgctgctcttgcatttcaccttacaagtcgagacggcgaaccaaggatgatagtaggcaaaaatgaaagaggtaaatcgctcttattcaaaacagcatctggtattaatatgtgcacattaatagcaatggatttaggggaaatgtgcgatgacaccgttacgtataaatgtccacacataacagaagtcgaacctgaagacatagactgctggtgcaatctaacatcaacatgggtaacgtatggtacgtgtaaccaagcgggcgagcacagacgtgataaacgatcagtagcactggcacctcatgttggtatgggtttagacacacggactcaaacatggatgtctgcagagggcgcttggcgtcaagtcgagaaagtagaaacctgggctttgagacatccgggatttactatactagcattattcctagcacactacataggtacatcactcactcaaaaagtagttatctttatattgttaatgctagtgacaccctcaatgacgatgagatgtgttggtgtagggaatagggatttcgtcgagggtctatctggagctacatgggtggacgtcgtattggagcatggaggatgcgtgactaccatggccaaaaataaacctactctggatatagaattacagaaaacggaagcaacacaactggcaacattaagaaaattatgcatagaaggtaaaatcacaaacataaccactgattccagatgcccaacacaaggggaggctgttcttccagaagaacaagatcaaaattacgtatgtaaacatacatacgttgatagaggctggggaaatggttgcggtctgttcggaaaaggctctctagtaacatgtgcaaaatttcaatgcttagagcccattgaagggaaagtcgttcaatatgaaaatcttaaatacaccgtaataataacagtacacactggcgatcaacaccaagtaggcaatgagacccaaggtgtgaccgcagagataacaccacaagcatccaccacagaagcaatactacctgagtatggtacattaggattagaatgttcaccaagaacaggattggattttaatgaaatgattcttctgacgatgaaaaataaagcctggatggtgcatcgtcaatggttctttgacctacccctaccatggacctcaggagccactactgaaacacccacgtggaacaggaaagaactacttgttaccttcaaaaatgcacacgccaagaaacaagaagtcgttgtactaggtagtcaagaaggcgcaatgcatacagcccttaccggagctactgaaatacaaaactctgggggtaccagtatatttgcaggtcatttaaaatgtcgcttgaaaatggacaagttagagcttaaaggtatgagttacgccatgtgtacgaatacgtttgtgctaaagaaagaagtatcagaaacccaacacgggaccattttaattaaagtagaatataaaggagaggatgtaccgtgcaaaattcccttttcaactgaagatggtcaaggtaaggcacataatggccgcttaataacagctaaccctgtagtcacgaaaaaggaagacccagtcaacatagaagcagaaccaccttttggagaaagtaatatcgtcattggaattggagataacgcactaaaaattaactggtacaagaaaggttccagtataggcaaaatgttcgaggccacagcacgtggcgctcgtagaatggcaatactgggtgatacagcatgggattttgggtctgtaggaggagtactaaactcacttgggaaaatggtccatcaaatatttgggagcgcgtacaccgcactattttcaggtgtatcctgggttatgaagattggaataggcgtattattgacgtggataggattaaacagtaaaaatacgagcatgtcattcagttgtatcgctataggaataataacattatatctaggagctgtcgtacaagctgacatgggatgtgttatcaattggaaaggcaaagaattaaagtgcggatccggaatatttgtaacaaatgaggttcatacatggacagaacaatataaattccaagccgactcaccaaaacgacttgctactgccatagctggagcatgggaaaatggggtctgtggcatccggagcaccacaaggatggagaacttactctggaaacaaatagcaaacgagctaaattacattttatgggaaaataatattaaactaaccgtcgtagttggtgatgtgataggtgttcttgaacaagggaaacgaacacttactctccaaccaatggagttaaagtactcttggaaaacttggggaaaggcaaaaatcgttactgccgaaactcaaaactcttcctttatcatcgacggaccgaacacccctgaatgtcctagtgcatctagggcttggaatgtttgggaagtcgaagattatggcttcggtgtttttactactaacatttggcttaaacttagagaagtttatacgcaattatgtgatcacaggctaatgtcggccgcagtaaaagacgaacgagcggttcatgccgacatgggttattggattgaatcacagaagaacggttcatggaaactagaaaaggcttcattaatagaagtaaagacatgcacgtggcctaagtcccatactttatggtctaatggcgtactcgaaagtgacatgattataccaaaatcccttgctggaccaatatcacaacataactatcgacccggttatcacacccagactgcgggcccatggcacctagggaaacttgaactagattttaactactgtgagggcacaacggtagtaatcacagaaaattgtgggacaagggggccatcactacgaacaaccactgtatcaggaaaactgattcatgaatggtgttgtcgttcttgtacattaccccctcttaggtacatgggcgaggatggatgttggtacggtatggaaatcagacccatatcggaaaaagaagaaaatatggtcaagtcacttgtctctgctggttcaggagaagtagacaatttcactatgggagttctgtgcctcgcaatattgttcgaagaagtaatgcgaggtaaatttgggaagaaacacatgatagcgggtgtgttctttacttttgtcttgttactcagtgggcaaataacctggcgagatatggctcatactcttattatgataggttcgaacgcttcagacagaatgggcatgggagtaacatacctagcgctgatagctacattcaaaatccaaccatttttagcactcggattctttctaagaaaattaactagcagggagaatctgctactaggtgtaggcttagcgatggctaccactctccaattgcctgaggacatagaacagatggctaacgggatcgcattaggactaatggccttaaaattgataacacagttcgaaacttatcaactctggacggcattaattagtctgacatgttcaaacaccatattcacgctgactgtagcctggcgtactgcaacacttatactggcaggggtttccctattacctgtatgtcagtcctcttcaatgcgtaaaacggattggctacctatgacagtggcagcaatgggagtcccaccactaccattatttatattctctctaaaagacaccctcaaaagaagaagctggccactaaacgagggcgtaatggctgtagggttagtatccattttagcaagcagcctccttaggaatgacgttccaatggctggtcccctagtggcaggagggctattaatagcttgttatgtaataaccggtacaagtgcggatctcacagtagaaaaagcagcagatgtcacctgggaagaggaagcagagcagactggtgtatcccacaatttaatgatcaccgtcgatgatgatggcacgatgagaataaaagatgacgaaactgagaatatactcactgtcttactcaaaactgctctgttaatagtatccggcatatttccctatagtatccccgcaacgctattagtgtggcatacatggcaaaaacaaacgcaacgtagcggtgttctatgggacgtaccaagtcctccagaaactcagaaagcagaactcgaagaaggggtttatagaataaaacaacaggggatcttcggaaagactcaagttggagtaggtgtacaaaaagaaggggtgtttcacacaatgtggcatgtaaccagaggggctgtactgacatacaatggcaaacgattagaaccaaattgggcatcagtcaagaaagatttaatttcctatggaggaggatggaggctaagcgcacagtggcagaaaggtgaggaagttcaagtcatcgcagtagagccaggtaaaaaccctaaaaattttcagacaatgcccggaacatttcaaactacaactggtgaaataggagctatcgcgctagactttaaacctggaacctcaggctcccctataattaacagagaaggaaaggtggttggcctatacggtaatggagtagtcaccaaaaacgggggatatgttagcggtatcgcacaaaccaatgcagaacccgatggtccgactcccgagttggaagaagagatgtttaagaagcgaaatttaacaataatggatctacaccctggaagcggtaaaacacgtaaatatcttcctgctattgtccgcgaggccatcaaaaggagactaaggactctaattttagccccaactagagtagtggccgccgaaatggaagaagcgttgaaaggtctaccgattcggtatcagacaacagctaccaagagcgaacatacaggcagggaaatagtcgacttaatgtgtcacgccacatttactatgagactactatctccagtaagagtacctaattacaatctaattataatggacgaagcacattttactgatccagcttccatagcagccagaggatacatatctactagggttggaatgggtgaagcagcagcgatttttatgacagccaccccaccagggactgcagatgcatttccacaaagtaatgcaccgatccaagacgaagaaagagacataccagagcgctcatggaactcggggaacgaatggatcaccgattttgcaggcaaaaccgtttggtttgtcccatccatcaaagcaggaaacgacattgcaaactgcttgcgcaaaaacgggaagaaagtaatacaactcagtagaaaaactttcgacactgagtaccagaaaacaaaacttaatgattgggatttcgtagtaactactgatatctcagaaatgggcgcaaatttcaaagcagatagagtaatagatccgagacgatgtttaaaacctgtgatactaactgatgggcctgagcgcgtgatattagcagggcctatgccagtaacggccgcatccgctgcccaacgacgaggacgtgtaggaagaaacccccaaaaagaaaacgatcagtacatttttacgggacagccactaaacaacgatgaagaccacgcacattggaccgaagcaaagatgctgctggataacattaataccccagaaggaattattcccgcactgtttgaaccagaacgagagaaatccgcggcgattgacggagagtatcgcttaaagggcgaatctcgaaaaaccttcgttgagttaatgcgacgtggggaccttcccgtttggctagcacataaggtagctagtgaaggaataaagtatacagatcgtaaatggtgttttgatggtcagcgcaacaaccaaattctcgaagaaaatatggacgtcgaaatctggactaaagaaggagagaaaaagaaacttcgaccaagatggttggatgcaagaacttattcggacccattagcacttaaagaatttaaagatttcgccgcaggcaggaaatcgattgcgctggatttggtaacggaaatagggagagttcctagccatttagcacatagaacgagaaatgctctagataatttggttatgctacatacaagtgaacacggcggtaaagcgtaccgtcatgcagtagaggaactgcctgaaactatggaaactctattactacttggactaatgattctgctcaccggcggcgctatgcttttcctgatatcaggaaaaggtattggaaaaacaagcattggactaatatgtgttattgcgtcttcgggaatgctatggatggcagagattcctctacaatggatagcttccgccattgttctggaatttttcatgatggttttgttgatacctgagccagaaaaacaacgcacaccacaggataaccaactcgcatatgtagtgattggtatccttaccttggccgctatcattgcggccaacgaaatgggacttttagagacaactaagagagacttgggtatgtccaaggaaccaggcgttgtttccccgacaagttacctagatgtagatctccatccagcgagtgcatggacactatacgcggtggcaactacggttattactcccatgttaagacacaccatagagaatagtacagcgaatgtatcattagccgcaatagctaatcaggcagttgtattaatgggtctcgataagggctggccaatctcaaaaatggatcttggagtgccacttcttgcactaggatgctacagtcaggtcaatcctctgacactcactgcagccgtacttttgcttattacgcactacgcaattattggtccaggtttgcaagctaaagcaacacgcgaagcacagaaaagaacagctgcaggaataatgaaaaatcctactgtagatggcattatgacaattgaccttgacccagtcatatacgactctaagttcgaaaagcaattaggacaagttatgttactggtcctttgtgcggtacagctattgttaatgcggacatcgtgggcactttgcgaagcacttactctcgccacaggaccaataaccactctttgggaagggtcgccaggaaaattttggaacacaactattgccgtatctatggcaaatatttttagagggtcatacctggctggtgcgggtctagcgttcagtataatgaaatctgtaggaacaggaaagcgtggcacaggtagccaaggagaaacactcggcgaaaagtggaagaagaaactgaatcaattgagcagaaaagaatttgatctatataagaaatcgggaattacagaggtagataggacggaagcaaaagaaggactaaaaagaggggaaattacacaccacgctgtaagtcggggtagtgcaaaactacaatggttcgtcgaaaggaacatggtcataccagaaggaagggtaatagatctaggttgcgggcgaggaggttggagctactattgtgctggccttaaaaaggtaactgaggtgcgaggatatactaaaggagggccgggtcatgaggaaccagtaccaatgtcaacatacggatggaacatagtaaaattgatgtcaggaaaagacgtattttatttaccaccagagaaatgcgacactctcttgtgcgatataggagaatcgtctccgtcgcccacggttgaggagagtcgaactataagagttcttaagatggtggagccgtggctaaagaataaccagttttgtatcaaagtactcaacccttacatgccaacagtagtagaacatttggaaaggctacaacgcaaacatggaggtatgctagtacgcaatccgctatcacgcaactccacacacgaaatgtactggataagcaatggcacaggaaacattgttgccagtgtgaatatggtcagtcgtttactactgaataggttcacaatgacacatagaagacctaccatagaaaaagatgtcgacttaggtgcgggtacaaggcatgtaaatgccgaaccggaaacacccaatatggatgttataggggaacggataaagaggattaaagaagaacataatagcacatggcactatgatgatgaaaacccatacaaaacgtgggcttaccatggctcatatgaggtgaaggctacaggatctgcatcaagtatgataaacggagtcgtcaaactcctaacaaaaccttgggacgttgtaccaatggttacccagatggccatgacggacaccactccattcggacagcagagggtctttaaagaaaaagtagatacacgtacacctaggtcaatgcctggaacaagaagagtcatgggaatcacggcggagtggttatggcgaaccttgggtcgaaacaagaaacctagattatgcacgcgggaggaatttactaaaaaggtacgaaccaacgcagctatgggggcagtctttacagaagaaaaccaatgggattcggcgaaagcagctgttgaggatgaagatttctggaaattagtagatagagagcgcgagctacataaacttggaaagtgtggatcatgcgtctacaacatgatgggaaaaagagaaaagaagctaggtgagtttggtaaagcaaaaggaagtcgtgcaatctggtacatgtggttaggagcacgttacctagaatttgaagcattaggattcttaaatgaagaccattggttttcgcgagaaaattcatacagtggcgtagaaggagaaggactacataaattaggatacattttacgtgacataagcaaaataccaggcggcgccatgtacgccgatgatacggcagggtgggatacacgaatcacggaggatgacctacataatgaggagaaaatcacgcaacaaatggatccggagcatcgacaattagcaaatgcaatattcaaacttacgtaccaaaataaggtcgtgaaagttcaaagaccaactcccacagggacagttatggatataatctcgcgaaaagaccaaagaggatcaggccaagtgggtacttacggcttaaatacgtttacgaatatggaggcacaacttatcaggcaaatggaaggtgaaggtgttcttagcaaagcggatctggaaaacccaagacttcctgagaaaaagattacccaatggctagaaacgaagggcgttgaaagattaaaaagaatggctataagcggagatgactgtgtagtcaaacccattgacgacagatttgcaaacgcactactcgctctcaatgatatgggtaaggtaagaaaagacataccacaatggcaaccttcgaaaggatggcacgattggcaacaagtaccattctgttcacaccacttccatgagctaattatgaaggatggtaggaagttagtagtgccttgcagacctcaggacgaactaattggtcgcgctcgaatatcacaaggggccggttggtctctccgtgaaacagcatgtcttggaaaggcttatgctcaaatgtggtctctcatgtatttccataggcgagacttacgcttagcctcaaatgcgatatgctcagccgtacctgtccactgggtaccaactagcagaacaacctggtcaatccacgcgcatcaccaatggatgactaccgaagacatgttgacagtttggaatagagtctggatagaagataatccctggatggaagacaaaacccccgtaactacgtgggaaaacgtaccgtatctaggaaaaagagaggaccagtggtgtggcagtttaatcggattgacaagtcgggctacttgggctcagaacattcccacagctatacaacaagtcagatcactcattggaaatgaagagttcttagattatatgccaagcatgaaaaggttcagaaaagaagaagagagtgaaggagctatatggtaa

SEQ ID NO: 23443 - RNA, 9873 nt, synthetic construct
  misc_feature 1..9873: note = derived and/or modified CDS sequence (opt6) from DENV-3__KF955479__SS-prME
  source 1..9873: mol_type = other RNA
accagtctgtgtctcatgatgatactaccagcagctctcgcttttcatttaacctcacgggatggtgaaccccgtatgatagttgggaaaaacgagcgcggtaaaagtttacttttcaaaactgctagtggtattaatatgtgtactctgattgcaatggacttaggagagatgtgtgacgatacggtaacgtacaaatgtccccatattactgaagtcgaacctgaagatatagattgctggtgtaatctaaccagcacatgggtaacgtacggcacgtgtaatcaagctggcgagcataggagggataaaagaagtgttgcattggcgcctcatgtaggaatgggacttgacacccgaactcaaacatggatgagtgctgaaggagcatggagacaggtggaaaaagtcgaaacatgggcattaagacacccaggttttacaatacttgcacttttcctagcacattacataggtacctctcttacacaaaaagtggtgatattcattttactaatgttggtgactcctagtatgacgatgcgctgtgttggagttggaaatagggattttgttgaaggactttccggtgcaacgtgggttgacgtagtattagaacatggaggttgtgttacgacaatggccaaaaacaaaccgacactagatattgaattgcagaaaacagaagctacccaattagcaacactaagaaaactctgtattgaaggaaaaataacgaatataacaacggactccagatgcccaacacaaggagaagcggttttacccgaggaacaagatcagaattacgtttgtaaacacacgtacgtcgaccgaggatggggaaatggctgcggactctttggtaaaggaagtttagtcacttgtgcgaaattccaatgtcttgaacccatagaaggaaaagttgtacagtatgaaaacttaaaatatactgtcattataacagttcacacaggtgaccagcatcaggtcggtaacgagacacaaggagtgaccgctgaaataacaccacaagcatcaacgactgaagccattctcccagaatatggtaccttgggccttgaatgctcaccaaggacgggcctagactttaatgaaatgatactactaacgatgaaaaataaggcttggatggtacacagacaatggttctttgacttacctctaccatggacaagtggagcaacaacggagacgccgacctggaaccggaaagaactattagttacattcaaaaatgcacacgctaagaaacaagaagttgttgtcttggggtctcaagaaggcgccatgcacactgctttaacaggtgcaacggaaatccaaaattccgggggaacctcaatatttgcgggacatttaaaatgcaggttaaaaatggataaactagaattaaaaggcatgtcatacgcgatgtgcactaatacttttgtgctaaagaaagaagtttccgaaacccagcatggaactatcctaattaaagtcgaatataaaggagaagatgttccctgcaaaatacccttctctactgaagacggacaaggaaaagcacacaacggcagactaataacagccaacccagtagtgacgaaaaaggaagaacctgttaatattgaagctgagcctccatttggcgaatcaaatatagtgataggaatcggggacaatgccctgaaaattaattggtacaagaaaggtagtagtattggaaaaatgtttgaagctacggcaagaggagcccgtcggatggccatactgggagacacagcttgggattttggtagtgtcggtggcgttttaaatagtcttggcaaaatggtacatcaaatttttggatcggcctacacggcactgttctccggcgtctcgtgggtgatgaaaattggtattggggtcctgttaacgtggattggacttaattcgaagaatacttctatgagcttttcatgtatcgcaattggaataatcactttgtatttgggagctgtagtacaggcggatatgggatgtgtgataaactggaaaggtaaggaacttaagtgtggcagtggcatatttgttacgaacgaagtacacacttggactgaacaatataagttccaggcagattcaccaaaaagacttgcgaccgcgatcgccggtgcttgggaaaacggtgtctgtggtatcaggtctacaactcggatggaaaatttactgtggaaacaaatcgctaacgaactgaactacatattatgggagaacaacatcaagttaacagttgtggtgggagacattatcggcgtattggaacaaggaaaacggaccttaacgccacaaccgatggagctgaaatatagttggaagacttggggaaaagccaagatagtaacggctgaaactcaaaactctagcttcataattgatggaccaaacactcctgaatgtcctagcgcttcacgtgcatggaacgtttgggaagtagaagattatgggtttggcgtgtttactacaaatatatggttaaaattaagggaagtttatacacaactgtgcgatcatagattaatgtcagcggccgtaaaagatgaacgagcagttcacgcagacatgggttattggatagaatcacagaaaaacgggtcatggaaattagaaaaggcatcatttatagaagtaaaaacctgtacatggccaaaaagtcatacactttggagtaatggtgtattagagagtgatatgataataccaaagtcacttgctggaccaataagccaacacaattatcgtcccggatatcatacacaaacggctggcccatggcatctcggaaagttagaactggatttcaattactgtgaaggaacgaccgtagtcataacggagaactgtggtacacgcggcccatctcttcgaacaactacggtgtctggaaaattgatacacgaatggtgttgccgctcgtgcacactaccaccacttaggtacatgggggaggacggatgttggtacggaatggaaatcagacctatatcagaaaaagaagaaaacatggtcaaatccctagttagcgcaggatcaggggaagtagacaatttcactatgggagtattgtgcttagcaatcttatttgaagaagtaatgcgtgggaaattcggcaaaaagcatatgatagcgggagtattctttacttttgtgctgttactgagtggacaaattacgtggcgcgatatggcacacactctcataatgatcggctcgaatgcctctgatcgaatggggatgggagtcacatacttagctttaatagcgacattcaaaatccaaccctttcttgccttaggatttttcttacgcaaactaacaagtcgcgaaaacttgcttctaggagttgggcttgcaatggcaacgactttacaattaccagaggatatcgaacagatggcaaacgggatcgctctaggactgatggcccttaaactaataactcagtttgaaacttatcagttatggaccgcattaatctcgctcacatgttccaatactatctttacactcacggtggcatggagaacagcaacattaatactagccggggtatctttactgccagtatgtcaatcctcatcaatgcgaaaaacggattggttgccaatgacagttgccgcaatgggagtccctcctttaccactatttatttttagcctaaaagacaccctaaagcgaagatcctggccactgaacgagggagtaatggcagtagggttagtcagcatactagcaagttcactcttaagaaatgatgtccccatggcagggccacttgtcgctgggggattacttatagcgtgttacgtgataaccggaacatccgcagatttaacggtagaaaaagcagcagatgtaacctgggaagaagaagctgaacaaacgggcgtgagccataacctgatgataacagttgacgatgatggaacaatgcggataaaggacgatgaaactgaaaatattctaactgtactattaaaaacagcactactaattgtatccggaatatttccatactccatcccagctaccttattagtgtggcatacatggcagaaacaaacacaacggagcggcgtactttgggacgtcccctctccccctgaaacacagaaagctgaacttgaggaaggcgtttatcgtatcaaacaacaaggtatattcggaaaaacacaagttggggtgggagtacaaaaagaaggagttttccatactatgtggcatgttacacgaggtgccgtattgacttataatggaaaacgacttgaacccaattgggcatccgtcaagaaagatcttattagctacggtggaggatggcgtctatccgcacagtggcaaaaaggcgaagaggtacaagtcatcgcagtggagccaggtaaaaatcccaaaaactttcaaaccatgcctggaactttccaaacaactactggtgaaatcggagcaatagcactagacttcaaaccgggcacaagtgggtcccccattattaacagagagggcaaagtcgtagggttatatggtaatggtgtagttactaaaaacggaggatatgtctcagggatagctcagacaaacgccgaacctgatgggccgacaccggaattggaagaagagatgtttaagaaacgaaacttgactataatggatttacatcccgggtcagggaagactagaaaatatcttcctgctatagtacgggaagcaataaaaaggcgtctccgaacgctgatattagcccccacaagggtagtggcagcggaaatggaagaggcattaaagggattaccaatacgataccaaacaaccgcaacaaagtccgaacacacaggacgagaaatcgtggaccttatgtgccatgctacgtttaccatgagattactaagtccagttagagtacctaactataatttaattataatggacgaggctcactttaccgaccctgccagcatcgcagctagaggttatatctcaaccagggttgggatgggagaagccgccgcaatattcatgacagcgactccgcctgggaccgccgatgcattcccgcaaagtaatgcaccaattcaggacgaggaacgagatatcccggaacgttcatggaatagtggaaatgaatggataactgacttcgcaggaaaaacagtatggttcgtcccatccataaaagccggaaacgacattgcaaactgccttcggaaaaatggcaagaaagtcatccaactaagtaggaaaacatttgataccgagtatcagaaaaccaagttgaacgactgggacttcgtagtaactactgatatatcagaaatgggtgctaactttaaagcagatcgagtgatagacccaagacgttgtctcaagcccgttatcttaactgatgggcccgaaagggtcatactagcaggcccgatgcccgtcacggcagcaagcgccgcgcaaagaagaggccgagtggggagaaacccacagaaagaaaatgatcaatatatttttacggggcaaccattaaataacgatgaagaccatgctcattggacagaagcaaaaatgttactggacaacataaatacaccagaaggaattattccagccctattcgaaccagaacgggagaaatccgctgctattgacggggaatacagattaaaaggcgagagccggaaaactttcgtggaattaatgagaagaggtgatctacctgtctggttagctcacaaagtcgcatcggagggaattaaatatactgatagaaagtggtgcttcgatggacaacgtaataatcaaatcttagaagagaacatggacgtagaaatatggacgaaagagggcgagaagaagaaattgcgaccacgttggttagacgcaagaacttactcggaccccctagcgttaaaagaatttaaagacttcgcggcgggaagaaaatccattgcacttgatctagtgacggagataggaagagtgccttcacatctagcccatagaacacgtaatgcgttagataacttagtgatgcttcatactagcgaacatggtggtaaagcctatagacatgcggtagaagaacttcctgaaactatggaaacactcctcctgctaggtctaatgatactccttacaggtggtgctatgctttttcttataagcggcaagggcataggaaagacgagtataggcctcatttgcgttatagctagttcaggaatgctttggatggctgaaatacccctacaatggatagcctcagcaatagtattggagttctttatgatggtcttgctgataccagaaccagaaaaacaaagaacgccgcaagacaaccagcttgcgtacgtggttataggaatattaaccttagcggccataattgcagcaaacgaaatgggactgctagagaccaccaaaagagatcttggtatgagtaaagagccaggcgtagtatcgcctacatcttatctagatgtcgaccttcaccccgcctcagcatggacattatacgcagtagctacaaccgttataacgccaatgttgcgacacacgatcgaaaatagtactgcaaatgtttctcttgcagccatcgctaaccaggctgtcgtactgatgggcctcgacaaaggctggccgatatcaaaaatggatctcggcgtaccgttattggccttaggttgctattcgcaagtaaatcctctaacgttaaccgctgcggttttattactgataacgcattatgccattattggaccaggattgcaagcaaaagctacccgggaagctcagaaaagaaccgctgctggtatcatgaagaacccaactgtagatggaattatgactatcgatttagaccctgttatctatgattcgaaatttgaaaaacagctcggtcaggtcatgttacttgtgctttgcgccgtacaattactactaatgcgaacaagttgggccctgtgcgaagcccttactttagcaacaggccctataaccactttgtgggaaggctcacctggaaaattctggaatacgacgattgctgtttccatggcaaatatatttcgcggttcttatcttgcaggagcaggcctagcattctctataatgaaaagtgtaggaactggaaaacgaggaacgggaagtcaaggcgaaacattaggtgagaaatggaagaagaaattaaatcaattatcacgaaaagaatttgatctgtacaagaaatcaggtataacggaagtcgatagaactgaagcaaaagaaggcttgaaacgaggagaaatcacgcaccacgcagtctctcggggaagcgcaaaactacagtggtttgtagaacgcaatatggtaatcccggaaggtagggtaatagacttaggatgtggccgtggaggatggtcttattactgcgcaggacttaaaaaggtaacagaagtgcgtggttacactaaaggagggcctggtcatgaagaaccagttccaatgtctacttatggttggaacatagtaaaacttatgtcaggcaaagacgtgttttacttgccacccgaaaaatgcgacactctcctttgtgacataggagaaagtagcccatcaccaacagttgaagaaagtagaacaatcagggtgttaaagatggtcgaaccatggctaaagaacaatcagttttgtattaaggttctcaatccttatatgcctacagttatagaacatttagaacgattacaacgaaaacatggaggaatgctggttaggaacccactgtctcgaaatagtactcacgaaatgtactggatatctaatggcaccgggaatatcgtagcgtcagtaaatatggtcagtcgactactcttaaaccgtttcacaatgactcatcgaagaccaacaatagaaaaagatgttgacttaggggctggcaccaggcacgtaaacgcagaaccagaaacgccaaatatggacgtaataggggaaagaataaaacgtatcaaagaagaacataattctacgtggcattatgatgatgaaaacccctataaaacatgggcttatcacggatcttacgaggtaaaagctactggttcggcgagcagcatgatcaacggtgtagtaaaattgttaactaaaccatgggacgtggttccaatagtaacccaaatggccatgaccgatacaactccatttggccaacagcgtgtgttcaaagagaaagtagatacacggactccaagaagtatgcctggaacaagaagagtaatgggaataacggcggaatggttatggcggaccttaggacgaaacaagaagcctcggttatgcacacgagaagaatttactaagaaagtccgtacaaacgcggcaatgggagctgtattcactgaggaaaatcaatgggacagcgcaaaagcagctgttgaagatgaagacttttggaaattagtggatcgtgaacgcgaactgcataaactagggaaatgcggctcatgtgtctataatatgatgggaaaaagggagaagaagctgggtgagtttggcaaagcgaaaggttcgcgtgctatctggtatatgtggctaggggctaggtacctcgaatttgaagcgctaggttttctgaacgaagaccactggttcagtcgagaaaacagttatagcggcgtagaaggtgaaggattacacaagctaggatatattttgagagatataagcaaaattccgggtggggcaatgtatgcagacgatacagccggatgggatacaaggattacagaagatgatctacataacgaagaaaagattacccaacagatggatcctgagcacagacaacttgctaatgcgatatttaaactgacgtatcaaaataaggtagtcaaggttcaaagaccaacaccaactggaactgtgatggatataatttcaagaaaagatcagagaggatctggccaggtagggacgtatggcctcaatacatttacaaacatggaagctcaattaataagacaaatggaaggtgagggtgtactctcaaaagcagatttagaaaatcctcatctaccagaaaagaagattacacagtggctagaaacaaaaggagtggaaagattaaaaaggatggcaatatcaggagatgattgcgtagtcaaaccgatcgacgatcgatttgccaatgcgttactagctctaaacgacatgggaaaagtaagaaaagatataccccaatggcagcctagtaaaggctggcatgactggcagcaagttccattttgtagccatcactttcatgaactaataatgaaagacggaagaaagctagtcgtaccttgtagacctcaggatgaattgattggacgagcacgaattagtcaaggcgcggggtggtcattacgcgagactgcttgtttaggaaaagcatatgcacaaatgtggagcttaatgtattttcataggagagacttacgtcttgcatcgaatgctatatgtagtgctgtgcctgtacactgggtaccaacttcaagaacgacatggtcgattcacgcccaccatcaatggatgacaactgaggatatgctaaccgtctggaaccgcgtttggattgaagataacccgtggatggaagataaaaccccagtaacgacatgggaaaatgtgccctatttaggaaagcgggaggatcagtggtgtggttcgttaataggacttacatcacgcgcaacgtgggctcagaatataccaaccgcgattcaacaggtccgttcgttaattggcaacgaggaatttctggattatatgccaagtatgaaacggtttaggaaagaggaagaatcggagggcgctatatggtga

SEQ ID NO: 23444 - RNA, 9873 nt, synthetic construct
  misc_feature 1..9873: note = derived and/or modified CDS sequence (opt6) from DENV-3__FJ850109__SS-prME
  source 1..9873: mol_type = other RNA
acaagtctatgtcttatgatgatattacccgcagctttagcattccatctaacctcacgagatggcgaacccagaatgatcgtaggtaaaaacgaaagagggaaaagtttactttttaaaacagcaagcggaatcaatatgtgtacgctaattgcaatggatttaggggaaatgtgtgatgatactgtcacttataaatgtccacatatcacagaagtggaaccagaagacatagattgttggtgtaatttaacaagtacatgggtaacctacggaacttgtaaccaagctggagaacacaggagagataaaagatccgtcgctcttgctccgcacgtgggtatgggactagatacgagaacacaaacatggatgtcggcagaaggagcctggagacaagttgaaaaagtcgaaacatgggcgttacgtcaccctggatttacaatcttagcactatttttagcccattacacgggaacgtccctaacccaaaaagtagtaattttcattttgttaatgcttgttacaccaagcatgacaatgcgttgcgtaggcgtgggaaatagagatttcgtcgaaggcctatcaggagctacatgggtggatgtagttttagaacacggagggtgcgttacaaccatggctaaaaacaaacctacactagatattgaacttcagaaaactgaagctacgcaactagcgaccctacgaaaattatgcatcgaaggcaaaattactaatataacaacagactctcgatgtccgactcaaggagaagctgtcttaccagaagaacaagaccaaaactatgtatgtaaacacacttatgtcgatcgcgggtggggcaacggttgtggattatttggaaaaggctcacttgttacctgtgcgaaattccaatgcttagagcctatagaaggaaaagtcgttcaatacgaaaatctaaaatatacagtcataataacagttcacactggcgaccaacaccaagtcggtaatgaaacccaaggagtgaccgccgagataactcctcaggcatctactaccgaggcaattttacctgaatacggcacgttgggcttggagtgctctcctagaaccgggttagatttcaacgagatgatactattaaccatgaaaaacaaagcctggatggtgcacagacaatggttctttgatttacctcttccttggacatcaggagcaacaacagagacgccaacttggaaccgcaaagaacttttggtaacattcaaaaatgcccatgccaagaaacaagaagtagttgtcttaggaagtcaagagggagcaatgcatacggcacttacaggggcaacagaaatacaaaactctgggggaacatctatttttgcaggccacttaaaatgtagattaaaaatggataaattagaacttaagggtatgagttatgccatgtgcacaaacacttttgttctcaagaaagaagtttcagagacacaacatggtacgatcctaataaaagttgaatataagggggaagatgtgccatgcaaaataccattttccacagaagacgggcaagggaaagcacacaacgggcgtctaataaccgcaaatccagtggtaactaagaaagaggaaccggtaaacatagaagctgaaccacctttcggagaaagtaacatcgttataggtattggagacaatagtttaaaaataaactggtataagaaaggaagtagcattggtaaaatgtttgaggcgacagcacggggagctcgtcgaatggcaatcttgggggatacggcatgggatttcggaagcgtgggtggtgtattaaacagtcttggaaagatggtccatcagatatttgggagtgcttatacagcactattttcgggtgtttcatgggtgatgaaaattggaatcggagtgctcttaacttggattggactaaatagcaaaaatacatctatgtcatttagttgcatcgcaatcggtataataacattatatttaggagcagtcgtacaagctgatacaggctgcgtcataaattggaagggcaaggaactcaaatgtggttctggtatatttgtcacgaatgaggtacacacatggactgaacaatataagtttcaagctgactcaccaaagagattggctactgctattgcaggagcttgggaaaacggtgtatgtggcattcgatcaactacacgtatggagaatctattatggaaacaaattgcaaatgagctaaactacatactatgggaaaataacattaaacttacagttgtagtaggagatataattggcgtgcttgaacaaggcaaaagaactttaacgcctcaaccaatggagctaaaatactcatggaaaacatggggaaaagcaagaatagtaacggcagaaactcaaaatagtagctttataatcgatggaccaaacactccagaatgtcccaacacaagccgagcatggaatgtctgggaagtagaagattacggttttggcgtgttcacaacaaatatttggttaaaactaagggaagtatatacccaattgtgtgaccaccgattgatgagtgcagcagtgaaagacgagagggctgtacatgctgatatgggctattggatcgagtcccaaaagaatggcagttggaaattagaaaaagccagtttaattgaggttaagacctgtacttggccgaaatcccacacattatggagcaatggggtactcgaatcggacatgataattccaaagtcattggctggacctatctctcaacataactataggcctggttaccacacccaaactgcgggtccatggcatttgggtaagctcgaactggatttcaactattgcgagggaacaacagtcgttataaccgaaaactgtggaactagaggtccctccctacgaaccactacagttagcggaaaattgatccatgaatggtgttgtaggagctgtacattaccgccgttacggtacatgggcgaagacggatgttggtacgggatggaaatccgccccatatctgaaaaggaagaaaacatggtcaagagtttagtatctgctggatccggtgaagtcgataactttactatgggcgtattatgcctagccatactttttgaagaagttatgagaggaaaatttggaaagaaacatatgattgccggagtgttctttactttcgtcttactgttatccggacaaataacttggcgtgacatggcgcatactctaattatgatcggaagcaatgccacggaccgaatgggtatgggggtaacttaccttgctttaatagcaacatttaaaatccagcctttcctcgctttagggttctttttacgaaagctaacaagtagagaaaatctgctgctaggggtagggctcgcaatggcaaccaccttgcaactcccagaagatattgagcagatggcaaatggtatcgcattagggcttatggcactcaaattaattacccagtttgaaacgtaccaattatggacagccttaatatcactaacatgcagcaatactattttcacactgacggtagcgtggcgtactgcgacgttaatattggcaggagtgagtttactccccgtatgccagtcaagttcaatgagaaagacagactggctacccatgactgtagcggctatgggagtcccacccttacccttattcatattctcgctaaaggataccctaaaacgccgaagttggccgttaaacgagggagtaatggctgttggtttagtgagcatactcgcatcgtcgcttcttaggaatgacgttccaatggcgggaccacttgtagctggagggcttctgattgcatgttacgtaatcacaggcacttcagctgacctaacagtcgaaaaagctgctgatgtcacctgggaagaagaagctgaacagaccggagtctcccataatttaatgataacagtggatgacgacggaacgatgagaataaaggatgatgaaaccgagaatattctaactgttcttcttaaaactgccctcttaatcgtatccggaatttttccgtattcgatacccgctactttactcgtctggcatacgtggcagaaacaaacccaacgatccggagttctatgggacgtaccctcacccccggaaacgcaaaaggcagaattggaagagggagtgtatcggataaaacaacaaggtatttttgggaagactcaagtgggagttggcgtccagaaggaaggagtcttccacacaatgtggcacgtcacgagaggggctgttttaacttataatggaaaaagactagaaccgaattgggcaagcgttaagaaagatctcattagctacggaggcgggtggcggctctctgcgcagtggcaaaaaggagaagaagtgcaggtaatagccgtagaaccaggcaaaaaccccaaaaatttccaaacaatgcctggtacctttcaaacaacaaccggtgaaataggcgctatagcgttagatttcaagcctgggacttcaggaagcccaattataaatagagaaggaaaagtagttggactatatggaaacggggttgtcactaaaaatggaggatatgtcagtggaattgctcaaactaacgctgaaccggatggaccaactcctgaacttgaagaagaaatgtttaaaaagcggaacttaactataatggacttacatccaggttcaggcaaaacacgtaaatacttacctgcaatagtgcgagaggcgataaaacgaaggttaagaacattaattctcgctcctacaagggttgtggcagcagaaatggaagaggctttaaagggcctgcccataagataccaaactacagcgacaaaatccgaacatacaggaagagaaatagtagacttaatgtgccacgcaacctttactatgcgccttctaagcccagtaagagtcccgaattacaacttgattattatggatgaagcacattttacggatccagcttcaatcgctgcaaggggatacatttctacacgagtgggaatgggagaagcagcagccatatttatgaccgccacacctcctggcactgcagacgcgttcccacaatcaaatgccccaattcaagatgaggagagggatattccggaacgcagttggaacagtggtaatgaatggattactgatttcgctggcaaaacagtgtggttcgtaccgagtattaaagccggcaatgatattgcgaattgcctcaggaaaaacggaaagaaagtaatacagctttctagaaaaacatttgatacagaataccagaaaactaaattaaacgattgggattttgtagtaactaccgacatttccgagatgggtgcaaattttaaagcagaccgcgtgattgatcctcggcgatgcctaaaaccggtaatactaacggatggtcctgaacgagtgattctcgctggaccaatgccagtaacggcagcaagcgcagcgcagagacgtggacgtgttggccgaaatccgcaaaaagagaacgatcaatatatatttacgggacagccacttaacaacgatgaagatcacgcccactggaccgaagctaaaatgctgcttgataatataaatactccagaaggaattataccagccctatttgaacccgagagagaaaaatcagctgccatagacggtgaatatcgactcaaaggagaaagcagaaagaccttcgtagaattaatgagaagaggagacttaccggtatggctcgcacataaagtggcaagcgagggcatcaagtacacagatcggaaatggtgttttgatggacagagaaataaccaaatactcgaagaaaacatggatgtagaaatctggactaaagaaggtgagaagaagaaactaagacctcgatggttagacgcacgcacatattccgatcctctagctcttaaagagttcaaagattttgcggcagggagaaaaagcatagcattggatctagtgactgaaataggaagagtgccaacacacctcgcacataggacgcgaaatgccctcgacaacctcgtcatgctacatacgtcggaacatgggggtaaagcctataggcatgcagtggaagaactcccagaaacgatggagaccctgttattattaggactcatgattcttctaaccggaggagcaatgttatttttaattagcggaaaggggataggcaaaacaagtataggattgatctgtgtaattgcatcgagtgggatgctatggatggcagaaataccactgcaatggatagcctcagcaatcgtattagaatttttcatgatggtactactaatacctgaacccgagaagcagcgaactcctcaagataatcaattggcatatgtggtgatcggaatactgacattagctgctattatagcagcgaacgagatgggtcttctggagactacgaaacgtgatttagggatgtctaaagaaccgggggtcgtttctcctacaagctatcttgatgttgatttgcatcccgcttcagcgtggactttatatgcagttgccactactgtcataactcctatgttaagacataccatcgaaaattcaaccgcgaacgtatcactcgctgcaatagctaatcaggcggtcgtattgatgggactcgacaagggatggccaatttcaaaaatggatttaggggtaccacttctggctttaggatgctactcccaggtcaacccactaaccttaacagccgctgttctattattaattacccactatgcaattataggaccggggcttcaagcaaaagcaacacgagaggcacagaaaagaacagctgctgggataatgaagaatccaactgtcgatggaattatgacaatagacttagatccagtaatatatgactctaaatttgagaaacaattagggcaagttatgctcctggtgctatgcgcagttcaattgctactaatgcgaacgtcatgggcactatgtgaagctctcacattagcgacaggacccataacaaccctatgggagggatctcctggaaagttttggaacactacgatagctgtcagtatggcaaatatattccgagggtcttatctagctggggcaggtctcgctttctcaataatgaagtcagtgggaaccggaaaacgcggtacaggctcgcagggagagacacttggagaaaaatggaagaagaaattaaatcaattaagtcggaaagaatttgacctgtataagaaaagtggtataacggaagtggatagaacagaagcaaaagagggtttaaaaagaggagaaattacgcaccatgccgtaagtcgaggatcagcaaaactacagtggtttgtagagcgtaacatggttatcccagaaggcagggtaattgatttagggtgcggaagaggcgggtggagttattactgtgccgggctgaagaaagttactgaggtaagaggatataccaagggcggtcctggccatgaagaacctgtccctatgtcgacatatgggtggaacattgtaaaattaatgagtggtaaagatgtattctacttaccaccggagaagtgtgatacactactctgtgatataggagaaagcagcccatcaccgactgtggaagaaagtcgaacaataagagtccttaaaatggtagaaccgtggctcaaaaacaatcaattctgcataaaagttctgaatccttacatgccagctgtgattgaacatcttgaaagattacagcgaaagcatggagggatgcttgttagaaatccattaagcagaaattcaactcatgaaatgtattggatatcaaatgggacaggcaatatagtcgcatcggttaacatggtttcaagactattactcaaccgctttactatgacacaccgcagaccaactatagaaaaagatgttgacttaggggccgggactcgacatgttaatgcagaaccagaaacaccaaatatggatgtgataggtgaacgcataaaaagaataaaagaggaacacaactcaacttggcactacgatgacgagaacccatataaaacttgggcttatcatggatcttatgaagttaaagcaacgggctccgcaagtagcatgataaacggagtcgtgaaactgctgacaaagccgtgggatgtagtacctatggtcatccaaatggcaatgacagatacgacaccattcggccaacaacgtgtatttaaagagaaagtagacacaagaacaccaaggtcaatgcctggcacaagacgtgtcatggagataactgcagaatggctatggagaactttgggtcgaaataagaaacctaggctttgtacccgagaagagttcaccaagaaagtaaggacgaacgctgctatgggagcagtttttacagaagaaaatcaatgggatagtgctaaagcagcagttgaagatgaagatttctggaaacttgttgatagagaaagggaactccataaattgggtaaatgtggctcttgcgtttacaacatgatgggaaagcgagagaagaaactgggggaatttggaaaagctaaaggaagtagggcgatatggtacatgtggcttggagcccgatacctagagttcgaagcattaggcttcctaaacgaagaccattggttctcacgagaaaacagttattccggagtagagggggagggcctccacaaacttggatacatacttagggacataagtaagattccagggggtgcgatgtatgcagacgacacagcggggtgggatactagaattacagaagatgacctacataacgaagagaaaataactcaacaaatggatccagagcatagacagttagctaatgcgatttttaagctaacataccaaaataaagtagttaaggtacagaggccgacacctaccggaacggtgatggatatcatttcgcgaaaagaccaaagagggtctggacaagtcggtacatacggattgaatacatttacgaatatggaggcccagttgataagacagatggaaggtgaaggagtgttgagcaaagctgacttggagaaccctcacttgcccgagaagaaaataacacagtggttggagacaaaaggagtcgaaagacttaaacgaatggcgataagtggcgatgattgcgtagtcaaacccatagatgaccgtttcgccaatgcgttactcgcactaaatgatatgggtaaggtaagaaaggacattccacagtggcaaccatcaaaaggctggcacgattggcaacaggtcccattctgtagccatcatttccacgaacttattatgaaagacggcaggaagctagttgtgccgtgtagaccacaagatgaactcattggcagggctagaatcagtcagggtgccggctggtcgcttagagagacagcctgcttagggaaggcatacgctcaaatgtggtcgctgatgtatttccatcgtcgtgatctaaggctagcatcaaatgctatttgctcagctgtaccagtccattgggttcctacctcccgaacaacatggtcaattcacgcgcaccaccaatggatgaccactgaagacatgctaactgtctggaaccgggtatggatagaagacaatccgtggatggaggacaaaacaccggtcactacatgggaaaatgttccatacttgggcaaacgcgaagatcaatggtgcggatccttaattggtttaacgtcccgagcaacgtgggcccaaaacattccaacggcgatacaacaagtcaggagtttgataggtaacgaggagttcttggattatatgccatctatgaaaagattcagaaaagaagaagaaagcgaaggggcaatatggtga

SEQ ID NO: 23445 - RNA, 9873 nt, synthetic construct
  misc_feature 1..9873: note = derived and/or modified CDS sequence (opt6) from DENV-3__GQ868586__SS-prME
  source 1..9873: mol_type = other RNA
acatcgctatgcctaatgatgatattaccagcggctttggcatttcacctcacaagtcgggacggtgaaccacgtatgatagtgggcaaaaatgaacgaggtaaaagtctactgttcaaaacggcatccggaatcaatatgtgcacactgattgctatggatctaggggaaatgtgtgatgacaccgtaacatacaaatgtccacacattacagaagtagaaccagaagatatagactgttggtgcaaccttacatcaacatgggttacatatggcacctgtaatcaagctggagaacatcgacgcgacaaaagatcagtggcattagcaccccatgtaggaatgggtttagataccagaacacaaacatggatgagcgcagaaggagcatggagacaagtagaaaaagtagaaacgtgggctttacgtcatccaggattcaccatattagcattatttttagcccattatataggaacatcactaacccagaaagttgtaatatttatactattgatgcttgttaccccaagcatgacaatgaggtgtgtaggagtaggaaatcgtgatttcgtagaaggacttagcggagcaacttgggtagatgtggtattggaacacggtgggtgtgtaaccacaatggccaaaaacaaaccaacccttgacattgaattacagaaaacagaagccacacaactagctacattacgcaaactatgtattgaaggaaaaataacaaatataacaaccgattctcgttgccctacgcaaggggaagcagttctgccagaagaacaagaccaaaattatgtatgtaaacatacgtacgtcgaccgtggctgggggaatgggtgcggcctcttcggcaaaggtagtttagtaacttgcgcaaaattccaatgcctagaaccaattgaagggaaagtagtgcaatatgaaaacctaaaatatacagtaataatcaccgttcatactggagatcaacatcaggtaggaaatgaaacccagggtgtgaccgcagaaataacaccccaagcatccacaaccgaagcaatactacctgaatatgggacactaggcctggaatgcagtccaaggactggactagactttaatgaaatgatcctactaactatgaaaaacaaagcctggatggtccatagacaatggttctttgacctaccgctgccgtggacatcaggagctaccactgagacaccaacgtggaataggaaagaacttttagtaacattcaaaaacgcacacgccaagaaacaagaagtagtagtcctagggtcacaggaaggggccatgcatacagcgctaactggcgcaaccgaaatacaaaatagcgggggaacctcgatattcgccggacatctcaaatgtagattaaaaatggataaactcgaactaaaagggatgagttatgctatgtgtacaaacacgtttgttctcaagaaagaagtaagtgaaacacaacatggaaccatcctaataaaagtcgactacaaaggcgaagatgttccttgtaaaatacctttctcaaccgaagatggacaaggcaaagcacacaacggccgattaataaccgccaatcccgttgtaacgaagaaagaggaaccagtgaatatagaggcagagccaccctttggtgaaagcaatatagtcataggaataggtgacaacgcacttaaaataaattggtataagaaaggttcaagcataggaaaaatgtttgaagcaacagcacggggcgctcgtcgaatggcaatcctgggagacactgcatgggattttggatccgtaggtggcgtcctaaattcattaggcaagatggtccatcaaatatttggaagtgcatatacggccctattttcaggcgtgtcttgggtaatgaagattggaattggtgtacttttgacttggattggactaaacagcaaaaacacgagtatgtcatttagttgtattgctatagggattattactctttatttgggagctgtagtacaggctgatacgggttgcgtaataaactggaaaggaaaagaattaaaatgtggtagtggcattttcgtaacaaatgaagtccacacatggacagaacaatacaaattccaagcggactcaccaaaaagactagccacagcaattgctggagcctgggaaaatggagtatgcgggatacgctcaactacaaggatggaaaatttactttggaaacagattgctaacgaactaaactacatcttgtgggagaacaacataaaattaacagtggtagtaggtgatatcatcggagttttagaacaaggaaagaggaccttgacaccacaacccatggaactcaagtattcctggaaaacctgggggaaagcgaaaatcgtaacagcagaaacacaaaattcctcctttattatagatggcccaaacactccagaatgcccgtcagcctccagagcgtggaatgtgtgggaggtggaagactacggctttggcgtgtttactacaaatatctggttaaaactaagggaagtttacacacagcaatgtgatcatagattgatgagtgcggctgtaaaagatgaacgagcagtacatgcggacatgggatattggattgaatctcaaaagaatggtagctggaaacttgaaaaagcaagcctaatagaagtaaagacatgcacatggcctaagagtcacactctgtggtccaatggagtcctagagtccgacatgataattccgaaatctttggcaggtccaatatcacaacataactataggcctggttaccatacgcaaactgctggtccatggcatttaggtaaattggaacttgattttaattactgtgaaggcacaacagtcgtaataactgaaaactgcggaactcgtggcccgagtttacgcacaacaacagtgagtggaaagttgatacatgaatggtgctgcagatcctgtactttaccacccttacgatatatgggagaagacggctgctggtacggtatggaaataagaccgataagtgaaaaagaggaaaatatggtaaagagtttagttagtgcagggagcggcgaggtggataattttactatgggtgtgttatgtttagcaatactcttcgaggaagtgatgaggggtaaatttgggaagaagcatatgattgcaggagtattctttacgtttgttttgttgctatcaggtcagataacttggagagatatggcgcatacgttaataatgataggaagtaacgcatctgataggatgggaatgggagtaacttatttagccctcattgcaacgttcaaaatccagccattcctagcattaggcttctttttgcgtaaacttacttcacgagagaatctgctccttggcgtcggattagcaatggcaacaacgcttcaattacctgaagatatcgaacaaatggcaaatggaatagccctaggtctaatggcgctcaaactcattacacaattcgaaacctatcaattatggacagctttaatcagcttaacatgctcaaatacaatatttacgctaactgtagcctggcgcacggctaccctgatactggctggcgttagtctcttacctgtgtgtcaatcaagtagcatgaggaaaacggactggttgccaatgacggtagctgctatgggagtacccccgttacccttgtttatattttcactcaaagatacattgaaaagaagatcatggccgctaaatgaaggcgtaatggcggtaggcctagttagtatattagccagcagcttattgagaaatgacgtaccaatggctggtccattagttgctggcggtctgttaatagcatgttacgtaattactggcacttcggcggatctgaccgtggaaaaagcggcagatgtaacctgggaagaagaggcagaacagactggcgtttcccataatcttatgattaccgtagatgatgatggcactatgagaattaaagacgatgaaactgaaaatattttgacagtactattgaaaacagcgctgttaatagtctcggggatattcccttattcaatccccgccacgttacttgtgtggcatacctggcaaaaacaaacgcagcggagtggtgtactgtgggacgtaccgtccccacctgaaactcaaaaggccgaattagaggaaggagtctatagaatcaaacagcaaggtatatttgggaagactcaggtcggagtaggggtacagaaggaaggtgtattccacaccatgtggcacgtaactcggggagcagtactgacatacaacggaaaaagattggagccaaactgggcatcagtcaagaaagaccttatatcgtatggaggaggatggaggctatcggcccaatggcaaaagggagaggaagtacaggtaatagcggtagaaccaggtaaaaacccaaagaactttcaaactatgcctggaaccttccaaactacaactggagagataggagcaatagcactcgacttcaaaccgggaacaagtggaagcccgataattaaccgagaagggaaagtggtagggctatatggcaacggagtagtaaccaaaaatggaggctatgtatccggtatagcgcagacgaacgctgaaccagatggtcctacacctgaactagaagaggaaatgtttaagaaacgaaacctgaccattatggatctacaccctggttcgggtaaaacacgcaaatatcttccagctatagtaagggaagctataaaacgaaggttacgaacactaatattggcgcctactagggtggtggcggcagaaatggaagaggctttgaagggtttgccaattaggtatcaaaccacagcaacaaagagtgaacatacgggacgcgaaatagtagatttgatgtgccatgcaacgttcactatgagactactgagccctgtaagagtaccaaattataacttaattataatggacgaagcccactttacagatcctgcatctatagcggcacggggatatatttcaactagggtcggtatgggagaagcagctgcgatatttatgacggcaacaccgccgggaactgcagatgcttttccacagtccaatgccccaatacaagatgaagaacgcgatatacccgaacgaagttggaactctggaaacgaatggataacagattttgctggcaagacagtgtggttcgtcccatcaataaaagctggaaatgacatagcaaactgcctacgtaagaatggcaagaaagtgatacaattgagccgaaagaccttcgacacggagtatcagaaaacaaaattaaatgactgggatttcgtagtaactacagacatctcggaaatgggtgcaaacttcaaagctgatcgggtgatagaccctcgacgatgtcttaaacccgtgatacttaccgacggacccgagcgagtaatcctcgcaggaccaatgccagtcaccgccgcatccgctgcacagcgacgtggtcgagtaggcaggaatccccaaaaagaaaacgaccagtatatatttacaggtcaacccttgaataatgacgaagatcatgcacattggactgaggcaaaaatgctgctggataatataaatactcccgaaggtattatacccgctttatttgagccagagagagaaaaatctgcagccatagatggggagtaccggctgaaaggagaatcaaggaaaacttttgtcgaactaatgagaagaggagacctacctgtttggctagcacataaagttgcttcagaaggaataaagtacactgatagaaagtggtgttttgatggccagagaaataaccagattcttgaagaaaatatggacgtagaaatttggactaaagaaggagagaagaagaaactccgaccaagatggctagacgcaagaacctactctgatcctctagcgttaaaagagttcaaagattttgctgcgggaagaaagtctatagcccttgacttagtgactgagataggcagggttccctcgcatcttgcgcaccgaacgcgaaacgccttggacaacttagttatgttacatactagcgagcacggtggaaaggcttataggcatgccgttgaggaattaccagaaaccatggaaaccttattactattaggtttaatgatccttttgaccggaggagcaatgttattcctgatttctggaaaaggcatcggaaaaacaagcatagggcttatatgtgtcatagcgagtagcggtatgttatggatggcagaaatacctctccagtggattgccagtgcgatagttttagaatttttcatgatggtactattaataccagagccggaaaaacaacgtacaccccaagacaaccaacttgcttatgtcgtgataggcattcttactctagctgcaattatcgcagcaaatgaaatggggttattggaaacaaccaaaagagatcttggcatgagtaaagaacccggagtcgtatcaccaacaagttacttggatgttgatttacatcctgcttcagcatggactttgtacgccgttgctacaactgtgataactccaatgctacgccacacgatcgaaaacagcacagcaaacgtttcactagctgcgatagcaaaccaagcagtagttttaatgggattagataaaggatggcccatttctaaaatggatctgggtgtcccactcctcgccttaggctgctacagccaagtaaacccgttaacattaacggcagctgtattgttgttgataacgcactatgcgataataggcccgggattgcaagccaaagcaacgagagaggctcaaaaacgaaccgctgctggtataatgaaaaaccccactgttgatggaataatgacgatagaccttgatccagtaatctacgactcaaaatttgaaaaacaattaggacaagtcatgctactcgtgttatgcgctgtacaattgctcctcatgcgtacatcttgggccctttgtgaggctttaacactagccacaggccccatcacaacgctctgggagggatcaccaggaaaattttggaatactactattgccgtaagcatggcaaatatttttagaggatcctatctagcgggagccggacttgcttttagtattatgaaaagcgttggaactggaaagcgaggaacaggtagtcaaggagaaacactcggtgaaaaatggaagaagaaattgaaccaactttctagaaaagaatttgatttgtataagaaaagcggcattactgaagtagatcgtacagaagctaaagaggggctaaaaaggggcgaggtaactcatcacgcagtttcaagaggttcagcgaaattgcagtggttcgttgaacgtaacatggtcatacctgaaggtagagtaatagacttagggtgtggcaggggcggatggtcatactattgtgctggtttgaagaaagtaacggaagttagggggtatacaaaaggaggaccaggtcatgaagaacctgtaccaatgtcaacttatggatggaatattgtcaaattaatgagcggaaaagatgtattttatctacctccggaaaaatgtgacacgttgctgtgtgacatcggtgaaagttctccatcccccacagttgaggaaagtaggaccataagagtgttaaaaatggtggaaccctggcttaaaaacaatcaattctgcattaaagtacttaatccctatatgccaacagttattgaacaccttgaaagactacaaaggaaacacggcggaatgttggtgagaaatccattgagcagaaactcgacccacgaaatgtactggatctcaaatggaacggggaacatcgtggcttcagttaatatggtgtccagattactgctaaataggtttaccatgacgcacaggcgacccacaattgaaaaggatgtagacctaggggcgggcaccagacatgttaatgcggaaccggaaacaccaaatatggacgtcataggcgaaagaattaaaagaataaaggaggaacataattcaacgtggcattatgatgatgaaaacccctacaaaacgtgggcatatcatggatcatacgaagttaaagcaacaggcagtgcaagcagcatgatcaacggagtggtaaaacttttaacgaaaccttgggacgtcgttccaatggttactcaaatggcgatgacagatacaactccatttggtcaacaaagggtattcaaggagaaggttgacacgaggactccacgctcaatgcccggtacgagaagagtcatgggaataaccgctgaatggctatggcgtactcttggtaggaataaaaagcctcggctttgtacaagagaagagtttaccaagaaggtgcgcactaacgcagccatgggagccgtattcacagaggaaaatcaatgggattcagccaaagcagcagttgaggatgaggatttttggaagttagtagaacgtgaaagagaactacacaagttgggaaaatgtggatcctgcgtatataatatgatgggtaaaagagagaagaaacttggtgagttcgggaaagccaaaggatcacgggctatatggtatatgtggttaggcgcgagatatctcgagttcgaggcactaggatttcttaatgaggaccactggttttcaagagaaaactcttacagtggagtcgaaggagagggactccataaactaggttacatattgagggatatatcgaagatcccaggtggggctatgtatgcagatgacacggccggatgggatacaagaattacggaagatgatcttcacaatgaggagaaaataacccaacagatggacccggaacacaaacaacttgcaaatgcgatttttaaattaacttatcagaacaaagtagtaaaagtacaacgaccaacccctacaggaactgttatggatataatctcacgtaaagatcaaagaggttcaggacaagtaggcacttatggtctaaacaccttcacgaatatggaagcacaattaatacggcagatggaaggtgaaggagtattaagtaaagctgacttggaaaacccccatctgccagagaaaaagattacacaatggctggagactaagggcgtcgagaggctcaaaaggatggctatatcaggggacgactgcgtagtaaaacctatagacgacagatttgcaaacgcactccttgcattaaacgatatgggaaaagtgcgaaaagacattccacaatggcaaccaagcaaaggatggcatgattggcaacaagtacctttttgcagtcaccactttcatgaattaataatgaaagatggacgtaagttggtagtcccatgtagaccccaggacgagttaatcggcagggcaagaatttctcaaggagcaggatggtcattgagggagaccgcatgcctcgccaaggcttacgctcagatgtggagccttatgtattttcacagaagagatctacgtcttgcttctaatgcgatttgttcagctgtacctgttcattgggtgccaacttccagaacaacatggtcaatccatgcccatcatcaatggatgacaacggaagatatgcttactgtatggaaccgagtatggattgaagataatccatggatggaggataagacgcctgtcaccacatgggaaaatgttccttacttaggtaaacgagaagatcaatggtgcggatcactaataggacttacatctcgagccacatgggcacaaaatatacctacagctattcaacaagtacgatccttaataggaaacgaggaatttttggactacatgccaagcatgaaacgattcagaaaagaagaagaatcagagggagctatttggtaa

SEQ ID NO: 23446 - RNA, 9873 nt, synthetic construct
  misc_feature 1..9873: note = derived and/or modified CDS sequence (opt6) from DENV-3__FJ850110__SS-prME
  source 1..9873: mol_type = other RNA
acatcattatgcctgatgatgattcttccggcagcgttagcatttcatttgacctcaagggatggagaaccgagaatgattgttgggaaaaatgaacgcggcaaaagtctgcttttcaaaacagcatcaggaattaacatgtgtacgctaattgcaatggatttaggagaaatgtgtgatgacacggtaacatataaatgccctcatattacagaagtggaacctgaagatatcgattgctggtgcaatctaacatctacttgggtaacatatgggacctgtaatcaagcaggagaacatcgtcgagataaaaggtcagttgcattagcaccgcatgtaggaatgggtcttgacacaagaacccaaacatggatgagtgcggaaggtgcatggcgccaagtggaaaaagttgaaacctgggcccttcgacatcccggctttacaattttagctctgtttttggcacattatataggtacgagtctcactcaaaaagtcgtaatattcattttactgatgttagtaacaccgagcatgacaatgaggtgtgtgggggtaggtaatcgtgactttgtcgaagggttgagtggggccacatgggtagatgtcgttttggaacacggaggatgcgttaccacaatggcgaaaaacaaaccaactttagacatcgaattgcagaaaactgaagcaacgcaactcgcaactctaaggaaattatgtatcgaaggaaagattacaaatatcaccactgattcgagatgtcccacacaaggcgaagcagtattgccagaagaacaagatcagaattatgtttgcaaacacacgtacgtcgacagggggtgggggaatggctgcggcctttttggaaaaggatccttggtaacatgtgccaaatttcaatgtctagaacctattgaaggaaaagtcgttcaatatgaaaatttaaaatatacagtcatcataacagtacatacaggagatcaacatcaagtgggaaacgaaacacaaggcgtaaccgcggaaattactccccaagcatccaccacagaagcgatactgcccgaatacggaactttaggattagaatgctctccaaggactggtttagatttcaacgagatgatcctattgacgatgaaaaacaaggcatggatggtacacaggcaatggttctttgatctgcctttaccgtggacatcgggtgcaacaacagagacacctacatggaaccgcaaagagttattggtcaccttcaaaaacgcacacgccaagaaacaagaagtggttgtactaggaagtcaggaaggggcgatgcatacagcgttaacaggcgctaccgaaatccaaaattcgggaggcacgagcatattcgctggacatctaaaatgtagattgaagatggataagctcgagttaaaaggaatgagttacgcaatgtgcacaaacacctttgttttgaagaaagaagtatctgagacacaacatggaacaatactgataaaagtggaatacaaaggcgaagatgtaccttgtaaaatacctttcagtacagaagatggtcaaggtaaggcccataacggaaggttaattacagctaacccggtcgtcactaagaaggaagaaccagtaaatattgaagcagagccaccttttggggaatcgaacattgtcataggaataggtgataacgccttaaaaattaattggtacaagaaaggaagctcaattggtaaaatgtttgaagcaacggcaaggggcgcacgaaggatggccatccttggtgatactgcgtgggactttggttcagtaggtggagtattaaattccttaggaaaaatggtccatcaaatattcggaagtgcatacacagcactgttctcaggagtttcatgggtaatgaaaataggaataggggtcttattaacctggattgggctaaatagcaaaaatacatctatgtcctttagttgtattgcgattggaataatcacactttatttgggcgccgttgtacaagcagacacagggtgtgtaataaattggaagggaaaagagctaaaatgtggaagcggaattttcgtaacgaatgaagtacatacgtggactgagcaatacaaatttcaagctgactcaccgaaaaggttagcaacagcaattgcgggcgcgtgggagaatggagtatgcgggatacgttcgactacaagaatggagaacttactgtggaagcaaatagctaacgagctaaactacattttgtgggaaaacaacattaaattaactgttgtcgtcggtgatataatcggcgtactcgaacaaggaaaaaggacactcacacctcaacctatggaattaaaatattcatggaagacgtggggtaaagcaagaatagtaacagcagaaacacaaaacagttcctttataatagacgggcccaatacacctgaatgtcctaacacgagcagagcctggaatgtgtgggaggttgaagactatggctttggcgtatttacaactaatatatggctcaaattacgagaagtctatacgcaattatgcgatcatagactgatgagtgcggcggtaaaagatgaaagagcagtacatgcagatatgggctactggatagagtcgcagaaaaatggaagttggaaactggaaaaagcatccttgatagaagtaaagacatgcacttggcccaaatcacacacattgtggagtaatggtgtattggagtccgacatgataattccaaagtccctagcgggtccaataagtcaacataattatagacctggctatcacacacaaacggctggcccttggcatttgggtaaacttgaattagactttaactattgcgaaggaacgacagttgtgataacagaaaattgcggaactcgcggtccaagcctccggacgactacagtctcaggaaaattgatccatgagtggtgctgtaggagctgtactttacctcccctccgatacatgggagaagacggatgttggtatggtatggaaataagaccaataaacgagaaagaagaaaacatggtaaagtccttagtctccgcaggatcaggggaggtggacaactttacaatgggagttttatgtttggctatattgtttgaggaggtaatgcggggaaagttcggtaagaaacatatgattgcaggagtattcttcacatttgtgttactacttagtgggcaaatcacatggagagatatggcccacacactgatcatgataggctctaatgcgacagataggatgggaatgggagtaacgtatttagcgttaatagcaacctttaagatccaaccttttctagccctcggattcttcctacgaaagttaacatcccgcgaaaacctattattaggcgtagggcttgcaatggctactactcttcaactgccggaagatatagaacaaatggcaaacggcatagcgctaggtttaatggcattaaaattaattactcaatttgaaacatatcagctatggactgcattaattagtttaacatgctcaaatacaatatttacccttacagtagcttggcgtaccgcgacgttaatcttagctggagtttcactcttaccagtctgccaaagttctagcatgcgtaagactgattggttacctatgacagtcgcagcaatgggtgtccctccgctaccattattcatattttcactcaaggataccctgaaaagacgtagctggcctttaaacgaaggagtaatggctgttgggctagtaagcatattagcatcctcgttactacgtaatgacgttcctatggctggcccgttagtcgctggaggactgctaatagcttgctatgtaatcacggggacgtcagccgatttaaccgtagaaaaggcagccgatgtaacatgggaagaggaggcagagcagacaggtgtaagccacaatttaatgattacagtagatgacgatggtacaatgcgtataaaagacgatgaaactgaaaatatccttaccgttctattaaagaccgcgcttttaatagttagcggcatattcccgtatagtattccggcaacattgctggtctggcacacgtggcaaaaacaaacacagagatctggcgtgttatgggatgtaccaagtccaccagaaacacaaaaagcagaactcgaagagggagtgtatcgaataaaacaacaaggaatcttcggaaaaacacaagtcggagtcggtgtacaaaaagagggtgtattccacacaatgtggcatgtaacaagaggcgctgttctaacatataatggaaaaagattggagccaaactgggcttcggtgaaaaaggacctcataagctatggaggcggttggcgattaagtgctcagtggcagaaaggagaagaagtgcaggtaatagcagttgaaccgggaaagaacccaaagaactttcagacaatgccgggcactttccagacgaccacgggagagataggagcaatagcgttggactttaaacctgggacttcgggctcaccaatcataaacagagaaggaaaagtagtgggactatatggaaatggggtggttacaaagaacggaggatatgtatcaggcatcgctcaaacaaatgctgaacctgatggcccaactccagaattagaagaagaaatgttcaagaaaagaaatttaacaataatggatttacatccaggatccgggaaaactagaaaatatttacctgctattgtaagagaagctattaaaagacgacttcgaacgcttatattagcaccgacacgggttgtcgcagccgaaatggaagaggctttaaaaggtctcccaataagataccaaacgactgccacgaaatctgaacataccggtcgtgagattgttgatctcatgtgtcatgcaaccttcactatgagactcttgtcccccgttagagttcccaactataatttaataataatggatgaggctcatttcacggaccctgcgagtattgccgcacgtggatacatttcaactcgtgtcggaatgggggaggctgcagctatttttatgacggctaccccaccggggacagcagatgcgttcccacagtcgaatgcacctattcaagacgaagagagggatataccggaacgaagctggaactctggaaatgaatggataacagacttcgcgggaaaaactgtctggttcgtaccaagcataaaagccggtaacgacatagcaaattgtttaaggaagaatggaaagaaagtgatacagttgagtcgaaaaacatttgacacagagtatcagaaaaccaaattgaacgattgggacttcgtagtgaccactgatatttctgaaatgggcgccaatttcaaagcagacagagtcatagatcctagaagatgcctcaaaccggttattctgacggacggaccggaacgagtaatactcgccggacctatgcctgtaacggctgcgtctgcagcacaacggaggggaagagtcgggaggaacccgcaaaaagagaacgaccaatacatattcacgggtcaaccattaaacaacgacgaggaccatgcgcattggacagaggcaaaaatgctcttagataatatcaatacgccagaagggatcattccagccttatttgagcctgaaagagagaaaagtgcagctatcgacggagaatatcgtttaaaaggcgaatccagaaaaacctttgtggaactaatgagaagaggagacctacccgtctggcttgcacataaggtagcctcagaggggataaaatataccgacagaaagtggtgttttgatggacagagaaataatcaaatattagaggagaacatggacgtagaaatttggaccaaagaaggcgaaaagaagaaattacggccgaggtggttagatgccaggacatactccgaccctctagcattgaaagagttcaaagactttgcggctggccgcaaatctattgctctagatcttgttacagaaattggaagagttcctacccatctagcacacagaactagaaacgcactagataacctcgtaatgcttcatacgtctgaacatggtggtaaagcatacagacatgccgtagaagaattgccagagacaatggaaactctactgttattaggattaatgattctccttacagggggtgccatgttattcttaatctcaggaaaaggtatagggaagacttctatcggtctaatctgtgtaatagcatcttctggaatgttatggatggcggaaatcccactgcagtggattgcgtctgcgatagtacttgagtttttcatgatggttttattaattccagaacccgaaaagcagaggacaccccaagacaatcagttagcatatgtcgtaataggcatcctgactctagctgccattattgcggccaacgaaatgggtttgctcgagactactaagagagacctgggaatgtccaaggagccgggagtcgtaagccctacatcttacctcgacgttgaccttcacccagcaagcgcatggactttatacgcggtagctacaactgtaattaccccaatgttgaggcacacaatagaaaactccactgcaaatgtttcgttagccgctatcgcaaaccaagctgtcgtcctcatgggtctcgataaaggttggccaataagcaaaatggacttgggagtgcctttattggcattaggttgttacagtcaggttaatccattaacacttactgcagcagttttattactcatcactcattacgcaataataggaccaggattacaagctaaagcaacacgggaggctcagaaaaggacagcagcaggcataatgaaaaatccgacagtagatggaataatgacgatcgacctagaccccgtgatatacgatagtaaatttgaaaaacaactcggacaagtgatgttattagttttatgtgcggtacaactattattaatgagaacttcctgggcattgtgtgaagccttaacattagcaaccggtccaataacaactttatgggaaggatcaccagggaaattctggaataccacaattgcagtgagtatggcaaacatcttcagaggtagctaccttgccggagcaggcttagcatttagtataatgaaaagcgtagggacaggaaaacgaggaaccggaagtcaaggagaaacactaggtgaaaagtggaagaagaaactaaatcaactaagcaggaaagagttcgacttatataaaaagtcggggattacagaggtggataggactgaagctaaagaagggttaaaacgcggcgagatcacccatcacgcggtctcaagaggctctgcgaaattacaatggtttgttgaacgcaatatggtaataccagaaggaagagtgatagacctagggtgtggtagaggagggtggtcgtactattgtgccggcttaaagaaagtaactgaagtaagagggtatacaaaagggggtccaggtcatgaggagcctgtaccaatgtcaacctatgggtggaatatagttaaactaatgtcaggaaaggatgtattctatttacccccggaaaagtgcgatactttgctatgcgatattggggagtcatccccttcgcctaccgttgaagaatcaagaacaattagagtgttaaaaatggtagagccttggctgaaaaacaaccaattttgtataaaagtcctgaacccctacatgccagcagtaatagagcatctagaacgactccaaagaaaacacggtggaatgctagtccgaaatcctttatcgagaaactcaacacacgaaatgtattggatatccaatgggactggcaacattgtagcaagcgtgaacatggtaagtcgtttgttactaaatcgttttactatgactcatagacgacctacaattgaaaaagatgtagatttgggagcaggtacgaggcacgtaaacgcggaaccagaaactcccaacatggatgttataggggaacgaatcaaaaggatcaaagaggagcataatagtacctggcattatgatgatgaaaatccgtataagacttgggcatatcatggatcgtatgaagtaaaagccaccggttctgctagttctatgataaatggtgtagtaaagttattgacaaaaccatgggacgtagtaccgatggttacacagatggctatgacagacacaacaccattcggtcagcaaagagtattcaaggaaaaagtcgatactagaaccccaaggtcaatgcccgggactaggagggtaatggagataacagctgaatggctgtggcgcaccttaggaagaaacaagaaacctagactctgcactagagaagaatttacaaagaaagttagaactaatgccgcgatgggagctgtatttaccgaagaaaatcaatgggatagcgctaaagctgccgtggaggatgaagatttttggaagctagtagatagggaacgtgaactacataaactcggaaagtgtggatcatgcgtttataatatgatgggtaaacgagagaagaaactaggagaatttggaaaagcaaaaggatcgagagcaatatggtatatgtggctgggggctagatatctagagttcgaagcgcttggattcttgaacgaagatcactggttctccagggagaacagttatagcggtgtagagggtgaaggtctacacaagttaggctacattttacgggatatatcaaagattccaggaggagctatgtacgcagatgacaccgccggatgggacacccggattaccgaagacgatctacataatgaagagaaaattacgcagcaaatggacccggaacacagacaactggcaaatgcaatcttcaaattaacttatcaaaataaagtagtaaaagtccaaagaccgacgcctacgggcaccgttatggatataatatctcgtaaagaccagcgtggcagtggtcaagtaggaacgtatggtctgaatactttcaccaatatggaagcacaactgatacgacaaatggagggagaaggagtattgagtaaagctgatttggagaaccctcatttaccggagaagaaaataactcaatggttagaaactaaaggggtggaaaggttaaagcgtatggcaatatcaggtgatgactgtgtcgtaaaacctattgatgacaggtttgcgaatgcattattagcgttaaatgatatgggtaaagtcagaaaggatattccccagtggcaaccgtccaagggatggcatgactggcagcaagtacccttctgttcacatcattttcatgaattaataatgaaggacggaagaaaactcgtagtaccctgtagacctcaggatgaattaataggcagggcaagaatcagtcaaggagccggttggtctttacgcgagacagcatgccttggtaaagcgtacgcacaaatgtggtcattaatgtatttccaccggcgcgatctaaggttagccagcaacgcaatttgctcggcagtaccagtccactgggtaccaacgagtcgaacaacctggagtatacatgcacatcaccaatggatgaccacagaggatatgctcactgtttggaaccgcgtctggattgaggataatccttggatggaagacaaaacgcccgtaacaacatgggaaaacgtaccctaccttgggaagcgtgaagatcaatggtgcggttcattgattggcttaacaagccgggcaacttgggcacagaatatacccacagcaatacagcaagtcagaagtctgatcggtaatgaggagttcttagactacatgccctcaatgaaacgatttagaaaagaagaagagagtgagggtgcaatttggtga

SEQ ID NO: 23447 - RNA, 9873 nt, synthetic construct
  misc_feature 1..9873: note = derived and/or modified CDS sequence (opt6) from DENV-3__FJ850111__SS-prME
  source 1..9873: mol_type = other RNA
acttccttatgtctcatgatgatacttcctgcagcgttggcatttcatttgacatccagagatggagaacctagaatgatcgttggtaaaaatgaaagaggaaaatcattattatttaaaacggccagcggaataaatatgtgtactttgatagcaatggatctcggagaaatgtgtgatgacacagtaacctataaatgtcctcatatcacagaagtagaaccagaagatattgattgctggtgtaaccttacatcgacgtgggtcacttatgggacatgcaatcaagcaggcgaacatcgaagagataaaaggagtgtggccttggcaccgcacgttggaatgggattagacacacgtacccaaacatggatgtccgcagaaggagcgtggcgtcaagtagaaaaagtagaaacttgggcccttagacatcctggatttaccattttggcgttattccttgcacattacataggaacgagcttaacgcaaaaagtcgttatctttattctcttgatgttagttacgccgtcaatgactatgagatgcgtaggggtaggaaacagagacttcgtcgaagggctctccggagcgacatgggtagatgtagtgctcgaacatggagggtgcgtaacaacaatggcgaaaaacaaaccaacattagatattgagctccagaaaacggaagcaacccaattggcaacattacgaaaactatgcatcgagggtaaaataacaaatattactactgatagcagatgccccacccaaggagaagccgtcttacccgaagaacaagaccaaaactatgtatgtaaacacacttatgtagatagggggtgggggaatggatgcggtttgttcggcaagggatcattagtaacttgtgctaaattccaatgtttagaaccaatagaaggcaaagtagttcagtatgaaaatttaaaatacactgtgattataacggtgcatactggtgatcaacatcaggtaggaaacgaaacgcaaggagtaacagcagaaattacgccgcaagcaagtactaccgaagccatattaccggaatatggcactctaggcctcgaatgtagcccaagaactggcctcgacttcaatgaaatgatattactaaccatgaaaaacaaggcttggatggtacacagacagtggttctttgatttaccccttccctggacatccggagctactacagagacgcctacttggaaccgaaaagaactccttgtaacatttaagaacgctcatgcgaagaaacaagaggtcgtcgtcctcggatctcaggaaggagcaatgcatacggctttaacaggagctacagaaatacaaaactccggcggtacgtctatttttgcagggcatctcaaatgccggctaaaaatggataaattggaactaaaaggcatgtcatacgcaatgtgtacgaacacattcgttctcaagaaagaagttagcgaaacacagcacggaacaatcctaattaaagtagagtacaaaggggaagacgttccctgcaaaataccattctcaacagaagacggtcagggaaaagcacataacggaaggttgataacggcaaaccccgtagttactaagaaagaagaacctgttaatatagaagcggagccgccttttggtgaatccaacattgtaataggaattggagataacagcctcaaaatcaactggtacaagaaagggtcatcgatcggaaaaatgtttgaagccacagcacgaggagcaagaagaatggcaatactaggagacaccgcctgggacttcggttcagtcgggggagttcttaattctcttggtaaaatggtccaccagatattcgggtccgcatatactgctcttttctccggggtctcttgggtgatgaaaattggaataggtgttttattaacatggattggattaaacagtaaaaacacatccatgtccttttcatgcatagctataggaataataactctctatctgggagccgtcgtccaagctgatacaggttgcgttatcaattggaagggaaaagaattgaagtgcggttcgggaatcttcgttaccaatgaggttcacacttggactgagcagtacaaatttcaagcagactcacctaaacgccttgctaccgcaatagctggtgcatgggagaatggcgtatgtggaataagaagtactacgcgcatggagaatttactctggaaacagattgcaaacgaacttaattatatactgtgggagaataatatcaaactcactgttgtagtaggagacataataggagtattagagcaaggtaaaagaacactaacgccacagccgatggaactcaaatatagttggaaaacctggggaaaagcacgtatagttacggcagaaactcaaaattcatcttttataatagatggaccaaatactccagaatgtccaaatacatctagagcgtggaatgtatgggaagtagaagactacggttttggagttttcacaactaatatttggttaaaactgcgtgaggtgtatactcaattatgtgatcataggttaatgagtgcagcggtaaaagatgaaagagcagttcacgccgatatgggttattggatagaaagtcagaaaaatgggtcctggaagctagagaaagcaagtctaattgaagtaaaaacttgtacctggccaaagtcacatactctatggagtaacggcgtactagaatccgatatgataataccaaagagtttggcaggaccaatatctcaacataattatcgtccgggctatcacacacaaacagccggaccgtggcacctagggaagttggaactagattttaattactgtgaagggactaccgttgtaataacagaaaattgtggtacgagaggtccttcacttagaacgacaacagtttctggtaaattgatacatgaatggtgctgcagatcctgtactctccctccactaagatatatgggagaagatggctgttggtatggaatggaaatacgaccgatttccgaaaaagaagaaaatatggtaaaaagcctagtatcagccggtagtggtgaagttgataacttcaccatgggcgtgttatgccttgccatactatttgaggaagttatgcgaggcaaattcggtaagaaacatatgatagctggtgtatttttcacctttgttctattactgagtggacagattacttggagagatatggctcatacattgattatgatcggatccaatgccacagaccgtatgggaatgggtgtaacctatttagcgttaatagcaacgtttaaaatacagccatttttagcattaggcttctttctaaggaaactcacatcgagagaaaatttgctgttgggtgttggcttagcaatggcaaccaccctacaactacctgaagacatagagcagatggcaaatggaatcgcattgggacttatggccttaaagttaattacacaattcgaaacatatcagttatggaccgccctaattagcttgacctgtagtaacacgatattcacactaacagttgcctggcgaaccgccaccttaatacttgccggggtgtctcttttgccagtatgccagtcgtcttcaatgcgaaaaacagattggctcccaatgactgtcgccgctatgggcgtacctcctctaccattatttatattttcattaaaagacacattaaagagacgttcctggcccttgaacgaaggcgtgatggctgtcggcctcgtgtctatcctagcgtcaagtctcttaaggaacgacgttccgatggcgggtccactggtagccggcggcttactcatagcctgttacgtcataactggtacatcagctgatttaacggtagaaaaagctgcggatgtaacgtgggaggaggaggcggaacaaaccggagtgtcacacaacttgatgatcacagtagatgacgatggaacaatgagaataaaagacgatgaaacagaaaacattctaactgtgttactaaagaccgcactcctaattgtttcgggtatattcccctacagcattccggccacactcttggtttggcacacttggcaaaaacaaacccaacgatcgggagtcttgtgggacgtaccaagtcctccagaaactcagaaagcagagctagaagagggagtatacagaattaaacaacaaggaatattcggaaaaactcaagtaggtgtaggagtacaaaaagaaggtgtttttcacactatgtggcatgtaacaagaggagccgtgttaacatataacggtaaacgattagagcctaactgggcatctgtgaagaaagaccttatatcttatgggggtgggtggagactcagtgctcaatggcaaaaaggagaagaggtccaagtcatcgctgttgaaccaggaaagaacccgaaaaatttccaaaccatgcctggtacttttcagactactacaggggaaataggagctattgcgctagactttaaacccggaacgtcaggtagtcctattataaatagagaaggaaaagtcgtagggttatacggtaacggtgtcgtcactaaaaatgggggatatgtaagtggaattgcacagacaaatgcggaaccagacgggcccacgccagaattagaagaagagatgttcaaaaagcgtaatttgactataatggacttgcatcccggtagtggtaagacacgaaaataccttcccgcgatagtcagggaggcgatcaaacgaagactaagaacactcatattagctcccacaagagtagtagccgccgagatggaagaagcactcaagggtctgcctatacgttatcagacaaccgccacaaaatccgaacacacaggacgtgaaatagtagacttaatgtgtcatgcaacgttcacaatgagacttttatcaccggtccgtgtccctaattacaatttaatcatcatggatgaagctcattttactgacccagccagcatagcagcaagaggttacatctctaccagggttggtatgggagaagcagccgcaatttttatgactgcaactccacctggaaccgctgatgcattcccacaatctaatgcccccattcaagatgaagagagagacatccccgaacgatcgtggaactcgggtaatgaatggataacggactttgcgggaaagacagtttggtttgttccgtctataaaagcgggcaacgatatcgcaaactgtttaaggaaaaatggaaagaaagtaattcaactatcacgtaaaacgtttgatactgaataccagaaaacgaaactcaacgactgggacttcgtagttacaacagatatatccgaaatgggtgcgaattttaaagctgatcgtgtgattgatccacgacgttgtctaaaaccagtaatactcactgacgggccggaacgtgtaatattagcaggtccaatgccggtcacagcggcaagtgccgctcagagaaggggaagggtaggccgtaatccgcaaaaagaaaatgaccagtatatattcacagggcaacctttaaacaatgatgaggatcatgcccactggacagaggcaaaaatgctattggataatattaacacgcccgaaggcataatcccagcactgttcgaaccggaacgtgagaaaagtgcagctattgacggagaatataggctgaaaggagagtcacgcaaaacattcgtcgaactaatgcgtcgcggcgatctacccgtatggctcgcacataaggttgcttccgaaggaattaagtatacagatagaaagtggtgttttgacgggcaacggaataaccaaatacttgaagaaaatatggatgtagaaatatggacaaaagaaggtgagaagaagaaattgagacctagatggttggacgcacgcacatacagcgatccactggctcttaaagaatttaaagactttgcagcaggacgtaaatcgatcgcgttagatcttgtaactgaaataggccgagtacctacacatttagcacatcgcactagaaatgcacttgacaatttggtcatgctacatacgtctgaacatggagggaaggcgtaccggcacgcggttgaagaactgccagaaactatggaaacgttactcctattaggactcatgattttactaacaggtggagctatgctatttttaatatcaggaaaaggcattggtaaaacaagtatcggcttgatttgcgttatagcatcttcggggatgctatggatggcagagatcccccttcagtggatagcatcagctatagttctcgagttctttatgatggtcctattaataccagaaccagaaaaacaaagaacaccacaagataatcaactcgcttacgttgttattggtatattaaccttagctgcgattatcgccgctaatgaaatgggcctattagaaactactaagcgggatctggggatgtccaaagaaccaggggtagtaagcccaacttcttatctcgatgttgacttacatccagcgtcagcatggactttatacgccgtcgcgacaacagtaatcacacctatgcttaggcatacaatagaaaacagcacagccaacgtctctctagctgctattgctaaccaggctgtagtactaatgggcttggataaagggtggccaatctctaaaatggacttgggagtacccttgctagccctaggatgctacagccaggttaatcccttgacattgaccgccgcagtcttacttttgataactcactacgctatcataggaccagggcttcaagcaaaagcaacgcgtgaagcccagaaacgcacagccgcggggataatgaaaaatccgacagtagacggaatcatgactatagacctagatccagtaatatacgacagtaaatttgaaaaacaattggggcaagttatgttattagtgctctgtgccgtacagttattactaatgagaacatcttgggcactgtgtgaagcattaacactcgctactggacctataactactttgtgggaaggaagtccgggtaaattctggaatacaaccatagcagtctcaatggcgaatatttttcgcggatcatacttggcgggagcaggattggctttttctatcatgaaatcggtgggaaccggaaaacgagggacaggatctcagggagaaacactaggcgaaaagtggaagaagaaattaaaccaattaagtagaaaagaatttgacctgtataagaaatcaggcattactgaagttgacagaaccgaagctaaagagggtctgaaaagaggggaaatcacacaccatgccgtttctcgagggagtgctaaattgcaatggttcgtagagagaaatatggttataccagaaggaagggtcatcgacctcggatgtggacgtgggggatggtcatattattgcgctggtttaaagaaagtcaccgaggtgcgaggatatactaaaggaggacccgggcacgaagaaccagtacctatgtccacatacggctggaatatcgtaaaattaatgtcaggcaaagatgtattttacttacctccagaaaaatgcgatactcttttatgcgatataggtgaaagcagcccttctcccacagttgaagagtcacgaacaataagagtcttgaaaatggtagaaccatggctaaagaataatcagttctgtattaaagttctaaatccatacatgccagcagtcatagaacatctagaacgcttacaaagaaaacatggcggaatgctagtaagaaatcccttgtctcgaaactcaacgcacgaaatgtactggatttctaatggtactggaaatatagttgctagtgttaacatggtaagtaggctgctactcaaccgattcaccatgacgcaccgccgtcccactattgaaaaggacgtagacttaggggctggtactcgtcacgtaaatgcagagccagaaacgccgaacatggacgttataggtgaacggataaaacggataaaagaagaacataattctacttggcattacgacgacgaaaatccatataagacttgggcgtatcacggctcgtacgaagtaaaagcaaccggttcagccagctcaatgataaatggggtggtcaagctactaacaaaaccatgggatgtagtaccaatggttattcaaatggcaatgacggacacaacaccttttggacaacaacgtgtattcaaagagaaagtagacactagaaccccgaggagtatgcctggcacgcgcagggtcatggaaataaccgccgaatggttgtggcgtacactaggacgaaataagaaaccaaggctttgtacacgagaagaatttacaaagaaagtacgcacaaatgctgcaatgggggccgtattcaccgaagaaaaccaatgggacagcgcgaaagctgctgtggaagatgaagatttctggaaattagtcgatagagaaagagaactacataagctgggaaaatgtgggagctgtgtatacaatatgatgggcaagagagagaagaaactgggtgaatttggaaaagcaaaaggctctcgtgcgatttggtatatgtggttgggcgcaagatatttagagtttgaagccctaggatttcttaatgaggatcattggtttagcagggaaaatagttattcaggagtcgaaggagaaggactacataaattaggctatatacttcgtgacatcagtaaaataccaggtggagccatgtacgccgacgatacagcagggtgggatacaaggataacggaagatgatctacataatgaagagaaaataacgcaacaaatggaccccgaacatcgtcaacttgcgaatgcaatctttaaacttacctatcaaaataaagtagtgaaagtccaacgccccaccccgacaggaacagtcatggatataatctcaagaaaggatcaacgaggaagcggccaagttggcacatacgggttaaatacatttactaacatggaagcgcaattaataaggcagatggaaggagaaggagtgttatctaaggccgacctggagaatccccatttaccagaaaagaaaataacacaatggttagagacgaaaggggtcgaacgactgaagagaatggcaatctcaggagacgattgtgtagtgaaaccgatagacgatcggtttgccaacgctctactggccttaaatgacatgggaaaagtacgaaaagacataccacaatggcagccaagtaaagggtggcatgactggcaacaggtacctttttgctcacaccattttcatgagctaattatgaaggacggccgaaaattagttgttccatgtcggccacaagacgaattaattggacgagcacgcatatctcaaggagccggttggtcgctgcgagaaacagcctgtctaggaaaagcatatgctcagatgtggagcctcatgtactttcataggagggacttacgactagctagcaatgcgatttgttctgcggtgccagttcattgggttcctacaagtagaacaacatggtcaatacatgcacatcatcagtggatgacaaccgaagatatgctaacggtctggaacagggtatggatagaagacaatccatggatggaagacaaaacaccagtgacaacttgggaaaacgtgccatacctcggtaagagagaagatcaatggtgtggtagtttaataggccttaccagtcgagccacgtgggcacaaaatataccaacagcgattcaacaagtgagaagccttataggaaatgaggagttccttgattatatgccatcaatgaagagatttagaaaagaagaagaatcggaaggtgcgatctggtag

SEQ ID NO: 23448 - RNA, 9873 nt, synthetic construct
  misc_feature 1..9873: note = derived and/or modified CDS sequence (opt6) from DENV-3__KF955486__SS-prME
  source 1..9873: mol_type = other RNA
acttcactatgcttaatgatgatactaccagctgcactagcatttcacttaacttctcgcgacggagaacccagaatgatagtaggcaaaaatgaacgaggaaaatccttattattcaaaactgcgagcggaataaacatgtgtacacttatagcaatggatttaggcgagatgtgcgatgatacagtaacttacaaatgccctcatataaccgaagtagaaccagaagatatagactgttggtgcaatcttacaagtacatgggtaacctatggaacgtgcaatcaagcaggagaacatagaagggacaaacgaagtgtcgcattggcaccgcacgttggtatgggattagacactcgcactcaaacatggatgtcagctgaaggcgcatggaggcaagttgaaaaagtggaaacatgggctctgagacacccaggttttacaatcctggcactctttttagcgcactacattgggacatccctcactcaaaaagtggtaattttcacattgcttatgttagtcaccccatcaatgaccatgagatgcgtaggagtcggaaatagagacttcgtagaagggcttagcggggcgacatgggtagatgtcgtattagagcacggcggctgtgtaactacaatggccaaaaataaacccacgctggatatagagctccagaaaacggaagcaacgcagttagcaacattgcgcaaactgtgcatagaaggaaaaatcacgaacattaccacagatagtagatgtccgacacaaggcgaggctgtactacctgaggaacaagaccaaaactatgtgtgcaaacatacatatgtagatcgaggatgggggaatggatgcggtctattcggtaaaggctctctcgtaacatgcgctaaatttcaatgccttgaacctatagagggaaaagtagttcagtatgaaaacctcaaatatactgtaataatcacggtacacactggagatcagcatcaggtaggcaatgaaactcaaggagtcaccgcagaaataactcctcaggcaagtacgacggaagcgatattaccagaatacggaactttgggtttggaatgctccccaagaacaggactagatttcaatgagatgatccttttaaccatgaaaaataaggcttggatggtacaccggcaatggtttttcgatcttccgttgccttggacaagcggagcaaccacagaaacacctacatggaaccgaaaagaactcttagtaacctttaaaaatgcacacgccaagaaacaagaagtagtagtacttggaagccaagaaggagcaatgcatacggctttaacaggagctacggaaatacaaaattctggtgggacctcaatatttgctggtcacctgaaatgtagattaaaaatggacaaacttgaactaaaaggtatgtcttatgcaatgtgtacaaatacattcgtactaaagaaagaagtgtcagaaacacaacatggcactattttaataaaagtagagtacaaaggcgaggatgtcccctgcaaaattccgttcagcaccgaggatggacaaggaaaagcccataatggtcgtcttatcactgcaaacccagttgttacgaagaaagaggaaccagttaacattgaagcggaaccaccgtttggagagtcaaatatagtcatagggattggagataatgctttgaaaatcaattggtacaagaaaggttcgtcaataggtaaaatgtttgaggccacagctagaggagcgaggcgaatggccatcttaggggatactgcttgggacttcggtagtgtaggaggggttttaaattcacttgggaaaatggtacatcaaatcttcggatcggcatatactgccttatttagtggtgttagctgggttatgaaaataggaattggagtccttttgacgtggattggcttaaactcgaaaaatacaagcatgtcattctcctgcatagccatcgggattataacactatacttaggagctgtcgtacaagccgatatgggttgtgtgataaattggaaaggaaaagagctgaaatgtggtagtggaatttttgtaaccaacgaagtacatacatggacggagcaatacaaattccaagctgattcaccgaaacgtcttgcgacagccatcgcaggagcatgggagaacggtgtatgtgggataaggagtaccacacgaatggaaaatttgttgtggaaacaaattgcgaacgaattaaattatatactttgggagaataatataaaattaactgtagtagtgggagatattataggtgtactggagcaaggtaagagaacattaaccccacaaccaatggaattaaaatacagctggaaaacatggggaaaagcaaagatcgttactgcggaaactcaaaatagctcattcattatagacggtccaaatacgcctgaatgtccatctgcatctagagcatggaatgtatgggaagtcgaagactatggatttggtgtttttaccacgaacatttggcttaaattaagagaagtatatacacaattgtgtgatcataggttaatgagcgcagcggtaaaagacgaacgcgcagtccatgcagacatgggatattggattgaatcacagaaaaatggatcttggaagttagaaaaagcaagtttgattgaagtaaaaacgtgcacatggccaaaaagccacactttatggtcgaacggtgtactagagtcagatatgattatacccaaatctcttgctggcccgatatctcaacataattatagacccggatatcatacccaaaccgccggaccatggcacttagggaagttagaactagatttcaattattgcgaaggtacaacagtcgtcatcaccgaaaattgcggaacaaggggaccctcacttcgaacgactacagtttcgggaaaattaatacatgaatggtgttgtcgcagctgtaccttaccacccttacgctacatgggagaggatggatgttggtatggtatggagattaggccaataagcgaaaaagaagaaaacatggtaaaatccttagtgagcgcagggagtggagaggtggataattttacgatgggtgtactatgtctagcaatattatttgaagaagtaatgagaggtaaatttggcaagaaacacatgattgcaggagtattctttacttttgttcttttactatctggtcaaataacatggagagacatggcacacacactcataatgataggcagcaatgcaagtgacagaatgggaatgggagtcacgtatcttgcactgatagcaacttttaaaattcaaccgtttctagcattaggattctttttaagaaaacttacgagccgtgaaaatttattactaggtgtaggtttagccatggcaactacattacagcttccagaggatatagaacaaatggccaatggcattgcattgggactaatggcattgaaactaatcacacaattcgagacataccagttgtggaccgctcttatttcattaacgtgctctaatactatatttacgctcacagtggcctggagaactgcaacgctaattttagccggagtcagtttactcccggtctgtcaatccagttcgatgcggaagaccgattggttaccaatgacggttgcagcaatgggagtgccgcccttaccattattcattttcagcctaaaagacaccctcaagaggcgaagttggcctctaaatgaaggagtaatggcggtgggattagtctcgatcttagctagctcgcttttacgcaatgacgttccgatggcaggtccattagtggcgggaggattattaatcgcatgctacgtaattactggtacgagtgcggatcttaccgtcgaaaaggcagccgacgttacgtgggaggaagaagcggaacaaactggagtctcacacaatctaatgataacagttgacgatgatgggaccatgagaataaaagatgatgaaacagaaaatattttaacagttttacttaaaacggccctccttattgttagcggaatttttccatacagcatcccagcgacgttgctggtgtggcacacgtggcaaaagcagacgcaaagatcgggtgtactatgggatgtcccctcgccacccgaaactcaaaaagcagagctggaagaaggcgtatacagaataaaacagcaaggcatcttcggtaaaactcaagttggagttggcgtccaaaaagagggtgtattccacacaatgtggcatgtaacgagaggcgccgttctaacatacaatggtaaacgtctcgaaccgaactgggcatcagttaagaaagacttaatatcatacggtggaggctggagactttcggcacaatggcaaaaaggagaagaggttcaggtaatcgcggtagagccaggcaaaaaccccaaaaatttccaaacgatgcctggtacatttcaaactacgactggagaaataggagcaatagctttagactttaaaccaggtacatctggttctcccattattaatcgtgaagggaaggttgtaggattgtatggcaacggcgtggtaactaaaaatggagggtatgtcagtgggattgctcaaaccaatgctgagcctgacggtcctacccccgaactagaagaggaaatgttcaagaaaagaaacttaactataatggatttacatcctgggagtgggaagacacgaaaatatcttccagcaattgtgagagaggccataaagcgacgcttgcggactttaatattagcaccaacccgagttgtagctgctgaaatggaagaggctttaaaaggtcttcccattagataccaaacaacagctactaagtctgaacacactggaagggagattgtagatctgatgtgtcacgcaaccttcaccatgcgactactctcacctgttcgtgtaccgaactataatctaataataatggacgaagcacacttcaccgatcctgcgtctatcgcagcccgcggttatatctcgactcgagtaggaatgggtgaggcagcggccatatttatgacggccactcctcctggtactgccgatgcctttccccaatccaacgctccaatacaagatgaggagaaagatattcccgaaagatcatggaactccgggaatgaatggataacagattttgcaggtaaaaccgtttggttcgtaccatccattaaagcaggaaatgatatagcgaactgtcttcgaaagaatggaaagaaagtcatacagctcagccgtaaaacttttgatacagaatatcagaaaacgaaattaaacgactgggatttcgtagtgacaaccgatatatcagagatgggggcaaatttcaaagccgacagagtcatagatcccaggagatgtcttaaaccggtgatattaacagacggaccagaacgggtaatattagcagggcctatgcctgtgaccgccgcgagtgctgctcaaagaagaggtcgagttgggcgaaatcctcaaaaagaaaatgaccaatatatatttacagggcaaccactaaataatgacgaggaccacgctcactggacagaagctaagatgctattagacaatataaataccccggaaggtataattccagcgctattcgaaccagaaagagaaaaatcagcagccattgacggcgaatataggctaaaaggagagagtagaaagacattcgtcgaattaatgcgcaggggagatctacccgtttggttagcacataaagtagcatcggaaggaataaaatatacagatagaaaatggtgttttgatggccagagaaataatcaaattctagaagaaaatatggacgtagaaatttggactaaagaaggcgagaaaaagaaacttcgcccgagatggctagatgcacgaacctacagcgaccccctagcgcttaaagaatttaaagatttcgccgcgggaagaaagagtatcgctttagacttagtaacagaaataggtagggtaccaacacatcttgctcaccgaacacggaatgcgctggataacctcgtaatgctacacactagcgagcacggaggaaaggcttacagacacgcagtagaagaactcccagaaaccatggagacgctgctactactcggcctaatgattttactaaccggtggcgccatgctattcctgattagtggcaaaggaattgggaaaaccagtataggtctgatttgcgtaatagcatcctccggaatgctctggatggcagagattccattgcagtggattgcctccgctattgtgctcgaatttttcatgatggttctattgatccctgaacccgaaaaacagagaacaccgcaagataaccagcttgcgtacgtcgtaataggaattttaacattagcagccattatagcggctaacgaaatgggtctattggagaccacgaaacgtgatcttggaatgtccaaagaaccaggggttgtcagtcccacaagttacctagatgtagacctccatcctgcatcagcttggacactctatgcagtagcaacgacagtgatcacaccgatgctgcgacatacaatcgaaaattcaacggcaaacgtaagtctggcggctattgcaaatcaagccgtagtattgatgggactagataaaggttggcccatctccaaaatggatctgggagtgccgctccttgccctagggtgctatagtcaggtaaacccactgacactgacggcagctgtgctcctcttaataacacactacgctataataggtccgggattacaagctaaagcaacaagggaagcacaaaaacgtacggcggccggaattatgaaaaatcctacagtagatgggatcatgactatagatctggatccggtcatttacgactcaaagtttgaaaagcaattaggtcaagttatgctacttgttctatgcgcagtacaactactactaatgaggacatcatgggccttatgtgaagctctaacgctagcaacaggaccgattactacattgtgggagggaagtccaggcaagttttggaatacaacaatagctgtgagcatggctaatattttcaggggttcatatctagcaggggcgggactagcattttctattatgaaaagtgtaggaacgggtaaacgcggtacaggatcacagggagaaacactgggcgagaaatggaagaagaaactgaatcaactttcaaggaaagaatttgacttgtacaagaaaagtggaattacagaggtagataggacagaggctaaagaagggttaaaacgtggcgaaatcacacatcacgcggtctcacgaggttcagcaaaattacaatggtttgtagaaagaaatatggttattccggaaggaagagtgatcgatttgggatgtggacggggaggctggtcatattattgcgcaggtttgaagaaagtaaccgaagtaaggggatacacaaaaggtggacctggtcatgaagaacccgtaccaatgtccacttacggatggaatatagtgaaacttatgagtgggaaggacgtattttatttaccccctgagaaatgtgacacgttattatgtgatatcggagaaagtagtccgtcaccaactgtggaagaatctagaacaataagagtcctgaaaatggttgagccttggctcaaaaacaatcaattttgtattaaagttctaaatccttacatgcctaccgttatagaacacttagaaaggctacaaaggaagcatggaggtatgttagttcgcaaccctttaagcaggaatagtacccacgaaatgtattggatatcgaatggaactggaaacatcgtagcaagcgtaaacatggtgtcacgattgttattgaacaggtttactatgactcaccgaaggcctacaattgaaaaagacgtagacctaggggctggtacacgacatgtgaatgccgaaccagaaacaccaaacatggacgtaataggagagagaattaaaaggattaaggaggagcacaacagcacttggcattatgatgacgaaaatccctataagacatgggcgtaccacggttcttacgaagttaaagcaactggttctgcaagtagtatgataaatggagtagtcaaattacttactaaaccatgggatgtagtcccaatggttacacaaatggcaatgacagacactacaccattcggacaacaacgagtctttaaggaaaaagtggacacccgcacacccaggtctatgcctggtacaaggcgggtcatgggaataacagcggagtggttatggagaacacttggacgaaataagaaaccacgactatgcacaagggaagagtttaccaagaaagtacgaacgaatgctgcgatgggagcggtcttcactgaagaaaatcaatgggatagcgcaaaagctgccgtggaagatgaggacttctggaaacttgttgatagagagcgggagttacataagctgggcaaatgcggatcgtgtgtatataatatgatgggaaaaagagagaagaaattaggcgaatttggaaaggcaaaaggaagccgagctatatggtatatgtggctaggcgctagatatctggagttcgaagcacttggattcctaaacgaagaccattggttctcgagagaaaattcttattcaggagtagagggagaagggctacacaaattaggatacattctcagagacataagcaaaataccaggtggcgcgatgtacgcagatgacacagcggggtgggatacgcgaattactgaagatgaccttcacaacgaagagaaaattactcagcaaatggaccctgaacatcgtcaactagcgaatgcaatctttaagctgacgtaccagaacaaagtagtaaaagtacaacgccctacccctacggggactgtaatggatattatttccagaaaagatcaacggggttctggtcaagtaggcacctatggacttaacacatttacaaacatggaagcacaactaataaggcaaatggagggcgagggcgtattaagcaaagcggatcttgagaatcctcatcttccagaaaagaaaataacacaatggctcgaaactaaaggcgtagaacgcttaaaaaggatggccatatccggagacgactgcgtcgtaaaacctatagatgatagatttgcaaatgccctactagcactaaacgacatgggaaaagtaagaaaagatataccgcaatggcagccctctaagggatggcatgactggcaacaagtacccttttgttcacaccactttcatgaattgataatgaaagacggtcgaaagctagttgtaccatgtagacctcaggacgaattaattgggagagcgaggattagccaaggcgcaggatggagccttagggagacggcttgcctaggaaaagcatatgcacaaatgtggtctctgatgtattttcatcgccgagatttaagattagccagtaatgccatatgttccgcagtacctgtgcactgggttccaacgtccagaactacgtggagcattcacgcccatcaccaatggatgacgaccgaagatatgcttacggtgtggaacagagtatggatagaagataacccatggatggaagataaaaccccggtcaccacatgggagaacgtcccctacctcgggaagcgagaagatcaatggtgtggaagtttaataggactaacatcccgagcgacttgggctcaaaacatccccaccgccatccaacaggtgagatcattaatcggaaacgaagagttcttagattatatgccaagcatgaaaagatttagaaaagaagaagaatctgaaggtgccatatggtag

SEQ ID NO: 23449 - RNA, 9873 nt, synthetic construct
  misc_feature 1..9873: note = derived and/or modified CDS sequence (opt6) from DENV-3__FJ898468__SS-prME
  source 1..9873: mol_type = other RNA
accagtttatgtctcatgatgattttacctgctgcattggcatttcatttaaccagtcgggacggggaacctcgaatgattgtgggtaaaaatgaacgagggaaatcattattgttcaaaactgcaagcggaataaatatgtgtactttaatagctatggatttaggtgaaatgtgtgatgacactgtcacttacaaatgccctcatatcactgaagtagaaccagaagatatagattgttggtgtaatttaacaagtacttgggtaacgtacggaacatgtaatcaagccggtgaacatcgacgtgataaacgttcagttgctctagctccacatgtagggatgggattggatactcggacacaaacttggatgtcagcagaaggggcatggaggcaagtcgaaaaagtagagacgtgggcactgcgacatcccggctttaccatactagccttatttctagcacactatattgggacgagtctaacacaaaaagtagttatatttatcctattaatgctagttacaccctcgatgactatgcgatgtgtcggagtaggtaaccgagactttgtggaaggcctctctggtgcaacgtgggttgatgtggtactagaacatggtggatgcgtaacaactatggcgaaaaataaacctactctggatattgaattacagaaaaccgaggctacacaactcgcaacgttgcgaaaactttgtattgaaggaaaaattacaaacataacgacagatagcagatgccccacacaaggggaagcagtactaccagaagaacaagatcaaaactatgtctgtaaacatacatacgtagacaggggttggggcaacggctgtgggttatttggaaaaggtagtctagtaacatgtgcgaaattccaatgtctggaacctatagaaggaaaagttgtacaatatgagaacctaaaatacacagtaataattactgtacacacaggtgatcaacaccaagtaggaaacgagacccagggagtaactgctgaaataacgcctcaagcatcaacaacagaagccatattgcctgaatatggaaccctcggtttagaatgttcaccacgtactggacttgattttaatgaaatgatattattaactatgaaaaacaaagcgtggatggtgcatcggcaatggtttttcgatttgcccttaccttggaccagtggtgctacgacggaaactccgacatggaacagaaaagaattattagtaacttttaaaaacgcacatgccaagaaacaggaagtagtagttcttggatcccaggagggggctatgcataccgcattaactggagcgacagagatccagaatagcggaggaacatcaattttcgccggccatttgaaatgtagactgaaaatggacaaactagagctaaaaggtatgtcctatgcaatgtgtacaaataccttcgtcctaaagaaagaggtcagcgaaacacaacatgggacaatactcataaaagttgagtataaaggtgaagatgtaccatgcaaaattccattttcgacagaagatggacagggcaaagctcataacggaagattaattacagccaatcccgtagtcacaaagaaagaggagcctgttaatatagaagctgagccaccatttggagaatctaatatcgtgatcgggataggagataatgctcttaaaattaactggtataagaaaggtagtagtattggaaaaatgtttgaagcaacagcacgaggtgcaaggcgtatggcgatattaggggatacagcttgggacttcggtagcgtcggaggagtattaaactcacttggaaaaatggttcatcaaatatttggaagcgcttacactgcactattttctggagtgagctgggtcatgaaaattggaataggtgttttgcttacatggataggcctgaacagtaaaaatacaagtatgtcattcagctgcattgcaataggcataatcaccttatacttgggggcggttgtacaggcagatatgggttgcgtaataaactggaagggaaaagaactgaaatgcggttccggtatattcgtaactaatgaagtacatacatggacggaacaatataaattccaagctgattcaccaaaacgactagcgactgcaatagccggagcgtgggaaaatggggtttgtggcatacgatcgacaactagaatggagaatttgctatggaaacaaatagctaatgaactaaactacattctttgggagaataatatcaaactaacagtagtggttggtgatgtgattggagtacttgaacaaggaaaacgaacactaacaccgcaaccaatggagctaaaatattcctggaaaacctggggcaaagccaaaattgtgaccgctgaaactcagaacagttcattcattatagatggtcctaacaccccagaatgccctagtgctagcagagcatggaatgtgtgggaagtcgaagactatggttttggagtgtttactactaatatctggctaaaattacgcgaagtttatacgcagttgtgtgaccataggttaatgtccgctgcagtgaaagacgagagggcggtacacgcggacatgggctactggattgagtcgcagaagaatggaagttggaaactggaaaaggcttccctaatagaagtaaaaacgtgcacgtggcccaaatcacatacactatggtcgaatggcgtcctagagagtgacatgataataccaaagagcctagcaggacccatttctcagcacaactacagacctggatatcatactcagacagccgggccatggcatttagggaaacttgaattggattttaattattgtgagggtactaccgttgttattacggagaattgtggaacccgcgggccttctctacgaactacaacagtatcgggaaaattaatacatgaatggtgctgcagaagttgcaccttgcctccactaaggtatatgggagaagacggttgttggtatggtatggaaattcgaccgatctcggagaaagaagagaatatggttaaatcgcttgtctcagcagggtcaggggaagttgataattttactatgggtgtattatgcctagctattctgttcgaagaagtcatgagaggaaaatttggcaagaaacacatgattgcaggagtcttctttacatttgttttattgttatcaggacaaatcacctggcgagatatggcacatacattaataatgatcggtagcaatgctagtgacaggatgggcatgggggttacatacttagcccttatagcgactttcaaaatacaacctttcctagcactcggcttcttcctcaggaaattaacttcaagagaaaatctacttttgggagttggtttagccatggccactaccctccaactcccagaagatatagaacaaatggctaacgggatagcactaggactaatggcattaaaattgattacacaatttgaaacatatcaactatggactgcattaatatctttgacatgttctaacacgatctttacgttgacagttgcgtggcgaacggcaacacttatactagcaggagtatcgttattaccagtgtgtcagtctagcagcatgcgaaaaaccgattggctacctatgacagttgccgccatgggggtacctccattgccactctttatattttcactaaaggatacattgaaaagaaggagttggccactaaacgagggtgtgatggctgtaggcctagtgagtatcttggcttctagcctattaagaaacgatgtaccaatggctggcccattggtggctggaggacttttgatcgcatgctacgttataacagggacatccgcagacttgacagtagaaaaagcagccgacgttacttgggaagaagaggcagagcaaactggggtaagccacaatcttatgatcacagtcgatgatgacggaactatgagaataaaagatgatgagaccgaaaacattctaacagtcttactaaaaactgcattgctgattgtgtctggcatattcccctatagcataccagcgaccttattggtttggcacacctggcagaaacagacgcaaagaagcggggtattatgggacgtaccaagcccacccgagacgcaaaaagcagaactggaggagggagtatatagaattaaacagcaaggcatctttgggaaaacacaagttggtgtaggagtgcaaaaagaaggtgtattccacacaatgtggcacgtgacaagaggcgccgtacttacctacaacgggaagaggttagaaccgaattgggcaagtgtgaagaaagatctaataagttacgggggtgggtggagactttctgcacagtggcaaaaaggagaggaagtacaggtaattgcggttgagccaggtaagaatccaaagaactttcaaacaatgccaggtacatttcaaaccactacaggagaaataggtgcaattgcccttgattttaagccaggaacctctggatcgcccattatcaatcgagaagggaaagtcgtagggctctacggaaacggagtcgtaacgaaaaatggaggatatgtatccggaattgcgcaaacaaacgcagaacctgacggaccgacaccagaattagaagaagagatgtttaagaaaaggaacctaaccataatggacctacatcctggatctggaaaaactcgaaagtatctgccagccatcgtccgggaggcaattaaaaggagactaagaacgctaatccttgcgcctacccgagtagtagccgccgagatggaagaagcattaaaaggtcttccaatccggtaccaaacaacggctaccaaaagtgaacacactggaagagaaatcgtagatctcatgtgccatgcaacattcacgatgaggctattaagtccagtacgtgttccaaattataatttaataataatggatgaagcccattttacggaccccgcgtcgattgctgctagaggatatataagtaccagagtcgggatgggcgaggcagctgcgattttcatgacagctacaccacccggaactgctgatgcatttcctcaatctaatgcgcccatacaagatgaagaacgagatattccggaaaggtcctggaactcaggaaatgagtggattactgattttgctggtaaaacagtatggtttgtaccaagtatcaaagcgggaaatgacatagctaactgcttaagaaagaatggaaagaaggtgattcaactatcaaggaaaacttttgatacagaatatcagaaaacgaaattgaatgattgggatttcgtagtcacaactgacatatcagagatgggagcaaactttaaagctgatcgagtgatcgatcctagacgttgccttaagccagttatcctcacggacggaccggaacgcgtcatattggcaggccctatgcctgtaaccgcagcatctgcggcacaaaggagaggaagagttggccgaaatccacaaaaggaaaatgaccaatacatttttacaggtcagcccttaaacaacgacgaggaccacgcccactggactgaagctaaaatgttgcttgataacataaacacgcctgaaggcattatacctgcacttttcgagcctgagagagaaaagagtgcagcaattgacggtgaatacagactaaaaggagagagcagaaaaacatttgtagagttaatgcgcagaggcgacctgccagtatggctagcacataaagtcgcatcggaaggaataaagtacacagacaggaaatggtgcttcgatggccaacgaaataatcaaattttagaagaaaatatggatgtagaaatttggacaaaagaaggagagaagaagaaactaagacctagatggttagacgcacgtacctacagcgatcccttagcgttaaaagaatttaaagatttcgctgccggccggaaatcaatcgcactagatttggttacagaaatcggacgggtcccttcacacttagctcatagaacaagaaacgcactagataatctagtaatgttacatacatcagaacacggaggaaaagcctacagacacgcagtcgaagaacttccagagaccatggagacgctcctattattgggcctcatgattttacttactggaggtgccatgctattcctaatatcagggaaaggaatagggaaaacaagtatcggattaatatgcgtaatagccagttcagggatgctatggatggccgagatccccctacaatggattgcgtctgcaatagtactagagttctttatgatggttctactgattccagaaccagaaaaacaacgcacacctcaagacaatcagctagcatacgtcgtaattggtatcttaacacttgctgcaatcattgccgccaacgaaatgggccttttagaaactaccaagcgagatttaggtatgagcaaggaacccggtgtagtctctccaacttcatacctcgatgtagatttacatccagcaagtgcatggactctttatgcggtagcaacaacagtaataacacccatgttacgtcacacaatagaaaactcaactgccaacgtgtcacttgcggcgattgcaaatcaagctgttgtcttaatgggcctagataaaggttggccaattagtaagatggacttaggtgtgcccttactagctttaggttgttacagccaagtaaaccctttgacacttacggcagctgttttgctgctgataacccattatgctataatagggcccggattacaagcaaaggctacacgagaagcccagaaaagaaccgcggctggcatcatgaaaaacccgacagttgatggcataatgaccatagatttagatccagtcatatatgatagcaagtttgagaaacaactagggcaggtaatgctcctcgtcctgtgcgcagttcaactacttttaatgcggacgagctgggcattatgtgaggctttgacgttggccacgggaccgattactacactatgggaaggaagcccaggaaaattttggaacactaccatagctgttagtatggcgaatatatttcggggaagctatctagctggggcgggacttgcatttagtatcatgaaatcggttggaactggcaagcggggaaccgggtcacaaggtgaaacactaggcgaaaaatggaaaaagaagctaaatcaactttctagaaaagaatttgacctgtacaagaaatcaggcatcactgaagtcgatagaacagaagctaaagagggcttaaagcgtggggaaatcactcatcacgccgtgtcgaggggttcagccaaactacaatggtttgtggaacgtaacatggtaatccctgagggtagggtaatagatttgggatgtggccgaggtggatggagttattattgcgctggcctaaagaaagttaccgaagttaggggctacacaaaaggtggccccgggcatgaagaaccagtcccaatgtctacctacggatggaatattgtcaaactaatgtcaggaaaagatgtattctacttgccacctgaaaagtgtgatactttgttatgcgacattggggaatcctctccttccccaaccgttgaggagagtagaacaattcgtgtacttaaaatggtagagccatggttaaagaacaaccaattttgcataaaagtactgaacccatatatgccaacggtagtagagcatttagaaagattacagcgaaagcatggtggcatgttagtcagaaaccctctatcacgtaacagcacgcacgaaatgtactggatttccaatgggactggtaatattgtcgcaagtgttaacatggtcagtcgtctactgctaaatagattcactatgacacaccgtcgaccgactatcgaaaaagacgtcgatttaggtgcggggacaaggcatgttaatgcggaaccagaaacacccaacatggacgtgattggagaacgcattaaacgaataaaagaggaacataatagcacctggcattatgatgatgagaatccttataaaacttgggcttaccatggttcatacgaagtgaaagcaacaggatctgcaagttcaatgatcaatggagtagttaagttactaactaaaccctgggatgttgtacccatggtaacacaaatggccatgacagatacaactccatttggtcaacaaagggtattcaaggaaaaggtggacactcgtacaccgcgatccatgcctggaacgagacgggtcatgggcataactgccgaatggctctggcgaacactaggaagaaataagaaaccaagactgtgtacaagggaagagttcactaagaaagtaagaacgaacgcagcaatgggtgctgtatttactgaagaaaatcaatgggattcagctaaagcggcggttgaagacgaagacttttggaaacttgtagatcgagaaagagaactacataaactggggaaatgcggaagctgtgtatataatatgatggggaaaagggagaaaaagttaggggaatttggaaaagcgaaaggctcaagggcgatttggtatatgtggttgggtgctagatatctagaatttgaagcattagggtttctgaatgaggatcattggttttccagagagaatagttactcaggcgttgaaggcgaagggttacataagttaggatatatacttagggacatatctaagataccgggaggggccatgtacgccgatgatacggcaggctgggacacccgaattactgaagacgatttacataatgaggagaaaattacgcagcaaatggatccagaacaccgacagctagccaatgcgatatttaaactgacatatcaaaacaaagtagtcaaagtgcagcgtccaactcctacaggcacagtaatggacatcatatcaagaaaagaccaaagaggatcaggacaagtaggaacctatggattgaatacattcactaatatggaagcccaactcatacgtcaaatggagggggaaggagtgctatctaaagccgacttagaaaatccaagattgcccgagaagaaaatcacgcaatggctagagactaaaggagtcgagagactgaaaagaatggcaataagcggggatgattgtgtagtcaagcccatagatgaccgattcgcaaatgctttactagcattaaacgacatgggtaaagtgagaaaagacataccccagtggcaaccttctaaaggatggcatgattggcaacaagtacctttttgtagtcatcactttcatgagctcataatgaaggacggcagaaaacttgtcgttccgtgtagaccccaagatgaactaataggcagagcaagaatatctcaaggtgcaggatggagtctaagggagaccgcatgtctcggtaaagcatatgcgcaaatgtggagtttaatgtattttcataggagggatttaagattagcctcgaacgccatatgtagtgctgttccggtacactgggttccgacttcccgtacaacttggagcattcacgcgcatcatcaatggatgacaacggaagacatgcttaccgtatggaatagggtgtggatagaggacaatccatggatggaagataaaacccccgtcacgacctgggagaatgtcccttatctcggaaaacgagaagatcaatggtgtggcagtctaatagggttaacttctagagcaacttgggctcaaaatatccctacagcgatacaacaagtcagatcacttataggcaacgaagaatttttagattatatgcccagcatgaagcgttttagaaaagaagaagagtcagaaggggctatatggtaa

SEQ ID NO: 23450 - RNA, 9873 nt, synthetic construct
  misc_feature 1..9873: note = derived and/or modified CDS sequence (opt6) from DENV-3__FJ898469__SS-prME
  source 1..9873: mol_type = other RNA
acaagtttatgcttaatgatgatacttcctgcggcacttgcgtttcatcttacgtctcgagatggggaaccaaggatgatagtcggtaaaaatgaaagaggtaaaagtctgttatttaaaacagcatcaggtatcaacatgtgcacattaatagcaatggatttaggcgaaatgtgtgatgataccgtaacatataaatgtcctcatataacagaagttgaaccggaagatatagactgctggtgtaatctcacaagtacctgggttacatatggaacttgcaatcaagcgggagagcatcgaagagacaaaaggagtgttgccctcgcaccacatgtcggaatgggcctcgacaccaggacacaaacatggatgtcagctgaaggtgcatggagacaagtagaaaaagttgaaacgtgggcccttcgccacccgggttttacaatattagcactctttctagcgcactacattggtacatcactgacacaaaaagtagtgatcttcatattactgatgcttgtcacaccatcgatgacgatgcgatgtgttggggttggcaaccgtgatttcgtagagggactcagtggtgctacatgggttgacgtagttcttgagcatggaggttgtgttactacaatggcgaaaaacaaaccaacattggatatagaacttcagaaaactgaggcaactcaactagcaaccttgagaaaattgtgtattgaaggtaaaattaccaatataacaacagattctaggtgccccacccaaggagaagcagtactaccagaagaacaagatcaaaattacgtttgcaaacatacatatgtggaccggggctggggtaatggctgcggcctatttggtaaaggtagtttggtaacgtgcgccaaatttcaatgcttagaacctatagaaggaaaagtcgtccaatacgaaaatcttaaatacacagtaatcatcactgtacatacgggggatcaacaccaagttggtaatgaaacccaaggtgttacagctgagataacaccgcaagcaagtactacggaagctatactaccggaatacggtacacttggtttagaatgtagtccaagaacaggattagactttaatgaaatgatattattaaccatgaaaaataaggcttggatggtacatagacaatggttctttgatctaccactaccatggacttctggagcaaccactgaaacaccaacctggaataggaaagaattgcttgtcacctttaaaaacgcacatgccaagaaacaagaagtcgtcgtgcttggaagtcaagaaggagcaatgcatacggcattaacgggcgccactgaaattcaaaattctggaggaacttctatattcgccggccatcttaaatgccgcttaaaaatggacaaactcgaactaaaagggatgtcgtacgccatgtgtacgaacacattcgtactaaagaaagaggtatcagaaactcagcacggaacaattctaataaaagtagaatataaaggagaagatgtgccttgcaaaattcccttctcaacagaagacggtcaaggaaaagcccataacgggcgattaattacagcgaacccggtagttactaagaaagaagaaccagtaaatatcgaagcggaaccacccttcggcgagagcaacattgtaattgggataggcgataatgcattgaaaataaactggtataagaaaggaagtagcattggcaaaatgtttgaagcaaccgcacgtggtgcacggcggatggcaattctaggtgataccgcctgggattttggatccgtagggggtgttctcaattcactaggtaaaatggtacaccaaatttttggaagtgcatacacagcactattttctggagtgagctgggtgatgaaaattggaataggggttctcctcacatggataggactaaattcgaaaaatacatcaatgagcttcagttgtattgctataggaataataacattatacttaggagcggtagtacaagctgatatggggtgtgttataaattggaaagggaaagaattaaaatgcggaagtggcatttttgtaacaaacgaggttcacacatggacagaacaatacaaattccaagcagatagcccaaaacgtttagccacggccatagccggtgcatgggaaaacggagtctgcggaattaggagtacgacccgaatggaaaacctattatggaaacaaatagcaaacgaattaaattatatcctctgggagaataacataaaactaacagttgtcgtaggtgacataattggtgttttagaacaagggaaacgaaccttaaccccacaacccatggaattaaaatactcatggaaaacatggggcaaagcaaagatcgttacagcggaaacacaaaatagctctttcatcatagatggcccaaacacacctgaatgcccgagtgcgtcgagggcctggaacgtatgggaagtcgaagattatgggtttggtgtctttactacaaacatatggctcaaactgagggaggtatatacacaattgtgcgaccatcgtttaatgtccgcggccgtaaaagacgaaagagcagttcatgcagacatgggctattggatagaatcacagaaaaatggttcatggaaattggagaaagccagtttaattgaggtaaaaacatgcacatggccgaaatcacatacattatggagtaacggagtgttggagagtgatatgataattccaaaatcactagcaggtccaatttcccagcataattaccggccaggttaccacacgcaaaccgcaggaccatggcatctaggcaaattagaacttgactttaattattgtgaaggaaccacggtagtaataacagaaaattgtggcactagaggtccttctcttcgaaccactaccgtaagcggaaaattaattcatgagtggtgttgccgctcatgcacactacctcccttgcggtatatgggtgaagatggttgttggtatgggatggagattaggccaatatctgaaaaagaagagaacatggtcaagtcattggtatctgcgggaagtggcgaagtagacaattttacaatgggagtactctgtttagctattttattcgaagaagtaatgagggggaaatttggcaaaaagcatatgatagcgggagtgttctttacatttgttctactattatccggacaaataacatggagagacatggcacacactttaataatgattggttcgaacgcatctgatcgtatgggtatgggagttacataccttgcattgatagcaacattcaagattcagccatttctagcgctaggtttctttttaaggaaactaacatcacgagagaatttattactaggcgttggactcgcgatggccacaactctacaacttcctgaagacattgaacaaatggcgaatggaatagcattgggtcttatggctttaaaattgatcacccaatttgaaacttatcagttatggacagcgctaatctccctcacgtgttcaaatactattttcactcttacagttgcctggagaacagccacattaatattagcaggcgtaagtctgctacctgtgtgtcaaagctcatctatgcggaagaccgattggctaccgatgacagtcgcagcgatgggagttccaccactacccctcttcatattctctttaaaggacactttgaagcgcagatcatggcctctaaacgagggagtaatggctgtagggctagtatctatcttagcatcctcgcttttgcggaatgatgtgcctatggcaggccctttggtggccggtggtctactgattgcttgctacgtgattaccggaacaagcgcagatttaacagtagagaaggcagcagatgtcacatgggaagaggaggccgaacaaacaggagtcagccacaatttaatgattaccgtcgatgatgatggaacaatgcgaataaaagatgacgagacagaaaacattctgacggtcttattgaaaactgcacttctcatagtaagcggaatatttccctactcaataccagctaccttactggtttggcatacttggcagaaacaaacacaaaggagtggagtactttgggacgtcccttctccaccagagactcaaaaggctgagttggaggaaggagtataccgaattaaacaacagggaatatttggtaaaacacaagtaggcgtaggagttcaaaaggagggtgttttccacaccatgtggcatgtcactcgtggagctgtattaacatacaatggtaaaagactcgaaccaaattgggcttccgtgaagaaagacctaatcagctatggaggagggtggcgtttatcagcgcaatggcaaaaaggtgaagaagtacaagtcattgcagtcgaaccgggaaagaatcccaaaaattttcaaacaatgcctggaacattccaaacaactacgggggaaatcggagcaatcgcacttgatttcaagccaggaaccagcggtagtccaattataaaccgagagggaaaagtcgtaggtctttacggtaatggggttgtcactaaaaacgggggttatgtaagcgggatagctcaaactaacgcggaacccgacggaccgactccggaattggaggaagagatgttcaaaaagagaaacctaactataatggacctacaccctggaagtggaaaaacaagaaaatatctgcctgcaatagtcagggaagctatcaaacgcagattacgaacactaatcttagcacccactcgagtggtagccgctgaaatggaggaagccttgaaagggttacctatcagatatcaaacaactgcgacaaaaagcgaacacaccggaagagagattgtggacctaatgtgtcacgcaactttcacgatgagactgctgagcccggtaagagttcctaactataacctcatcattatggacgaagctcacttcacggacccggcatcaattgcagctcgcgggtatataagtaccagggtcggtatgggcgaagcagccgctatttttatgacagcaactcctccgggtacagcagatgctttccctcaatctaatgcacctatacaagacgaagagagagacattccggagagatcgtggaactccgggaacgaatggataacagacttcgcgggcaagactgtatggtttgttcctagtattaaagcagggaatgatatagcaaattgtttaaggaaaaacggtaagaaagttatacaattgtccagaaaaacatttgataccgaatatcagaaaacaaaactaaatgactgggattttgtagtcacgacggacattagcgaaatgggagctaatttcaaagcagatagagtgatagatcctagacggtgcctaaaaccagtaatattaaccgatggacccgagcgagtaatactggcaggaccaatgcctgtaacagcagcaagtgcggctcagagaagaggcagggttggtaggaatcctcagaaggaaaatgatcaatacatatttaccggccaaccgttaaacaatgatgaagatcatgcacattggacagaagctaaaatgcttctggataatataaatacaccagagggtattataccggctctcttcgagccggagagagaaaagagcgcagccatagacggagagtacagactaaaaggcgagtccagaaagacattcgtagaattgatgagaagaggagacctaccagtctggctagcacacaaagtagcgtcagaaggaataaaatacaccgaccgaaaatggtgttttgatggccagcgtaacaaccaaatattagaagaaaacatggatgtggaaatatggacaaaggagggtgagaagaagaaactccgaccgagatggttggatgctcggacgtattccgatccactggcgttaaaagaatttaaagatttcgcagcgggtagaaaatcaatagctctcgatttagtgacagaaatcggacgtgtgccaactcacctcgcacatcgaacacgaaatgcactcgataacctagttatgcttcacacctcagaacacggaggaaaagcatatcgccacgccgtggaagagttacctgaaacaatggagactctactgctgttaggactaatgatactcctgacaggtggagcaatgttatttcttatatcaggaaaaggtataggtaaaacatcaataggtttaatatgtgtaatagcatcaagtgggatgctatggatggccgagattccacttcagtggatagcttccgccatcgttttggaatttttcatgatggttctattaataccggaaccggaaaaacaaagaacaccccaagacaatcaactcgcgtacgtagtaattgggatactaacgctagcagctatcattgctgcaaacgagatgggtctgctagaaacaactaaacgagatcttgggatgtcaaaagaaccaggagtcgtaagtcctactagctacctagacgtcgatttgcatcctgccagtgcctggacactgtacgcagtggcaacgactgtcataacccctatgctccgacacaccattgaaaattcgactgctaacgtaagtttggccgctatagctaatcaagcagtagtacttatgggattggataaaggatggcccatctctaaaatggacctaggagtcccactgcttgcacttggctgctacagtcaagttaacccactaactttaacagcagcagtattattattgatcactcattatgcaattataggtccaggtttacaggctaaagcgacaagggaagcgcaaaaacgcacagctgctggaattatgaaaaacccaacagtagatggaatcatgacaattgacttagatccagtaatttacgacagtaaatttgaaaaacaattggggcaggtaatgttattagtgttgtgcgcggtacaattattactgatgcgaacaagttgggcactttgtgaagccctcactctagcgacagggccgatcacgacgctctgggagggcagtcccggtaaattctggaatactaccatagccgtgtcaatggcgaatatattcagagggagttatttagcaggcgcaggattggcatttagtataatgaaatccgtcgggactggtaaaaggggaacagggttacaaggcgagacactgggagaaaagtggaagaagaaacttaatcaacttagtagaaaagaatttgacctctataagaaatctggtataacagaggtagacagaacagaagcaaaagaggggcttaaaagaggggaaataacacaccatgctgtaagtagaggtagtgcaaagttgcaatggtttgtggagcgaaatatggttatcccagaaggtcgcgtcatagatttgggttgtgggagagggggctggtcatattattgcgctggacttaagaaagtgacagaggtgagagggtacactaaaggaggacccgggcatgaggaacccgtgcctatgtcgacctatggatggaacatagttaaacttatgtcagggaaagacgtattctacttacctccggagaaatgcgacaccctcctctgtgatataggtgagagtagtccttctccaactgtggaagaaagccggacaataagggtattgaaaatggtagaaccatggcttaaaaacaatcaattttgtatcaaagttctaaatccttatatgcctacggtaattgaacatcttgagaggttacagagaaagcatggagggatgctagtaagaaatcccttgagtagaaattcaacacacgaaatgtactggatctctaatggaaccggtaacatagtagcgtctgtaaatatggtatcgcggttattattaaatcgctttacaatgacacacagaagacctacaatcgaaaaagacgttgacttaggcgcggggacgcggcatgtaaatgcagaacccgaaacacccaacatggatgtcataggtgaaagaataaaaagaataaaagaagaacacaattctacatggcactacgatgatgaaaacccgtacaagacatgggcataccacgggagctacgaagtaaaggccacaggttccgcgagcagcatgataaacggagtagtcaaacttctcacaaagccctgggatgtagttcctatggtgacacaaatggcgatgactgatacaacaccgtttggacaacaaagagtttttaaggaaaaagtagatacgagaaccccaaggtcgatgccaggaacacggagagttatgggcatcactgcagaatggctgtggcgcacattagggcgcaataagaaaccgaggttatgcacaagagaagagtttaccaagaaagtcaggaccaatgcggcgatgggcgccgttttcactgaagaaaatcaatgggattcagcaaaagcagccgtggaggatgaagatttttggaagttagtggatcgtgaaagagaactgcacaaactaggaaagtgtggttcatgcgtatacaacatgatgggtaaaagagagaagaaacttggcgaatttgggaaagcaaaggggtccagagcgatttggtacatgtggctcggcgcaaggtatttagagttcgaagccttgggatttttgaacgaagaccattggttttcaagagagaacagctactctggggtagaaggtgaagggctgcacaaactaggctatatactacgtgatattagcaaaatccccggaggggctatgtacgcagatgacactgccgggtgggataccagaattactgaagatgatctgcataatgaggagaaaataactcagcaaatggacccagaacaccggcaacttgctaacgctatattcaaactaacgtaccagaacaaagttgtaaaggtacaaagacccactccaacggggacggttatggacatcataagcagaaaagaccagagaggatcaggtcaagttggaacgtacgggctaaatacattcactaacatggaagctcaattaatcaggcaaatggagggagaaggggtgctatcgaaggcagacttggaaaacccacacctacccgaaaagaaaataactcagtggcttgagacgaagggagtagaaagacttaaacgaatggcgatttccggggacgactgtgttgtgaagccaattgatgacagatttgcaaacgctcttttagcccttaacgatatgggtaaagtacgtaaagacatcccacaatggcagccaagtaaaggctggcacgattggcaacaagttccgttctgctcacaccattttcatgaacttattatgaaggatgggaggaagttagttgtcccgtgtagaccgcaagacgaactgatcggacgcgctcgaattagtcaaggagccggatggtcattacgggaaactgcgtgtctcggaaaagcgtacgcccaaatgtggtctctaatgtatttccacaggagagatttaaggcttgctagcaatgctatctgtagtgccgtacccgttcattgggtaccgacttctcgaacaacgtggagtatacatgcacatcatcaatggatgacaacagaagatatgttaacggtatggaatcgtgtttggatcgaggataatccgtggatggaagacaagacaccagtaacaacttgggaaaacgtcccatatcttggcaaaagggaagatcaatggtgtggttctcttataggattgaccagtcgcgcgacatgggcacaaaatataccaacggctatacaacaagtacgaagtcttataggaaatgaagaatttcttgattatatgccttctatgaaaagatttaggaaagaagaggaaagcgagggagctatatggtaa

SEQ ID NO: 23451 - RNA, 9873 nt, synthetic construct
  misc_feature 1..9873: note = derived and/or modified CDS sequence (opt6) from DENV-3__FJ898470__SS-prME
  source 1..9873: mol_type = other RNA
acgagtctgtgtttgatgatgatattacctgcagcactcgcttttcatttgacttctagagatggtgaaccacgaatgatagtaggcaaaaatgaacgcgggaaatctttgttatttaaaactgcatcaggaataaacatgtgcacactaatagcaatggatctaggagaaatgtgtgacgatacagtaacatataaatgtccgcatatcacagaagttgaacccgaagacattgattgttggtgcaaccttacgtctacttgggttacgtacggtacatgtaaccaagcaggagaacaccgcagagacaaaagaagcgtagccctagctccacatgtcggtatgggactcgacacacgaacacaaacctggatgtcagctgagggtgcatggagacaagtggaaaaagttgaaacatgggccctgcgacacccaggtttcacaatactggctcttttcctggcacactatataggcacttctttaacacaaaaagtagtaattttcattttactaatgttagtaacgccatcaatgaccatgcgctgcgttggcgttggaaatcgagattttgtagagggcctaagcggtgcgacatgggttgatgtagtactagaacatgggggatgcgtaacaactatggctaaaaataaacctacattagacatcgaactacagaaaactgaggctactcaattagcaacgcttagaaaactgtgtatcgagggcaaaataacaaatatcacaacagattcaagatgtccaacgcaaggtgaggctgtcttaccagaagaacaagaccaaaattatgtctgcaaacatacctatgtagatcgggggtggggtaacggttgtggactattcgggaaaggatcattggtaacctgtgcaaaattccaatgcttagagcccatagaggggaaagtagtacaatatgaaaacttaaaatacacagttattattaccgtacatacgggggatcaacatcaagtcggtaatgaaacgcaaggcgtgacagctgagataacgccacaagcatcaacaacggaggcaatattacctgaatacggtacattaggattagaatgcagtcctaggaccggacttgattttaatgagatgatattattaacaatgaaaaataaagcatggatggtacataggcaatggttctttgatctacctttaccttggacatctggagctacaaccgaaacaccaacttggaaccgcaaagaattgttggttacattcaaaaacgcacatgccaagaaacaagaagtagtagtactcgggagtcaggaaggagcgatgcacacagccttgaccggagctacagaaatacaaaattctggcggtactagcatcttcgccggccatttgaaatgtcgccttaaaatggacaaactggagttaaaaggtatgagttatgccatgtgtacaaatacatttgttcttaagaaagaagtgtcagaaacacaacacggaaccattctgatcaaagtagagtacaaaggagaagacgtaccatgtaaaataccattcagtacggaagatggacaggggaaggcacacaatggaagattaataactgcaaacccagtcgttactaagaaagaagaaccagtaaacatcgaagccgaaccaccgttcggagagagtaatatcgtaattggaataggagacaatgcactaaaaatcaattggtacaagaagggaagttcgataggaaaaatgtttgaggcaaccgcaagaggggctcgcagaatggcaatactgggagatacagcgtgggactttgggagtgtcgggggagttttaaactcgctgggtaaaatggtacatcaaatcttcggatccgcctatacggcactattttctggagtgtcctgggtgatgaaaattggaataggtgttcttctgacatggataggtctaaatagcaaaaatacaagtatgagtttttcttgtatcgcaattggaataataacattgtacctaggagccgtagtacaagctgacatgggatgcgtaattaattggaaaggaaaagaactgaaatgcggctcaggaatttttgtcacaaatgaagtacatacctggactgaacaatacaaattccaagctgacagccccaagaggctagcaacagcaattgcaggcgcttgggaaaatggtgtgtgcggtattagatccactactcggatggaaaatttattatggaagcaaattgcaaatgaacttaactatatactatgggagaataacataaagctaaccgtagtagtcggggatattattggcgtcttagaacaaggaaaacgaaccctaaccccgcagccgatggaattgaaatactcatggaagacatggggcaaagcgaaaatagtaacggcagaaacacagaactcatcttttataatagatgggccaaatacacctgaatgcccgtctgcatcacgtgcatggaatgtgtgggaagttgaagactacggatttggtgtattcacaacaaatatatggctaaagttgagagaagtgtatactcagctttgcgatcatagactgatgagcgccgcagtaaaggacgaacgggcagtacacgctgacatgggttactggatagaatctcagaagaacgggagttggaaattagagaaagcaagtttaatagaggttaaaacttgcacgtggcctaaatcgcacacactctggagtaatggagtactcgaaagcgacatgattataccaaaatcattagcggggccaataagtcaacataattacaggccagggtaccacactcagacagccggcccttggcacctaggaaagttagaattagacttcaattactgcgagggaactacagtcgtcataaccgaaaactgtgggacacgaggaccaagtttacgcacgactaccgtcagcggcaaacttatacatgaatggtgttgtcgctcgtgcacactgccgcctctaagatatatgggcgaagacggatgttggtatggtatggaaatacgacccattagtgaaaaggaggaaaatatggtcaaatccttggttagtgccggatcgggtgaagtcgataattttacgatgggtgtactctgtctcgcaatactttttgaggaagtaatgagaggtaaattcggcaagaaacatatgatagcaggagtatttttcacatttgttttgttgctttcgggtcaaataacctggagagacatggcacacacactaatcatgattgggagtaatgcgagtgatcgcatgggaatgggagtgacatatttagctctaattgcaacattcaaaatccaacccttcctagccttaggattctttttacgaaaacttacatcacgggaaaatcttttgttaggcgtaggtcttgcaatggccactacacttcagttaccagaggacatcgaacaaatggccaacggaatcgcactcgggctaatggctcttaaattgataacacaattcgaaacataccaattgtggacggcattaattagtctgacctgctctaacacaatatttacactaacggtagcgtggcgaacggcgacactaattttggcaggcgttagtctactaccagtttgccaatcgtcctccatgcgtaaaacagattggcttcccatgacggtggccgcgatgggagtacctccattaccgctatttatcttctcattgaaagataccctaaaacgaaggagttggcctctcaacgagggagtgatggctgttggactggttagcatcctggcctcatcccttttgaggaatgatgtaccaatggccggaccacttgttgctggtggattgctcatagcgtgctatgttatcactggaacaagtgcagatcttacagtagaaaaagctgctgatgtcacatgggaagaggaagcagaacagacaggagtatcacataatttaatgataaccgtggacgacgatggaactatgagaataaaagatgacgagactgaaaacatattgacagtcttattaaaaacagcactactgatagtctctggcatattcccctactctatacctgcaactttattagtatggcatacatggcaaaaacaaacgcagcgaagcggtgttctctgggacgtcccatcacccccagaaactcagaaggctgaactggaagaaggagtatacagaataaaacaacaaggtatatttggaaaaacccaagttggggtgggcgtgcaaaaagaaggagtattccacactatgtggcacgtaactagaggcgcggtcttaacatataatggtaaacggctagagccgaactgggcaagtgttaaaaaggaccttatttcatacggtggcggctggaggctctcagcacaatggcaaaaaggagaggaagtacaagttatcgcggttgaaccaggcaaaaatcccaaaaactttcaaaccatgcctggaaccttccaaacgacaactggagaaataggggcaatcgctctagattttaaaccgggcacatccggcagtcccattataaatcgagagggaaaagtggtggggttatacggtaacggagtagtaacgaaaaacggaggttatgtatcaggaatagctcagacgaatgctgaacctgatggacctacaccagaactagaagaggagatgtttaagaaaagaaatcttacaataatggatctacatccaggaagcggcaaaactagaaaatatctaccggccatcgtaagagaagctatcaaaagacggttaagaacattgattctagctccaacgagagtagtagcggcagaaatggaagaagcattgaaaggacttcctattaggtatcaaactacagccacaaaatccgaacacacaggccgtgaaattgtggatcttatgtgccacgccacttttaccatgagattgctatcacctgtgagagtccccaattacaatttaatcataatggacgaagcacacttcaccgatccagcaagtattgccgcaagaggatacattagcacaagggtaggaatgggcgaggcagctgccatcttcatgacagctacgccaccaggtacagcagatgcttttccccaaagtaatgcacccattcaagatgaagaaagagatatacccgaaagaagttggaactcaggaaatgaatggatcacagactttgccgggaagactgtttggtttgtcccttcaatcaaggctgggaatgacatagcgaactgcctcaggaaaaatgggaagaaagtcatacaattgagccgaaagacatttgatactgaataccagaaaacgaaattaaatgattgggactttgtagttacaaccgacataagtgaaatgggagcaaactttaaagcagatagagtcattgacccaagacgttgtctaaaaccagtgatactaacagacggtccggaaagggtaatcctcgcagggccaatgcccgtaactgctgcatccgccgcccaaagaagaggcagagtcgggagaaaccctcaaaaggaaaacgatcagtatatatttacaggtcaaccgttaaataacgacgaagatcacgcacattggacggaggcgaaaatgcttttagacaatattaatactccggaaggcataataccggcactattcgaaccagaaagagaaaaatcagcggctatagacggagagtataggctcaaaggcgagagccgaaagacatttgtcgagttaatgcgtcgtggggatctaccagtatggttggcccataaagttgcttcagagggcattaagtatacggataggaaatggtgcttcgatggccaaaggaataaccaaatattagaagaaaacatggacgtagaaatatggacgaaagaaggagagaaaaagaaattgaggcctagatggctagacgccaggacgtatagtgaccctcttgccctaaaagagtttaaggattttgccgctggtaggaaatcaattgcacttgatcttgtaaccgagatcggacgggttcctactcacctcgcacaccgaacacgcaatgctctcgacaatctagttatgctacatacgtccgaacacgggggaaaagcatacaggcatgcagtagaagagttaccagagacgatggaaacacttttactgttaggtcttatgatactcttaacgggcggggcaatgttatttttaatatctggaaaaggtataggaaaaacaagtataggtttaatatgtgttatcgcatcatccggtatgctatggatggccgaaatacccttacagtggatcgcatcagctattgtcttagagttctttatgatggtattactaataccagaacccgagaaacaacgaacacctcaagacaaccaattagcgtacgtggtcattgggatcctaaccttagcagcaataatagcagcaaacgaaatgggccttctggagacgaccaaaagagacttaggtatgtcaaaagaacccggagtagtctcacctacaagttatctggatgtagatttgcatcctgcctcagcatggacattatatgccgttgcaaccacagtgattacgccgatgctgcgtcacactattgaaaactctacagcaaacgtatcgcttgctgcaatagcaaaccaagcagtagtcctcatgggtttggataaaggatggcccattagcaaaatggatttgggcgtcccacttctagccttaggatgctattcccaggtaaatccattaactcttacggccgctgtacttttattgatcacacattatgcgataattggacctggtttacaagccaaggcaacacgagaggctcagaaaagaaccgcggccggaataatgaaaaatcctacagttgatggtataatgactatcgatttagacccagtaatatatgactcaaaatttgaaaagcagctaggccaggtaatgctccttgtattatgtgcggttcaactcttattaatgcgtacttcatgggcattgtgtgaggccctgaccctagcaacgggacctataacgacattgtgggaaggaagccccggcaagttttggaatacgaccatagcagtatctatggcaaacatatttaggggtagttatctcgcaggagcgggtcttgcgttttcgatcatgaagagtgttggaacaggaaaaagaggtactggatcgcaaggagaaaccttgggcgaaaagtggaagaagaaactaaatcaactttcgcgaaaagaatttgatctgtataagaaatctgggataacggaggtggacagaacagaagcaaaagaagggctcaaaaggggcgaaataacccatcatgcagtctcgaggggaagcgcaaaattgcagtggttcgtagagaggaatatggttataccggaaggaagagtaattgatttgggttgcgggcgaggtggttggtcctattactgcgctggtctgaagaaagtcactgaagtacgaggttacacgaaaggtgggccgggacacgaggaacccgtccccatgtcaacgtatggatggaacatagttaaactcatgtctggaaaggatgtattttacctcccgccggaaaaatgcgacacattattatgcgatattggtgagagctccccatcacccacagttgaagagtcaagaactatcagggttctaaaaatggttgaaccttggttgaaaaacaatcaattctgtataaaagtgctaaatccatacatgccaaccgtgatcgagcacttagaaagactacagagaaagcacggaggaatgttggtaagaaatccattatccagaaacagtacacacgagatgtattggatttcaaatggaacaggaaacattgtagcatcagtcaatatggtatctcggctattgctgaatcgattcacaatgacacatcgacgaccgaccatagaaaaagacgtagacttgggagcaggcactcgacacgtaaatgctgagccagaaacacccaatatggacgtaataggtgagcgcataaaacgaataaaggaggaacataattccacgtggcattatgatgatgaaaacccctacaaaacatgggcttaccacggttcttacgaagtaaaggccacagggtctgcaagttctatgataaacggcgtggtaaaacttttgacaaaaccctgggacgtagtgcctatggtaacacaaatggccatgactgatacaacaccttttgggcaacaaagagtattcaaagaaaaggtagatactcgcacgcccaggtcaatgcccggtacaagacgtgttatgggtataacagcagaatggctctggaggacccttggtcgaaacaaaaagcccagactgtgtacccgagaggagtttactaagaaagttagaacaaatgccgcgatgggagcagtatttaccgaggaaaaccagtgggacagcgcaaaagcagcggttgaagacgaagatttctggaaacttgttgacagggagcgagaactacacaaattaggaaaatgtggttcttgtgtttacaacatgatgggtaagagggaaaagaaactaggcgaatttggtaaagcgaaaggatcgagagcaatatggtacatgtggctaggagctcgatatttggaatttgaagctctaggttttcttaatgaggaccattggttctccagagaaaattcatatagtggtgttgaaggagaaggcctacataaactaggatacattctaagagatattagtaaaatccctggaggagcgatgtacgctgatgatactgcaggctgggacaccagaattaccgaagacgatctacataatgaagaaaagatcacgcaacagatggatcctgagcatcgacaattagctaatgcaatctttaaattaacttatcaaaacaaagttgtgaaagtgcaaagaccaacacccgctggaaccgtaatggacattatttctcgcaaagatcaacgcggaagtggacaagtgggaacttatggactaaacacgtttacgaacatggaagcccagcttatacgccaaatggaaggagagggagtcttatcgaaagcagatctagaaaacccgcacctacctgagaagaaaataacacaatggctagaaactaaaggcgtagaacgattaaaacgaatggctataagtggagatgactgtgtcgtaaaaccaatcgatgatagattcgcgaatgcattgttggctctaaacgacatgggcaaagtccggaaagacataccccaatggcagccatctaaggggtggcatgactggcaacaagtacccttctgctctcaccactttcatgaattaataatgaaggatggtcgaaaacttgtagtcccgtgtagaccccaagatgaactcattggaagggcacgaatatcacaaggagcaggatggtcattacgtgaaacggcttgcctagggaaggcttatgcccagatgtggtctctcatgtattttcacagaagagaccttaggttagcctcaaatgcaatctgcagtgcggttccagttcattgggtaccaacgagccgtacaacgtggtctatccacgcccaccatcaatggatgactactgaagatatgttaactgtatggaacagggtatggatagaggacaacccctggatggaagacaaaactcccgtcacgacatgggaaaatgttccttatttaggaaaaagagaagaccagtggtgtgggtctctgataggactgacctccagggcaacctgggcccaaaatataccaactgcaattcaacaggtaagaagtttgatcggcaatgaggaatttctcgactatatgccatctatgaaaaggtttcgaaaagaagaggaaagtgaaggagctatatggtaa

SEQ ID NO: 23452 - RNA, 9873 nt, synthetic construct
  misc_feature 1..9873: note = derived and/or modified CDS sequence (opt6) from DENV-3__FJ898471__SS-prME
  source 1..9873: mol_type = other RNA
acctctttatgtttaatgatgatccttcctgcagcacttgctttccacttaacgtcaagagatggtgaacctagaatgatagtaggtaaaaatgaaagaggaaaaagtcttctttttaaaacggcatctggaataaatatgtgcactctaatagcaatggatcttggcgaaatgtgtgatgacacagtaacgtacaaatgtccgcatattacagaagttgaacctgaagatattgactgctggtgtaatctaacatctacttgggttacatacggcacgtgtaatcaagcaggggaacacagacgagacaaacgatcagtcgcactggcgccacacgttggtatgggactagatacaagaactcaaacatggatgtcagctgaaggggcatggagacaggtagagaaagtagaaacttgggcgttaaggcaccctggttttacaatattagcactttttctagcgcactacatcgggacaagtctaatacaaaaagtggtaatattcatactattaatgctcgttactccatcgatgactatgagatgcgtcggtgtaggaaatcgtgatttcgttgaaggtttgtcaggagcaacatgggtagatgttgtattggaacacgggggttgtgtaacaacaatggctaaaaataaaccaactttggacatagagttgcagaaaacagaagcaacccaacttgcaacattacggaaattatgtatagagggaaaaattacgaacataacgacggactctcgatgcccgacccaaggagaagcggtactcccagaagaacaagatcagaattacgtatgcaaacacacatacgtagatcgaggatggggtaatggttgtgggctctttggaaaagggtccttagttacgtgcgcaaaatttcagtgcctcgaaccaatagaaggaaaagtcgtccaatatgagaatcttaaatatactgtgattattacagtacataccggcgaccagcatcaagttggaaacgaaacacaaggtgttactgcagagataacgcctcaagcgtccacgacggaggcaattctgcctgaatacggtaccttagggctagaatgcagcccaagaacgggcttagactttaacgagatgattctattaacgatgaaaaacaaggcttggatggtacatagacaatggttcttcgacctacctttaccttggacgtcaggagctaccactgaaacaccgacgtggaacagaaaagagctgcttgtaacgttcaaaaacgctcatgctaagaaacaagaagtggtcgtgctcggtagtcaagagggagcaatgcacacagctttaacaggggcaacagaaattcaaaatagtggaggcacaagcatctttgctggtcatttgaaatgtagactaaaaatggataaattagagcttaaagggatgtcttacgcgatgtgcactaatacgtttgtccttaagaaagaagtatcagaaacacagcatggtaccatattaataaaagtagaatataagggagaggatgtaccctgtaaaataccgtttagcacagaagatggtcaagggaaggcgcacaatggcagactaattactgcaaaccccgtcgttactaagaaagaggaaccggtgaatattgaagctgaaccaccatttggggaatcgaacattgttataggaatcggtgacaatgcattaaaaatcaattggtataagaaaggtagctcaataggaaaaatgttcgaagcaactgcccgaggagcgcgccgcatggccatactcggcgacacagcctgggatttcggatcagtagggggagtactaaattcattgggtaagatggtgcaccaaatcttcggatcggcatatacagcacttttctcaggagtaagttgggtgatgaaaattggaataggagtactgttgacttggataggattgaacagcaaaaatactagcatgtcattcagttgtatagttataggcatcataaccctatatctaggcgccgtagtacaagccgacatgggatgcgtcattaattggaaaggaaaggaactaaaatgcggaagcggtatatttgtcacaaatgaggttcatacatggaccgaacaatataaatttcaagcagattcccctaaacgtctcgcaacggcgatagctggagcttgggaaaatggagtatgcggtattcgttccaccacacgcatggaaaacttactatggaagcaaatagcgaacgagcttaattacatactttgggaaaataacattaagttgaccgttgttgttggtgacattattggagtacttgaacaaggtaagcgaaccttaaccccacaaccaatggaattaaaatactcatggaaaacctggggtaaagcgaagatagtaacagcagaaactcagaactcatcattcataatcgatggaccaaatacccctgaatgtcccagcgcctcacgtgcgtggaacgtttgggaggtcgaagactacggttttggcgtcttcacgactaatatatggctgaaattaagagaagtctatactcaattatgtgatcatagacttatgtcagcagccgtaaaagatgagcgagccgttcacgccgatatgggttattggatagaatcacaaaagaatggatcttggaagctcgagaaagcctcacttattgaggttaaaacttgcacttggcctaagtcacatacattgtggtcaaatggagtacttgaatccgatatgatcatccctaaatcactcgctggcccaatttcacaacacaattaccgcccaggctatcatacccaaacagccggtccgtggcatcttggcaagctggagttagatttcaactattgcgaaggaactacagttgtaatcacggaaaattgtggcacaagaggtccctctctccgtacaactacagtctcaggtaagttaattcacgaatggtgttgcaggtcctgcacgctacctcccctgaggtatatgggtgaggatggatgttggtacggaatggaaatacgaccaataagtgagaaagaagaaaacatggtgaagtccttggtttctgcagggagtggagaagtagataattttaccatgggggtcttatgtctagccatcttatttgaagaagtcatgagaggcaagtttggaaagaaacatatgatagccggtgtattctttacgtttgtattgctgctgtcaggacaaataacatggagagacatggcacatactttaataatgataggcagcaatgcctctgatagaatgggtatgggtgttacatacttagcactaatagccaccttcaaaatacaaccatttttggcgctaggattcttcctccgtaaattgacaagccgagaaaatttgttgctcggtgtgggactggcaatggcaacaacactacaattaccggaagatatagaacaaatggcaaatgggattgcattaggcctgatggccttaaaacttattacacagtttgaaacctaccaactttggacggcattagtctctttgacttgctctaatactatctttaccctaacggtcgcgtggagaacagcgaccttaatattggccggcgtgtcattgctgcctgtgtgtcaatcttcttctatgcgaaaaactgattggctacctatgaccgttgctgctatgggagtacccccactgcccctgttcatatttagcctcaaagacaccctcaaaagaagatcatggcctttaaatgaaggcgtaatggcggtagggttggtatccatcctagcgtcaagtctattaagaaacgatgttcctatggctggtcctttggttgcaggcggattacttatcgcgtgctatgttattactggaacatctgctgatttgaccgtagaaaaagcagcagacgtaacttgggaggaagaagcagaacagactggagtttcacataacttaatgatcactgtagacgatgatggcacaatgagaattaaagatgatgaaactgaaaatattctcacagttttgttaaaaactgcactccttattgtaagtgggatattcccttatagcatacctgctaccttattagtgtggcatacttggcagaaacaaacgcaaagatctggagtcctttgggatgtgccgagtccaccggagacacaaaaagctgaattagaggaaggtgtttatagaataaaacaacaaggaatattcggaaaaacccaggtgggcgtgggtgtacaaaaagaaggagtatttcacaccatgtggcatgtaacccgaggtgcagttctaacttacaacgggaaaagactagaaccaaattgggctagcgtcaagaaagacttgatatcatatggtgggggttggagattatccgctcagtggcagaaaggggaagaagtacaggtaatagcagtggaacccggtaaaaatcccaaaaattttcagacaatgcctggcactttccaaactacgactggagaaataggagccatagcactagattttaaaccaggcacttcaggtagtcctatcataaatagagagggaaaagtagtgggtttgtatggcaatggagttgttactaagaatggtggatatgtctctggaatagcacaaacgaatgcagaacccgacggaccaactccagaattagaggaagaaatgtttaagaaacgcaacttaacaatcatggacttgcacccaggctcaggcaaaactaggaagtatctaccagcaattgtaagagaagccatcaaacgacgattaagaactttaatcttagccccaactcgagtagtagcagccgagatggaagaagcattaaagggcttgcctatacggtatcagacaaccgcaacaaaatcggaacacacaggtcgggaaattgtagaccttatgtgtcatgcaacctttacgatgagactcctaagccctgtgcgcgtacctaattataaccttataatcatggatgaagcacatttcacagatccagcttcaatcgctgcccgtggttacatatcgactagagttggtatgggagaagcagctgcaatttttatgacggccacgcctccagggacagcggatgctttccctcaatccaatgccccgatacaagacgaagaacgtgacatacctgagagaagctggaactcgggaaatgagtggataactgacttcgcaggaaagactgtatggttcgtcccatcgatcaaggctgggaacgacatagcaaattgtttaaggaaaaatggaaagaaagtgattcaattaagcaggaaaacattcgacacggagtatcagaaaacaaaacttaatgattgggatttcgtggttactaccgatatctctgaaatgggtgcaaatttcaaagctgaccgagttattgacccacgacggtgtttgaaacctgtgatattaactgatggaccggaaagggtgatactagctggaccaatgcctgtcacggcagcctccgcggcacaacgaaggggacgagtaggcaggaacccccagaaagaaaatgatcaatatatttttacaggccaacctctcaacaatgacgaagaccatgctcattggacggaagccaaaatgttgcttgataatataaacacgccagaggggattattccagctttatttgagcccgagcgcgaaaagtcagcagctatagatggggagtacagattaaaaggcgaaagcagaaaaacgttcgtcgaactaatgagacgaggtgatttaccagtttggctcgcctataaagtagccagtgaaggaataaagtacacagacaggaaatggtgtttcgatggacaaagaaataatcaaatactagaagaaaatatggacgttgagatttggaccaaggaaggcgagaagaagaaactccgaccgcgatggttggatgcacgtacatatagcgatccactagctcttaaagaatttaaagacttcgctgcaggtagaaaatcgatagctttggatctcgttactgaaattggacgagtaccgtctcatttagcccacaggactcggaacgctttagacaacctcgtaatgcttcatacaagtgaacatggcggtaaggcctatcgacacgctgttgaggaattgccagaaacaatggaaactctacttctattggggttgatgatattattgacaggtggggcaatgttattcttaatatccggaaaaggtataggaaaaacttccatcggcctcatttgtgtaatagcttctagcggaatgttgtggatggcagagataccgctacagtggatagcatctgctatagtgttggaatttttcatgatggtactgttgataccggaacctgagaaacaacgaacgccacaagacaaccaattagcttatgttgtaataggaatactaacgctagctgccatcattgcagcaaatgagatgggactcttggagaccacaaaaagggatctaggaatgtccaaagagcccggcgtggtttcaccaacatcgtacttagatgtagatctgcatcctgcttctgcttggacgttatatgcagtggccacaaccgtgattacaccaatgctaagacataccatcgagaacagtactgcaaacgttagcctggcagctatagccaatcaggcagtggtactaatgggactggataaaggttggccaatatcaaaaatggacttaggagtacctctattagcactaggctgttattctcaggttaacccgctaacgcttacagctgcagtactattattgattacccactacgccataataggacccggcctccaagcaaaagcgactagagaggcacaaaagagaacagccgcaggtataatgaaaaacccaaccgtagacggtattatgaccatagatctggacccggtaatatatgattcaaaatttgaaaaacaacttggccaagtaatgttgcttgtattatgtgcagtacaattgctcttaatgagaacatcatgggcattgtgcgaagcattgacattagcgacaggacccattacgacattatgggaaggatcacccggaaaattctggaacacgacgatagccgtatcaatggctaatatatttagagggtcatatttagccggtgctggactagcatttagcataatgaaatccgtaggaacaggaaaacgtggtacaggatctcaaggtgaaactcttggagaaaaatggaagaaaaagctaaatcaattaagtagaaaagaatttgacttgtataagaaaagtggcataacagaagttgatcgaactgaagcaaaagagggtttaaaacgtggggaaatcactcaccatgcagtgtccagaggttctgctaaactacaatggtttgtagaaaggaacatggtaatcccagagggaagggtaattgacttaggatgtggaagaggtggttggagttattattgcgcaggtctcaagaaagtaacagaagtccgagggtatactaaaggaggaccaggtcacgaagaaccagttccaatgagtacatacggctggaatattgttaaattaatgagcggtaaagacgtgttctatctacccccggagaaatgtgacactctactatgtgacataggcgaaagtagtccaagtcccactgtagaagaatcgcgaacaatacgtgtcttgaaaatggttgaaccctggcttaaaaataatcaattttgtataaaagtcctaaatccatatatgcccacagttattgaacatctcgaacgactacagagaaaacatggtggtatgttagtgaggaacccgttatctagaaatagcacccacgaaatgtattggatatcgaacggcactggaaatattgtggcaagcgttaacatggtctctaggttacttttgaatagatttactatgacacaccgcagaccgacaattgaaaaggatgtagatctaggtgcaggtactagacacgtcaatgcagaacccgaaacccccaacatggacgtcataggagaacggattaaacgaataaaagaagaacataatagtacttggcattatgatgatgaaaacccatacaaaacatgggcatatcatggtagctacgaagttaaggcgacaggtagtgccagtagtatgataaacggcgtggttaaacttcttacaaaaccttgggatgtggtaccaatggtaacgcaaatggcaatgacggatacaaccccattcggacaacagcgagttttcaaagaaaaagtggatacgagaacacctaggtcaatgccaggaacaagaagggtaatgggaataactgcagaatggttatggagaacacttgggagaaacaagaaaccaagattatgtacccgagaagagttcactaagaaagtaagaaccaacgccgcaatgggtgctgtgtttacggaggaaaaccaatgggactcggctaaagccgctgtagaagatgaagatttttggaaattggttgatagagaacgagagttacataagttaggaaaatgcggaagctgtgtctacaatatgatggggaaaagagagaagaaactaggagaatttggaaaggctaaaggatccagggctatctggtatatgtggcttggagcaaggtatttggagttcgaggcgttaggttttctgaatgaagaccattggttctccagagaaaattcctattctggtgttgaaggtgaaggattacacaaacttggatacatcttacgtgacataagcaaaatacccggaggggccatgtatgccgacgatacagcagggtgggacactcgcataactgaagatgacttgcacaatgaagagaaaataacccaacaaatggacccagaacatcgccaactcgcgaacgctatctttaaattaacataccaaaataaagttgtaaaagtacagagaccaacgcctactggtacggttatggatattatatccagaaaggatcaaagagggtcaggccaagtcggtacctacggactaaatacctttacaaacatggaggcgcaactgattcgtcaaatggagggggagggagttttatcaaaggcagatctggaaaatccgcacttaccggagaagaaaatcacacagtggttagaaacgaagggcgttgagcggctaaagcgtatggctatctccggtgacgactgtgtagtcaaaccgatagacgacaggtttgctaatgctctgctagctttaaatgacatgggaaaggtgcgaaaagatatcccccagtggcaaccaagtaaaggttggcatgactggcaacaggtgccattttgttcacaccatttccatgagcttattatgaaagatgggagaaagctggtggtaccatgcaggcctcaagatgaactaattggccgagcaagaatatcacaaggagcaggatggtcacttcgtgaaacggcatgtctaggaaaagcatatgcacagatgtggtcacttatgtattttcataggagagatctcagacttgcaagtaatgctatatgttcggccgtgccggttcattgggtaccaacttcaagaacgacatggtcaatacacgctcatcaccaatggatgacaactgaggacatgctaacagtctggaatagagtgtggatagaagataacccatggatggaggacaagactcctgtaacaacctgggagaacgtgccttatctcggtaaacgtgaggatcagtggtgtggatcattaataggtctaacgagtagggctacatgggcccaaaacatacctaccgctattcaacaagtaagatcactgataggaaacgaggagttccttgactacatgccaagtatgaagagattcagaaaggaagaagagtctgaaggagccatatggtag

SEQ ID NO: 23453 - RNA, 9873 nt, synthetic construct
  misc_feature 1..9873: note = derived and/or modified CDS sequence (opt6) from DENV-3__FJ898472__SS-prME
  source 1..9873: mol_type = other RNA
acatcattatgcctaatgatgatactccctgcagcattggcttttcatttaacttcacgagacggggaaccacgcatgatagttggcaaaaacgaaagaggaaagagcttactattcaaaacagcatcagggataaatatgtgtacgctgatagcaatggatttgggagaaatgtgcgatgatactgtaacctacaaatgtccacatataaccgaagtagaaccagaagacattgattgctggtgcaatttgacgagtacttgggtcacttatggaacatgcaatcaagcaggagaacaccggagggataaacgttcagtggcattagcaccacacgtaggaatggggcttgatacccggacacaaacatggatgtctgcagaaggtgcgtggcgacaagtcgaaaaagttgaaacttgggcactgagacatcctggatttacaatactggcgctattcctagcacattatattggcacaagccttacacaaaaggtggtaatatttatccttcttatgttagtgaccccatcaatgacaatgagatgcgttggagtaggtaatcgtgacttcgtagagggcttaagcggagcaacctgggttgacgtcgtacttgaacacggtggttgcgtaacaacaatggccaaaaacaaaccgactttggacatagagttacagaaaacagaggcaacccaactcgctactttaagaaaactttgcattgaaggtaaaattactaatataacgactgactcacgatgccccactcaaggagaagccgttcttcccgaggaacaagatcaaaattacgtgtgcaaacacacatatgttgacagagggtggggaaacggttgcggattatttggtaaaggttctttagttacatgtgccaagtttcaatgtttggaacctatcgagggcaaagtggtacaatatgaaaatttaaaatatacggtaataataacggttcacactggtgaccaacaccaagtaggcaatgaaactcaaggagtaacagcagaaataaccccacaagcaagtacaaccgaagcaatactccctgaatatggaactctcggtctggaatgctcacccagaacaggtttggatttcaacgagatgatcctattaacaatgaaaaataaagcatggatggttcataggcaatggtttttcgacctcccattaccctggacatccggtgctacaaccgaaactccaacctggaatcgaaaagaactattagtaactttcaaaaatgcacacgcgaagaaacaagaagttgtcgtattgggtagccaggagggcgctatgcacacggcactaacgggtgcaactgaaattcagaactccgggggaacgtccattttcgcaggccatcttaaatgcaggttaaaaatggataaattggaattaaaaggcatgtcctacgcaatgtgtactaatacctttgtcctcaagaaagaagtgagcgaaacacaacacggaacaatactaataaaagtggaatacaaaggtgaagatgttccttgtaagataccatttagcaccgaagatggccagggaaaggcccataacggccgtttgataactgccaatcccgttgtaacaaagaaagaagaacccgtcaatattgaagccgaacctccattcggtgaaagtaatattgtaataggtattggcgacaacgctctaaaaataaattggtacaagaaaggaagttccatagggaaaatgtttgaagccaccgcaagaggcgctcgacgtatggctattctaggcgacaccgcatgggactttggcagtgttggaggagtgcttaattctcttggtaaaatggtacaccaaattttcggtagtgcttatacagcactatttagcggcgtatcatgggtgatgaaaatagggattggcgtgttactaacgtggatagggttaaattctaaaaacacaagcatgagtttttcgtgcatcgctatcggtataattacactatacctgggagctgttgtacaagcagatatgggatgtgttataaattggaagggtaaagaacttaaatgtggcagtggcatctttgttactaatgaagtccatacctggacagaacaatataaattccaagcggactcaccaaagaggctagcgaccgccatagcaggggcatgggagaatggcgtttgcggaataaggagcaccacccgcatggagaatctcttatggaaacaaattgcaaacgaattaaactacatcttgtgggaaaacaacatcaaactaactgttgtagtcggcgatatcataggcgttctagaacagggtaaaagaacgcttacaccacagcccatggaactaaagtattcatggaaaacatggggtaaagcaaaaatagtcactgctgagacgcaaaacagttcattcattatagacggaccaaacacacctgaatgtccaagcgcaagtagggcatggaacgtttgggaagttgaagattacggctttggagtctttaccaccaatatatggctcaaattaagggaggtctatacgcaactgtgcgatcataggttaatgtccgccgcagtcaaagacgaaagagccgtgcacgcagacatggggtattggatagaaagccagaaaaacggttcctggaaattagaaaaggcttcattaattgaagtcaaaacctgtacatggccaaaaagccatactctctggagtaatggcgtattagaatcggatatgataataccaaaatcattggctggtcctatctcacaacataattatcgtccaggataccatacacagaccgcagggccatggcatctcggaaaattggaactagacttcaattattgcgagggaacaaccgtggtaattactgaaaattgcggtacaagaggcccgtcgctgcgcacgacaacagtatcaggtaagctcatccatgaatggtgttgtagaagttgtaccttacccccactaaggtacatgggtgaggatgggtgctggtacggtatggagataagacctatatcggagaaagaagaaaatatggtaaagtcattggtatcagcaggctcaggtgaagtagacaatttcacaatgggcgtactttgccttgccatattatttgaagaggtgatgagaggtaagttcggcaaaaagcatatgattgctggcgtatttctaaccttcgtactactattaagcggtcaaataacttggagagacatggctcacacgttgatcatgataggttctaatgcatcagatcgcatgggaatgggcgtcacttatttagcccttatagctacttttaaaatccaaccatttttagctttaggctttttcctgcgaaaattaaccagtagagaaaatcttctattaggagttgggctggcaatggcaacaactttgcagttgcccgaagacattgaacaaatggctaatggaatagcactaggtttaatggcactcaaacttataactcaatttgagacatatcagttatggactgcattgatatcattaacttgctcaaacacgatatttacattgactgttgcttggcgtactgcgactttgatcctagctggggtaagtctcttgccagtatgccaaagttccagcatgaggaaaactgattggcttccaatgaccgttgcggcaatgggtgtccctccattgccattattcatattcaacttaaaggacaccttaaaaagaagatcgtggccattgaacgaaggagtgatggctgttgggttagtgtcaatactcgcgagttcgttattgagaaacgatgtcccaatggctgggcccctagtagctggcggactcttaatagcttgctatgttatcacaggcaccagtgcagatttaacagtggaaaaagcggccgacgttacttgggaagaggaagctgagcagacaggagtctcacataatttgatgattaccgtcgacgacgacgggacaatgaggataaaagatgatgaaaccgaaaacatattaaccgtcctactaaaaactgctttacttatagtgagcggaatttttccatatagtatacccgcaacattactcgtttggcatacctggcagaagcaaacacaacgttcaggtgtactgtgggatgtgccttctcctcctgagactcagaaagctgaactggaggagggcgtatacagaatcaaacagcagggtatctttgggaaaactcaagtaggggtaggtgtacaaaaagaaggagtattccatacaatgtggcatgtcacacgaggggcggttctaacatataacgggaaaagactcgaaccaaattgggcgtcagttaagaaagatctaataagttatggaggtgggtggcgtctctctgcacaatggcaaaagggggaagaagttcaggtcatagcagtagaaccagggaaaaatcccaaaaattttcaaacgatgcctgggacattccaaaccactactggggaaattggagcaatcgcgctagattttaaaccaggcaccagcggcagtcccataataaacagagaaggaaaggtagtcgggctttatgggaacggagtagtaacgaaaaatggtggatatgtttcgggaattgcgcaaaccaatgcagaacctgatgggccaacgcccgaattggaagaagaaatgttcaagaaacgaaatcttacgataatggacttacaccctggatcagggaaaacaagaaaatatttaccagcgatagtacgggaagccattaaacgaagactaaggacactaattctagcacctacaagagtagtcgcagccgaaatggaagaggcgctaaaaggattaccaataagataccaaacaacagcaaccaaaagtgaacataccggaagggagattgtggatctcatgtgtcacgctacctttacaatgcgcctcttatcaccggtacgtgttccaaactacaacttgataataatggacgaagcacactttacagacccagcctctatagccgcacgtggatatatatctacaagagtcggaatgggtgaagcagcagcaatatttatgactgcgacaccaccaggaactgccgatgcttttccccaatcaaatgccccaatacaagatgaagaacgtgacatacccgaacgaagttggaactctggcaatgaatggataactgactttgcagggaagaccgtctggtttgtaccatctattaaagcaggaaatgatatcgcaaactgcctgcgtaaaaacggaaagaaagtcatacaactcagcagaaaaacattcgatacagaatatcagaaaacaaaactaaatgattgggacttcgtagtaacgactgatatatctgaaatgggagcgaatttcaaagcagacagagttattgatccacggagatgtcttaaaccagtaatacttacggacggacccgaacgagttattctagctggaccaatgccagttacagccgcaagtgctgcgcaacgaagaggccgggtaggtcgtaaccctcaaaaggagaatgaccaatacatatttactggacaaccattaaacaacgacgaagatcatgcacactggaccgaggcgaagatgctactcgataatataaacacgccggaaggcattatacccgcactatttgaaccagaaagagaaaaatcagcagccatcgacggagaatatagactaaaaggcgaatctagaaaaactttcgtagagttaatgagaagaggagatttacccgtctggctcgcacacaaagttgcatccgaaggaataaaatacaccgaccgcaaatggtgcttcgatggccaaagaaataatcaaatactagaagaaaacatggacgtagagatatggacaaaggaaggcgagaagaagaaactaagaccccgctggttggatgcacgaacatattccgatcctttagcgttaaaagaatttaaagattttgcggcgggaagaaaatctatagctcttgatttagtaacagaaataggcagagtacccactcatttggctcatagaacccgcaacgcgctagataacctcgtcatgctacatacaagtgaacacggaggaaaagcctatcgccacgcagttgaagaattacccgaaacaatggaaactcttctcttacttggattaatgatactccttacaggaggtgcgatgttgtttctaatatccggaaaaggtattgggaagacaagcatcggattaatatgtgttattgcgtcgagtggaatgctatggatggccgagataccactacaatggatcgcctcggcaatagttctagagttctttatgatggtactattaattccggaacccgaaaaacaaagaacaccacaagacaaccaattagcctatgtggtaattggaattttaactctcgcagcaattatagcggcaaatgaaatggggcttttagaaacaacaaaaagagacctcggtatgtcaaaggaaccaggcgttgtttcacccacatcttatcttgatgtagatttacatccggcatcggcgtggacgctttacgcagtcgccactacggtaataacgcctatgttacgccacacaattgaaaactctacggcaaacgtctccttagcagcaatagctaaccaagcagtggtactcatgggtcttgataaaggatggcctattagcaagatggatctaggagtaccattactagcattagggtgttattcccaagttaacccactaacacttacagcggctgtactactgcttataacccactatgccattattggacctggtctacaagcaaaagcgaccagagaagcgcagaaaaggactgcagcaggaattatgaagaacccaactgttgacggcattatgacgatagatttagatcccgttatttatgatagcaaatttgagaaacaactaggacaagtaatgttattagttctgtgtgcagtacaacttttattaatgcgaacctcttgggcgttatgcgaggctttgacgttagcaacgggtccgattactacgctctgggaaggttcgccagggaaattttggaacaccacaatagcagtatcaatggccaatatattccgggggtcgtatttagcgggggctggacttgccttttccatcatgaaatctgtaggtacgggcaaaagaggcactggatcacagggtgaaacattgggcgaaaagtggaagaagaaattaaatcagttatcacgtaaggagttcgatctctacaagaaaagcggcattacagaggttgatcgtactgaagcaaaggaaggtttaaagagaggcgaaataacgcatcacgccgtcagccgcggatccgccaaactacaatggtttgtagagcgtaacatggttatacctgaaggaagggtaatagatcttggatgtggaagaggtgggtggagctactactgtgcaggccttaagaaagtcaccgaggttcgtggttatacgaagggcgggccaggccacgaagaaccagtaccaatgagcacttacggatggaatatagtaaaattgatgagtgggaaagacgtattctatttacccccagagaaatgtgacacactcttatgtgatataggagagtcgtcaccttccccgaccgtagaagagagtcgaacaatacgtgtactaaagatggtcgaaccttggctcaaaaataatcagttttgcatcaaagtcttaaatccgtacatgccgacggttatagaacatcttgaaagattacagcgaaaacatggaggaatgctagttcgaaatccactctcgagaaattcaacacacgaaatgtattggatcagcaatgggactggtaacatagtagcaagcgtgaatatggtaagccgtctccttcttaataggtttacaatgactcaccgacgacccacgattgagaaagacgtagatctgggggctggtacaaggcacgtcaatgcggaacccgagactcccaacatggatgtaatcggtgaaaggataaaaagaattaaagaagaacataattcaacatggcactatgatgacgagaatccctataaaacttgggcatatcatggcagctatgaagtaaaagcaactggtagcgcgtcaagtatgatcaacggagtagtaaagctcctgaccaaaccatgggacgtagtacccatggtaacacagatggcaatgacagacacgacaccttttggacaacagagagtcttcaaagaaaaagttgatactagaacacctcgtagtatgcctgggacaaggagagtcatgggaattacggcagaatggctatggagaacattaggaagaaataaaaagcccagactatgcacgcgggaggaatttacaaagaaagttagaaccaatgcagcaatgggtgccgtctttacagaggagaatcagtgggattcagcaaaagcggctgtcgaagatgaagacttctggaaattggtcgatcgcgaaagagaacttcataagctcggaaaatgtggaagctgtgtatacaatatgatgggcaaaagggagaagaaattaggtgaatttggcaaagcaaaaggatcgcgcgctatttggtacatgtggttaggggcaagatatcttgaatttgaagccttagggttccttaatgaagatcattggttcagtagagaaaattcatatagtggggttgaaggcgaaggattacataaattaggatacatactaagagatatatcaaagattccgggaggagctatgtacgcggatgacaccgcgggttgggacacacgaataactgaggacgacttacataacgaagagaaaataactcaacaaatggatccagaacatcgacagttggcaaatgcgatatttaaactcacttatcaaaacaaggtagtgaaggttcagagacctacacccacaggtacggttatggatataataagtcggaaggatcaaagaggtagtggacaagtgggtacgtacggccttaacacttttacaaacatggaagcccaacttataaggcagatggaaggagaaggggttctaagcaaagcagacctagaaaatccacatttgccagaaaagaagatcacccaatggttagaaactaaaggcgtggagagactaaaaagaatggcgatatcaggagacgactgcgtagtaaaaccgatcgatgaccgattcgccaacgcactcctagcattaaatgatatgggaaaggttcgcaaggacatcccgcaatggcaacctagcaaaggctggcacgactggcaacaagtacctttttgcagccatcacttccatgagttaataatgaaggatggaaggaaacttgtggttccatgccgtccccaagatgagctgattggcagagcgagaatctcccaaggtgccggttggtccctacgagaaacagcatgcttagggaaagcgtatgcacaaatgtggtcactaatgtactttcaccgcagagacctccgattagcttcaaatgccatttgcagcgccgtccctgtacattgggtaccgacgtctcgaactacctggtcaatacacgctcatcaccaatggatgaccacagaagatatgctcactgtatggaatagagtttggatagaagacaatccttggatggaagacaaaacaccggttacgacgtgggaaaacgtgccctatctgggaaaaagagaagaccaatggtgtggtagtttgataggactaacctcacgagctacgtgggcacagaacattcctacagctatacaacaggttcggagtttaatcggaaatgaagaatttcttgactacatgccatctatgaaaaggtttcgaaaagaagaagaaagcgaaggagcaatttggtaa

SEQ ID NO: 23454 - RNA, 9873 nt, synthetic construct
  misc_feature 1..9873: note = derived and/or modified CDS sequence (opt6) from DENV-3__FJ898474__SS-prME
  source 1..9873: mol_type = other RNA
acttcattgtgtctgatgatgatactaccagcagcactggcatttcacttgacatcaagggatggtgaaccgaggatgatagttggcaaaaacgaacgagggaaatctttgttatttaaaacagcaagcggaataaatatgtgtacactaatcgcgatggatctaggagaaatgtgtgatgacacggtcacttataaatgcccacatatcacagaagtagaaccagaagacatagattgctggtgcaacctaacatctacatgggtaacctacggtacatgtaaccaagcaggagaacatcgccgagacaaaaggtccgtagcattagctccgcacgtgggaatgggacttgatacacgcacacaaacgtggatgtcggcggaaggtgcttggagacaagtagaaaaagtggaaacatgggcgcttagacaccctggatttacaatattagcattatttctcgcacattacatcgggacatccttaacacaaaaagtggttatatttatcttacttatgctagtcacaccgagcatgaccatgaggtgtgtaggggtcgggaatcgagactttgtggaggggctgtctggagcaacttgggtagatgtagtgctagaacatggagggtgtgtaactaccatggctaaaaataaacctacgttagacatagagttgcagaaaacagaagcaacacaattggctacactaagaaaattatgtatcgaggggaaaataacgaacataacgactgattcgagatgtccgacacaaggggaagcggcactcccagaggagcaagaccaaaactatgtgtgtaaacacacctatgtagatcgaggatggggaaacggatgcggactttttggaaaaggatctttagtgacatgtgcaaaattccaatgcctggaaccaatcgaaggaaaagtagttcaatacgaaaatttaaaatatacggtaataattaccgtacatacaggtgatcaacatcaagtaggaaacgaaacacaaggagttacggcggaaattacgccccaagcatcaactactgaagcaattttacctgaatatggaacccttggtctcgaatgttctccacgtacgggattagacttcaatgaaatgatattattgacaatgaaaaataaagcatggatggtacatcgtcaatggtttttcgaccttccgctcccatggacatccggagcaacaaccgaaactccaacatggaacagaaaggaactgctcgtaacatttaaaaatgctcacgccaagaaacaagaggtagtcgttctaggaagtcaagaaggcgcaatgcatacagcattgacaggagccactgaaatccaaaattcgggcgggacttctatttttgcaggccacttgaaatgtcgcttgaaaatggataaattagagcttaaaggcatgagttatgccatgtgtacgaatacattcgtacttaaaaaggaggtatcagaaacccaacacggaaccatcctcattaaggttgaatacaagggcgaagatgtaccttgtaaaataccgttctcaactgaggatggacagggaaaagcacataacgggagactaataacagctaacccggttgtcaccaagaaagaggaaccagttaacatagaggcagaaccgccttttggagaatccaatatagtaattggaataggagataatgccctaaagataaattggtacaagaaaggaagctcaataggaaaaatgttcgaggctaccgcaaggggtgcgagaagaatggcaatattgggagacacagcgtgggattttggtagtgtaggaggagtattaaattccttaggtaaaatggtccatcagatattcgggtcagcctatacagcattattttcaggagtttcctgggttatgaagattgggataggcgttctactaacttggatcggactaaattccaagaacacttccatgtcattcagttgtattgccataggaataattactctctacctaggagcagttgtacaagcagatatgggatgtgttattaattggaaaggcaaagagttaaaatgcggctctggaattttcgttacaaatgaagtacacacatggacagagcaatacaaatttcaggctgacagtcctaaacgactcgcaacagccatcgctggtgcctgggagaatggtgtctgtggaataaggagcacaactagaatggagaacctgctatggaaacagatagctaacgaattaaactatatattgtgggagaacaatataaaattaacagtcgtagtaggggatattataggtgtattggaacagggtaagcggacccttactccccaaccgatggaactaaaatattcatggaaaacatggggtaaggccaagattatgactgcagaaacccaaaactcatcgtttatcattgacggtccaaatacacctgaatgccctagcgcctctagggcttggaacgtttgggaagtcgaagattatggttttggagtatttacgaccaatatctggctaaaattgcgagaagtttatactcaattatgcgatcatagacttatgtcggctgcaattaaggacgaaagagctgtacatgcagatatgggatattggattgaaagccagaagaatggatcatggaaattagaaaaagcaagtctcatagaagtaaaaacatgcacgtggccgaaaagccatacgctatggagtaacggggtcctagaaagtgatatgataattcctaaaggcttagcgggtccaataagtcaacataatcatcgtcctggatatcatacgcagaccgctggaccttggcacctaggaaaattagaattagactttaattattgcgagggtactactgttgtcataacggaaaactgtggaactaggggtccatcactgagaacgacaacagtgtccggaaaacttatacatgaatggtgctgtcgtagttgcacactacctccattaaggtacatcggggaggacgggtgttggtacgggatggaaattagacccatctcagagaaagaagagaatatggtcaagtcattagtatctgcaggctcaggcaaagtcgataatttcacaatgggcgttttgtgcttagcaatactatttgaagaagttatgagaggtaaatttggcaagaaacatatgatcgcaggcgtattctttaccttcgttcttctattaagtggacaaataacatggagagacatggcacacactttaatcatgattggatcaaatgcatccgaccggatgggtatgggcgttacatacctagcactgatagctacgtttaaaatacaacccttcttggccttaggtttctttttaagaaaactcacatcgcgtgaaaacctattattgggtgtaggacttgccatggcaacaaccttgcagctaccggaggatatagaacaaatggcaaatggaatcgcgttggggttaatggcgctgaaactaatcacccaattcgaaacataccaactatggaccgctttgatctctcttacttgcagcaatacaatcttcacccttacagtagcctggcgaaccgctacattgatactggctggagtatctttattacccgtctgtcaaagttcatcgatgcgtaaaacagattggttgccaatggctgtagcagctatgggcgtacctcccttacctcttttcatatttagcttaaaagataccttaaagcgtaggtcctggcctcttaatgaaggagtaatggcagtgggcttggtatcaatactagcatcatcccttcttagaaacgatgttccgatggccggccctttagtcgcgggaggattactaatagcatgctacgtgataacaggtacttccgctgatttaacagtagaaaaagccgctgacataacctgggaagaagaagcagaacaaacgggtgtttcacacaatctgatgataactgttgacgacgacggaactatgagaattaaggatgatgaaaccgaaaacatcctcacggtattattaaaaacggcccttttaattgtaagtgggattttcccttactctatcccagccaccctattagtctggcacacatggcagaaacaaacacaacgaagtggagtgctatgggatgttccgtctccgccagaaactcaaaaggccgaactggaagagggagtataccgaattaaacagcagggtatattcgggaaaacacaggtaggtgtcggagttcaaaaagaaggcgtatttcataccatgtggcatgtaacaagaggggctgtattgacttataatgggaaaagactagaacctaattgggcatctgtgaagaaagatttaatatcgtatggtggaggttggaggctttctgctcaatggcaaaaaggagaagaagttcaggtaatagcagtagaacctggcaagaaccccaaaaattttcaaaccatgcccggtacattccagaccattactggagaaattggtgcaatcgcccttgattttaagccaggaacctccggatcccctataataaatagagagggtaaagttgttggactatacggcaatggtgttgtcactaagaatgggggatatgtaagcggaatagctcaaaccaatgctgagccagatgggccaactccagaacttgaagaggaaatgttcaagaaacgtaatttaaccatcatggacctccatccgggctcagggaagactagaaaatacctcccggcaatcgtgcgtgaagcaataaaaagaagactaagaacccttatactggctccgacgagagttgtcgcggctgaaatggaagaagcattgaaaggtttacctataagataccaaaccacggcaacaaagtcggaacacaccggacgtgaaatagttgatctcatgtgtcacgcgactttcacgatgcgactattatcaccagtacgagttcctaactacaatttaataatcatggacgaagcgcattttacagatcctgcttcaattgctgctaggggttatatatctacaagggtagggatgggagaagccgctgcaatattcatgacagcaacacctcctggaactgctgatgcattccctcaatccaatgctcccatccaagatgaagaaagggacattccagaacgctcttggaacagtggaaacgaatggatcacggactttgctgggaaaaccgtatggtttgtacccagcataaaagcaggaaacgatatagcaaattgcttaaggaaaaacggtaagaaagtcatacaactcagccgaaaaacatttgacactgaatatcagaaaactaagttaaatgattgggatttcgttgttactacagacatatcagaaatgggtgctaacttcaaagctgacagagttatcgaccctcggcgctgtctaaagcccgtgattcttacagatggccctgagcgagtaatcctagcaggaccaatgcctgttacggccgcaagtgcagcccaacgtcgaggacgtgtagggcgtaatcctcaaaaagaaaacgaccaatacatatttacaggtcaaccactcaacaacgacgaagaccacgctcactggactgaggccaaaatgctattagacaatatcaatacacctgaagggataattccagcgctctttgagccggaacgggaaaaatcggctgcaatcgatggagaatatagattaaaaggtgagagcagaaaaacatttgtagaattgatgagaagaggggatttgccagtatggttagctcacaaagtggcgagtgaaggcataaaatatactgatagaaaatggtgtttcgacgggcagagaaataatcagatattagaagaaaatatggatgtggaaatatggacaaaagagggagagaaaaagaaacttaggccaagatggttagatgctagaacctactctgaccctctagcattgaaagaatttaaagacttcgcagcaggacgcaaaagtattgcattggatctagttaccgagataggtcgtgttccctcccacttagcacaccggactagaaatgcattagataacctagtaatgcttcatacgtcagaacacggcggacgagcgtatagacacgcggtcgaagaactgcccgaaacaatggaaactctattgcttctaggattaatgatactattaacgggtggcgctatgttattccttatttctggcaaaggtataggtaaaaccagcatcggtcttatttgtgtaatagctagttcaggcatgttgtggatggccgagatccctcttcaatggattgcatctgccatagtattagagtttttcatgatggtgctgcttataccggagccagagaaacaacgaaccccacaagataaccaattagcctacgtagtaatcgggatactaaccctagctgcaattatagcagcgaatgaaatggggctattggaaaccacaaaaagagatctaggtatgagtaaagaaccgggtgtagtatcacctacatcttaccttgatgtagacttacatccagcaagtgcctggaccttgtatgccgtagcaacaacggtcataacaccaatgttaaggcatacaattgaaaactccaccgcaaatgtatcactagctgccatagccaatcaagccgtagtattaatgggtttagacaaaggatggccaataagcaaaatggacctgggcgttcctctattagcattaggatgttatagtcaagtaaatccattaacgctaacagcagctgttttgctactaataactcattatgcaattataggcccgggtctacaagcaaaggctacaagagaagctcagaaaaggaccgccgctggtataatgaaaaatccaacagttgatgggattatgactattgacttagatcctgtaatatatgacagtaagttcgagaagcagttgggacaagtaatgctattagtactctgtgccgtacaactactcttaatgagaacatcctgggcactatgcgaagcgctcactctagcaacaggcccaatcacgacgctttgggagggatcacctggaaaattttggaataccactatagccgtctcaatggctaacatatttcgaggtagctacttggccggcgcgggcctagcattcagcataatgaaaagcgtaggtacagggaagcgtggaacaggatcccaaggagaaacccttggcgaaaagtggaaaaagaaactgaaccaactatctcgaaaggagtttgacctttacaagaaatcaggtattaccgaagtggacaggaccgaggccaaagaaggtttgaaacgtggtgagacaacacatcatgcagtcagtagaggatcggccaaattgcaatggtttgttgagcgcaacatggtaataccagaaggtagagtcatagatttaggatgcggtcgcggaggctggagttattattgcgccggcctaaagaaagtaactgaggtaagaggatacacaaaaggaggtcccggtcacgaagaaccagttccgatgtctacttatggctggaatattgtcaaattaatgtcagggaaggacgtattttaccttccaccagaaaaatgtgatacactactctgtgacattggcgagtcgagtccaagcccaacagttgaggaatcgcgaactatacgtgtactaaaaatggttgagccttggctcaaaaataaccaattttgcattaaagtactaaatccctacatgccaacagtaatagaacacctcgaacgattacagagaaagcatggcggaatgctcgtgaggaatccactgtcaagaaactccacccacgaaatgtactggataagtaatggtactggtaacatcgttgcaagtgtcaatatggtctcaagactcttacttaaccgatttaccatgacccatcgaagacctacaatagagaaagatgtagaccttggtgcaggaacacgtcacgtcaacgctgagccggaaacacccaatatggatgttatcggagaaagaataaaacgtattaaagaagaacacaatagtacttggcattacgatgacgagaacccctacaaaacttgggcgtatcacggatcatacgaggtaaaagccacgggatcagccagttccatgataaacggtgtagtcaaacttctaacaaagccatgggacgtagtacctatggtaacgcagatggctatgacagatacaacgcctttcgggcaacaaagagtttttaaggagaaagtagatacacgtacacctcgatctatgcctgggacaagacgagtaatgggtattaccgctgaatggctatggagaactttaggacgcaacaagaaacctagattatgtactcgtgaagagtttactaaaaaggttcgaactaacgccgcaatgggagctgtgtttacagaagaaaatcaatgggattcagcaaaggctgcagttgaagatgaagatttttggaaattagtagatcgagaaagggaattacataaattgggcaaatgtggatcttgcgtctataatatgatgggtaagagagagaagaaactaggtgaatttggaaaagcgaaaggttcccgtgcaatatggtatatgtggctaggagctagatacttagaatttgaagctctcggctttctaaatgaagaccattggttcagtcgcgaaaattcttactcaggagtagaaggtgagggtctccataaacttggttacatattgcgcgacataagtaaaatacctgggggcgcaatgtatgcagatgacacagctgggtgggacacaaggataactgaggatgatctccacaacgaagagaaaataactcagcaaatggacccagagcacagacaattggcaaacgcgattttcaagttaacctaccaaaataaagtagtaaaagtacaacgacctacaccaactggaacagttatggacatcatctcaagaaaagatcaaagagggtcaggacaagttggaacttacggattaaatactttcacgaatatggaagcacaactaatcagacaaatggaaggcgagggcgtcttgtctaaagcagacctagaatcacctcacctacccgagaagaaaatcacacaatggctcgaaacgaaaggggtagaaagactcaagcggatggctatttccggggacgactgtgtagttaaacccatagatgatcgattcgcaaatgcattattagcactgaacgatatgggaaaagttaggaaagatatcccccaatggcaaccgagcaagggatggcatgactggcagcaagttccattttgttcacatcactttcatgaacttatcatgaaagacgggcgcaaactggtagtgccatgcagaccacaagacgaactgataggtagagcacgtatatcgcaaggcgccggatggagtttgcgggagacagcgtgcctgggaaaagcatatgcccaaatgtggagtttgatgtacttccaccggagagatttaagattagccagtaacgcaatatgctcagcagtaccagttcactgggttcccacatctcgtactacttggagtatacatgcccatcaccagtggatgacaacagaggacatgttaaccgtatggaaccgtgtctggatagaagataatccatggatggaggacaaaacacctgtaaccacttgggaaaacgtaccctacttaggtaaacgagaagatcaatggtgtggtagcctaataggtcttacatccagagcgacttgggcccaaaatataccaacagcaattcaacaagtcagatcacttataggaaatgaagaatttctagattacatgccgtccatgaaacgttttcgtaaggaagaagagtcggaaggtgcaatatggtaa

SEQ ID NO: 23455 - RNA, 9873 nt, synthetic construct
  misc_feature 1..9873: note = derived and/or modified CDS sequence (opt6) from DENV-3__EU529688__SS-prME
  source 1..9873: mol_type = other RNA
acctcgctttgcctgatgatgatactgccagcagcattagcttttcatctaacgagcagggatggtgaacctcgtatgatagtcggcaaaaacgaaaggggaaaatcactactgtttaaaacggcgagtggtatcaacatgtgcactctaatagcaatggatctaggagaaatgtgtgatgatactgtgacctataaatgcccacacataacagaggtggaacctgaagacatagattgctggtgcaatttaacatccacttgggtcacttacggaacatgcaatcaagctggagaacatcggagggacaaaaggtctgtagcacttgctccgcacgtagggatgggattagacacccgaactcaaacatggatgagcgcggaaggagcttggagacaagtagaaaaagttgaaacatgggcattaagacacccaggattcaccatcctagctttgttcttggcacactatatcggaacatcgctaacccaaaaagtagtcatctttatactacttatgttagtaacgccaagtatgacaatgcggtgtgtaggggtcggaaaccgtgactttgttgaagggttgagtggcgcaacatgggtagacgtggtattggagcatggaggatgtgtaacgaccatggcgaaaaacaaaccgacgctagacatagaactacagaaaacagaagcaacacaattagcaacattaagaaaattatgtatcgaaggcaaaatcaccaatataacaacagactcaaggtgccctactcaaggagaggcagtgttgccggaagaacaagaccaaaattatgtttgcaaacatacatatgtagatcgtggatggggcaacggctgcgggctttttggtaaagggtcgcttgtaacatgtgctaaattccaatgtttagaaccaattgaaggaaaagtagtgcaatatgaaaatctaaaatatactgtgatcataaccgtacataccggcgatcaacaccaagtaggaaacgaaacacaaggtgttacggcagaaataactcctcaagcatcaaccacagaagcaattctgcctgaatacggaacgttaggactagaatgcagtccaaggacaggtttagattttaatgagatgatccttttaacaatgaaaaataaagcatggatggtacacaggcaatggttctttgatctgcccctcccttggacttccggagcaacgactgagacccctacctggaacagaaaagaattgttagtaacattcaaaaatgcacacgccaagaaacaagaagtcgtagtcttaggaagccaagaaggagcaatgcatactgcgctcactggagctacagagatacaaaacagtggcgggacatcaatctttgcaggacatttaaaatgccggttaaaaatggacaaactagagctcaaaggtatgtcatacgccatgtgtactaacactttcgtgctcaagaaagaagtgagcgaaacccaacatgggaccatattaataaaagttgagtataaaggagaagatgtgccttgcaaaattccattctccacggaagacggacaaggcaaagcccataacggcaggctcataacagcgaacccagtggtaactaagaaagaagaaccagtaaacattgaagccgagccaccttttggcgaaagcaatattgtgattggaatcggtgataatgccttaaaaataaactggtataagaaaggaagtagtattggcaaaatgttcgaagccacagcgcgaggtgcgagacggatggcaattttgggcgatacggcttgggattttggaagtgtaggtggagtactcaattcactcggtaaaatggttcaccaaatcttcggttcagcatacactgcattgttcagtggagtgtcatgggtaatgaagattggtataggcgtcctactgacatggatcggattaaatagcaaaaataccagtatgagctttagttgtatagctatagggattattactctatatttaggtgccgtggtccaagcggatatgggttgtgtgattaattggaaaggtaaagaactcaaatgcggttccggcatttttgttacgaacgaagtccacacttggaccgaacaatataagttccaagcagatagtcctaaaaggctagcgaccgcaatcgctggcgcctgggaaaacggtgtctgcggaatccgctcaactacaaggatggaaaacctactatggaaacaaattgcaaatgaactcaactacattctatgggaaaataatattaaactgacagtagttgtcggggacactataggagttttggaacaaggcaagagaactctaacgcctcaaccaatggaattaaaatattcatggaaaacgtggggaaaagcaaaaatagtgacagcagaaacacaaaattcttcgttcataattgacgggcctaataccccagaatgtccaagcgcgtctagagcatggaatgtgtgggaagttgaagactatggattcggagtattcactacaaatatatggctaaagctaagggaagtatacacacagctatgtgatcaccgcttaatgtctgccgctgtgaaagatgaacgcgcggttcacgcagatatgggatattggatcgaaagtcagaaaaatgggagttggaagctagaaaaggcttccctcattgaagtaaagacgtgtacttggccaaaaagccatactctgtggtcgaacggggttttagaatccgacatgataattcccaagtcactagctgggccaataagccaacacaactaccggccaggctatcacacacagacagcaggaccatggcatctaggaaaactagaattagacttcaattactgcgaaggaactactgttgtcatcactgaaaattgtggaacgcgaggtccaagtctcagaactacaacagtatctggtaaactcatacatgagtggtgttgtagatcatgcacgctacctccgttaagatatatgggggaggacggatgttggtacggtatggagattaggccgatcagtgaaaaagaagaaaatatggtgaaatcactggtgtcagctggttcaggcgaggtagacaactttacaatgggggttttgtgtttagctattctttttgaggaagtgatgagaggtaaatttggtaagaaacatatgatagcaggagtatttttcacattcgtattattgctatctggacagattacatggagagacatggcacacactttgataatgataggatcgaatgcttcagatagaatgggaatgggtgtaacatatcttgcattgatagcaacatttaaaatccaaccatttctagccttaggctttttcttacgaaaattgaccagcagagaaaatttactcttgggtgtgggactagctatggcaactacactccaattgccagaagatatcgaacaaatggcaaacggaatagctctcggattaatggctctcaaattaataacacaattcgaaacctatcaattatggacagctctaattagcctcacatgttccaatactatttttaccctgaccgtagcatggcgaactgctacactaatccttgctggtgtatcacttctcccagtatgccaatcaagttctatgcgcaagacagactggttacccatgactgtagcagctatgggagtgcccccattaccactttttatattcagcttaaaggataccctaaaaagaaggtcatggcccctcaatgagggagtaatggccgtaggtttagtttctatattagccagttctctactaaggaatgacgtgccgatggcaggtccgctagtagcaggagggctgctgatagcgtgttacgtcattacgggaacctcagctgatctaaccgtggaaaaagcagccgacgtgacatgggaggaggaagcggaacaaacaggagtcagccataatttaatgataactgtggatgatgacggtacgatgagaataaaagatgacgaaacggaaaatatattaaccgtcttattaaaaactgcacttttgatagtttccggtatatttccatacagcattccagcaacattacttgtatggcatacatggcaaaagcaaacgcaacgaagcggggtactttgggatgttccatcccctccagaaacacagaaagcagaattagaagaaggggtttataggataaaacagcaagggatatttggtaaaacccaagtcggcgtaggagttcaaaaggagggagtgtttcacacaatgtggcacgtcacaagaggtgccgtgttaacctataatggtaaacgtttagaaccaaactgggcatcggttaagaaagacctgatttcctacggcggaggctggcgtctgtcggcacaatggcagaaaggagaagaagtccaagtaatagcggttgagcctggcaaaaaccccaaaaattttcaaacgatgccgggcactttccagactacaactggagagattggggctattgccttagattttaaacctggcacttcaggatcacctataataaatagagagggaaaagtagttggcttgtatggaaatggtgtcgtaacgaaaaacggaggctatgtttctgggatagctcagactaacgccgaacctgacggtccaacccctgaacttgaggaagagatgtttaagaaacgaaatttgaccatcatggacttacatcctggttcgggcaaaacgaggaagtacctacctgccatagtcagagaggcaataaagaggagattacgaacgctaatcctagcaccaacgcgagttgtagctgccgaaatggaagaggcactaaaaggattgcccatccgataccagacaaccgctactaagtcagagcacacaggaagagaaatagtagacctaatgtgccatgctacgtttacaatgcgattattgtcacccgtaagagtaccaaactacaacttaataataatggatgaagctcacttcacggatcctgcgtccatagcagcgcgaggctatatctccacaagagttgggatgggagaagccgccgcaatatttatgactgcaaccccaccgggaaccgccgacgcgtttccccaaagcaacgctcccatccaggacgaagaaagagacattcctgagagatcctggaatagcggtaatgaatggataacagattttgctggaaagactgtttggttcgtgccatctattaaggcggggaatgacattgctaactgccttaggaagaacggaaagaaagtgatacagctctcacgaaaaacttttgacactgaataccagaaaacaaaactgaatgactgggatttcgtggtgacgacagatataagcgagatgggagcaaactttaaagcagatagagttattgacccgagacgctgcctaaaacccgttatacttacagacggtcctgaaagagtaatcttggcaggacctatgccggtcacagcagcgtctgcagctcagagaagaggaagggtaggacggaaccctcaaaaagaaaatgaccagtatattttcacgggacaaccactaaataatgatgaagaccacgcacattggacagaagcgaagatgctcctggataacatcaatacaccggaaggcataataccagcactgttcgaaccagaacgagaaaagtcagcagctatcgacggtgagtatagacttaaaggagaatctagaaaaacattcgtagaattaatgagaagaggagacctgccagtttggttagctcataaagttgcctccgagggaataaaatatactgatcgaaagtggtgttttgatggccagagaaataatcaaatattagaagaaaacatggacgttgagatatggacaaaagagggagagaaaaagaaacttcggccaagatggcttgatgcaagaacttactcagaccctctagcactcaaagaatttaaagactttgccgcaggacgaaaatcaatagccttagacttggtcacggagataggtagagttccctcacatttagcacaccgtacaaggaatgcattagataacctggtgatgcttcacacatcagaacatggtggtaaagcatacagacatgcagtcgaagaactacccgaaacaatggaaacgctactcttgttgggcttgatgatcttactgactggaggagcaatgctctttctaattagcggtaaaggaataggcaagacctctattggacttatttgcgtaatagctagttcagggatgctctggatggcagaaatcccactgcaatggatcgctagtgccatcgtactagagttctttatgatggtactattaataccagaaccagaaaagcagcgaaccccgcaagacaatcaactagcttacgtagtaataggaattttaacactcgcggcaataatcgctgcgaatgaaatgggtttgttagagactacaaaacgagacctagggatgtctaaagagccgggtgttgtatctcccaccagttatctagacgtagacctacatccagcatccgcatggaccttatacgcagtagcgaccacagtaataacaccaatgctccgtcatacaattgaaaactccaccgccaatgtttcgttagctgcgatagccaatcaagctgtagtattaatgggactcgataaggggtggcccatcagcaaaatggacttaggggtaccgcttctagcattggggtgctatagccaagtaaacccactgacactcacagccgcggtcttactccttatcacacactatgccataataggtcccggtcttcaagcgaaagcgactcgagaagcgcagaaaagaacagcagcaggcataatgaaaaatccaacggtagatgggataatgacaatcgatctagatcccgtaatatatgatagtaaatttgaaaagcaattaggtcaggtcatgctcctcgtcctatgcgcagtgcaattgttattaatgaggacgagttgggctctgtgcgaggctttaactttagccacaggacccatcaccaccttatgggaaggatcaccgggaaaattctggaacacaacaatcgcagtaagtatggcgaacatatttagagggtcgtatttagccggtgcaggcctagcattttctatcatgaaatcagtggggacaggaaagaggggtacaggctctcaaggggaaacattgggcgaaaaatggaaaaagaaattgaaccaattatctcgtaaggagtttgacctctataagaagagtggaattaccgaagtggatcgaaccgaagccaaagaaggattaaaacgcggagagatcacgcatcacgcagtaagtcgaggctccgcaaaattgcaatggttcgtagaaaggaatatggttatccccgaaggtagggtaatcgatctgggttgtggtcgtggcggttggtcctattattgtgcgggcttaaagaaagtaacagaagtgagagggtacaccaaaggaggaccaggacatgaggaaccagttccaatgagtacttacggatggaatatagtgaaactaatgtcaggtaaagatgtattctatctaccaccagagaagtgtgataccttattgtgcgacataggagagtcctctcctagcccgaccgtcgaagaatctaggactatccgagtattaaaaatggttgagccatggcttaagaacaatcaattctgtataaaggtcctcaatccatacatgccgaccgtaattgagcacttagaaagattgcagagaaaacatggagggatgctagttagaaacccgttatcacgtaacagtacacacgaaatgtattggatttccaatggtacaggaaatatagtggcttcagtgaatatggtgtcgcgcttgttgctaaatagatttaccatgactcatcgtaggccaaccatagaaaaggacgtcgatttgggcgcaggtacgaggcatgttaatgcagagcctgaaacgccaaatatggatgtaattggagaaagaataaaaagaattaaagaagaacacaatagtacatggcattatgacgatgagaacccatacaaaacatgggcataccatggttcatacgaagtgaaggcgacgggatctgcttcaagcatgataaacggagtggttaagctactaaccaaaccatgggacgtcgtcccaatggtcacgcaaatggcgatgacagacacaactccattcggtcaacaaagagtatttaaagagaaagtagatacacgaaccccaagatcaatgcctggtacgaggagagttatgggaattacggctgaatggctctggagaactctaggaagaaataagaaacctagattgtgcactagagaagaatttactaagaaagtgcgaacaaacgctgcaatgggtgcagtcttcaccgaggagaaccaatgggattcagcgaaagcagccgtcgaagatgaagatttctggaaacttgttgaccgagaacgggagctacataaattgggcaaatgcgggtcatgtgtgtataatatgatgggcaaacgagagaagaaactcggggagtttggtaaagctaaggggtcaagagcaatctggtatatgtggttgggcgccagatatctagaatttgaagccctcggattcttaaacgaagaccactggtttagtagagaaaactcatatagcggcgtcgaaggtgaaggactccacaaattgggctacatacttcgggacattagcaaaataccaggtggagcaatgtacgcagatgatacagcaggatgggacacacggattaccgaagatgatctacataacgaagaaaagataacccaacaaatggatcctgagcatcgacaactcgcaaacgccatattcaaactcacgtaccaaaataaggttgtaaaagtacaaagacccacaccgactgggacagttatggatatcatatcaagaaaagatcagaggggatcgggacaagttggaacatatggactgaacacttttacgaacatggaagcacaattaataaggcagatggaaggcgaaggcgttcttagtaaggctgatctagagaaccctcatttaccggagaagaaaataacacaatggttagaaacaaaaggggtagaaagattaaaacgaatggctatatcgggcgacgactgcgtcgttaaaccaattgatgacaggtttgcgaatgcgcttttagcacttaatgacatgggaaaggttagaaaagatatcccacaatggcagccgtcaaagggctggcacgactggcagcaagttcccttttgttcgcatcacttccatgaattaataatgaaagacgggcggaaattagtggtaccttgtagaccgcaggacgaactaataggtagagcccgtatcagccaaggtgcggggtggagtctacgagagactgcctgccttggaaaagcatatgcacaaatgtggagcttaatgtactttcatcgtcgggatctaaggcttgcctccaatgccatatgtagcgcggtccctgtccactgggtaccgacaagcagaacaacctggagcatccatgcccaccaccaatggatgacgaccgaagatatgttaactgtatggaatagagtctggattgaagacaacccatggatggaggacaaaactccggtcacaacatgggaaaacgtgccgtatctaggaaagcgcgaagaccaatggtgtggcagcttaattggacttacttccagagccacttgggcacaaaacataccaaccgcgatacagcaggtacgctcactaatcgggaacgaagagttccttgactacatgccaagtatgaaacgcttccgaaaagaagaagaaagtgaaggggctatatggtag

SEQ ID NO: 23456 - RNA, 9873 nt, synthetic construct
  misc_feature 1..9873: note = derived and/or modified CDS sequence (opt6) from DENV-3__EU482613__SS-prME
  source 1..9873: mol_type = other RNA
acaagcttgtgtttaatgatgatcttgccagcagccttagcatttcatttaacatcgagagatggtgaacctaggatgatagttggtaaaaacgaaaggggaaagagtctattattcaaaacggcgtcaggtataaacatgtgtactctaattgcaatggacttgggcgaaatgtgtgatgacacagtaacgtacaagtgtccacatattactgaagttgagccagaggatatcgattgttggtgcaatcttacatctacatgggtaacatacggcacatgcaaccaagcgggagagcataggagggacaaaagatcggtagcactagcaccgcacgttggcatgggtctcgatacaaggactcaaacgtggatgtccgcagaaggagcctggcgacaagtagagaaagtagagacatgggcattaaggcatccaggctttaccattttggccttatttcttgcacactatatcggaacgagcttgacgcaaaaagtagtcattttcattctgctaatgctagtaactccatcaatgactatgagatgcgtaggagtcggaaatcgagattttgtagaaggactatcaggtgctacgtgggtcgacgtagtattggagcacggtggctgcgtcaccacgatggccaagaacaaaccaaccttagacatcgaactacaaaaaacggaagccacgcaactagcaacacttcgaaagctatgtatcgaaggtaagattacgaatattacaacagattcgcgttgtccaacacaaggcgaagctgttttaccggaagaacaagaccaaaattacgtatgtaagcatacgtatgtcgataggggctgggggaacggatgtggattatttggtaaaggttctttggtaacttgcgcgaaattccagtgtctcgaacctatagaagggaaagtggttcaatatgagaatctaaagtacacagtgataatcacagtacacacgggagatcaacaccaggtgggaaacgaaacccagggcgtaactgcagaaattacaccccaggctagtacaacagaagcaatattaccggaatatggcacacttggtttggaatgttcaccaaggactggacttgatttcaatgagatgatcctattgaccatgaagaacaaagcgtggatggtacatcgacaatggttttttgacttacccttgccctggacctcaggggccaccacggaaaccccgacatggaacaggaaggaactacttgtaacattcaaaaatgctcacgccaagaaacaggaggtagtagttcttggctcacaagagggagctatgcacactgcactgactggagccacggagattcaaaattcgggcggtaccagtatctttgctggccatctaaagtgccgattaaaaatggacaaattggagctaaaggggatgtcctacgctatgtgtaccaacacctttgtgctaaaaaaagaagtgtccgagacccagcatgggaccatcttaattaaagtagaatataaaggagaggatgtaccgtgcaaaattccattctcgactgaagatggtcaaggaaaagcacataatgggagattgattactgcaaatcctgttgtcaccaaaaaagaagaacctgttaatattgaggctgagccaccattcggagaatcaaacatcgtgataggaataggagacaacgcgctaaaaattaactggtacaaaaaaggtagctctatcggaaaaatgtttgaagctacagctagaggggcgaggagaatggctatactcggagataccgcttgggattttggctcagtagggggtgtgttaaattcgttaggaaaaatggtacatcaaatatttggttcagcttatacagctttattcagtggagttagctgggttatgaagataggcataggtgtgctattaacctggatagggttgaacagtaaaaacacgtcaatgtcattttcatgcatcgcgattggtattataacattatatcttggggccgttgttcaggcagacatgggttgtgttattaattggaagggtaaagaacttaaatgtggctcaggaatttttgtcaccaatgaagtacatacatggaccgaacaatataagtttcaagccgactcaccaaaaagactcgctacagctatagcaggtgcgtgggaaaatggcgtatgtggaatcagatcaacaacaagaatggaaaacttgttatggaaacaaatagctaacgaactgaattatatcttatgggaaaataatataaaactgaccgttgtggtcggagatataataggagtactcgaacaaggaaaaagaaccctgacgccacaaccaatggagttgaaatactcatggaaaacatggggtaaagctaagatcgtaaccgctgaaactcaaaatagttcatttataattgacggtcccaatactcccgagtgcccctctgcatcgagggcatggaatgtttgggaagtcgaagattatggatttggagtcttcactacaaatatatggttaaaactgcgagaagtatacacgcaattgtgtgaccatagactgatgtccgccgctgtgaaagacgaacgagcagtccacgcagatatgggatattggatcgaatcacagaaaaacggaagttggaagttagaaaaagcaagtttaatagaggttaaaacatgcacatggccaaagtcccacacactatggtcaaatggtgtactggagtcagacatgattataccaaaatctttagcaggtccaatcagccaacataattatagaccaggttaccatacccaaacagccggaccatggcatttgggcaaattagagcttgattttaactactgtgagggaacaaccgtcgtgatcacggaaaactgcggcacccgaggccccagtcttcgcacgactacggtgtccggcaagttgatacacgaatggtgttgtaggagctgtacacttccgccactgagatacatgggtgaagatggatgctggtatggaatggaaatacgtcctatctccgaaaaggaagaaaacatggttaaatcgttggttagtgccgggtctggagaagtagataactttaccatgggagttttatgtttagcaatattgttcgaagaagtgatgcgtgggaaattcggaaagaaacatatgattgcaggagtcttcttcacattcgtactattgttaagtggccagataacatggagagatatggcccataccttgataatgatcggatcaaacgccagtgacagaatggggatgggtgtaacttacctggcgctaatcgcaacatttaaaattcaaccttttcttgccctaggattcttcctaagaaaactaaccagtcgagaaaatttattactaggtgttgggttagcaatggcaacgacacttcagttacctgaagacatagaacaaatggccaatggaatcgcgcttgggttaatggctctgaaacttataacccagtttgaaacctatcaattatggacagcactgattagccttacgtgctctaatactattttcaccctcacagtggcatggagaacagctacattgatcctagcaggagtatcattgttaccagtatgccaatcttcatcgatgagaaaaacggattggctgcccatgacagttgcagccatgggtgtcccgcctcttcctttgtttatttttagtctaaaagatacactaaagcgccgctcatggccactaaatgagggggtaatggcggtaggattagtttcaatattggcatcgagtcttctgcgcaatgatgttccaatggccggaccgttggttgcagggggcttgctcattgcttgttatgtaatcacaggaacttcagccgacttaacagttgagaaagccgcagatgtaacctgggaagaggaagctgaacaaacaggggtgtcacataacctaatgatcacggtagacgacgacggaactatgagaataaaggatgatgaaactgaaaatatactaacagtacttttaaagacagcattgttaatagttagcggaatttttccctactctattcccgcaacacttttagtctggcatacatggcaaaagcagactcaacgcagcggggtcctctgggatgttccctcgccccccgaaacgcaaaaagctgaacttgaagaaggagtatatcgcatcaagcaacagggaatttttggaaaaacacaagtgggtgtaggtgtacaaaaagagggagtgttccacaccatgtggcacgtcactcgaggagctgtgctcacttacaatgggaaaagactggaaccaaattgggctagcgtcaagaaagatttgatatcatatggcggtgggtggcgacttagtgcacaatggcagaaaggggaggaggtacaggtaatagcggttgaaccggggaaaaatcccaaaaactttcaaaccatgccagggacctttcagactacaactggagaaattggcgctatcgcactggattttaagcccggaacatcaggttctcctataatcaaccgcgaaggaaagatcgtaggactgtatggtaacggggttgtaacaaaaaatggaggatatgtatcagggattgctcaaaccaatgcagaaccagatggaccgacacctgaactagaggaggagatgttcaagaagagaaatctcacaattatggatttgcatcctggttcagggaaaactaggaaatacttaccagccatcgtacgagaagcaataaaacgacgactaagaacgttgattctggcacctaccagagtagtggcagcagaaatggaagaggctttgaaaggactaccgattcgatatcaaactacggcaacgaaaagtgaacatacaggtcgagagatagtggatctaatgtgtcacgcaacattcactatgagacttttgtcaccggtaagggttcctaattataacctgataataatggatgaggcccactttacagacccagcgtccatagctgctagagggtacattagcacaagagtaggaatgggtgaagcagctgcaatctttatgacagccacgcccccaggcactgcagatgcttttccacaatctaatgctccaatacaagacgaggaacgagatatcccggaaagatcatggaacagtggcaatgaatggataaccgatttcgcggggaaaacagtttggttcgtaccgtccataaaggcgggcaatgacattgcaaattgtctccgaaaaaacgggaaaaaagtcatacaattatcacgaaaaacattcgacacagaataccaaaaaacaaaattaaatgattgggactttgtggttactaccgacataagtgaaatgggagcgaactttaaggccgaccgagtaatagacccacgaagatgtctgaaaccagtgattttgactgatgggccagagagagtaatcttagcgggacctatgcccgtcacagctgctagtgccgcacaacgcagaggtagagttggtagaaatcctcaaaaagagaatgatcaatacatctttactggacaaccgttgaataatgacgaggatcacgcccattggacagaagcaaaaatgctcttggacaatataaatacaccggagggaattataccagccctatttgaacccgaaagagaaaaatcggcagcgattgatggagaatataggttgaaaggtgaaagcagaaaaacgtttgtcgaactaatgcgcagaggcgatctaccagtttggcttgctcataaagttgcgtcagaaggaataaagtacacagacagaaaatggtgttttgatggtcagaggaataatcagatactggaagaaaatatggacgtagaaatatggactaaagaaggcgagaagaaaaaactacgacccagatggctagatgctcggacctatagtgaccctctggcactaaaagaatttaaagatttcgcagcaggtcgtaagtcaatcgctttagatctagttactgagataggacgagtaccgacacatcttgcgcatcgcacccgtaacgcattggataatttagtcatgttacacacatcagaacacggagggaaagcgtatagacatgcagttgaagaattgcctgagacaatggaaaccttgctcctattagggttgatgatactactcactgggggcgcgatgctttttcttatatctggaaaaggcataggtaagacgagcattggattgatctgcgtaatagcatctagcggaatgttatggatggcagaaatacctttacaatggatcgcctcagcaattgtattagaatttttcatgatggttttgttaataccagaaccagaaaaacaacgaacacctcaggacaatcaattagcatatgttgttataggaatcctcacactagctgcaattatagcagcgaatgaaatgggacttttggaaacgacaaaacgagatttaggaatgtcaaaagaaccaggtgtagtatctcctacatcttatctcgacgtggatttgcatcctgcaagtgcgtggacactatatgctgttgctacaaccgttataacaccaatgttacgtcacacaatagaaaattctaccgcaaacgtctcattagctgctattgccaaccaagcagtggtactaatggggctcgacaagggctggccaataagcaagatggatttaggagtaccactactagctttaggctgttattcccaagttaatcccttaactttaacagcggcagtcttactccttattacacactacgcaataataggtccgggattacaagccaaggcaacccgtgaagcgcagaaacgaacagccgccggcatcatgaaaaatccaacagtagacggtattatgactattgatttagaccccgttatatacgactcaaaatttgaaaaacaattgggacaagttatgttgctcgttttgtgtgctgtacaacttctgttaatgaggaccagttgggcactatgtgaggcattaaccttggcgacaggtccaattacaactttatgggagggaagccccggtaaattctggaacacaaccatagctgtatcaatggctaatatatttcgtggttcatacttagccggtgcaggactagctttctcaataatgaaaagcgttggaaccggaaagagaggaactgggagccaaggcgaaactctcggagagaaatggaagaaaaaattaaatcagttatccagaaaagaattcgacttatataaaaaaagtggcataacagaggttgatagaactgaagcaaaggagggattgaaaagaggagaaattacgcaccatgctgttagcagaggttctgcaaaattacagtggttcgtagagagaaatatggtaattccagagggaagggtaatagatctaggctgtggccgaggaggatggtcatactattgcgctgggctaaaaaaggtaactgaagtccggggctacacaaaaggaggcccgggccatgaagaacctgtacccatgtcaacatacggatggaatattgtgaaacttatgagtggaaaggatgtattctatctaccaccagaaaagtgtgatacgcttctttgtgatataggcgagtcatcgccaagccctacagtcgaggaatcaagaactatacgtgtattaaaaatggtagaaccgtggttaaaaaataaccagttctgcatcaaagtattaaacccatacatgccgactgtaatagaacacctagagaggttacaacgtaaacatggcggaatgttagttaggaacccgctttcgcgtaattctacacacgaaatgtattggatctccaatggtacaggaaacattgtcgcatcggtaaatatggtttcgaggttactattaaacagattcacaatgacacatcgtcgaccaacaatagaaaaggatgtcgatctcggagctggtacaaggcacgttaacgctgaacccgaaacacctaatatggacgtaatcggtgaaaggataaaaagaataaaagaggaacacaactcgacgtggcattatgatgatgagaatccatataagacctgggcctaccatggatcatacgaagtaaaagcaacaggatctgctagcagcatgataaatggcgtagttaaactacttacaaaaccatgggatgtcgtccctatggtgacacagatggctatgaccgacacaactccgttcggacagcaacgcgtcttcaaagaaaaagtcgacacacgaacgcctagatcaatgccggggacgcggagagtaatgggaataactgcagaatggttatggagaacgctaggtcgaaataagaaaccgagactttgcacgcgagaagagttcaccaaaaaggtacgaacaaatgcagccatgggagcagtatttaccgaggaaaatcaatgggacagtgctaaagcagcagtcgaagatgaggatttttggaaattggtagatcgtgaacgcgagttgcacaaattaggtaaatgtggttcatgcgtatataacatgatgggcaaaagggaaaagaaactcggcgaatttggtaaagcgaaaggatcccgagcaatttggtatatgtggctaggcgctagatatttagaattcgaagcattgggctttttaaatgaagatcactggttttctagagaaaattcgtactcaggagtagaaggagaaggtctacacaaactaggttatattctacgcgatatctccaaaataccaggtggagcaatgtacgcagatgacacagccggctgggatactaggattacagaagacgatttacacaatgaggaaaaaattacacaacagatggacccagaacacagacaactcgcgaatgcgatatttaaacttacatatcagaacaaggtggtaaaggtccagcgaccgactccaacaggtacagttatggatataatatctagaaaagatcaaagaggaagcggtcaagtggggacatacggactaaatacgtttactaatatggaggcccaattaatccgccaaatggaaggcgaaggggttctgagcaaagcggacttagaaaacccacacttacccgaaaaaaagataacccagtggcttgaaacaaaaggagttgagaggctaaaaagaatggctattagtggcgatgattgtgtagtaaaaccgatagacgacagatttgctaatgcactgttggctttaaatgatatgggaaaagtaagaaaagatattcctcaatggcaaccatcaaaaggttggcacgactggcaacaagtacccttttgcagtcatcatttccatgaactaataatgaaagatggccgaaaactcgttgtcccgtgtagacctcaagacgaattaattgggcgagcaagaattagtcaaggagctggctggtctctgcgcgaaacagcatgtcttggtaaagcatatgcccaaatgtggtccctaatgtatttccaccgccgagacttgcgattagcatcgaacgctatatgcagtgccgttccagtacattgggtacccacctctagaactacatggtcaatacacgcgcaccaccaatggatgactacggaagatatgttaacagtttggaatcgcgtatggattgaagataatccatggatggaagataaaacacctgtcaccacatgggaaaatgtgccctatttaggcaagcgcgaagatcagtggtgcggttctttaataggactcacaagtcgagcgacctgggcccaaaatatcccaactgccattcagcaagtccgttctttgatcggaaatgaagaatttttagactatatgccatccatgaaacgattcagaaaggaggaggaaagcgaaggagccatatggtaa

SEQ ID NO: 23457 - RNA, 9873 nt, synthetic construct
  misc_feature 1..9873: note = derived and/or modified CDS sequence (opt6) from DENV-3__EU529690__SS-prME
  source 1..9873: mol_type = other RNA
acaagtttatgtctaatgatgattctacctgccgcattagcgttccacttaacgagtagagatggagaaccacgtatgatagtagggaaaaacgaaagaggaaaatccttgttatttaaaacagcaagtggaataaatatgtgtaccctaattgctatggacttaggagaaatgtgcgatgatacagttacgtataaatgcccacatataacagaagtcgaaccggaagacatagattgttggtgcaaccttacctcaacttgggtaacatacggaacttgtaaccaagcaggagaacatcgtcgagataaacgatcagtggctctagcaccacacgtgggtatgggtttggatacacgaacgcaaacatggatgtctgcagaaggagcctggaggcaggtagaaaaagtggaaacctgggcattaagacatccgggatttacgatattggcattatttttggcgcactacattggaacttctctcacacagaaagttgtaatatttattttactgatgctcgttacaccttccatgaccatgagatgcgttggtgttggcaaccgagattttgtagaaggcttatcgggcgcaacgtgggtcgatgtagtactcgaacatggaggatgcgtgaccacaatggctaaaaataaaccgacactagacatagaattacagaaaaccgaagcaacacaattagcaactctgcgcaaactatgcatcgaaggtaaaataacaaacatcactaccgactcgagatgcccaacccaaggagaagcagtactaccggaagaacaggaccagaactacgtttgtaaacatacgtatgtcgatcgcggatggggcaatggatgcggactattcgggaaaggtagcttagttacatgcgcaaaatttcaatgcttagaacctatagaaggcaaagtagtccaatacgaaaatcttaaatatacagtaataataactgtacatactggcgaccaacatcaagttggaaacgaaacacaaggagtaaccgcagaaattactccccaagcaagcaccacagaggccatactcccagaatatggtactctagggctggaatgtagtccacgaacaggcctagattttaatgaaatgatactattgacaatgaaaaataaagcgtggatggtacaccgtcaatggttctttgatttgccactaccatggacatccggtgcaacaaccgaaacaccaacatggaacaggaaagaactactcgtaacatttaaaaatgcccacgccaagaaacaagaagttgttgtacttggttctcaagaaggcgcaatgcatacagctctaacaggagcgactgagattcaaaatagcgggggaacatcaatattcgcgggccatctcaaatgtaggctaaaaatggacaaactcgagttgaaaggaatgagttatgcgatgtgtacaaatactttcgtcctgaagaaagaagtttcggaaacccaacatggtactatactaattaaagtggaatataaaggagaagatgtaccgtgcaaaataccattcagcactgaagatggtcaaggtaaggcacataatgggagactcataacggcaaatcctgtagtaaccaagaaagaagaacccgtaaatatagaggcggaaccaccatttggagagagcaacattgtaatagggataggcgataacgccttaaagataaattggtataaaaagggaagtagtataggtaaaatgttcgaagccacagctagaggtgcgcgccgcatggcaatattaggggataccgcatgggatttcggcagtgtaggaggagtccttaattccttgggaaaaatggtccaccagatattcggaagcgcatatacagccttattttcaggagtctcttgggttatgaaaattggcataggtgtactcctaacttggataggtctaaactcgaaaaatacaagtatgtcattctcatgtatcgccattggtataattacactatatttaggcgctgtagtccaagcagatacggggtgtgtcataaactggaaaggaaaggaactaaagtgcggcagtggcattttcgttacaaatgaggtacacacgtggactgagcagtataaattccaagccgatagcccaaaacgtcttgcaacggcaattgccggtgcttgggaaaatggagtatgtggaattagatcaacaacaaggatggagaacctactttggaagcaaatagccaatgaactaaattatattctgtgggaaaacaacataaaactaacagtagttgtgggggatataataggagtgttagagcagggcaaaaggactctaacgccacaaccaatggaattaaaatactcgtggaaaacatgggggaaggcaaagatagtaacagcagagacacaaaatagttcctttattatcgatgggcctaacactcccgaatgcccatccgccagcagggcgtggaacgtttgggaagtggaagactatggttttggcgtatttacgacaaacatttggttaaaattacgggaagtttatacgcaactctgtgatcatcgacttatgagtgcggcagttaaggacgaaagggccgttcatgccgacatgggatattggatcgaatctcagaaaaatggctcttggaaattagagaaagcatcgttaatagaagtaaaaacttgtacgtggccaaaatctcataccctctggagtaatggcgtactcgaaagtgatatgataataccaaaaagtttggctggaccaatatctcaacataattaccgtcctggttatcatacgcagaccgctgggccatggcatcttggcaagctagaacttgattttaactactgtgaaggaactacagtagtaataacagagaattgtgggacgagaggcccatccttaagaaccacaacagtttcaggaaaattaatccacgaatggtgctgcagatcatgcacacttccccctctgagatacatgggagaggatggttgctggtatggtatggaaattagacccatatcagagaaagaagaaaacatggtaaaatccttagtgtcagcgggaagtggtgaagttgataactttacgatgggagttctatgcttagctattcttttcgaggaagtaatgcgaggaaagttcggcaagaaacacatgatagctggagtattctttacgtttgtgctcttgctgtctggacaaattacgtggcgggacatggcacatacactgataatgattggaagtaacgccagtgaccggatgggaatgggggtaacatatcttgcgttaatcgcgacattcaaaatacaaccatttctagctctcggatttttcttacgaaaacttacaagccgtgaaaatttattactaggagtcgggttagccatggctactactcttcaactcccggaagatatagaacagatggctaacggaattgccttaggattaatggcactaaaactcataacacaattcgagacatatcaattatggacagcattaattagtttgacatgttcaaacacaatctttacattaacggttgcctggagaacagcaacactaattctagctggagtctcactattaccagtctgtcagtcatcaagtatgcgaaaaacagattggctaccgatgacagtcgcagctatgggggtgccaccacttccgttgttcatctttaacttgaaagatacgctgaaaaggaggagttggcctctgaacgaaggagtcatggcggtcgggttagtttcaatattagcttcgtcgttgttaaggaatgatgtccctatggcaggtcctttggtagccggtggattgttaatcgcttgctatgtaataacaggtacatcagcagacttaactgtagaaaaagcagccgatgttacatgggaagaagaggcagaacaaactggagtaagtcataacttaatgataacagtagatgacgatgggaccatgcgaattaaagatgacgaaacggaaaacatacttacggtactcctaaaaacggcactattaattgtatcaggtatatttccctattcgatacctgctactttactcgtatggcacacatggcaaaaacagacgcaaagaagtggggttttgtgggatgtccccagcccgccagaaacccagaaagctgaactagaagaaggcgtatatcgtattaaacaacaaggcatattcggtaagacccaggtgggtgtaggtgttcaaaaggaaggagtattccacacgatgtggcacgtgactcgaggtgcagtacttacctacaatggtaagagattagagccaaattgggcatcagtcaagaaagatttaatatcatatggcggaggttggaggctttcagcacaatggcagaaaggtgaagaagtacaagtaatagccgttgagcctggcaaaaaccctaaaaattttcaaacaatgccagggacttttcagacgacaaccggagaaataggagcgatagctctagactttaaaccgggaacttcaggcagccccataatcaatcgcgaaggcaaagtcgtggggttgtatggaaacggtgtcgttactaagaatggcgggtacgtatctggcatagctcaaaccaatgccgaaccggatgggccaactccagaattagaagaagagatgttcaagaaaaggaatctcactataatggatctccacccaggttctggaaaaaccaggaaatatctcccagcaatagtacgagaagcgattaaacgacgtctacgaacattaatcttagccccaacacgagtggtggcagcagagatggaagaagcgctaaaaggtttaccaataagatatcaaacgactgcaactaaaagcgaacatactggacgagagatcgtagacctaatgtgtcacgcaacctttacaatgagattactatcacctgtccgagttcccaactacaacttgattataatggatgaagcccatttcacggaccctgcttcaatagctgcaaggggctatattagtactcgagtcggtatgggagaggcagccgcaatatttatgactgcaacaccacctggtactgcagatgcatttccacaatcaaatgcgccaatacaggatgaagaaagagatataccagaacgaagttggaatagcggcaacgaatggatcacggattttgcaggcaaaacggtttggtttgtaccatcaataaaggctggaaatgatattgctaattgtttgcgtaaaaatgggaagaaagtaattcaattatcaagaaagacatttgatacagaatatcagaaaacaaaacttaatgattgggattttgttgtcacaacagatatatctgaaatgggtgctaatttcaaagctgatagagtaatagatccccgtagatgtctcaagccggtaatactaactgacggaccagagcgtgttattttagcaggacctatgccagttactgccgcatcagccgctcaacgccgtggtcgggtaggacgaaatccacagaaagaaaacgaccaatatatcttcacaggtcagccgttaaacaacgatgaagaccatgcccactggacggaagctaagatgctcctggataatattaatactcctgaaggaattatacccgcactattcgaaccagaaagggagaaaagtgcggcaatcgatggcgaatatcgactcaaaggagaatctcggaaaacgttcgtagaactcatgaggagaggagacctacctgtatggttggcacataaagtagctagtgagggtattaaatacacagatagaaaatggtgttttgatggtcaacggaataaccaaattcttgaggaaaatatggatgtagaaatctggacaaaagagggtgagaaaaagaaattacgtcctaggtggctggacgcccgaacatatagtgatccgttggcacttaaagagttcaaagactttgctgctggccgcaaaagcatcgctttagatcttgttacggaaattggtcgagtgccaacccacttagcgcaccgaaccaggaatgccctcgataacctagttatgctacatacctctgaacatgggggaaaggcttataggcacgcagtggaagaattaccagaaaccatggaaactttactactcctcggcttaatgatactcttaaccgggggagctatgctgtttctgatatccggtaaaggtattgggaaaaccagtatcggattaatatgtgttattgcctcaagtggaatgctttggatggccgaaattccactccagtggattgcatcagccattgtattggagttcttcatgatggttttgttaattccggagcccgaaaaacaacgaacgccacaagataatcaattggcttatgttgtcatcggcattttgactttagccgcaattatagcggctaatgaaatggggctcctagaaaccaccaagagggatttgggaatgtccaaagagcctggggtagtatcacccactagctacttagacgtggatctacaccctgcctctgcttggacactttacgcggttgccacaacagttattacgcccatgctcaggcatacgattgaaaactcaacagctaatgtatccttggcagcaatagctaatcaagcagtagtattgatgggcctagacaagggttggccaatcagtaaaatggacttaggagttccactattagctcttggatgctattctcaagtgaaccctcttactctaacggctgccgtcttacttctaataacacattatgctattataggccctgggttgcaagctaaagccacaagggaagctcagaaaagaactgctgcaggaataatgaaaaaccctacagtggatggtataatgactatcgatctagaccctgtaatatatgattcaaagttcgaaaagcagttgggccaagtgatgctcttagtgctttgcgcggtgcaacttttattaatgcgtacatcatgggcactttgcgaagcattgacactggccacaggaccgattacaacattgtgggaaggatccccaggaaagttttggaatacgacaatcgccgtatctatggccaatatattcagagggtcctatctggctggagctggacttgcattctcaataatgaaatcagtaggtaccggaaaaagaggaactgggagtcagggagaaactctgggcgaaaaatggaagaagaaattgaatcaattatcccgaaaagagtttgatctgtataagaaatcgggcatcacagaagtggatagaacggaggcgaaagaaggtttaaaaagaggagaaataacccatcatgctgttagtagaggctcagctaaacttcaatggtttgttgaacgaaatatggtgattcctgaaggtagggtgatagaccttggatgtggtagagggggatggagttactactgtgctggcttaaagaaggtgaccgaagtaaggggttacacaaaaggtggaccaggacatgaagaacccgttccaatgtccacttacgggtggaacatagtcaaactaatgagtggtaaagatgtattctatctaccccctgaaaagtgtgacactctattgtgcgacatcggtgaatcatcaccaagtccaactgtagaagaaagccgaacaataagggttctgaagatggtagagccttggctgaaaaacaatcaattctgcataaaagtactaaatccgtatatgcctacagtaatcgaacacctggaaagattgcaacgtaagcatggtggtatgctagtacgtaatcctctatcaagaaacagcacccacgagatgtactggatcagcaacggtacaggaaatatagtggcaagtgtgaatatggtgtcgcgccttctcttaaatagattcacaatgacccacagacgtccaactattgaaaaagatgtagatttaggggcaggtacacgacatgtcaacgcagaaccagaaaccccgaatatggatgtaattggagaacgaataaagagaataaaagaagaacataattcaacatggcattacgatgatgagaacccatataaaacttgggcttatcatggatcttacgaagtaaaagctactggctctgctagttctatgataaatggagtggtgaagttattaactaaaccttgggatgtagtacccatggtaacgcagatggcaatgacagacactaccccatttgggcagcaaagggtattcaaagaaaaagtagacacacgcacaccccgaagcatgccaggtacaaggagagtaatgggtataaccgctgaatggctatggcggacgttaggcagaaacaagaaaccccgtttatgtacccgagaagaatttactaagaaagttaggacaaacgctgcaatgggtgccgttttcaccgaagaaaatcaatgggattcggctaaagctgcggtcgaagatgaagacttctggaaacttgttgatcgggagcgagagcttcacaaactaggtaaatgcggatcgtgtgtatacaatatgatggggaagagggagaagaaactaggcgagttcggaaaggccaaagggtcacgagctatttggtatatgtggctaggtgcgaggtatctcgagttcgaagcactcggattcttgaatgaagatcactggtttagcagggaaaacagctattcaggtgtggaaggtgaagggttacacaaacttggatatatattgcgcgacatttcgaaaatacccggcggagccatgtacgcggatgatacagccggatgggacacacgaatcactgaagacgacttacataatgaagagaaaatcacgcaacaaatggatcctgagcatagacaacttgcaaatgcgattttcaaactaacttaccaaaataaagtcgtgaaagttcaaaggcctactcccacaggaactgttatggatataatatccagaaaagaccaaagaggttcaggacaagtagggacctatgggcttaacactttcactaacatggaagcacaactcattagacaaatggaaggagaaggtgtcctatcaaaggcagatctagaaaaccctcacttgccagaaaagaagatcactcaatggttagagacaaagggcgtagaacgattaaaaaggatggcgatttcgggcgatgattgcgttgtaaaaccgatagacgatagatttgccaacgctctattagccctgaacgatatgggtaaagtacgcaaagatatcccccagtggcagccatcaaaaggatggcatgactggcaacaagttccattttgcagccatcactttcatgagttgataatgaaggacggcagaaagctagtagtcccatgtcgaccccaagacgaattaataggcagagcaagaatttctcaaggagctgggtggtcgttaagagaaactgcctgtttgggtaaggcttatgcacagatgtggtcgcttatgtactttcatcgaagagaccttcgacttgccagtaatgcaatatgttccgcagttcccgttcattgggttccaacaagcaggactacgtggtctatacacgcccaccatcagtggatgacaacagaggatatgttaacggtctggaacagagtctggatagaagataacccttggatggaggacaaaaccccggtaacgacatgggaaaatgttccatatctcggtaaacgcgaagatcaatggtgtggatcgctgataggtctcacatctagagcaacctgggcacagaatattcctacagcgattcaacaagtccgatcattaatcggtaatgaagaatttttagactatatgccttcgatgaagcgattccgaaaagaggaagagtcggaaggagccatctggtag

SEQ ID NO: 23458 - RNA, 9873 nt, synthetic construct
  misc_feature 1..9873: note = derived and/or modified CDS sequence (opt6) from DENV-3__EU529691__SS-prME
  source 1..9873: mol_type = other RNA
acttcgttatgcttgatgatgatcctaccagccgcattagcatttcatcttacatcgcgtgacggagaaccgcgaatgatagttggcaaaaacgaacgaggtaaatcattattattcaaaacggcttcaggaattaatatgtgtacactaattgcaatggacttaggagaaatgtgtgacgatacagtaacatataaatgtccccacatcaccgaagtagaacccgaagatatagactgctggtgcaacttaacctccacatgggtaacttacgggacctgtaatcaagctggagaacatcgtagagacaaaagatccgtcgcactagcacctcacgtaggtatgggactagacacacgtacacaaacttggatgagtgcggaaggagcgtggagacaagtcgaaaaagtggaaacttgggctttaagacaccccgggtttacaattttagccctcttcctagcgcactatataggaacctctcttacacaaaaagtggtaatctttatactattgatgcttgttactccaagtatgacgatgaggtgtgtaggtgttggaaatagagattttgtagaaggattaagtggagccacatgggtcgatgtagtactcgaacatggtggttgcgtcacaaccatggccaaaaacaaaccaacccttgatatcgaactacagaaaactgaagcaacccaacttgcaactcttcgcaaactctgtatagaaggaaaaatcacaaatataacaacagacagcagatgccccacccaaggagaagcggttttaccagaagaacaagatcaaaactatgtctgcaaacatacctatgtggaccgcggatggggaaatggttgcggtctgttcggtaaaggcagtcttgttacatgtgctaaattccaatgtctagaacctattgaaggaaaagtcgtgcagtacgaaaaccttaaatacacagtaataatcaccgtccatacaggcgaccaacatcaagtcggcaatgagacccagggagttacggcagaaatcaccccacaagcgagcactactgaagcgattctcccagaatatggtaccttgggcctagaatgtagcccacgaacgggattagatttcaacgaaatgatattacttacaatgaaaaataaagcatggatggttcacaggcaatggtttttcgacttaccactgccatggacatctggtgcaaccactgaaactcctacttggaaccggaaagaactattagtcacattcaaaaatgcccatgcgaagaagcaagaggtagttgtactaggttcgcaagagggtgcaatgcatacagccctaaccggagccacagagatacaaaacagcggaggaaccagtatcttcgccggtcatctgaagtgtcgtctcaagatggataagttagaactaaaaggcatgagttatgctatgtgcacaaatactttcgtactaaagaaagaggtttctgaaacccaacatgggacaatcctgataaaagtggaatataagggcgaagatgcaccttgtaaaatcccgtttagtaccgaagacggccaaggtaaagcacactctggacgattgattacagccaacccagtagttacgaagaaagaagaaccggtgaatatagaagcagaacctccatttggagaaagcaacatcgtaattggaataggagacaacgcccttaagattaattggtacaaaaaggggagtagtattggaaaaatgttcgaagcgacagctaggggagcacgccgtatggccatcttgggcgatacagcgtgggacttcggaagtgtcggcggcgtgttaaattcactaggtaaaatggtccatcagatcttcggtagtgcgtatacagctttgttcagtggagtatcatgggtgatgaaaatcggcatcggagtactactgacgtggatagggcttaactctaaaaacacaagcatgtctttttcttgtattgctgtaggaataataacgctgtacctgggtgctgtcgtacaagctgacatggggtgtgtgataaattggaagggtaaagaacttaagtgcggcagcggtatttttgtaacaaatgaagtccacacatggacagaacaatacaagtttcaggcagactcaccaaagagattggcgactgcaatagctggagcttgggaaaacggtgtctgtggaataaggtcaacaacgcgaatggaaaatctactctggaagcagattgccaacgaacttaactacattctatgggaaaacaacataaagttaacagtcgttgtaggtgacataataggagtgttagaacaaggaaaacgaacactaacaccccagccgatggaattaaagtactcatggaaaacctggggaaaagctaaaattgtgactgccgagacacagaactcgtcgttcattattgacggaccaaataccccagagtgcccaagcgcctccagagcttggaatgtatgggaagtggaagactacgggttcggggtctttacaactaatatctggctcaaactaagagaggtttatacacaactttgtgatcaccgattaatgtctgcagcagtaaaagacgaacgcgcagttcatgcggatatggggtactggatcgaaagccagaaaaacggtagttggaaactcgagaaagcatcattaattgaagttaagacatgtacatggccaaaatcccatacactatggagcaacggagtcctagaatctgatatgataatacctaagagtcttgcaggacctatatctcagcataatcatagaccaggctatcatactcaaaccgcaggcccttggcacctgggaaaactcgaattagacttcaactactgcgagggcacaacggtagtaataacagaaaactgtggaaccagaggcccctcacttcgaaccaccactgtatcggggaaattaatccacgaatggtgttgccgatcgtgtacactccctccacttcgttatatgggagaagatggatgctggtacggcatggaaatcaggccaatatcagaaaaagaagagaatatggtaaagtcactcgtctctgctggaagtggaaaagtggacaattttaccatgggagtcttgtgtcttgccatactattcgaggaagtaatgagaggaaagttcggcaagaaacatatgatagccggagtattctttacgttcgttctattattatccgggcaaataacatggagagacatggcacataccttgatcatgattggtagcaacgctagcgaccgaatgggcatgggagtcacgtatctcgccttaatagccacttttaaaatacaaccatttttggcattgggattctttctacgtaaattgacaagtagagaaaatctactgttgggagtagggctcgccatggcgacaacactacagttaccagaagatattgagcagatggcaaatggaatcgcattaggtcttatggccctcaaattgattacacaatttgaaacctaccaactatggacagcacttatatcacttacatgttctaatacaatgtttactctgaccgtcgcttggaggacagcgaccttgattttagctggagtaagtttattaccggtatgtcaaagttcatctatgagaaagactgattggttacctatggcagtagccgcaatgggagtacctccactacctctgttcatattcagtttaaaagatacgctgaaacgaaggtcctggccattaaatgaaggtgtcatggcagtcggtctagtgtccatattagcctcctcattactacgaaatgacgtacccatggcaggacccttagtagccggtggtcttttaatagcgtgctatgtaataactggaacaagtgctgatttgacagttgaaaaagcggccgacattacttgggaagaagaggccgaacaaacaggtgtatcacacaacttaatgataacagtggatgacgatggtacaatgagaataaaggatgatgaaactgaaaacatcttaactgtcttgcttaaaaccgcactattgatagtaagtggcgtatttccttattcaatacccgcaaccttactggtatggcacacatggcaaaaacaaactcagcgatctggtgtactatgggacgtaccatctcctccagaaacgcaaaaagcagaacttgaagagggagtataccgaattaaacaacaaggaatttttgggaagacacaagttggagtaggcgtacaaaaggaaggtgtatttcacactatgtggcacgtaactagaggggcagtactaacttacaatggaaaaaggctggaacccaattgggccagcgtgaagaaagatttgatttcatacggtggtggatggagactaagtgcacaatggcagaaaggagaggaagttcaagtaattgccgttgaaccaggcaaaaatcccaaaaactttcaaacaatgcctggaacattccaaaccacaacgggtgagataggtgccattgcactagactttaaacccggtactagcggatctccgataataaatagagagggtaaggtcgtgggcctatatggaaatggtgtagttactaaaaatgggggatacgtatcgggcatagctcaaactaatgccgagccggatggacccacccctgagttagaagaggagatgtttaagaaaagaaacttaacaataatggatttacacccaggaagtggtaaaacacgaaaatacctaccggcaatcgttcgggaagcaataaaacgaaggctgagaactctaattctcgctccaacgagagtagtagcagcagaaatggaagaggcattgaagggcctaccgataagatatcagaccaccgcaacaaagagcgaacacactggaagagagattgttgatctaatgtgtcatgcaacatttacaatgagactactatctcccgtgagagtacccaactataacttgattataatggatgaagcacattttacagaccccgcatctattgctgccaggggatatataagtactagggtgggaatgggagaagcggccgccatatttatgacggcaactccaccaggtacagctgacgcgtttccacaatctaacgcaccaatacaggatgaagagagggacattcctgagcggtcctggaatagcggtaatgagtggattaccgacttcgctgggaagaccgtatggttcgtaccatcaattaaagccggcaacgacatagctaactgtttaaggaaaaatggtaagaaagttatacaactgtctagaaaaacttttgataccgaataccagaaaacaaaactaaatgactgggattttgtcgtcacaactgatataagcgagatgggtgccaactttaaagcggatcgagtgatagacccaagacgttgtctaaaacccgtaatactaactgatggtcccgagagggttattttagcaggtcccatgccagtcaccgccgcaagtgctgctcaaagacgaggacgtgtaggacgaaatcctcaaaaagagaacgatcagtatatattcacagggcaaccactaaataacgatgaggatcatgcgcattggacagaagcaaagatgttactagataatattaacacaccagagggtataatacccgctctgttcgaacccgaacgagaaaagtctgcagcaatagatggggaatatagattgaaaggagaatcaagaaaaactttcgtagagttaatgaggaggggagatttacctgtatggctagcgcataaagtggcctcagaaggaataaaatatactgatagaaagtggtgtttcgacggtcaacgcaacaatcaaatactagaagagaatatggacgttgagatatggacaaaagaaggcgagaagaagaaattgaggcctaggtggctagacgccagaacctatagcgatccactagcacttaaagaatttaaagatttcgctgcaggacgtaaaagtattgctttagacttagtcactgagataggaagggtaccatcacatctcgcacacaggactagaaacgcattagataacttggtgatgttacacacaagtgaacatgggggtagagcttatcggcatgcagtagaggaattgccagagactatggaaactcttttactcttaggactaatgatactgctgaccggaggcgcaatgctctttttaattagtggtaagggaataggtaaaacttcaataggactgatctgtgtaattgctagcagtgggatgctatggatggctgaaatacccctacaatggattgcgagtgctatcgttttggagttctttatgatggttctgctaataccagaacccgaaaagcaacgaactcctcaagacaaccagcttgcatatgtagtaataggcattctcacattagccgctattattgcagcaaatgaaatgggactcttggaaactactaaacgcgatcttggaatgtctaaagaacccggggttgtcagtccaacatcgtacctagatgtggatttacatccagcgagtgcctggacgctttacgccgtagctactacagtaataacgcctatgttaaggcacacaattgaaaactccaccgcaaacgtttcactagctgcgattgctaaccaagcagtcgtgttaatgggactcgacaaaggttggccaatttcaaagatggacctgggcgtgcctctattagcactaggttgttattctcaagttaatcctttaacactcactgcagccgtactattgttgattactcattacgctatcatagggcccggattacaagctaaagcaacaagagaggcgcagaaaagaaccgctgcagggattatgaaaaatccaacggtagacggtattatgacaattgatctagatcctgtaatatatgattcgaaatttgagaaacaactaggtcaggttatgctcttagtcctgtgcgcagttcaattactactaatgaggacgtcctgggcactttgtgaagccctgacattagcaacaggtcctattacaacactgtgggaaggcagtcctggaaagttttggaatacgaccatagcagtatcaatggcaaacatatttagagggagttatttggcaggagccgggttagccttctcaataatgaagtcagtcggaacaggcaaacgagggactgggtctcaaggggagacattaggtgagaaatggaagaagaaactaaatcaattatctcgaaaagagttcgatttatataagaaatctgggataactgaagttgatcgaacagaagctaaggaaggtctaaaacgtggcgagacaacacatcatgctgtctcaagaggaagtgcaaaattacaatggttcgtcgaacgaaacatggttataccagaaggccgagtgatagatcttggatgcggacgaggaggctggtcgtattattgcgccggattgaagaaagtcaccgaagtaagaggttacaccaagggaggaccgggccatgaggaaccagtcccaatgagcacatacggttggaatatcgttaagttaatgtctggcaaagatgttttctatctacccccagagaagtgtgacacacttttgtgcgatataggagaatcgtccccgtcaccgacagtcgaagaaagtagaacaatacgtgtgttgaaaatggtagaaccttggctgaagaataatcaattttgcattaaagtcctcaatccctatatgccaacagtaatagaacacttagaaaggttgcaaagaaaacacggcgggatgttagtcaggaacccactttcgagaaattcaacacacgaaatgtattggatctcgaacggaacaggtaatatagtagcgagtgtcaatatggtgtcaaggctattattaaatcgatttactatgacacataggcggcccacgatagaaaaagatgtagatttgggtgctggtacccgtcacgtgaatgctgaacctgaaacacccaatatggacgtaataggggaaagaataaaacgcattaaagaagaacataattcaacatggcactatgacgatgaaaacccttacaagacatgggcataccatggctcatacgaagtaaaagccacaggaagcgcatcaagcatgataaatggtgttgtcaaattgttaactaaaccctgggacgtcgttcctatggttactcaaatggcaatgaccgataccacaccgttcggtcagcaaagagtcttcaaagaaaaggttgatacaagaacaccgagatcaatgcctgggacgcgtagagtaatgggtataacagctgaatggctttggagaacattaggtcggaataagaaacctagactctgtacgagagaggagttcacgaagaaagttcgaacaaacgctgccatgggggcagtctttacagaggagaatcaatgggactctgctaaagcagcagttgaagatgaagatttctggaaacttgtcgatagagaaagggaactacataaattaggtaaatgtggaagctgtgtatataacatgatgggaaaaagagagaagaaattgggggagttcggaaaagcgaagggtagtagagctatatggtacatgtggttgggcgcaagatacttagaatttgaggcactaggttttctaaacgaagatcactggtttagtagggaaaattcttattccggagtagagggagagggacttcataaattgggttacatattgagggatatttctaagatccctggaggagcaatgtatgcagacgatactgcgggatgggatactcgtataactgaagatgatttgcataatgaagaaaagattacgcaacaaatggaccctgaacatagacaacttgcaaacgccatattcaaattgacttaccaaaataaagttgtaaaagtgcaaaggccaaccccaacaggaaccgttatggatataatatctaggaaggaccaacggggatcaggtcaagtgggaacctatggtttaaataccttcacaaacatggaagcacaactaatacgtcaaatggaaggggaaggcgtgttgtcaaaggcggacctagaaaatccccatttaccggagaagaaaatcactcagtggttagaaactaaaggtgtcgaacggttaaaaagaatggcaatatccggcgacgattgtgtagtaaaaccaatagatgaccgattcgcaaacgctctcctagctcttaatgatatgggtaaagtacggaaagatattccgcagtggcaaccctccaaaggatggcatgattggcaacaagtaccattttgctcccaccattttcatgaattaataatgaaagatggtcgtaaattagttgtgccgtgtcgcccacaagacgaattaatcggacgcgcaagaataagccaaggagctggttggagcttacgtgaaacggcctgtctcggtaaagcctatgctcaaatgtggtctctaatgtattttcataggcgagacctacggttagcatcgaatgcaatttgtagcgcggtaccagtgcactgggttccaacgagcaggacgacatggtccatacatgcccatcaccaatggatgacaacagaagatatgctcactgtttggaaccgagtttggattgaggataatccatggatggaagataaaactccggtgactacatgggagaacgtaccgtacttagggaagagagaagatcagtggtgtggctcgttaatagggctaacatcgcgtgcgacatgggctcagaacatacccacagccattcaacaagtaagaagtctaataggcaacgaagagttcttggactacatgccaagcatgaagaggtttagaaaagaagaagagtcagagggagccatttggtga

SEQ ID NO: 23459 - RNA, 9873 nt, synthetic construct
  misc_feature 1..9873: note = derived and/or modified CDS sequence (opt6) from DENV-3__EU569689__SS-prME
  source 1..9873: mol_type = other RNA
acgagcttgtgcttgatgatgattctacccgctgcactagcttttcacttgacttcaagggatggagaacctcgaatgatagttggcaaaaatgaacgcggcaaaagtcttctatttaaaactgcatcaggaattaacatgtgcacgttaatagcaatggatttaggggaaatgtgtgatgacacagttacatataaatgcccgcacataacggaagttgaaccagaggatatcgactgttggtgtaatctgacttcgacttgggttacttacggtacctgtaatcaagctggtgaacaccgacgcgataaaaggtccgtagctttagcaccccacgtaggaatgggattagacactaggacccaaacatggatgtcggctgaaggagcatggagacaagtagaaaaagttgaaacatgggcccttagacacccaggatttacaatactagcccttttcttagcccactacataggaacaagcctaacacaaaaagttgtaatattcattttactcatgttagttactcctagtatgacaatgagatgcgtcggcgtgggaaatcgtgactttgtcgaaggattaagcggggccacatgggtcgacgtagtgctagaacatggagggtgcgtcacaactatggccaaaaacaaaccaacactcgatatagaactgcagaaaaccgaagcaacccaacttgccacgttacggaaattatgtatcgaaggtaaaataactaatataacaacagattcaaggtgtccaacccaaggagaagcggtgctgcctgaagaacaagatcaaaactatgtttgcaaacatacgtatgtagatcgaggatggggaaacggatgcggactattcggaaaaggttcacttgtcacttgtgcaaaatttcaatgcctggaacctatagaaggaaaagtcgtacaatacgaaaatctaaaatatacagtgattataacggttcacacaggagatcaacatcaagtaggcaatgaaactcaaggggtaaccgctgaaattacacctcaagctagcaccacagaggcaatattaccagaatatggtactctaggattagaatgtagcccgagaaccggattggacttcaacgaaatgatattactaacaatgaaaaataaagcatggatggtgcacagacaatggttctttgacctacccctgccgtggacgagtggagcgacaacagagacgcctacctggaatcgaaaagaactattggtaactttcaaaaatgcccacgctaagaaacaagaagtagtggttttaggttcgcaagagggcgccatgcatacagcattaacaggagcaacagagatacaaaattcaggaggaacaagcattttcgccggtcatttaaaatgcagattgaaaatggacaaattagagctgaaaggaatgtcgtacgcaatgtgtactaatacattcgttctaaagaaagaagttagcgagactcaacatggaacaattttgatcaaagttgaatataaaggcgaggacgtcccttgtaaaataccattttccactgaagacggtcaaggcaaagcacataacggaagactaataacggcaaaccctgtagttactaagaaagaggaaccagtcaatatagaagctgaacctccttttggtgaatcaaacattgtaataggcattggggataacgcgctcaaaatcaattggtataagaaaggatcaagtattgggaaaatgttcgaagctaccgctcgcggagcacggagaatggcaatacttggcgatacagcatgggatttcggctcagtcggtggggtactaaatagtttgggtaaaatggtacatcaaatctttgggtcggcctatacagcacttttcagtggtgtctcttgggtgatgaaaataggtattggtgtattactgacatggataggccttaatagcaaaaacacaagtatgtctttttcatgtatagccataggaataataactttatacttaggagctgtcgttcaagcagatatgggatgcgtgataaattggaaaggaaaggagttaaaatgtgggagtggaatttttgttacaaatgaagtacatacttggaccgaacaatataaattccaagcagatagtcctaaaagactagcgaccgcaatagcgggcgcttgggaaaatggcgtgtgcggcattcgatccactaccaggatggaaaatttattatggaaacagatagccaatgaactaaactacattctttgggaaaataatattaaactaactgtagttgttggagatatcataggcgtcctagaacaaggaaagaggacattaacaccacaacctatggaactaaaatacagctggaaggcttggggtaaagctaaaatcgtaacagcagaaacacaaaactcttcttttataatagacggccctaacacacctgaatgtcctagtgctagtagggcatggaatgtctgggaagtggaagattacggatttggagtctttactaccaatatatggttaaaattacgtgaggtttacacacaactctgcgatcaccgattaatgtcagcagcagttaaagatgaaagggcagtacacgctgatatgggttactggattgaaagtcagaaaaatggcagctggaaactagaaaaagcgagcttaatcgaggtgaaaacttgtacttggcccaaatcccatacactttggtctaacggggtcttagaaagcgacatgataataccaaaatccctagctggaccaatatctcaacacaactataggccagggtaccacacacaaactgcaggaccatggcatctgggaaagctggaactggattttaattactgtgaaggcactactgttgtaataacagaaaactgcggtacacgcggacctagtttaagaacaacaacagtctcggggaaattaatacatgaatggtgttgtcgaagttgtaccctgccgcccttacggtatatgggagaagacggttgctggtatggtatggaaattagacccataagtgaaaaagaagaaaacatggtgaaatccttagtatccgcaggtagtggagaggtcgataattttaccatgggggtcttatgcttagcgatactatttgaagaagtaatgcgtggtaaatttgggaagaaacacatgattgcaggagtcttctttacttttgtgctccttttaagcggacaaataacctggcgggatctagcccacactctaataatgatcgggagtaacgcaagcgataggatgggaatgggagtaacctacctagcattaatcgcgacttttaaaatacaaccctttttagcgttgggattcttcttgcgaaaattaacctcaagggaaaatttgttgctaggggtagggcttgctatggcgactacacttcaactaccagaagatatagaacaaatggccaatggtatcgcccttgggcttatggccttaaaactgataacacaatttgaaacatatcaactatggacagctttaatatcgcttacatgtagtaacacaatattcactctcacggtagcttggcgcaccgcaacactcattttggctggagtcagcttactaccagtgtgtcaaagttctagtatgcgaaaaacggactggttaccaatgacagtagccgcaatgggtgttccaccacttcccctcttcatatttagtttaaaagacacactgaagcgccgatcttggcctttgaatgagggcgttatggccgtaggtttagtgtctattttagctagtagcttactgaggaatgatgtcccaatggcagggcccttagtagccggtggtctattgatcgcttgctacgtcataacaggtacaagtgctgatcttacagtagagaaagcggcggacgtgacatgggaggaggaagcagaacagaccggagtaagccataacttaatgataactgtagatgatgatggaacaatgaggataaaagatgatgaaacagaaaatatcttgacagtattattgaagactgcgctacttattgtctcaggtatctttccctatagcataccagctacattacttgtatggcatacttggcaaaaacaaacgcagcggagtggcgtactctgggatgtgccgtcgccgcctgaaacacagaaagctgagttagaagagggtgtctacagaattaaacaacaaggtatcttcggaaagacgcaagtaggggttggagtgcagaaggaaggagtctttcatacgatgtggcacgtcacaagaggagctgtcctcacctacaacggaaaaaggctagagcccaactgggcctctgttaagaaagaccttatctcatacggaggcgggtggagattaagcgcccagtggcaaaaaggtgaggaagtccaagtcattgcagtggaaccaggtaaaaatccgaagaattttcagacaatgcccggcacgttccaaacgacaacaggtgagataggagctatagctttggatttcaaaccaggtacaagtgggtcacctattataaatagagagggtaaggtcgtaggtctatacgggaatggagtagttacaaagaatggcggatacgtttcaggaatcgctcaaactaacgcggaacctgatggtccaacacccgaattagaagaagagatgtttaagaaacgtaatttgacaataatggacctacaccccggatcaggtaaaacaagaaaatatctacccgccatagttagagaagctataaaaagaagactccgaacactaatcctagcaccgacgcgtgtagtagcagcagaaatggaagaagcacttaaaggccttccgattaggtatcagacaactgcaacaaaatccgaacatacgggccgcgaaatcgtcgacttaatgtgtcacgctacatttactatgaggttactgtcacctgttcgagttcccaactataacctcataataatggacgaggcacacttcacagaccccgcctctatcgccgcaaggggttatatatcaacacgtgttggaatgggtgaagcggcggccatatttatgacagcaacacctcctggtaccgctgacgccttcccccaaagcaatgccccaatacaagatgaagaaagagacatacccgagcgatcttggaactcaggaaacgaatggatcacagattttgccggaaagacggtttggtttgtaccaagtataaaggcggggaacgacatagcgaattgtcttcgcaaaaacggaaagaaagttatacagctaagccgtaaaacgtttgacactgaatatcagaaaacaaaacttaatgactgggactttgtagttaccactgatattagcgaaatgggagcaaatttcaaggctgatagagtaatagatccaagaagatgcttaaaaccagtaatcttgaccgacggacctgaacgtgtgatattggcaggcccgatgccagtgactgccgcctcggcagcgcaaagaagagggcgtgtcggtagaaacccccagaaagaaaacgatcagtacattttcactggtcaacccttgaataatgatgaggaccacgcacattggacagaggccaaaatgctgttggataacataaatactcctgaaggaataataccggctttattcgaaccagaacgagagaaatctgccgctatagatggagagtatagattaaagggtgaaagtcgaaagacattcgtggagctgatgagaagaggagatctacccgtatggctagcccataaggtggcttcggaaggaataaaatatacagaccgcaaatggtgttttgacggacaacgaaacaatcagattttagaagagaacatggatgttgaaatatggactaaagaaggagagaagaagaaattaagaccccgctggttagatgcaaggacatacagtgacccactagcattgaaagaatttaaggattttgcagcgggtaggaagtccatagctctagaccttgtaacagaaattggaagagttccaacgcatttagcccaccgaacacggaacgccctggacaatcttgttatgttacatactagcgaacatgggggcaaggcttaccgtcatgccgtagaagaacttcctgagacaatggaaacacttctgctacttggcctaatgatattattaacgggaggcgcaatgttattcctaatatccggtaaagggattggcaagacaagcataggtttaatttgtgttatagcctcatctggaatgctatggatggctgaaatacccctacaatggatagcatcagctatagtcttagagtttttcatgatggttctacttatacccgagcccgagaaacaaagaacccctcaagacaatcagttagcttatgtcgtaataggaattttgaccttagccgcaatcatagccgctaatgaaatggggctattggaaactacaaaaagagatctagggatgagtaaagaaccgggagttgtgtcaccaacaagctacttggatgtcgacttgcatccagcatccgcatggacattatacgctgtagctacaactgtaataactccgatgttaagacatactatagaaaattctacagcgaatgtaagtctagcagccattgcgaatcaagcagtcgtgttaatgggattagataaaggctggcccataagtaaaatggacttaggagttcctttacttgcgctaggctgttattcacaagtaaatcctttaacattgaccgccgctgtcctgcttttgattactcactacgcaattataggcccaggactccaggcaaaagcgacgcgagaagcccagaagcggaccgcagcaggcatcatgaaaaacccaacggtagacggaattatgacaattgacctcgaccctgtcatttatgactcaaaattcgaaaaacaacttggacaagtaatgctcttagttttgtgtgctgtacaactattactcatgagaacgtcctgggctctttgcgaggcactgacgttggctaccggaccaataacaactttatgggaagggagtccaggcaaattttggaacacgacgattgccgtaagcatggctaacatatttcgggggtcttatctcgccggcgcaggtttagctttttctataatgaaaagtgtaggaacgggaaaacggggaacgggatcgcaaggtgaaacattaggagaaaaatggaagaagaaattaaaccagctaagtaggaaagaatttgatctatataagaaaagtgggataacggaggtagaccgaacagaagcaaaagaagggctaaaacgaggagaaataactcatcatgctgtgtcaagaggatctgctaagttgcaatggtttgtcgagagaaatatggttattccggagggacgagtaatagatttgggatgtgggcgcggaggatggagctactactgtgctggattaaagaaagtaacagaagtaagaggttacacgaagggcggaccgggccatgaagaacctgtccccatgtcgacttatggatggaatattgttaaattaatgtcgggaaaagatgtattttatctgccgcctgaaaaatgtgatactttactatgcgacatcggggagagtagtccatcccccaccgttgaagaaagccgcacaattagagtacttaaaatggtagaaccatggcttaaaaataaccaattctgcataaaagttctaaatccatacatgcccaccgttatagaacacctagagagattgcaaagaaagcatggcggtatgttggttagaaatcctttgagtcgtaattcaactcatgaaatgtactggatatcaaatggcactggaaatatagtagcctctgtcaatatggtatccagactgcttctcaacagatttacaatgacccacagacgtccaacaattgaaaaggatgtagatttaggtgcaggaaccagacacgtcaatgcagagccggaaactccgaatatggacgtgataggagagagaattaaacgtataaaagaagaacacaacagcacttggcattacgatgacgaaaacccatacaaaacttgggcgtaccacggaagctacgaagtgaaagccacaggatccgcgagcagtatgattaacggcgttgtgaaactacttacaaaaccgtgggacgtagtacctatggttactcaaatggcaatgaccgacacgactccattcggacaacaaagggtatttaaggaaaaagttgatacaaggacaccaaggagcatgcctggaacaagacgagtaatgggtataacagcagagtggctatggaggactttaggtcgtaacaaaaagcctcgactatgtactagagaagaatttaccaagaaagtccgaacaaacgcagccatgggtgcagtgttcacagaagaaaatcaatgggattcagcaaaggcggctgtcgaagacgaggatttttggaagttagttgatagagaaagagaattacacaagttgggcaaatgcggttcgtgcgtgtataatatgatgggaaagagagagaagaaattgggagagtttggaaaagccaagggaagccgagctatctggtatatgtggctcggggctaggtatttggaatttgaggcgcttggcttcttaaatgaagatcattggttttcacgcgaaaacagctactctggagttgaaggggaaggactccataaacttggctatatccttcgtgacataagtaaaataccaggaggagctatgtacgcagacgacaccgcgggctgggacacaagaattacagaggatgatctacacaacgaagagaaaataacccagcaaatggatccagaacatagacaattagcgaatgccattttcaaacttacatatcaaaataaagtggtcaaagtccaaaggcccacgcccacgggtacagtaatggatatcatttcacgaaaagaccaaagaggcagtggtcaagtcgggacctacgggctaaacacttttactaatatggaagcgcaattaattagacagatggaaggagagggtgtgttatccaaagcggatttagaaaacccacacctaccggagaagaaaattacccaatggttagaaactaaaggtgttgaacgactgaaaaggatggcaataagcggtgacgattgtgtcgtaaagcctatcgacgaccgatttgccaatgcattattagcactaaacgacatgggaaaagttcgaaaagacattccacaatggcaaccgtcgaaaggatggcatgattggcaacaagttcccttttgttcgcaccactttcatgaattaattatgaaagacggcagaaagctagtcgtaccatgtcgaccacaagatgaattaatcggtagagccaggataagtcaaggagcgggctggtccttacgcgaaacagcgtgccttggaaaggcgtatgcccaaatgtggtcattaatgtactttcatagaagggatctgaggctcgctagtaatgccatatgctcggcggtaccagtacattgggtaccgacaagtagaacaacctggtccatccatgcgcatcatcaatggatgacgacggaagatatgctaacagtatggaacagagtatggatagaggacaatccttggatggaggataaaactcctgtcacaacatgggaaaatgtgccctacttagggaaaagggaggatcaatggtgcggttcattgataggactcacaagtagagcaacatgggctcaaaatatacctacggctattcaacaagttagatcgttgattggaaatgaagagttcctcgactacatgccaagtatgaaacgtttcagaaaggaagaagaaagtgagggtgctatatggtaa

SEQ ID NO: 23460 - RNA, 9873 nt, synthetic construct
  misc_feature 1..9873: note = derived and/or modified CDS sequence (opt6) from DENV-3__EU482614__SS-prME
  source 1..9873: mol_type = other RNA
actagcctctgtttgatgatgatactcccagcagctttggcttttcacctaacaagtcgcgatggggaaccacgaatgattgtaggcaaaaatgaaagaggaaaatccttactatttaaaacagcaagcgggattaatatgtgcacactcattgcaatggatttaggagaaatgtgtgatgatacagtaacctacaaatgtcctcacattacagaagtcgagcccgaggacattgactgctggtgcaacttaacttctacttgggttacttatggtacgtgcaaccaagcaggagaacatcgaagagataaacgaagtgtcgcgttagcaccacacgtagggatgggtttagacacccgaacgcaaacatggatgtctgccgagggagcatggcgtcaagtagaaaaagttgaaacatgggcgcttagacatcccgggtttactattctagcgctgtttctagcacattacataggtacaagcctaacgcaaaaagtcgtaatctttatactcttgatgttagtaactcctagcatgaccatgagatgcgtcggagtcggaaatcgcgattttgtcgaaggactatccggagcaacttgggtagatgtagtgttagaacacgggggatgcgtgacaacgatggccaaaaataaaccgacactagacatagaacttcagaaaacggaagcaacacaactcgctaccctgcgaaaactatgtatagagggaaaaataaccaacataactacagattcccggtgtccgacacaaggagaagctgttctaccggaagaacaagatcaaaactatgtatgtaaacatacttatgtggatcgtggatggggtaacgggtgtggactgtttggaaaaggaagtttggttacgtgtgctaaatttcaatgtttagaaccgatagaaggtaaagtcgtccaatacgagaatttaaaatatacagtaatcataacggtacatactggggaccaacaccaagtaggtaatgaaactcaaggtgtgacagctgaaattactccacaagcctcaaccaccgaagccatattacctgaatatggtaccctaggattagaatgttcaccaagaactggactcgacttcaatgaaatgatcctattaacgatgaaaaataaagcatggatggtacatagacaatggttcttcgatctgccactaccatggacttcgggtgcaacaacagagacccctacatggaaccggaaagaattattagtcacattcaaaaacgcacatgctaagaaacaagaagttgtagtgctaggatcacaagagggagccatgcacacagcattgactggggcaaccgaaatacaaaatagcgggggaacttcaatatttgcaggacatttaaaatgtcgactaaaaatggataaactagaattgaaaggaatgtcttatgcaatgtgcactaacacctttgtcctaaagaaagaggtaagcgaaacgcagcatggaaccatacttattaaagttgagtacaaaggagaagatgtaccttgcaaaattccattttcaacagaagacggacaaggaaaggcccataatggcagattgattactgcaaatccggtagtaaccaagaaagaggaaccagttaatatagaagcagaaccaccttttggagaaagtaatattgttatcggaatcggagataacgcactcaaaattaactggtacaaaaaggggtcttctataggtaagatgttcgaggcgacagcacgtggagccagaagaatggctatactgggggacacagcttgggatttcgggtcggtcggtggggtattaaatagcctaggtaaaatggttcaccaaatattcggtagcgcatacacagctcttttctctggcgtctcctgggtgatgaaaatcggaataggagtactccttacttggatcggcctaaattctaaaaatacctcgatgagcttcagctgcatagcaattggaataattaccttgtatctaggcgccgtagtacaagcagatatgggttgcgttataaattggaaaggaaaagaacttaaatgcggaagcggtattttcgtcacaaacgaagtgcatacctggactgaacaatataaattccaagcagatagccctaaaagactagctactgctatagctggcgcatgggaaaacggtgtttgtggcataaggtcaaccacaagaatggaaaatttgctatggaaacaaattgcgaacgaattaaactacatcttatgggaaaataatatcaaacttacagtggttgtcggtgacataattggagtccttgaacaaggtaaacgaacacttacaccacagcctatggaattaaaatatagttggaaaacatgggggaaggcgaaaatcgttactgccgagacacaaaactcgtcatttataattgatggaccaaatacaccggaatgcccctcagcaagtagagcatggaatgtttgggaagtggaggattacggctttggtgtctttacgacaaatatatggctaaagctaagagaagtatacacgcaattgtgcgatcatcgattaatgtccgcagctgtaaaagatgagcgagcggtacacgctgacatgggctattggatagaatctcaaaagaatggctcgtggaaactagaaaaagcgtctcttattgaggtaaaaacttgtacatggcccaagagtcacactctttggtcaaatggcgtactagaatcggacatgataattcccaaatcattagctggtcctataagccagcataactacagaccagggtaccatacacaaaccgcaggtccctggcatctgggaaaattggaactagatttcaattattgtgaaggaacgacggttgtgataaccgaaaattgtggtacacgagggccttcccttaggacgaccacagtctcagggaaattaatacatgaatggtgttgtaggtcttgtacattacccccactaaggtacatgggagaagacggatgttggtatggaatggaaattcgaccaatttcagagaaagaggaaaatatggtcaagtctcttgtctccgcagggtcaggagaggtggacaatttcactatgggagtattatgtctcgcaattttatttgaggaagtaatgagaggtaaatttggcaagaaacacatgatagcaggagtattctttacttttgttctcctactatcaggccaaataacatggagggatatggcccataccctaataatgataggaagcaatgcaagcgacagaatgggtatgggagtgacttatttagccctaatagccacttttaagatccaaccatttctggctttaggattctttctcaggaaactgacgagccgagaaaatttgcttttgggagtgggattagctatggcaaccacactgcaactaccagaagatattgaacaaatggccaatgggatagcactaggattaatggccttaaaactaataactcagttcgaaacttaccaattatggacagccttaatatctttaacctgctcgaatacaatctttaccctgacagtcgcatggagaacagcaaccttaatattggccggtgtttccttgttgccagtttgtcaaagctcgagtatgagaaaaaccgactggttaccgatgaccgttgcagcgatgggtgttccacctttaccactattcatattttctcttaaagacacactcaaacgaagatcttggcctttaaatgaaggtgtaatggcagtaggcttagtctcaatcttggccagcagccttttacgaaacgatgtgccaatggctggccctttagttgccggcgggctattaatagcatgctatgtgatcacgggtacgtctgccgacctgaccgtagagaaagctgctgacgtaacttgggaagaggaagctgaacaaactggagtatcacataacctaatgataacagttgatgatgacggtaccatgagaattaaagacgatgaaacagagaatatattaacagtattgttgaaaacggctcttttgatagtctccggaatcttcccatatagcattcctgcaacgctgctggtctggcatacatggcaaaagcaaactcagcggagtggagtactctgggacgttcctagtccacccgaaacacagaaagcggaactagaggaaggtgtatacaggatcaaacagcaaggcatttttggtaaaacacaagtcggtgtcggagtacaaaaggaaggagtttttcataccatgtggcatgtaactaggggtgccgtcttgacacataatgggaagagactcgaaccgaattgggctagtgtcaaaaaggacctaataagctatgggggcggatggcgcttaagtgcacagtggcaaaaaggtgaagaagtccaagttatcgctgtagaaccaggtaagaaccccaaaaactttcaaacgatgccaggtacctttcaaactacaacaggagaaattggagcgatagcacttgatttcaaaccaggcacctccggatcgcctatcataaacagagagggcaaagtcgtgggcctgtacgggaatggagtagtaaccaaaaatggcggatatgtcagtggcatagctcaaacaaatgctgaaccagacggaccaacgcctgaactggaggaggagatgtttaagaaacgtaacctaacgattatggatttacaccccggttcaggtaaaacaaggaaatacttaccagctatagtacgagaagccataaaaaggaggctaagaaccctaatactcgctccgacaagagtagtcgctgcagaaatggaagaagcactaaagggcttaccaataagatatcagacaacagccactaaatcagagcatactggtagggaaatagtagatttaatgtgtcacgcgacatttacaatgagattgttaagtccagtcagagtgccaaactacaatctaatcattatggatgaagcccattttacagatcctgcatcaattgcggccagggggtatatctcaactagggtgggaatgggagaagcagccgcaatattcatgactgcgacaccaccaggaacggccgatgcttttccccaaagtaatgcgccgatacaagacgaagaacgggacattccagaaaggtcgtggaactccggaaacgagtggataaccgatttcgccggaaagaccgtctggtttgtaccctcaataaaggcgggaaacgacatcgcaaattgcctaaggaaaaatggcaagaaagttattcagctgtcacgcaagacattcgatacagaatatcagaaaactaaactaaatgattgggattttgttgtgacaactgatatatcagagatgggagctaattttaaagcagatcgagttatagacccaagaagatgtctcaaacccgttatactgactgatggaccggagagagtgatattagcaggaccgatgcccgtgaccgcagcatccgccgctcaaagacggggtagggttggaagaaatcctcagaaagaaaacgatcagtatattttcactggccagcccttgaacaatgatgaagatcacgctcattggaccgaagccaagatgctactagacaacataaatacacccgaaggcatcataccagcactgtttgaacctgaaagagagaaaagtgcagcgatcgatggtgaatatcgtctaaaaggggaatcacgaaagacatttgtggaattaatgcgtaggggtgacttaccagtgtggcttgctcataaagtagcgtctgagggtataaagtataccgaccgtaaatggtgtttcgatggccagagaaataatcagatactcgaagaaaatatggatgtagaaatctggactaaggagggagaaaagaagaaactgagaccccgctggcttgacgcacggacgtatagtgatcccttggccttaaaagagttcaaagattttgcagcgggcagaaaatcgattgccctagacctagtaacagaaattggtcgagtcccgtcacacctagcacataggacgaggaacgctctcgacaatttggtgatgctacatacctctgagcatggcgggaaggcttatcgtcatgcagtagaagaactgccagaaacaatggaaacactattattgctcggcctaatgatcctactgacagggggcgctatgctatttcttataagcggaaaagggatagggaagacaagtatagggctaatatgcgttatcgcgtcatccggaatgttatggatggcagaaataccgttgcaatggattgcttcagcaatcgttttagagttctttatgatggttttactaataccggaaccagaaaaacaacggactccacaggacaaccaattagcttatgtagtgataggtattcttacactcgctgccattattgcagctaacgagatggggttattagaaacaactaaaagagacctcggtatgtcgaaagaacccggagttgtttcaccaacttcgtatttagacgtggatttacaccccgcatctgcatggactttatacgcagtagctacgacagtaataaccccaatgttacgccacactatagaaaactccaccgcgaacgtatcattagcagccattgccaatcaagctgtagtattaatgggactagataaaggttggcctatatcgaaaatggacttaggtgtcccgttattagctctgggatgctattctcaagttaatccgctaacgttgacagcggcagtgttactgctcatcactcattacgctattattggccccggactacaagccaaagcaactagggaggcccaaaagaggactgcagcaggaataatgaaaaacccgactgtggatggaataatgactattgatcttgatccagttatctatgacagcaagtttgaaaaacagttaggtcaggtaatgcttctagttctgtgcgcggtacaacttttgctaatgcggacatcttgggcattgtgtgaggcacttacattggcaacgggaccaattactacattgtgggaaggtagcccgggaaaattctggaatactactatagctgtatctatggccaacatttttcgaggctcatatttagctggagcaggattagcatttagcattatgaaatcggtcggcactggaaaaagaggtactggttcacaaggtgagaccctaggagaaaaatggaaaaagaaattgaaccaattaagtagaaaggagttcgacctgtataagaaatcaggtataacagaggtagatcgaacagaagctaaagaaggactaaaacgcggtgagataacacatcatgccgtgtcgcgaggttctgcaaaattacaatggttcgtagaacgtaacatggtaataccagagggcagagtcatagatcttggatgcggtagaggtggttggagttattattgcgcaggtctaaagaaagttaccgaagtacgaggatacaccaaagggggacccgggcatgaggaaccagtcccaatgagtacgtatggatggaacatagtgaaactaatgtctggcaaagatgtcttctatctcccaccagaaaaatgtgatactttactgtgtgatattggagaaagtagtccttcgccaacagtcgaagaatcaagaacgatacgagttttaaaaatggtagaaccatggctcaaaaataaccaattctgcataaaggtcctaaatccatatatgcccacagtgatagagcatttagaacgtttgcagagaaaacatggagggatgttagtgagaaaccctttgagccgtaactcgacacacgaaatgtattggatctccaatggaaccggcaatatagtagcatccgtcaacatggtatcacgcttactattaaatagattcacaatgactcatcgtcggcctaccatagaaaaagacgtcgatcttggagcgggtacaagacatgtaaacgcagaaccagaaacaccaaacatggatgtaattggggagcgtataaaaagaataaaggaggagcacaatagcacatggcattatgatgatgaaaacccttataaaacgtgggcatatcatggcagttatgaggtcaaagccactggatcagcctcaagtatgataaatggagtagtaaaattattaaccaagccatgggacgtagttccaatggtgactcaaatggcaatgacagatacgacaccatttgggcaacagagagtctttaaggaaaaggtggacacacgcaccccacgatcaatgccaggcacaagaagagtaatgggtataacagcggaatggttatggcgaacattgggacgtaacaaaaagcccagactatgtacaagagaggagttcacgaaaaaggtgcgcacaaatgctgctatgggagcggtattcacagaggagaatcagtgggactcagctaaagccgcggtagaagacgaagacttttggaagttagtggacagggaacgcgaacttcacaaactcgggaaatgcgggtcttgtgtgtataacatgatggggaagagagagaagaaacttggagaatttggcaaagcaaaaggctcaagagccatttggtacatgtggctgggagccagatatttagagtttgaagccctaggattcttaaacgaagatcactggttttcccgtgaaaattcttactcaggggtcgaaggggaaggcttacacaaactcgggtatattctgagggatatatcgaaaataccgggcggtgctatgtacgcagacgatactgcgggatgggacacacgtataaccgaagacgacttgcataatgaggagaaaataactcagcagatggatccagaacataggcaattggctaacgcgatttttaaactaacgtaccagaataaggtcgtgaaagtccaacggccaacacctacaggaaccgtcatggatattatatcgagaaaagatcaacgcggttcgggacaagttggtacttacggactaaatacattcacgaacatggaggctcaactaatacgacagatggaaggagaaggagtcctatccaaagccgatctagagaatccacacctaccggaaaagaaaatcacccaatggttggaaacaaagggagtagaaagactcaagcgaatggcgatatccggtgatgattgtgtagtcaaaccaatcgacgatagatttgcaaatgcgctactagcactcaatgacatggggaaagtacgtaaagatatacctcaatggcagccaagtaaaggatggcatgactggcagcaagtcccgttttgttctcaccactttcatgaactaataatgaaagatggacgtaaattagtagtgccatgcaggccgcaagatgaattaataggccgagcgcgaatcagccagggagcgggttggtctctacgtgaaacagcttgtcttggcaaagcgtatgcacagatgtggagcttaatgtatttccatagacgagatctacgtttagcgtcgaatgcaatctgctcagcagtaccagtacactgggtaccaacatcaaggaccacatggagcatacacgcacatcaccaatggatgaccacggaagatatgttaaccgtatggaaccgtgtctggatagaagataacccatggatggaagataagacaccagtaacaacatgggagaatgtaccctacctaggtaaaagagaagaccaatggtgcggctcattaattggtttaacatccagagccacttgggcacaaaatataccaacagccatacagcaagtacggagcctaattggtaacgaagaatttctcgattatatgccatcaatgaaacgttttcggaaagaggaagagagtgaaggtgcgatctggtga

SEQ ID NO: 23461 - RNA, 9873 nt, synthetic construct
  misc_feature 1..9873: note = derived and/or modified CDS sequence (opt6) from DENV-3__EU569690__SS-prME
  source 1..9873: mol_type = other RNA
acttctttatgtttaatgatgatactccccgcagcattagctttccacttaacaagtcgagatggagaaccgagaatgatagtaggcaaaaatgaacgagggaaaagtctcctgttcaaaacggcgagcgggataaacatgtgtactctcatagcaatggatttaggagaaatgtgcgatgacacggtgacgtataaatgtcctcatattacagaagttgaacccgaagacatagactgctggtgcaatctaacatcaacctgggtaacttatggaacatgtaaccaagccggcgagcaccgccgagataaaagaagtgtagcacttgctcctcacgttggcatggggttagacacacgtactcagacatggatgagtgcggaaggcgcttggcgccaagttgaaaaagtagaaacttgggcacttagacatcctggcttcactatattagcactattcctagcacattatattggaacatccttaacacaaaaagtagtaatattcatcctccttatgttagtgacaccttcgatgacaatgagatgcgttggagttggcaatcgagacttcgtcgaaggtctatcgggtgcaacgtgggtagacgtagttttggaacatggagggtgtgtaaccactatggctaaaaacaaacctaccctagatatagaattacagaaaactgaggcaacacaactagcaacattaagaaaactatgtatagaaggtaaaatcaccaatattacgacagattccaggtgccctacacaaggcgaggccgtgttgccagaagaacaggatcagaattacgtctgtaaacatacatatgtagatagaggttggggaaacggatgtggcctattcggaaaagggagcttagtgacatgcgccaaatttcaatgcttggagccgatagagggaaaagtagtacagtatgaaaatttaaaatacacagtgataatcacagttcatacgggagatcaacaccaagttggtaatgaaacacaaggggtaactgctgagattacccctcaagcctcgacaaccgaagcaatactgcccgaatatggaacactcggattagaatgctctcctagaacagggttagattttaacgagatgatactactcacaatgaaaaataaagcgtggatggttcaccgacagtggttctttgacttacctttaccgtggacctctggggctactactgaaacaccaacatggagcagaaaagaactgcttgttacgttcaaaaacgcacatgcaaagaaacaagaagtagtagtcctaggctcacaagagggggcaatgcatacagccttaacaggagcaacagaaattcaaaatagcggaggtacgtctattttcgcagggcaccttaagtgtcggttaaagatggacaaacttgaattgaagggaatgtcctacgcaatgtgtacgaacacgttcgtactaaagaaagaggtatcagaaacgcagcatggcactatactaataaaagttgagtataagggagaagatgtaccctgtaagataccatttagtacggaagatgaacagggtaaagcccataatggcaggttaattacagcgaatccagtggtaaccaagaaagaggaacccgtgaatatcgaagcagaaccacctttcggcgaatccaacattgtaatcggtataggggacaatgcattaaaaataaattggtacaagaaaggttcatctattggaaaaatgtttgaagcgaccgcaagaggagcaaggaggatggcaattttaggggatacggcatgggactttggatccgtcggtggtgttctaaacagtctaggaaaaatggtgcaccaaatatttggatccgcatatacagcactcttttcgggagtgagttgggtcatgaaaatcggaattggagtgttgttaacctggataggcttaaactcgaagaatacaagtatgagtttttcttgcattgcaattggtataattaccttatatttaggtgcagttgtccaagctgatatgggatgtgtaattaattggaagggtaaagaattaaaatgcggttctggaatctttgttaccaacgaagtacacacctggaccgagcaatataagttccaagcagacagcccaaagagattagctacagcaattgctggtgcgtgggagaacggcgtgtgcggaattagatcaaccactaggatggaaaacctattatggaaacaaatcgcaaacgaactaaattacatcctttgggaaaacaatatcaaacttaccgtagtcgtgggagatattatcggtgttcttgaacaaggtaaaagaaccttaataccgcaaccgatggaacttaaatacagttggaaaacatggggtaaagccaaaattgtaactgctgaaacacagaacagctcgtttataatagatggtccgaacacaccagaatgccctagtgcatctagagcatggaatgtctgggaagtagaagattacggcttcggcgtgttcaccactaacatttggctaaaattgagagaagtgtatacacaattatgtgaccataggttaatgagcgctgctgtaaaagatgaaagagcagtacacgccgatatgggctattggatagaatcacagaagaatggcagttggaagttagaaaaagcaagcctcatagaagttaagacgtgtacctggcccaaaagtcatacgctatggagtaacggtgttctagagtccgatatgataattccaaaaagtctagctggtccaatttctcagcataactatcgccccggctaccatacacaaactgcaggaccatggcatttagggaaactagaactggattttaattattgcgaaggtacaacagttgtgattactgaaaattgcggcaccaggggccctagcttaagaaccactaccgtatctgggaaacttatacatgaatggtgttgtcgtagctgtaccctacctccacttagatatatgggagaagacggttgttggtatggaatggaaataaggccaatatcagaaaaggaggaaaatatggttaaaagtctcgtaagtgcaggaagtggagaagtcgataattttacaatgggagtgctatgcttagcgattctctttgaggaggttatgaggggcaagtttggaaagaaacacatgatcgcgggagtattctttacctttgtattacttctatcaggtcagataacttggagagacatggctcacacgctaatcatgataggctcaaacgcaagcgaccggatgggaatgggagttacatatttagcactcatagctacgtttaaaatccaaccctttttagctttaggattctttctgcgtaaactaacatcaagagagaacctgctgttaggagtcggcttagctatggcaacaacgctacaattaccagaagatatagaacaaatggcaaacggaatcgcgttaggcctcatggcactaaaattaattacacaattcgaaacgtatcaattgtggacagcgctaattagtttgacatgtagtaatacaatttttacactcacagtagcatggcgtacagcaactctaattctagcaggcgtatcactcttacctgtatgccaaagctcatccatgcgaaaaacggactggctgccaatgacggttgctgcaatgggggttccaccactgccgttattcatattttctttgaaagatacacttaagcgacgaagctggccactaaatgaaggagtaatggctgtaggcctcgtttcgattttagccagttccctattaagaaatgatgtgccgatggctggaccacttgttgcgggtggactgttaattgcgtgctacgtgataaccggaacatctgcagatttaactgtagaaaaagcagcagatgtcacctgggaagaagaagcagaacaaactggcgttagtcacaatttaatgataacagtggatgacgacggaactatgagaattaaggatgacgaaacagaaaacatactaacggtgcttttgaaaacagcgcttttaattgtctccggaattttcccttatagcatcccggcaacgcttttagtctggcacacatggcaaaagcagacccaaaggagtggcgtactatgggacgtaccaagtccacccgaaacgcaaaaagcagaattagaagagggagtgtaccgtataaagcaacaaggcatcttcgggaaaacgcaggttggggttggagttcaaaaagaaggagttttccacaccatgtggcacgtaacacgaggggcagtattaacttataacggtaaaaggcttgaaccaaattgggcatcagtcaagaaagatttaatatcatatgggggaggttggcggttatcagcccaatggcaaaaaggcgaagaagtgcaagtaattgcagtagaacccggcaagaatcctaaaaactttcaaacaatgcctggaacctttcaaacgacaactggtgaaattggagcgattgccttggattttaaaccaggtacctcgggctcaccaatcataaatcgagagggcaaggtcgtaggactttatggaaatggggtagttactaaaaacggaggttacgtgagtggcatagcgcagacaaacgcggagccggatggaccaacaccagaacttgaggaggagatgttcaaaaagaggaatctcaccatcatggatttgcatccaggatcaggcaagacgaggaaataccttcctgcaattgtaagagaagcaataaagagaaggttaaggaccttaattctggcacccactagagtagtcgccgctgaaatggaagaggctttgaaaggattgcccataaggtatcaaactacagcaacgaaatctgaacatacaggccgcgaaatagtagatttgatgtgtcatgccacatttaccatgcgattattatcacccgtaagggtacctaactataacctaataataatggatgaagcccattttactgatcctgctagtatagcggcaaggggctacatcagtacacgagtaggaatgggagaggctgcagcaatatttatgacagctactccacctggtacggcagatgccttccctcagagtaacgcaccaatacaggacgaagaacgagatatacccgagcgttcctggaacagtggcaatgagtggataaccgacttcgcaggcaaaacagtttggtttgtaccatccatcaaagcagggaacgatatagccaattgcttaaggaaaaatggaaagaaagttatacaattaagtagaaaaacattcgatactgaataccagaaaacgaaactaaacgattgggacttcgttgtcactactgacatatcggaaatgggagcaaattttaaggcagaccgcgtaatcgatccaagaagatgtcttaaacccgtaattctcacagatggccccgaacgagtcattttagccggacccatgcctgtcacggctgccagtgcagcacaacggagaggccgagtcgggcgaaatcctcaaaaagaaaacgatcagtatatatttaccggacaaccgttaaataatgacgaagaccatgctcactggacagaagcgaagatgttactagacaacatcaatactccagagggaataatccctgcccttttcgagccggaacgagaaaaatcagctgccattgatggggaatatcgtcttaaaggggagtcaaggaaaacgtttgttgaactgatgaggagaggggatctacctgtatggttagctcacaaagtcgcttctgaaggcataaaatacactgatagaaagtggtgtttcgacggtcaaagaaacaatcaaatcttggaggaaaatatggacgtcgaaatttggactaaagaaggagagaagaagaaactacgtcctaggtggttagatgcacgaacatattcggatccactcgcattgaaagaatttaaagactttgcagctggtaggaaaagtattgcactagatcttgttaccgagatcggacgagtacctacacacctggcacacagaactcgaaatgcactggataacttggttatgctacacacatctgaacacggcggaaaagcataccgacacgctgttgaagaacttcccgagacgatggagacgttactactattagggttaatgattttactaaccggcggggcaatgctattcttaataagtggcaagggaataggtaagacttcgataggtttaatctgtgtgatcgcatcgtccgggatgttatggatggcggaaattccacttcaatggatagcaagtgctatagttcttgagtttttcatgatggtattacttataccagagccggaaaagcaaagaacaccccaagataatcaactagcatatgtcgtaatcggaatacttacgttggcggctatcatagccgcaaatgaaatgggactcttagaaacaacgaaacgagatctgggaatgtcaaaagagccgggagttgtttccccaacaagttatctagatgttgatcttcatccagcctccgcatggacactatatgctgtagcaacaacggtaataacaccaatgctaagacacactattgagaactctaccgcaaatgtgtcactcgcagcaattgcaaaccaggcagtcgtgttaatggggttggacaaaggttggcccatatcaaaaatggatttaggtgtccccttattagctcttggctgttacagccaagtcaatccactaacattgactgctgccgttttacttcttataacgcactacgctataataggaccgggactacaagcaaaagctacacgggaagctcaaaaacggactgcagcgggcatcatgaagaatcctacagtagatggaattatgactatagatttagatcctgtcatttacgactcaaaatttgaaaaacaattaggccaagtaatgttattagtactatgtgcagttcaactgttgttaatgaggaccagttgggcattatgtgaagcgttaacattggccactggtcctataacgaccttatgggaaggttctcctggtaaattctggaacactacaatagcggtaagcatggcgaatatatttcgcggcagctacctagccggcgccggtctcgcatttagcataatgaaaagcgtaggtacaggcaagagaggtacaggatcacaaggagaaacacttggcgaaaagtggaagaagaaactaaatcagttaagtagaaaggaatttgacctatataaaaagagtggtattactgaagtagatcgcaccgaagctaaggagggactgaaacgaggcgagataacacaccatgcagtatcaagaggctccgccaaattacaatggtttgtagaacggaacatggtaattccagaaggaagggtaattgatctaggttgtggccgaggtggatggtcatactattgtgccgggctaaagaaagtcacagaagtacgtggatatacaaagggaggtcccggtcatgaagaacctgtcccaatgtcgacatatggttggaatatcgttaaattaatgtctggaaaagatgttttctatctccctccggaaaaatgtgacaccctactttgcgacataggagaaagctccccctcaccaacggtggaagagtctcgaacaatacgagtattaaagatggttgagccttggttgaaaaataatcaattttgtataaaagtgctaaacccatatatgccaacagtcattgagcatcttgaaagacttcaacgaaaacacggaggtatgttagtacgtaatccgctctccaggaactcaacacatgagatgtactggatttctaacggtactggaaatatagtggcatcggtaaatatggtatcaagacttctactaaaccgatttacaatgacacatcggcggccaactatcgaaaaagacgtggatttaggagcagggacacgacacgtcaatgcagaaccagaaacacctaacatggacgtgatcggcgagcgtattaaaagaatcaaagaggagcataactcaacctggcattacgacgatgaaaatccttataagacgtgggcgtatcacgggtcatatgaagtaaaagcgaccggcagcgcctcgtcaatgatcaatggcgtcgtgaagttgcttaccaagccttgggatgtcgtacccatggtcacccaaatggctatgacagatacaacaccatttggccaacaaagagtcttcaaagaaaaagtggatacccgaaccccacggagcatgcctggtacaagaagagtcatgggaataactgcagagtggctctggcgaactctgggacggaacaagaaacctagactatgtactcgtgaagagttcactaaaaaggtaagaacgaacgctgccatgggggcagtttttactgaggaaaaccagtgggactcagccaaagcggccgtagaagatgaagatttttggaagttagtggacagagaacgagaactacataaattaggaaagtgcggtagctgtgtatataacatgatgggtaaacgagagaagaaactaggagagtttggaaaagctaaagggtcaagagctatatggtatatgtggttaggagcgcgatatctagaatttgaagcactcggatttctaaatgaagaccactggttttccagagaaaactcgtactcaggagtggagggagagggacttcataagctcggatatatccttagggatataagtaaaataccgggaggagcaatgtatgcagacgacaccgccggatgggacacacggataacagaggatgatttacacaacgaagagaaaataacacagcaaatggatcccgagcataggcagttagccaatgctatctttaaattaacataccaaaacaaagttgtcaaagttcaacgacctacccccaccggaacagttatggacataattagtcgcaaagatcaaagaggcagtgggcaagtaggtacctatgggttaaacacttttaccaatatggaggctcaactcattagacaaatggagggagaaggtgtactctcaaaagccgacttggagaacccacatttacccgagaagaaaatcactcagtggttagagactaaaggggtagaaagattaaaacgaatggcaatatcaggggatgattgcgtggtcaaaccaattgacgataggtttgcaaatgcgttgctggcgctaaacgatatgggaaaagtaagaaaggatattcctcaatggcaaccatcaaaaggttggcacgattggcagcaagttcctttctgctcgcaccacttccatgagcttattatgaaagacgggcgtaaattagtagttccttgtcgaccccaagatgaacttataggacgagcacgcatatcacaaggtgcaggttggtcattacgtgagactgcatgcttgggtaaagcatatgcccaaatgtggtctttgatgtactttcatagaagggacctaagactagcttccaatgcaatttgttcagcggtcccggtacattgggtacctacaagtcgaacaacatggagcattcacgctcatcatcaatggatgacaacagaggatatgttaaccgtatggaatcgcgtatggatagaagataacccctggatggaagacaaaacaccagtaaccacgtgggaaaacgtaccgtatttagggaagcgggaggaccaatggtgcggatccttaataggattaacctcaagagccacttgggcacagaatatacccacggctattcaacaagttcgcagtttgattgggaatgaggagttcctagactatatgccgtccatgaagagatttcggaaagaagaagaatcagaaggagccatttggtag

SEQ ID NO: 23462 - RNA, 9873 nt, synthetic construct
  misc_feature 1..9873: note = derived and/or modified CDS sequence (opt6) from DENV-3__EU569691__SS-prME
  source 1..9873: mol_type = other RNA
acatctttatgcctgatgatgatccttccagcagctttagctttccacttgacatctagagatggagaaccacggatgatagttgggaaaaatgaacgaggaaaatcattactattcaaaactgcgagcggaactaatatgtgtacattaatagctatggacctaggagaaatgtgcgacgatactgtaacatataaatgccctcatattacggaagtagaaccggaagatatagattgttggtgtaatctcacaagtacatgggtaacttacggaacctgtaaccaagcaggggaacatcgtcgcgacaaacgatcggtagcgttggctccccatgttggcatggggttagatacgcgtacacaaacatggatgtccgctgaaggtgcatggaggcaagttgaaaaagttgaaacatgggcattgaggcaccccggctttacaatcctagctctttttctagctcattacataggtacatccttaactcaaaaagtagtcatattcatactcttaatgctggtaactccatcaatgaccatgcgttgcgtcggcgtgggaaaccgagatttcgtagaaggtctttcaggagcaacatgggtagatgttgtcttggaacacggaggctgtgtaacaactatggccaaaaataaaccaacccttgacatcgaactacagaaaacagaagcaactcaactagctactcttaggaaattatgtatagaagggaaaatcacaaatataacaacagattccagatgtccaacgcaaggtgaagcagttctaccagaagaacaagatcaaaattatgtatgcaaacatacatatgtcgaccgaggttgggggaatggatgtggtttgtttggtaaaggttcgctagtaacatgtgcaaaatttcagtgcctcgaaccgatcgaaggaaaagtcgtacaatacgaaaatctgaaatacacagttattataactgtccacactggagatcagcatcaagttggtaatgaaacgcaaggggtaacagcggaaattacacctcaagcaagtacaacagaagctatactcccagaatacggtacgttgggcttggaatgcagtccaagaacaggtctggattttaacgaaatgattctccttacaatgaaaaataaagcatggatggtccacaggcagtggtttttcgatttgccactgccgtggaccagtggggctaccaccgaaaccccgacctggaacagaaaagaattattagtgacatttaaaaatgcacatgccaagaaacaagaagtagtcgtattagggagccaagaaggcgcaatgcacacagcattgacaggtgcgacagaaatacaaaattccggaggcacatctattttcgcgggtcacctcaaatgtagactgaaaatggataagttagaacttaaaggtatgagttacgctatgtgtacaaatacttttgtactaaagaaagaagtcagtgagacacaacatggcaccatactcataaaagttgaatataaaggggaggatgtaccatgcaaaataccattctcaactgaagatggacaagggaaggcacacaatggaagattgatcacggcaaacccagtcgtaaccaagaaagaagaaccagttaacatagaagcagaaccaccatttggagaaagtaatatagtaattggaataggtgacaatgcacttaaaatcaattggtataagaaaggatcttcgataggaaaaatgttcgaagcaaccgccagaggtgctaggcgaatggcaattttaggggatacagcctgggattttggttcagtaggcggggtccttaattctcttggtaaaatggtacatcagattttcggatccgcatacaccgcattgttctccggcgtatcatgggttatgaaaatcggaatcggagtacttttaacatggataggacttaacagtaagaacacaagtatgagcttcagttgtattgcgatcggaataattaccctgtatttgggggcggtcgttcaggctgacatgggatgtgtaataaattggaaaggaaaagaacttaagtgcggaagtggaatatttgtaacaaatgaagttcacacttggaccgaacaatacaaatttcaagctgacagtccgaaacgcctagccacagcgatagccggcgcgtgggagaatggggtatgtggaatcagatctacaaccaggatggaaaatttactctggaaacagatagcgaatgagctaaattacatattatgggaaaataacattaaactaaccgtagtggtaggggatataataggagtattagaacaaggaaagcgtacactaacgccccaaccaatggaactcaagtattcctggaaaacctggggaaaagcgaaaatagttacagcagagacacaaaattcttcatttataattgacggcccaaatacgcccgaatgtccaagtgcaagtagagcatggaatgtatgggaggtagaagattacggcttcggagtttttacaacaaacatatggttaaaattaagagaagtctatacgcagctctgtgatcatagactaatgtcagcagcagttaaagacgaaagagccgttcatgcagatatgggatactggatagaatctcagaaaaacgggtcctggaaattagaaaaagcatctctcattgaagttaaaacttgtacttggcctaaatcgcatacactatggtctaatggggtactagaaagcgatatgatcataccaaaatcacttgcaggaccaataagtcaacacaattatagaccaggataccatacacaaactgctggcccttggcacctggggaaactggagttagactttaattactgcgaaggcaccactgtcgtaataacagaaaactgtggtactagaggtccttccttacgcacgaccacagtcagcggtaaattaatacacgaatggtgctgccgaagctgtacgttacccccattaagatatatgggagaagatgggtgttggtatggtatggagatccgaccgattagcgagaaagaagagaacatggtaaagagcttggtatctgccggatctggggaagtagacaatttcaccatgggagttttatgtctagctatattgtttgaagaagttatgcgtggaaaatttggcaagaaacatatgatagcgggagtgttctttacattcgttctattactcagtggccaaataacttggagagacatggcacataccctgattatgataggaagtaatgcatccgacagaatgggcatgggcgttacttatctcgcattaatcgcgacattcaaaattcaaccatttctagcacttggattctttttacgtaaattaacttctagagaaaatttattactcggagtaggcctggcgatggctacaacacttcaactaccagaagatatcgagcagatggccaatggaatagcgttaggtctgatggcattgaaactaattacacagttcgagacctaccaattgtggacagcacttatatcattgacctgcagcaacacgattttcacactgaccgtcgcttggcgtacagctacactcatacttgctggcgtctctttgttaccggtatgccaaagcagttctatgagaaaaaccgattggttaccaatgacagttgcagcaatgggagtccctccgctaccgctatttatattcaccctaaaagacaccctaaaaaggagatcttggcctttaaacgaaggcgtcatggcagtcggacttgtgtctattctcgcgtctagtttacttaggaacgacgtacccatggccgggcccctagtggccggcggactactaatagcctgttatgtaattaccggaacaagcgcagacctcacggtagagaaagcagctgacgttacttgggaagaggaagcagaacaaacaggcgtatctcataatttaatgataactgttgatgacgacgggaccatgaggatcaaggacgatgagacagaaaatatactaacagtactcttgaagactgctttacttattgtatcaggcatattcccctatagcattccagctacgcttctcgtttggcatacatggcagaaacaaacccaaagaagcggggtgctatgggatgtgccatccccacccgaaacccaaaaagccgaattggaagaaggggtatacagaataaaacaacaaggaatctttggcaaaacgcaagtgggagtaggagttcaaaaggaaggtgtatttcatacaatgtggcacgtgactcgcggggctgtcttgacgcataacggaaagagactagagccgaactgggcatctgtcaagaaagatcttatatcgtatggaggcggctggagactaagtgcacaatggcaaaaaggggaagaagtacaagtcattgccgtagagcctggcaaaaatcccaaaaactttcagactatgccgggaacgtttcaaaccactacaggagagataggcgccattgcattagactttaaacccggaacgtcaggcagtcctataatcaatagggaaggaaaagtcgttgggttatatggaaatggagttgttaccaaaaatggaggatatgtctccggcattgcacaaacaaatgcagaacccgatggcccaacaccagaactagaagaagagatgttcaagaaacgcaacctgacaataatggatctacacccagggtcaggaaaaacccgtaagtatctgcccgctattgtaagagaggcaataaaaagacgattgcggacgcttatattagctccaacgcgtgttgtagcagcagagatggaagaagctctgaagggactacctataaggtaccaaacaacagccacaaaatcagaacacacagggagagaaatcgtagacctgatgtgccacgctacattcactatgcgtttactaagcccggtaagggttccaaattataacttgatcataatggacgaagcacactttacagatcctgccagtattgctgctcgagggtatatatccactcgagtgggaatgggcgaagccgctgctatcttcatgaccgctactccaccagggacggcagatgcgtttccacaaagtaacgctcccatccaagacgaagaaagagacattccggaaagaagttggaactctggtaacgaatggataacagacttcgcgggaaaaacagtttggtttgtcccgtcaataaaagcagggaatgatatagccaactgtcttaggaaaaatgggaaaaaggttatacaactatcaagaaaaacatttgatacggaatatcagaaaacaaaattaaatgactgggatttcgtcgtaacaacagatatatccgaaatgggcgcaaattttaaggcagaccgggttatagatccacgtagatgcttaaaaccagtaatattgaccgacggacccgaaagagtgatactagccggccccatgcctgtcacagctgcttcggctgctcaaagacgaggacgtgttggcagaaatccacaaaaagagaatgaccaatacatatttacgggccaacctctaaataacgatgaagaccatgcccattggaccgaagctaaaatgcttctggacaatattaatacacccgaaggaataatacctgcactattcgaacctgaaagggagaaaagcgcagcaatagatggtgaatatagattgaaaggagagagtcgaaaaacttttgtcgaattaatgcgtcgaggcgacttgccagtttggctagcacacaaagttgcgtctgaaggtataaaatacacagatcgaaaatggtgctttgacggacaaagaaataatcaaatattagaagaaaacatggacgttgaaatctggacaaaagaaggagagaagaagaaattacgtccaagatggctagatgcaagaacctactccgatccattagctctaaaggaatttaaagattttgctgcaggaaggaaatcaatagctttagatctagttacggaaataggacgagttccaactcatttagcacaccgcacaagaaatgcattggataacttagtaatgctccacacatcagagcatggaggcaaagcctatagacatgcagtagaggaattacccgaaacaatggaaacacttcttttgcttggacttatgatattactaacaggcggcgcaatgcttttccttatatctggaaaggggattggaaaaacttcaataggactgatatgcgtcatcgcatccagtggcatgttatggatggccgaaatacctttacaatggatcgctagtgctatagtgttagagttctttatgatggtgttactaataccagaaccggagaagcaacggacaccgcaagacaatcaacttgcttacgtagttattggcatattgaccctcgctgcaataattgctgctaacgaaatgggtctacttgagacaacaaaacgtgatttaggtatgtcaaaggaaccgggagtagtcagcccaacaagctacctcgatgtagacctacatcccgcttcagcgtggacattatacgcagtagcgacgactgtaataacaccaatgcttcgacacactatagaaaatagcactgccaatgtttcattagctgcaatagcaaatcaggcggtagtgttaatgggactagacaaaggatggcctatttcgaaaatggatttaggtgttccccttttagcactaggttgctactcccaagtaaatccattaaccttaacagctgcggtccttctgttaattacacactatgctataatcgggcctggccttcaagcaaaagctactagagaggcacagaaaagaaccgcggcgggtataatgaagaatcctactgtggatggaataatgaccatagatctcgatcccgtcatttatgattcaaagtttgaaaaacaattgggtcaggtcatgctcctagtattatgtgcagtccagttgctgctaatgcgtacttcgtgggcattatgcgaagccttaacacttgcgacagggccgataacaacattgtgggagggcagtccgggtaaattttggaatacgacgatagcggttagtatggcaaacatcttcagaggatcatatttagctggagcaggtttagccttcagcattatgaaatctgtagggaccggaaaacgaggaaccggaagtcagggagaaacattaggcgagaaatggaagaagaaattaaatcaattatcgagaaaggagttcgacctatacaaaaagagcgggataacagaggtagataggacggaagctaaggaaggactaaaaagaggagaaataacgcaccacgctgtaagtcgcggtagtgctaaattgcaatggtttgttgagagaaatatggtaattccggagggccgtgtaattgatctcggatgcggacgtggcggatggtcgtactattgtgcgggtctgaagaaagtaactgaagttagaggttacaccaagggtggcccaggacatgaggaacccgttcctatgtcgacttacggatggaacattgtcaaacttatgtcaggaaaagatgttttctatttacccccggaaaaatgcgacacacttctctgcgatataggagagtccagtccttctcctactgtcgaagaatcccgtactatacgtgtcttaaaaatggttgaaccatggttgaaaaacaaccaattctgcataaaagtattaaatccttatatgcctacggtgatcgagcacttggagagattgcaacgaaaacacggcggcatgttagtccgaaacccattatcgcgtaattcaacccacgaaatgtattggatttccaatgggactggaaatatagtggcctcggttaacatggtaagcagactcttattgaatagatttaccatgactcacaggagaccaactattgaaaaagatgtagatttaggggcaggcactcggcatgttaatgcagaaccggagacaccaaatatggatgtcattggagagcgaataaaacgtattaaggaggaacacaatagtacttggcactacgacgacgagaatccataccgcacttgggcttatcatggctcatatgaagtgaaagcaacaggatctgccagttcaatgattaatggcgtagtaaaattgcttaccaaaccctgggatgtagttccaatggttacccagatggcaatgacagatacgacacctttcggccagcaacgtgtctttaaggaaaaagtagacacgcgcacacctagaagtatgccgggaacaaggagagtaatgggtattactgctgaatggctctggaggacacttgggcgaaacaagaaacctcgcctgtgtacaagagaagaatttacaaagaaggttagaacgaatgcggcaatgggagcagtattcactgaagaaaatcaatgggattcagcaaaagctgctgttgaagatgaggatttctggaagctagtcgatagagaacgcgaattgcataagctaggtaaatgtggtagctgtgtctataacatgatgggaaaaagagagaagaaactcggcgagttcggtaaagctaagggaagtagagccatatggtacatgtggctaggagcgagatatttagaatttgaggctttgggtttcctaaatgaagaccattggttcagcagagaaaatagctattccggtgttgaaggtgaaggactccacaagttaggctatatattaagagacataagcaagattccaggtggagctatgtatgccgacgatactgccggttgggatacgcgcataacagaagatgatctacataacgaggagaaaataacacaacagatggatcccgaacatcggcaattagcgaatgcaatttttaaacttacttatcaaaacaaggtcgtaaaagtccaacggcccacacccacaggcacggtaatggacataatttctcgtaaagaccaacgaggttccggacaagtaggaacctatgggttaaacacattcacaaacatggaagcacaattaatccgccagatggaaggcgagggggtgctttccaaggcagacttagaaaacccacatttacccgagaagaaaataactcaatggcttgaaactaaaggggttgagcgattaaaaagaatggcaatatctggggatgactgtgtagttaaacccatcgatgaccgtttcgctaatgctctcttagcattgaatgacatgggtaaggtacgcaaagatataccccaatggcagccgtcaaagggatggcacgattggcaacaagtaccattttgttcgcatcacttccatgaattaattatgaaggacggacgtaagttagtagtaccctgtagacctcaagatgaactgatcggtagagcgcggatatcgcaaggcgctggatggagtttaagagaaaccgcatgcctaggaaaggcgtatgcccagatgtggtcactaatgtatttccatagacgtgacttacgattagcgtcaaatgcgatatgctcagcagtaccagttcattgggtgccgacctctagaacaacgtggtctatacacgctcaccatcagtggatgaccacagaagatatgctcaccgtatggaaccgtgtatggattgaagataatccatggatggaggacaagactccagtgacaacgtgggaaaatgttccatatttagggaaacgtgaggatcaatggtgcggctcgttgataggattaacatcacgcgctacgtgggcacaaaatattccaacagccattcaacaagtaagatcattaataggaaatgaagagttcctggattatatgcccagtatgaagcgctttaggaaggaagaagaaagtgagggagcgatttggtaa

SEQ ID NO: 23463 - RNA, 9873 nt, synthetic construct
  misc_feature 1..9873: note = derived and/or modified CDS sequence (opt6) from DENV-3__EU482452__SS-prME
  source 1..9873: mol_type = other RNA
acaagcctctgtctaatgatgatgctgccagctacattggcgtttcatttaacaagtcgtgatggagaacccagaatgattgtaggcaaaaacgaacgaggaaaatctctactatttaaaaccgcgagtggtataaatatgtgcactcttatcgcgatggacttgggagaaatgtgcgacgatacggtgacctacaaatgtccgttgatagcggaagtagaacctgaagatatagactgttggtgcaatctaacgtcgacttgggttacttatggtacttgtaatcaagccggagaacaccgtagagataaaagaagtgtggccttggcaccccatgtcggaatgggattagatacacgtacacaaacatggatgtcagcggaaggagcatggaggcaagttgaaaaagtcgaaacttgggcactcagacacccaggattcactatacttgccttatttctagcccattatataggaacatctttaacccaaaaagttgtcatttttattctcttgatgctggttaccccatctatgacgatgcgatgcgtcggagtaggaaaccgagattttgtagaaggattatcgggtgcaacatgggtagacgtagtactcgaacatggaggatgtgtaacaacaatggcgaaaaacaaacctacattagacattgagttgcagaaaactgaagcgacgcaactagcaacactccgaaaattatgtattgaaggaaaaataactaatatcactacggactcaagatgtccaactcaaggcgaggccatattgcccgaggaacaagatcagaattacgtctgtaaacatacatacgtagacagagggtggggaaatgggtgcggtctatttggtaaaggttcattagttacatgtgcgaaatttcaatgcctagaacccattgaaggaaaagtcgttcaatatgaaaacttgaaatatacggtaatcataactgtacataccggtgatcaacaccaggtgggtaatgacactcaaggagtaacagttgaaatcacccctcaagcgagcacagttgaagcagtactccccgagtatggtactttgggactagaatgttcaccgaggacggggcttgattttaacgaaatgattctactgactatgaaaaacaaagcatggatggttcacaggcagtggttcttcgatttaccacttccctggacaagcggggctactactgaaaccccaacgtggaaccggaaagaactacttgtcacattcaaaaatgcacatgccaagaaacaagaagttgtagttttggggtcccaggaaggtgcaatgcacaccgcccttacaggagcaacagaaatacaaaactctgggggcacttcgatatttgctggacaccttaaatgtcgtttaaaaatggataaattggagctaaaaggcatgtcttacgcaatgtgtctagatacatttgtattgaagaaagaagtaagtgaaactcagcatggtactatccttataaaagtggagtacaaaggagaagacgctccatgtaaaatcccgtttagtactgaagatggccaaggtaaagcgcacaatggtagattaatcactgctaacccggtggttactaagaaagaggaaccagtcaatatcgaggccgaacctccattcggcgaatcaaacatcgtaattggtatcggtgataaagcccttaaaatcaactggtataagaaagggtcaagtataggtaaaatgttcgaagccacagcaaggggcgcgcgcaggatggcaattttgggagacacagcatgggacttcgggtcagtcggtggtgtattaaattcactcggaaaaatggtgcaccaaatatttggatccgcttatactgcattattttcaggtgtatcatggattatgaaaattggaattggagtattgctgacctggatcggattaaatagtaaaaacacatctatgtctttttcgtgtattgttataggtataataacgctgtatttgggtgcggtagtgcaagcggacatgggatgcgttattaattggaaaggtaaagaactcaaatgtgggagcggtatatttgtgacaaatgaggtgcatacatggaccgaacagtacaaatttcaagccgattctcccaaaaggcttgctacagcgattgcaggagcgtgggaaaatggggtatgtggaatacgctctacaacccgaatggagaatctactttggaaacaaatcgccaatgaactaaattacatcctatgggagaataacataaaacttacagtcgtggtaggggacgttattggggtcttagagcagggtaaacgtactcttactccgcaacctatggaattgaaatatagttggaaaacgtggggaaaagcaaaaatcgtaaccgcagaaactcaaaattcatcatttattatagatggcttgaacacccccgaatgcccaagcgccagtagggcatggaatgtatgggaagtagaagattacggattcggagtatttaccacaaatatttggttaaaactccgtgaagtatatactcaaagttgtgatcacaggttgatgagcgcggcgattaaagatgagcgagccgtgcatgcagatatgggttattggatagaaagccagaaaaatggctcatggaaattagagaaagcgtcattcatagaggttaaaacttgtacttggcccaaatcgcatacattatggagcaatggcgtactggaatcagacatgattataccgaaatctttggcgggaccaatctctcagcataaccaccgacctggatatcatacacagacggctggaccatggcatctaggcaaactagaattagatttcaattactgcgagggcacaactgttgtaataacggaaaactgtggaacacgtggcccctctcttcgaaccactacagtatcagggaaattaatacacgaatggtgctgtagatcctgcacattgccaccattgagatacatgggagaggatggctgttggtatggcatggagatccgaccgattaatgaaaaagaagagaatatggtaaagagcttagtaagcgcaggaagcgggaaagtagacaattttactatgggtgttttgtgtttggccatactatttgaagaagtaatgcgaggcaagttcggtaagaaacacatgattgctggtgtactatttaccttcgtattactactaagtggacaaattacttggcgagacatggctcatacattaataatgataggaagtaacgcatcagatagaatgggaatgggtgtgacctaccttgctctaatagcaacattcaaaatacaaccatttctagctctaggtttctttttgagaaaattaacatcacgtgaaaatttacttttaggagtaggtttagcgatggctacaacccttcaattaccagaggatattgaacagatggcaaacggaatagctttaggcttaatgacactgaaattaataactcaattcgaaacataccaattatggacagccctagtcagtttaacgtgtagcaatacaatttttacattgaccgttgcgtggcgaactgctactctgatactagccggagtcagtttactacctttatgtcagtcatcgagtatgagaaaaacagattggttgccaatgaccgtagcagcgatgggggtgtcgcccttgcctttatttatattttcgttaaaggatactccaaaacgccgtagttggcccctaaatgaaggtgtaatggcagtaggtttggtttcaattctagctagctcattattgagaaatgatgttccaatggccggacctctcgtggcgggaggtttactaatcgcgtgctatgtaattacggggacaagtgctgacttaacagttgaaaaagccgctgatgtaacgtgggaagaagaagcggagcagacaggtgtctctcacaatctaatgataactgttgacgatgacggaacgatgagaattaaagatgatgagacagaaaacattttgacagtactgcttaaaactgcattgctaattgtaagcgggattttcccctatagcattcctgctaccttgttagtctggcatacctggcaaaaacaaacacaaaggagcggcgtattatgggatgtaccttcgccaccggaaacgcaaaaggcagagttagaagagggtgtataccgtataaaacaacaaggaatattcggaaaaacgcaagtaggcgtcggtgtacagaaggagggagtatttcatactatgtggcatgttaccaggggagcggtcttgacccacaatgggaaaagacttgagcctaactgggcgtctgtcaagaaagatctgataagctatgggggaggatggagattatccgcacaatggcaaaaaggagaagaagttcaggtcatagcagtggagccaggaaagaaccctaagaattttcaaaccatgcccggaatttttcaaactaccaccggagagataggcgcaatagcattggactttaaaccagggacttccggaagtccaattataaaccgagagggaaaagtggtcggattatacggcaatggggtagtaaccaaaaatggaggctacgtttcaggtatcgcccaaactaacgcagagccagacggtccaactccagaacttgaagaagaaatgttcaagaaaagaaatttgaccatcatggatttacatccaggttcgggtaaaactcggaagtacttgcctgcgatagtacgagaagctatcaaaaggagactgagaacgctaatattagccccaacgagagttgtagcagccgagatggaagaagcactaaagggtttaccaatacgctaccaaacaaccgccactaaatctgaacacacaggtcgcgaaattgttgaccttatgtgtcatgcgaccttcacaatgaggttattgtccccagtcagagtaccgaactataacctaatcatcatggacgaagcacatttcactgatcctgccagtatagcagcacgaggatatataagtacacgagttggaatgggtgaggcagcggcgattttcatgactgccacaccaccaggaacagctgaggcttttccacaatctaatgcaccaattcaagatgaagagagagatatacctgaaagatcctggaacagtggtaatgaatggatcaccgactttgtaggaaaaacggtgtggtttgtaccaagcataaaagctggaaatgacatcgctaactgtctccggaaaaatggcaagaaagtgatacaactctcacgtaaaacatttgatactgagtatcaaaagacacgtctaaatgattgggactttgtagtaaccaccgatattagtgaaatgggggctaattttaaagcagacagggtgattgatccgagacgatgtttaaaaccagtaatactcacggatggaccggaaagagttatattagctggcccaatgcctgtaacagcagcatcagcggcgcaacggcgcgggagagtcggcagaaacccacaaaaagaaaatgaccaatatatattcacgggacagccacttaataacgatgaggaccacgcccactggacagaagcgaaaatgttgttggataacataaacacacctgaaggtataatacctgcgttattcgaaccagaacgcgaaaaatcggcagccattgatggagaatatagattgaaaggagaatcaagaaaaacgtttgtggaactaatgagacgcggggatttgccagtatggctagcccacaaggtggcgagtgaaggcataaaatatacagatcgtaaatggtgctttgacggagaacgaaataatcaaattttagaagaaaacatggacgtcgaaatatggacaaaagaaggagaaaggaagaaactacgaccacgctggcttgacgcacgcacgtattccgatccccttgcattaaaagagttcaaagattttgctgcaggacgtaaaagcatagcactagacttagtaacggagattggacgagtaccttcccatttagcctacagaactagaaatgctctagataatttagtaatgttacatacatcagaacatggaggcagagcatacagacatgcggtcgaggaactgcccgaaacgatggagacacttctcttattagggttgatgattctactaacaggcggtgccatgttgtttttgatctctggcaaaggaatcggtaagacatctattgggctaatttgtgtgatagtttcaagtgggatgttatggatggcggatattccattacagtggattgcgtctgccatagtgttagagttcttcatgatggtactattaatacctgaacctgaaaagcaaaggacaccccaagacaatcaattagcttacgtcgtaattggaatcctaacccttgcagctatagtcgccgcaaatgaaatgggactattggagacaacaaaaagagacttaggaatgtcaaaagaaccaggagtagttagtccaacatcctatctggatgtagacttacatcccgcttccgcttggacactatacgcagtggcaacaacagtgataacaccaatgttaaggcacacaatagaaaacagcaccgcaaatgtttctctagcggcgatagctaaccaagcagtagtcctaatgggtttagacaaaggttggccaatttcgaaaatggacctgggagttccgctattagcgctcggttgctatagccaagtgaaccctttaactttaacagcagcagttctcctattagtaacgcactatgcaatcataggacctggattgcaagcaaaagcgacccgagaagctcagaaaagaaccgcagccggcattatgaaaaatccaaccgtcgatggaataatgaccatagatctggatcccgtgatatacgactctaaatttgaaaaacaactaggacaagtaatgcttctcgtcctatgtgctgttcaattacttctaatgcgaaccagttgggcattatgcgaagctctgacgttagcgaccggtccaataacaaccctttgggaaggttctccgggaaagttctggaatacaacaattgccgtttccatggctaatatctttagaggatcgtatctagccggagccggattagcattctcgattatgaagagtgtgggcacaggtagacgaggaacaggaagccaaggtgaaactttgggcgaaaaatggaagaagaaattaaatcaattgagtaggaaagagttcgatctgtataagaaatcaggcatcacagaggttgatagaaccgaggcaaaggaaggattgaaacgtggcgaaacaactcatcacgctgtcagcagaggaagtgcaaaattacaatggtttgtagagagaaacatggtaatacctgaaggacgagttatagacttagggtgtggacgaggaggctggagttattattgtgccggattgaagaaagtaacagaagtaagagggtataccaagggtggtcctggtcacgaagaacctgttcccatgtctacttatggctggaatattgtaaaactgatgagtggaaaagacgtattttatcttccaccagaaaagtgtgataccctattatgtgatattggtgaaagtagtccgtcaccaacagttgaagaatctaggacaatacgagtcctaaaaatggttgaaccatggttgaaaaacaatcagttctgtataaaagtgttaaacccatacatgcctacggtaattgaacatctagaacgattgcaacgtaaatatggagggatgttggtgagaaatccgctatcgagaaattctacccacgaaatgtattggataagcaacggtaccgggaatatagtaagtagtgtaaacatggtgtcccgactacttctaaatagatttaccatgacgcatagacggcctacaatagagaaagatgtagatttaggagccggtacaagacatgtaaacgcagagccagaaacaccgaacatggacgtgataggtgaacgtattaaaagaataaaggaagaacattcttccacttggcattatgacgatgaaaatccgtataaaacgtgggcatatcacgggagttatgaagtgaaggcaacaggctccgcctcgtcaatgattaatggagtggttaaactactaactaaaccctgggacgtagtcccaatggttactcagatggcgatgaccgacaccacgcctttcggacaacagagagtatttaaagagaaagttgacactcgcacacctagacccatgcctggcactagaaaggtaatggaaataactgcagagtggctatggcgaacactaggaagaaataagaagccccgattgtgtacacgcgaagagttcaccaagaaagtgcgaaccaacgcagcaatgggagcggttttcacagaagaaaatcagtgggactccgctcgggcggcagttgaagacgaagaattttggaagctagttgaccgcgaaagagagctgcataaactagggaaatgcggttcatgtgtctataacatgatgggaaaaagggagaagaaattaggtgagttcggaaaagcaaaaggttctcgcgctatctggtacatgtggctaggtgctcgttaccttgagttcgaagcactaggatttcttaatgaagatcattggttctctagagaaaattcatacagtggtgttgaaggtgaaggattacataaactaggatatatcctcagagacatatccaagattccaggaggagcgatgtatgcagatgacacggctggctgggatacacgaataacagaggacgatctacataatgaagaaaagattacacaacaaatggacccagaacatcgccagttggctaacgcaattttcaaattaacttaccaaaacaaggtagttaaagtacaacgtccaactcccaagggcacagtcatggatataatatctagaaaagaccaacgagggagcggacaagtgggaacatacgggttaaatacctttacgaacatggaggctcaactcgtcagacaaatggagggcgaaggagtactaagcaaggcagatctggaaaatccacatttactagaaaagaaaattacccaatggttagaaaccaaaggcgtcgaacgactgaaacgaatggctatctccggcgacgactgcgtagtaaaaccgatcgatgatcgctttgccaatgcattattggcactaaacgatatgggaaaggtaagaaaagacataccccaatggcaaccgtctaaaggctggcacgattggcaacaggttcctttttgctctcaccacttccacgagcttattatgaaagacggacgtaagctagttgttccttgtagaccacaggatgaattaatagggagggcgagaatatctcagggtgccggttggtccctaaaagaaacggcatgcttaggcaaagcctatgcccaaatgtggagcctcatgtatttccataggcgtgatcttcgcctcgcatcaaacgcgatatgttctgcagtacctgtacactggatcccaacgagcagaaccacatggagcattcatgcccatcaccaatggatgactacggaagatatgttaacagtgtggaatagggtatggatcgaggacaacccatggatggaagacaaaacgccagtaactacttgggaagatgtgccatacttaggaaagagagaagaccaatggtgcggcagcttgatcggactgactagcagagcaacatgggctcaaaatatactcaccgcgatacaacaagttaggagcctaatcggagacgaggagttcttggattatatgcctagtatgaagcgcttccgaaaagaagaagagtcggaaggagcgatttggtga

SEQ ID NO: 23464 - RNA, 9873 nt, synthetic construct
  misc_feature 1..9873: note = derived and/or modified CDS sequence (opt6) from DENV-3__EU482453__SS-prME
  source 1..9873: mol_type = other RNA
acgagcttatgtctaatcatgatgttacccgctacattagcattccacctcacatctagagatggagaaccaagaatgattgtcggcaaaaatgaaagaggaaaatcattgctctttaaaacagcaagtggtattaatatgtgtacattaatcgcgatggatctgggggaaatgtgtgacgacactgtaacttacaagtgcccactaattgcagaagtggaaccggaagatatagattgctggtgcaacttgacttctacctgggtcacttatggaacatgcaatcaagcaggagagcatcgaagggacaagaggtctgttgctcttgctcctcatgtgggaatggggcttgacacccgtactcaaacgtggatgtcagcagaaggtgcatggcgacaggtagaaaaggtagagacatgggcgctacgtcacccggggttcactatcctagcgctatttctggctcactatataggaacttccttaacccaaaaagtggtcattttcatcttattgatgcttgtcacacctagcatgacaatgaggtgtgttggtgtaggcaacagagactttgtggaaggattatctggtgcaacatgggtagacgtggtgcttgaacacggaggatgcgtcaccacaatggccaaaaataaaccaactttagacatcgagctacagaaaactgaggcaacacaattggctacactccgcaaattgtgcatagaaggaaaaataaccaacattacaactgactcaagatgtcctacacaaggcgaagcaatattacccgaagaacaagaccaaaattatgtatgtaaacacacctacgtagataggggttggggtaacggatgcggattatttggaaaaggcagcttggtcacatgcgcaaaatttcaatgtttagaaccaatcgaaggaaaggttgttcaatatgagaacttaaaatatacagtgatcatcaccgtacacacaggtgatcaacatcaagtagggaatgacacacagggggttacagttgaaataacaccgcaagcatcaactgtagaagcagtacttccagaatatggtacactaggtctggaatgtagtccaaggacaggtctagacttcaacgagatgattcttctaacaatgaaaaacaaagcatggatggttcatagacaatggttctttgatttgcctctgccatggacttcaggtgcaactaccgaaacacctacgtggaatagaaaggagctgcttgtaacgtttaaaaacgcacatgcaaagaaacaggaagtcgttgtcctcggcagtcaagaaggtgctatgcatactgcgttaacaggagcaacagagatacaaaacagtggcggtacttcaattttcgctggacacctaaaatgccggttgaagatggacaaattagaactaaagggaatgagctacgccatgtgcttaaatacattcgtactaaagaaagaagtaagtgagacacaacatggtacgattctgattaaagtagaatataaaggggaagatgctccatgcaagatccctttttccacagaagacggccagggtaaggcacataatggacgccttataacagccaaccctgttgtaactaaaaaggaggaaccagtaaatatagaagcggaaccaccattcggcgagtcaaacatagtcataggaattggtgataaagcgcttaaaataaactggtataagaaaggatctagtattggcaaaatgtttgaggctaccgctagaggtgcccggcggatggcaatactgggtgatactgcctgggacttcggaagcgtaggaggggtacttaattcattagggaaaatggtacatcagatctttggatctgcgtacactgcattattttcaggagtatcctggatcatgaagatagggattggagtcctgttaacctggataggactaaattccaagaatacatctatgtcattcagctgtatagctatcggtataattacactttatctgggggcggtagtccaagcagatatgggatgtgctataaattggaaagggaaagaactcaagtgtggttcaggaatattcgtaaccaacgaagtccacacatggactgagcagtataaattccaagcggactctcccaagaggttagccacggcgatcgcaggagcctgggagaatggggtgtgtggaataagatccacaacgcgtatggagaatttactctggaagcaaatagcgaacgaacttaattatattttgtgggaaaataatataaaattgacagttgtagtaggtgacataatcggagttctagaacaagggaaacgaaccttaaccccacaacccatggaattaaaatatagttggaaaacttggggcaaggctaaaatagtaacagcagagacacaaaattcttctttcataattgatggacccaacacacccgaatgcccgagcgcatctagagcttggaacgtttgggaagttgaagattatggttttggcgtatttacaactaatatttggcttaagctaagagaagtatatacacaaagttgtgatcacagattgatgtctgcagcaatcaaagacgaaagagcggttcatgcagatatgggatattggatagaatctcagaaaaatggaagttggaaactggaaaaagccagctttatagaagtaaaaacgtgtacttggccaaagtcacataccttatggagtaatggagttctggaaagcgatatgataatacccaagtctctagctggaccaatatcacaacataatcataggcccggatatcatacgcaaacagcaggcccatggcaccttggtaaactcgagctcgactttaattactgcgaaggtacaactgtcgtaataactgaaaactgtggcaccagaggcccatctctaagaactaccacagttagcggtaagctaatacatgagtggtgctgccggtcatgtacccttccaccacttagatacatgggagaagacggatgttggtatgggatggaaattagaccaacaaacgagaaagaggaaaatatggttaaatccttggtatcagcgggaagtgggaaagtcgataatttcacaatgggagtactatgcttggcaatattatttgaagaggttatgaggggcaaattcgggaagaaacatatgatagcaggagtactgtttacatttgtactacttctttctgggcaaataacatggagagatatggctcacacgttgataatgatcggttcaaacgccagtgaccgaatgggcatgggagtgacttacttagcgttgatagccacttttaaaatacaaccatttctcgcattgggatttttcttaagaaagttgaccagtcgagaaaacttattactaggcgtagggctagcaatggcaacaaccttacaactaccggaagatattgaacaaatggcaaacggaattgcacttggtttaatgaccttaaaacttatcacacaatttgaaacatatcaactgtggacagcgctagtttcacttacgtgctccaatactatctttacactgacggtagcatggagaactgctacactcattttggccggtgtctcgcttttaccgctgtgtcagtcatcaagcatgcgaaaaacagattggctgccaatgacagttgccgccatgggtgtacccccattgcctctctttattttctcactaaaggatacaccaaaacgtcgctcttggccattaaatgaaggagtaatggctgtcggcttagtatcaatattagcgtccagtctgctaaggaacgatgtaccaatggcagggccgctagtagccggtggtttgttgatagcatgttatgtaataacaggaacttcagcagacctgactgttgaaaaagctgccgatgtcacatgggaagaagaagcggaacaaactggtgtcagtcataatttgatgatcacagtagacgatgatggaacaatgcgtataaaagatgatgagactgagaatatactaacagttctattaaaaacagcgttattaatagtttccgggatatttccatattctatacccgccacgttattagtgtggcatacgtggcagaaacaaacacaaagaagtggagttctatgggatgttccgtcacctccagaaacccaaaaagcggaactggaggaaggtgtctatcgtataaagcaacaaggaatcttcggtaaaacgcaagttggggttggcgtgcaaaaagagggagtgttccatacaatgtggcacgtcacaagaggtgccgtactaacacacaacgggaaacgtcttgaacctaattgggcgtctgttaagaaagaccttatatcgtatggaggtgggtggcgcctttcggcacaatggcaaaaaggtgaagaagttcaggtgattgcagtagaaccagggaaaaaccctaaaaactttcaaactatgccaggcatctttcaaaccaccacaggcgaaatcggagcaatagcattggattttaaaccaggcacaagtggtagcccaataattaacagggagggcaaggttgtggggctttatggaaacggtgtagtaactaaaaatggtgggtatgtatctggcatagcacaaactaatgctgaaccagatgggcccactcccgaattggaggaagaaatgttcaagaaacgaaatcttaccataatggatttacatccagggtcagggaaaactagaaaatatttaccggctatcgttcgcgaagcaattaagagaaggttacggaccttgattctggcacctacccgcgtggttgcagccgaaatggaagaagcattaaagggtttgccaataagatatcaaacgacagcaactaaaagtgagcatacaggaagagagattgtcgatcttatgtgtcatgcgacattcacaatgagactattgtccccagttagagtaccaaattataatctaataattatggatgaagctcactttactgacccggcaagtatcgcagctagagggtacatttccacacgtgtggggatgggagaagcagcagccatttttatgacagcaacccctcctggcaccgcggaagcatttcctcagtcaaatgctcccatccaagatgaagagagggatattccagaacgctcatggaatagtggaaacgagtggatcactgacttcgtaggcaaaacagtgtggtttgtcccctcaataaaagctggcaacgatattgctaattgccttcgaaagaatggcaagaaagttatccaattaagtcggaaaaccttcgacacagaataccagaaaactagactaaatgactgggattttgtagtaacgactgatatatccgagatgggagcaaattttaaggcggatagagttatagatccgcgacgctgtctgaaaccggtaatactcacagatggaccagaacgagtaatcttagctggaccaatgcctgtgaccgcggcatcagctgcgcaaagacgtgggcgtgtagggaggaatccgcaaaaagagaatgatcaatacattttcacgggacaacctctaaataatgacgaagatcatgcacactggacagaagcaaaaatgctgctcgataacattaacactccagaaggaattatccccgctttattcgaacctgaacgtgaaaagtctgcagcaatagacggcgaatatcgtttaaagggagaatctcgaaaaacgttcgtagaattgatgcggagaggcgatcttcccgtctggcttgcgcacaaagtagcatcagaaggtattaaatacactgacagaaaatggtgcttcgatggtgaacgtaataaccaaattctcgaagagaatatggacgttgaaatctggactaaagagggagagaggaaaaagttgcgaccccgatggttggacgcaaggacatattcagatcccttagccttgaaagagtttaaagacttcgcagccggtcgtaaatcaatagcgttagacctggtaacggaaataggacgggttccatcccatctcgcatataggacccgaaatgcgttagataatttagtaatgctacacacaagtgaacatggagggagggcataccgacatgcagtagaagagttgccggaaacaatggaaacactactactactgggattaatgatacttttaacaggcggtgcgatgctatttctaatatccggaaaggggataggtaaaacctcaataggcctgatctgtgtaatcgtaagctcaggtatgttatggatggcagacgttcctctacagtggattgcatctgctatcgtattagagttcttcatgatggttctactaatcccggagcctgagaagcagaggactccacaagataatcagttagcatatgtagtcatcggtatccttacactggctgctatagtcgcagcaaatgagatgggactactcgaaaccactaagagggatcttggtatgagcaaagaaccaggagttgtaagccccacaagctacttagacgtcgatctacatcccgcatcagcatggacattatacgctgttgcaacgacagtgatcacacccatgctccgacacacgattgaaaatagtactgcgaatgtaagtctagccgcaatcgcaaatcaggccgtggtcttaatgggtttagataaaggttggcccatatcgaaaatggacctaggggtgccattactcgctttaggctgctactcccaagtgaatccattaacacttaccgccgcagtgcttcttttggttacacactatgcgataataggaccgggtttgcaggctaaggctacgcgtgaagcacagaaaagaacggccgcaggaataatgaaaaaccctactgtagacggcattatgaccatcgacctagatcccgtcatatatgattcgaagtttgaaaaacaattaggacaggttatgttattagttctttgtgctgtacaattactgttaatgcgaaccagctgggctctttgtgaagcactaacactcgcaacaggacccattacgacactatgggaaggcagtccaggtaagttttggaatacgacaattgcagtaagcatggctaatatttttagaggctcatatctagctggtgctggattggcttttagtatcatgaaaagtgttggtactggtagacgtggaactgggagtcagggagagacgctgggggagaagtggaagaagaagctaaaccaactatcaaggaaagaatttgatctatacaagaaatccggaattacagaagtagatcgtactgaagctaaagagggattgaaaagaggtgaaacaacacatcatgcagtaagcagaggatcggcaaaattacaatggtttgtagagagaaacatggtgatccctgaaggaagggtaattgatttgggatgtggaagaggagggtggtcctactactgtgctggactaaagaaagtaacggaggtgagagggtatacaaaaggaggtccagggcatgaggaaccggttcctatgtcgacctatgggtggaacattgtcaaattaatgagtggaaaggatgtcttttatctccctcctgagaaatgtgatacattattatgcgatatcggggaatcttctccctcgcctacagtagaagagagtagaaccataagggttctaaagatggttgaaccctggctcaaaaacaaccagttctgcatcaaggtcttaaacccttacatgccaacagtcatcgaacatttagaaaggttacaaaggaagtatggaggaatgctcgtacgtaatcctctatctagaaatagcactcacgaaatgtattggatttcaaatggaacaggcaatatagtatcgagtgttaacatggtctcaagacttcttcttaataggttcaccatgacccatagacgccctaccatagaaaaagacgttgatttaggcgcgggcactaggcatgtcaatgctgagccagagacaccgaatatggacgtaataggagagagaattaaaagaataaaagaggaacatagtagtacatggcattatgacgatgaaaacccatataagacgtgggcgtatcatggatcctatgaggtaaaagctacgggatctgcaagttcgatgatcaatggtgtagttaagctgcttaccaagccttgggacgtagtacctatggttacacaaatggcgatgactgatacaacccctttcggacaacaaagagtatttaaggaaaaagtagatactcgaactccaaggccaatgccaggtactagaaaggtaatggaaataacagcggagtggctgtggcgaacactagggcgaaataagaaaccacgcctgtgtacaagagaagaatttacgaagaaggtgagaacaaatgcagcaatgggtgccgttttcacagaagaaaatcaatgggattctgctagagcggccgttgaagatgaagaattttggaagttagtagatagagaaagagagttacacaagctcggaaaatgtggaagctgcgtatacaatatgatgggtaaacgggagaagaaacttggagagttcggcaaagccaaaggatcacgagcgatatggtacatgtggttaggagcacgatatcttgagtttgaagcgctcgggtttttaaatgaagatcactggtttagtcgtgaaaacagttatagtggagtagagggtgagggtttacataaactaggatacattttaagagatatttcgaaaataccagggggagcaatgtatgcggacgacacagctggatgggacacacgtataacggaggacgatctacacaatgaagagaaaattactcagcaaatggatcctgaacatagacaactagcaaatgccattttcaaactaacgtatcagaataaggtggtaaaggtacagagacccactccaaaaggaactgttatggatataatcagccgaaaggatcaacgtggctctggacaagttggcacatacggattaaacacttttacaaacatggaggcacagctagtaagacaaatggaaggagaaggcgtcttatctaaagcagatcttgaaaaccctcacttattagagaagaaaataactcaatggttggaaacaaaaggagtggaaagattgaaaaggatggcaataagtggtgatgactgcgttgtcaaaccaatcgacgacaggtttgcaaatgcgcttctagcgctaaatgacatgggtaaagttagaaaagacattccgcaatggcaaccctcgaaaggatggcatgattggcagcaagttccgttttgctctcaccatttccatgaactaattatgaaggatggtcgaaaactcgtagttccatgcagaccccaagacgaattaattggtcgagcacgaatctcacagggtgcggggtggagtttgaaagagactgcgtgcttaggtaaagcatatgcacagatgtggtcgctaatgtactttcaccgtcgagatctaagattagcttcaaacgctatctgctcagctgtacctgtacattggataccaacgtcaagaacaacatggagcatacatgcacaccatcagtggatgacaacagaagatatgctcacggtatggaatcgtgtatggatcgaagataacccatggatggaagacaagactcctgtcacgacctgggaagatgtcccatacttaggaaaaagggaagatcaatggtgtggcagtttaattggactaacaagtagagcaacgtgggcgcaaaatatacttactgcaatccaacaagtaagatcgctaataggtgatgaagaatttttagactatatgccctcgatgaaacgatttaggaaagaagaagaactagaaggggcgatttggtaa

SEQ ID NO: 23465 - RNA, 9873 nt, synthetic construct
  misc_feature 1..9873: note = derived and/or modified CDS sequence (opt6) from DENV-3__EU482454__SS-prME
  source 1..9873: mol_type = other RNA
acgtcgttgtgtttaatgatgatgcttccggcaacgttagctttccacttaactagccgagacggggaaccaaggatgatcgttggcaaaaatgagcgcggtaaatctttactatttaaaacagccagtggaataaacatgtgtaccctcattgctatggatctaggggagatgtgtgatgacactgttacttacaaatgcccattaattgccgaagtagaaccggaagacatcgactgttggtgtaatttgacaagtacttgggtaacctacggaacctgtaatcaagctggtgaacacagacgtgacaaaagatctgtggccctggctccccacgttggtatgggtttagatactcgaacacaaacttggatgtccgccgaaggagcctggagacaagtagaaaaagtggagacgtgggctctcagacacccgggttttactatacttgcgttattcctagcccactatattggaacgtcactaacacagaaagttgttatattcatcttattaatgctcgtcaccccgtcgatgacaatgcgttgcgtcggagtcggaaatagggattttgtggaaggactgagtggtgctacatgggttgatgttgtcctggaacatggtggatgcgttacaaccatggcgaaaaataaaccgacgctcgatatagaattgcagaaaacagaagccacacaactggcaaccttaagaaaattgtgcatagaaggtaaaattaccaacataaccacagactcacgatgtccaacacaaggggaagcaacgttaccagaagaacaagaccaaaattacgtatgtaaacatacatatgtagatagagggtggggtaacggatgcgggttatttggaaaaggttccttagtaacgtgcgccaaatttcaatgcctagaacccattgagggaaaagttgtccagtacgagaatcttaaatacacggttattatcacggtacataccggagaccagcatcaggtcggtaacgacacacaaggagtaacagttgagattacaccacaagcatccaccgtggaggcggtacttccggaatacggaactctgggccttgagtgctcaccacgcacaggattagactttaacgaaatgatacttttaactatgaaaaataaagcatggatggtacaccgacaatggttctttgacttgcctcttccgtggacatcaggagcaactactgagacaccaacatggaatcgaaaagaactattagttactttcaaaaatgcccatgctaagaaacaagaagtagttgtactggggtcacaggaaggagcaatgcacaccgccttaacaggagctacagaaatacaaaattctggtggaacgtcaatatttgcaggccatttaaaatgcaggcttaaaatggacaaactagaattaaaaggaatgtcgtatgcgatgtgtctaaatacatttgtcctaaagaaagaagtaagcgaaacccaacatggaaccattcttataaaagtagagtacaaaggagaagatgcgccttgtaaaataccttttagtactgaagatggtcaagggaaagctcacaacggacgattaattactgcaaaccctgtggtcaccaagaaagaagaaccagtaaacatagaagcagagcccccgttcggcgaatcaaacattgttatagggattggagataaagcgttaaaaatcaattggtacaagaaaggttcctcaattggaaaaatgtttgaagccactgcaaaaggtgcgcgcaggatggctatcttgggggatacagcctgggactttggttcagtaggcggggtcttaaattctcttggaaagatggtacatcagattttcggtagcgcatatacagcattattttcaggggtatcatggataatgaaaattgggattggggtgctactaacgtggataggactaaatagcaaaaatacatctatgagtttttcatgcatagttatcggcatcataactttatatctgggggcagttgtgcaagcagatatgggctgtgtaattaattggaaaggtaaagaacttaaatgtggaagcggcatttttgtcacaaatgaagttcatacatggacagaacaatataaatttcaagccgattcgcctaaacgactggcaacagcaatagcaggagcttgggaaaatggagtatgcggaattagaagtacgacgcgaatggagaatctactatggaaacaaattgcaaatgagctaaactatattctctgggagaacaatattaaattgacagtggttgtaggtgatattattggtgttctggaacaaggcaaacgaaccctaacaccacagccgatggagttaaaatatagctggaaaacatggggcaaggcgaaaatagtaacggcagaaacgcaaaatagcagcttcataattgacggcccaaacacacccgaatgtccctcagcaagccgggcatggaatgtttgggaggtcgaagattacggttttggggtattcaccactaacatatggttaaagttacgtgaagtttatacacaaagttgtgatcacaggttaatgagtgcagcgataaaagatgaaagagcggtacatgcagacatgggttactggatagaatctcagaaaaacgggtcatggaaacttgaaaaagccagtttcatagaagtaaagacttgtacatggccaaaatcacacacactatggagcaatggagtattagaatctgatatgataattccgaaatctctcgcagggccaatatcccaacataaccaccgtccggggtatcatacacaaacagcgggtccttggcatctagggaaactcgagctagacttcaactattgtgaaggtactactgtagtgatcactgaaaactgtggtacaaggggacctagtcttagaacaaccactgtttcgggaaaattaatccatgaatggtgttgtaggagttgtacattgccaccgcttcgatatatgggagaagacggatgctggtatggtatggaaatacgccctatcaatgagaaagaggaaaacatggttaagagtttagtatcagctggatctggaaaagttgacaatttcacgatgggagtcctttgtctagcaatactgttcgaagaagtgatgcgaggtaaattcgggaagaaacacatgatagcaggggttttgtttacttttgtactcttactatcgggccaaatcacctggcgcgacatggcccacacattaattatgataggaagcaacgcatcggaccgaatgggtatgggagtcacttatttggctttaatcgccacttttaaaattcaaccgttccttgccctagggttctttctaaggaaactcaccagtagagagaacttactacttggagtcggcttagctatggccacaacattacaactgcctgaagatatagagcaaatggcaaacggaatcgcactcggattaatgactctgaagctgataacacaatttgagacctatcaactttggacagctctagtttcgctgacgtgtagcaatactatttttacactaacagtagcgtggcgaacagcaactctcattttagccggtgtcagcctacttcccttatgccagtcttcaagtatgagaaaaactgactggctaccgatgacggtcgcggcaatgggtgttccaccattacctctatttatattctctttaaaagacaccccaaaacgccgctcatggcctttgaacgaaggagtgatggcagtaggcttagtctctatacttgctagtagcctcctaagaaatgacgtgccaatggctggaccgttagtagctggtggactactgatagcatgctacgtaattactggaacctcggcagacttaactgttgaaaaagcggcggatgtgacctgggttgaagaggcagaacaaaccggtgtgtcacacaatctaatgataactgtggacgacgatggaacgatgaggattaaggatgatgaaaccgagaatatcttgacagtattactgaaaaccgcattgttgatcgtctctggaatatttccatattcaatcccagcaacgttattagtgtggcatacctggcaaaaacaaacgcagcgcagcggtgtactatgggacgtcccatcaccacctgaaactcaaaaagcagagttggaagaaggcgtataccgtataaaacaacaaggaatatttggtaaaacgcaggttggagtaggcgtacaaagagaaggcgtatttcatacaatgtggcacgtaacaagaggggcagtattgacacacaacggcaaaagactagaacccaattgggcatcagttaaaaaggatctaatatcatatggaggaggatggagactctccgcacaatggcagaaaggggaagaagtacaggtaatagcagtggagcccggcaaaaatcccaaaaattttcagaccatgcctggaactttccaaacaacaaccggcgagattggagctatagcacttgatttcaagcccggcacgagtggatctcccataataaatagagaagggaaagtcgtcggactatacggtaatggcgttgtaaccaaaaacggaggttacgtatcaggcatagcccaaacaaacgccgaaccagatggtccaacaccagagcttgaagaagaaatgttcaagaaacgaaatctaacaattatggacctacacccaggcagtggaaagacaagaaagtacctacctgctatagtaagggaagcaataaaaaggagattaaggacactaatattagcgcctacaagggtggtcgcagctgaaatggaggaagcactaaagggactccctattaggtaccaaactacagcaaccaagtccgagcatacgggccgcgaaattgtagatctaatgtgccacgccacattcacaatgcgcctccttagcccggttcgcgtaccgaattataacttgattattatggacgaagctcattttacggacccagctagcatagcagcacgcggttatattagtacaagagtggggatgggagaggcggctgcaatcttcatgacagcgacacctccagggacagctgaagccttcccacagagtaatgccccgattcaagatgaagaacgcgatattcctgaacgttcatggaactctggaaatgaatggattacagatttcgttgggaaaactgtatggtttgtaccaagtattaaagccggaaacgatatcgcaaactgtttaagaaagaacggcaaaaaggtcatacagctctctagaaaaacttttgatacagaatatcagaaaacaagactaaacgattgggatttcgtggtaacaacagatataagtgagatgggggcaaattttaaagcggatagagtgattgaccctcgacgctgtctaaaaccggtcattcttacggatggccctgagcgtgtgattctagccggccctatgcctgtaacggctgcaagcgcagcccaacgaagaggaagggttggtagaaatccacaaaaagaaaatgatcaatatatattcacaggccaaccattaaataacgacgaagatcacgctcactggactgaggcaaaaatgcttttggacaatataaacactccagaaggaattataccagccttatttgaaccagagcgagaaaagtctgccgcaatcgacggagaatatagactaaaaggcgaatcgagaaaaacgtttgtggaattgatgcgtcgaggcgatttaccagtatggctagcccacaaggtagcatccgaaggaataaaatatactgacaggaaatggtgcttcgacggagagcgcaataatcaaattcttgaagaaaacatggacgtagaaatatggactaaggaaggagaacgcaaaaagttaagaccaagatggctcgacgcacgaacatatagtgatccactggctctcaaagaatttaaggatttcgcagcggggcgcaaatctatagcgctggatttggtcactgaaataggtcgtgttccatcacatctagcccatagaacgcggaatgctttagacaacctagtaatgttacacaaaagtgaacacggtgggcgagcgtaccggcatgccgttgaagaactcccagagaccatggagacattactgctattaggccttatgatactcttaaccggaggtgcaatgttatttttgatatcaggaaaaggaataggaaaaacaagcatgggcctgatttgcgtcatcgtgtcttcaggcatgctttggatggcagatgtaccattacaatggatagcatcagcaatagtattagagttctttatgatggtactactaataccagaaccagaaaagcaaagaactccccaggacaaccagctagcttatgttgtaataggcattctgacattagcagcgatagtggctgcaaacgaaatgggcttactcgagacaactaaaagagatttgggaatgtccaaagagccaggcgttgttagccccacttcatacctcgatgttgatctacacccagccagtgcctggactctatatgctgtagcgacaactgtaataacacccatgttacgacatacgatagaaaattcgactgcaaacgtaagtttagcagccattgcaaaccaggcagtagtgcttatgggattagataaaggttggccgattagtaaaatggacttaggtgtgcccctattagctctgggctgttacagtcaagttaatcccctaaccttgaccgcagcagtattattacttgtcactcactatgcgataataggcccgggcctacaagcgaaagcaacacgagaggcacagaagcgcactgctgcaggcataatgaaaaatccaacagtagatggaattatgacaattgatttagaccccgtaatatatgatagtaaatttgaaaaacaattaggacaagttatgctgctcgtcctatgtgccgtgcagttactattaatgaggacttcttgggctttatgtgaggctttaacattagcaactggtcccataacaacgctatgggaaggctctccaggtaaattttggaatactactattgcggtctcaatggcaaacatattcaggggctcttacctcgcgggagctgggctagcattctctattatgaaatcagtcggcactggtaggcgaggaacaggatcacaaggagaaaccttaggtgagaaatggaaaaagaaattgaatcaactaagtagaaaagaatttgatttgtataaaaagtctggaatcacggaagtagaccgcacagaagccaaagaaggcctaaagagaggagagacaacacatcatgccgtgtctcgtggttccgcaaagctgcaatggtttgtcgaacgtaatatggtaatacccgaaggtagagtaatagacttaggatgcggtcgaggagggtggagttattattgcgccggactaaagaaagtaaccgaggttcgtgggtatactaagggcgggccaggacacgaagaaccagtgccaatgtcgacctatgggtggaacatagtaaaactaatgtcaggcaaagatgtgttttatttgcccccagaaaaatgtgacacgctactgtgcgatattggtgaaagttcaccgagcccgaccgtggaggaatcccgcacgataagagtcctcaaaatggtggaaccatggctcaagaacaaccaattttgtataaaagtgttaaatccttacatgccgacagttattgagcatctagaaagacttcagcgtaagtatggcggtatgttggtccgaaaccccttatctagaaactcaacccatgaaatgtattggatctcgaatggtactggaaacatagtctcaagcgttaatatggtctcaagactgctgctgaataggttcacgatgacacacagaagaccaacaatagagaaggacgttgatctgggtgcgggaactaggcacgtaaatgcagaaccagaaactccgaatatggatgtgattggcgaacgaattaaaaggataaaagaagaacattcttcgacatggcactatgatgacgaaaacccctataagacatgggcttatcatgggtcgtacgaagtaaaagccactggttcagcatcatcaatgataaatggcgttgtcaaactcttgaccaaaccttgggatgttgttccaatggttacccaaatggcaatgacagatacaactccgtttggacaacagagggtatttaaggaaaaggtagatacacgaactccgcgaccaatgccgggcactagaaaagtaatggagattacagctgagtggctatggagaactctcggacgaaacaagaaaccgagactttgtacaagagaggagttcactaaaaaggtacgtacgaatgccgcaatgggggctgtatttacagaagaaaatcaatgggattcagcaagagcggcagtagaggatgaagaattttggaaactggtagacagggagagggaattacacaaactcgggaaatgcggttcttgtgtatacaatatgatgggtaagcgggagaaaaagctaggtgaatttggaaaggcaaaaggttctagagctatatggtatatgtggttaggagcgcgataccttgaatttgaggcacttgggtttcttaacgaagaccactggttctctagggaaaattcttactcaggagttgaaggcgaaggattgcacaaattaggctacatactgagggatatatctaagataccaggaggggcgatgtacgcagacgacacagcgggctgggataccagaataaccgaagatgacttacataacgaagagaaaattacacaacagatggaccctgagcatagacaattagctaatgcgatctttaaactcacttaccaaaacaaagtagtaaaagtgcaacgacctacgcccaaaggcacagttatggatattatctcaagaaaagatcaacgagggagtgggcaagtgggaacgtacggactcaatacgttcaccaacatggaggctcagttagtccgtcaaatggaaggcgagggggtattgagtaaggctgatctggagaatccacatttgctagaaaaacggatcacacagtggttggaaacaaaaggagtcgagagactaaaaagaatggcgatctccggcgatgactgtgtggtaaagccaattgatgacagatttgcaaatgccctactcgcgttgaacgatatgggaaaagtaaggaaagatataccacaatggcagccatcaaaaggatggcacgattggcagcaagttcctttttgctcacatcattttcatgaattaattatgaaagatggtcgaaagttagtagttccgtgtagacctcaagacgaattaataggcagggcacgtatcagtcagggagccggatggtcgctaaaggaaacggcatgtttaggtaaagcatatgcccaaatgtggtccctaatgtattttcacagacgagacttacggttagcgagtaatgcaatatgcagtgctgtccctgcacattggattccgacttcacggacgacttggagtatccatgcacatcatcaatggatgaccactgaggatatgctcaccgtgtggaaccgcgtctggatagaagacaacccctggatggaggacaaaacccctgtaactacatgggaggacgtaccatatctcgggaaacgtgaagatcaatggtgtggtagcttaataggacttacgtctagggctacgtgggcgcaaaatatcctaaccgcaatacaacaggtaaggtcattaattggagacgaagaatttttagattacatgccatcaatgaaacgttttagaaaagaagaagagtcagaaggcgccatctggtga
